United States Patent 7,745,391 (HUMAN THROMBOSPONDIN POLYPEPTIDE) - sequence listing, part 204

SEQ ID NO: 485838 - DNA, 696 bp, Homo sapiens
  misc_feature (448)..(448): n is a, c, g, or t
  misc_feature (579)..(579): n is a, c, g, or t
  misc_feature (581)..(582): n is a, c, g, or t
  misc_feature (585)..(585): n is a, c, g, or t
  misc_feature (596)..(596): n is a, c, g, or t
  misc_feature (606)..(606): n is a, c, g, or t
  misc_feature (615)..(616): n is a, c, g, or t
  misc_feature (619)..(619): n is a, c, g, or t
  misc_feature (649)..(649): n is a, c, g, or t
  misc_feature (656)..(656): n is a, c, g, or t
ggccggctggggccctgggtacgctgtagaccagaccgcgacaggccagaacacgggcggcggcttcgggccgggagacccgcgcagccctcggggcatctcagtgcctcactccccaccccctcccccgggtcgggggaggcggcgcgtccggcggagggttgaggggagcggggcaggcctggagcgccatgagcagcccggatgcgggatacgccagtgacgaccagagccagacccagagcgcgctgcccgcggtgatggccgggctgggcccctgcccctgggccgagtcgctgagccccatcggggacatgaaggtgaagggcgaggcgccggcgaacagcggagcaccggccggggccgcgggccgagccaagggcgagtcccgtatccggcggccgatgaacgctttcatggtgtgggctaaggacgagcgcaagcggtnggcgcagcagaatccagacctgcacaacgccgagttgagcaagatgctgggccaagtcgtggaaggcgctgacgctgggcggagaaagcgggcccttcgtggaggaggcagagcggttgcgcgtgcagcantnntgngggaccacccnaattacaagntaccggccnnggngggcgcaagcaggtgaagcgggttgaagcnggttggnaggggcggatttccttggcacgggcttggttgagcccgag

SEQ ID NO: 485839 - DNA, 192 bp, Homo sapiens
catacaacttgtcaagaaaatgacaattcccacctctacagcgtggtgcatgctgcttctgaaacatgctccttgttcttctccattagtagcgcacctgcacgctccttgaagactcacctcaaaacgccagactgaccagaccaaccccgacagtgcaaattaattgctgcgcccagagcagtatgagca

SEQ ID NO: 485840 - DNA, 134 bp, Homo sapiens
actgggtactatgagacttcagttccaggtggaaacggattggacgggctgactcttagattatactttcaccaggcgtgaaaagttcttcactatcactactatttgtgccttttcccttctttatttggttt

SEQ ID NO: 485841 - DNA, 378 bp, Homo sapiens
  misc_feature (154)..(154): n is a, c, g, or t
  misc_feature (229)..(229): n is a, c, g, or t
  misc_feature (278)..(278): n is a, c, g, or t
  misc_feature (351)..(351): n is a, c, g, or t
  misc_feature (361)..(361): n is a, c, g, or t
taactacatttgtaaccaattacttttttaactttttgccagttctgcttctgtaaaaattgcttcagctaaaatcccccctcgcctatttagaccacagtatagaaacaaaactagccccttcctcaggggccgagagaatttttagcgttantggcctctcggtcgccagctaataaaggactctttaatttgtctcaaagtgtggcgtttctctgtaactcgcttngtcacaacactgtaggtcatcatcaatgactattcggcagctccacagncacccacagcggtggctttcaccccagccctgggttccaagtgctcctatggacagccgaggcaatcggtttnccaaatgctnggcttacgtttcacagt

SEQ ID NO: 485842 - DNA, 103 bp, Homo sapiens
  misc_feature (52)..(52): n is a, c, g, or t
ttggagcatgaggaggaaatgaggagagatgaagtacggacgatgagactcntgaacaaatgagttgctcgacgaggaagaagacattgaccctttttatgcg

SEQ ID NO: 485843 - DNA, 137 bp, Homo sapiens
aaaaaaaaaaaaaaaaaggtgggggttttgggggaaaccccttctttttgggtttggggggggaaaaaaaaggggaaatttcctggtttcttttttggggggttttttttttccaaaaaaggggcccctttccccta

SEQ ID NO: 485844 - DNA, 1128 bp, Homo sapiens
  misc_feature (435)..(435): n is a, c, g, or t
gtatatttgaagtaactgtcaggctattatatcttaaaagttgtggaacatgtaccatgtacgtgtcattactagtatttcaatgcttcagtgctatgatgcatccaggtcatgttcaattctagtaatagaagaagtgatgttgattcatgttgtagagggctcgttgcattatagaacttttatcatatcttatatgcactacaatttgggatacatgatatagactataattctaatttctgaattcacccgtgttaagttaccattggtcagggatatttgccttgaactacgcgctaatcttcgatctagaagcaacgaacttctttggggtatgacagcggtggggtgcggcggcagtgagggggctaggaacagagcagtctctaatattaatgagtatgaaaatacattcaatcgcttttgatttanataaatactaagaaacgccaattggatgttgcgcatatggggggccgggtgtattggatcatgggcataatactgatttacgtcacgtactcttgtggtcattttaaaagggggttcataggaatagtttcgcttatcaagagagggtttcagtgcgagacacatcgagataccatcttcatatccaaggaaacattgtaccataactgtacaggtctacctattctccgtatctacgagtcaggacaactttcattaagggagtaataagcagtcaatagattacgcctcaattggattcttgggcattgagtattctctgaactctttccattttttcacaaaatctgcgccatacccaggtttaaagttacgcctgggggtcacaagcacggccatgtaggttactgttcaccaggttgtctgcaggtaccttagcatcgtgtgactcctgcaattattcaatacccctgtatcggacacaccaaagtccctttgtgcttacaaggcctcgaatatttgggggctagggatgggaccactaagttccggcaagcatctcacttttagaggctttcccgtcttcgtcgccatttatcggaggaacagccggaattggtgtcgaaaaacacgttgaaccgagatcgctgggttacaggattctccacagtggcatctcacctgtgggcacct

SEQ ID NO: 485845 - DNA, 301 bp, Homo sapiens
aaaacaagaaatttattaaatatacaaaacaggaatacagttcaattactgagtctaaaaaatttcatttttacatgaccaagacattttttacaactgtttacaaaagactcccacctgtgcataacctttggaccatgtgcgctatctttcatatctgcaagagaaacctaaagtgttaatatttgactgttaagtattgacatcttttagcgtggggtgtgaaatgcacaagtacccctgaatggctcaaagggatgggataatgctaaaaacactaacttgcgataaagtgcagttt

SEQ ID NO: 485846 - DNA, 451 bp, Homo sapiens
  misc_feature (262)..(262): n is a, c, g, or t
  misc_feature (299)..(299): n is a, c, g, or t
  misc_feature (302)..(302): n is a, c, g, or t
tcgggctttagcttccacagattcaaggaccaggagttgagaggaagcagcctcctgtccaggacccagttccgggcctgcccaaccctaggaatagatgctgtgatttcttctttgagcctctgcaactcctcaagcctgacttagagcatcctcaagtcacaagagagaaacaaaggacggaaagacgcaaaggacgcttgctggctttctcttttaaacgcctggctgaccacatccccgactctgggctgagccaggnccgaggctggccccagcgctgccggagcgggaggcanganttacgccttgcatcttgcctgatgacagacctcagacaatttctggggcagaggaaaagagcataataagcttaatttcagcattgtaaaggttattattataatcatttccctctgaagaattgtaaataattcatttgcaaaactct

SEQ ID NO: 485847 - DNA, 302 bp, Homo sapiens
actcctaaaataatttaataaatgattaacattgaatacagaatatgctgtgcacttacatttattcttatatgataaccatgtgcgtgctattctaatcaaagaaactagataaacaagtataatacagttggataaaaagatatatatatggaatctttctaataaatgcataaaagttataccaaaaaagtcataaataattaactttagaagagggttttgttatatacaaaaacaatgaaagagaaattttacttctcattttattattggcttttctgttttatttttggaaacat

SEQ ID NO: 485848 - DNA, 932 bp, Homo sapiens
cacgcgtcgcgaggaccaggctgccgtggctgctggatgcggaccttcgtgggcgccgggctgagtggggtgcatccgtttgctggacgtctacaatgcagcgcctggagcttggctttgggccggtggctgccacccgaggctctggctgtgggctgagtgctgtgggaccaaccaccgtgctctgcccgatagcccatgccatgtgcggggtgtccccatgccatgaacctggaggctggaatgtgttccatttgctcatgatgctcctgctcctggtcgcgtcggaccaacctgtgccgaatgagaagagcccctgccagcccaacccctgccatggggcggcgccctgccgtgtgctgcccgagggtggtgctcagtgcgagtgccccctggggcgtgagggcaccttctgccagacagcctcggggcaggacggctctgggcccttcctggctgacttcaacggcttctcccacctggagctgagaggcctgcacacctttgcacgggacctgggggagaagatggcgctggaggtcgtgttcctggcacgaggccccagcggcctcctgctctacaacgggcagaagacggacggcaagggggacttcgtgtcgctggccactgcggtgacctgcggctggagtttccgctacgacctgggccagggggcagcggtcatcaggagcagggacgccagtcaccctgggagcctggaccaggctctcactggaggcgaaacggcgcatggtgcctgcgtgttggccgagggccccgtgtgtgggggagtcccggttccgcacaccgtcctaaacctgaagggagccgtctacgtagggggcgctccgaccctcgcagctggccgtgctgttgccgtgtctctgggttcgacggtgccaaccatggtggacgtcgtccttggaggtacc

SEQ ID NO: 485849 - DNA, 162 bp, Homo sapiens
tgctcggtaccgattacgctcctagacggtgggtaaaagtagctgaaaaacatgtgcagggcctggcacagtggctcatgtctgtaatcccagcactttgggagtgccaaggctggtggatcacctgagtgtcagtgagttctgagaccagcctgtcttggg

SEQ ID NO: 485850 - DNA, 1054 bp, Homo sapiens
gcaaaatcttccttattctgaaaagatgacagttttgttagtctacaatggccctcatatgctggaaccaaacacatggaatttaaaggctttccaaaggcggcggcgccgtattacattcactcaacccttcattaatcaacacagtcacacagcagcagggcacacttgcggcaatttttattgtccaacaattcatcgtttcatcacagtcataggctccaactgcacatcaccacaggcagcattcactcagaacacgcacacacagcagttatttttggcacaacctgcttttacaatcacaaatcagcgttgcatcacatggcaaccctataatgaccattatccaaaatagacagctgggtagtacaagttaacgtcattctatcagatacttaggttgacacttggacgttcattgagacacctctgaccactgagtcattcagttctcatgttaaaatggtacttaactattacaaatcaaaggtacagtggaagaagggttaatcacaagaagttacttatatggtagccctgagcttagaattgcagagtaacttataaataaacattaatagagcactaaagatgactctagaagcctaagtcgctaagattatctacacaagtgttatatataagtatttaaaaaattgatatgaaaatgtctaagtgtatagtaagtaagttgatgaacagatcatagatcatgagatatacatactgacaaaaaggattaccatatcatctcccagaacagacacacgcacaatcaaatgacgaccaagaacaagacaagtaaaacgcaaagcattgaatgcatagtacaacaacaaagagacactatacacagggaggaaaacacacaagcacacaagagaggcatacaacaaacaagccacagcacacaccacggcaacagcacacagacctgcacaaagacatggcacacaacaccacaggcacacaaccaaaacccaaaccacaacagaattgcaacagcagaacacaaacaaaaagacgacaaaacagcgaagaacagcacact

SEQ ID NO: 485851 - DNA, 238 bp, Homo sapiens
agttgatggagaacctgtgaagatgtgataaactgacacttgctctatagagcgaggtactcacaaggcgagttggggaatatgcatagctcgagacagagctgagctttcgcggaatagctctagcgcgcccgctctatatggtgagttgtgacccacatagagtccacgggcaaggtgaatgggatacattgttcgaatggcaaggtcccagtgtcgcggacttgcgattcggtcg

SEQ ID NO: 485852 - DNA, 1017 bp, Homo sapiens
agcggctgtgtgagccgtagccttaccaagggaagtggttgtgtgatcgccatcttacggaacagatgttctgcgtactctgtggcgcactcgtggcagcgggcgaaccctcttcagacatcgccgagcatctgtcatgtctggttgcagctgagtagagtacctctgtgggatcctccgactagtagttcaccctaggggccctctacaggtgcacagccgccgacggaccgtcgacaacgctgtgcagctcggcctgcacgtgggaagcagttacaggttgatgagattgtggcctccggcgcaaggtacttaatgcactgatgtgcggactgttggtggggtcttaagcttgtggtcatgactacacacttgctgtggttcccctgagatcttaggtgaaatgccgtatgcaggtggacccgcgcaataacgctacaatggcagtatgttaacggagttcatcaagttactcattcaaacggagggactgagtgttcagtgcgtttgtgcgcgtacaaggtgatagggctcctgacttctctcgttggcttacctcgcagtgctagggtgacatcatgcaaggtatctggctatggtatgaagctccttctaataagatctgtgtactaagcaagtatgcttggcagagggatgacactaccttatgcgtctggcgcacatcactatatgatgagctgcgctctgcgcagtggctgaattctttcgctgacattgccctggctcctatgcgaagcgtgtaaggttcgaattcaatacccagtccaggttactgccaaccacttttgagggatgtggcctcccacagatgtatagggcacgaagggcgtagagagcatgtctacaaggggggtttgctcctctctggaatgacgagaaaataccaataaacgcctgtatgaacttcggcatgcttttgaacgtacctgtttgaaggcactggtaaaagttagcaggattcgtaagccgcggcatggaatgttcaaggcatagcac

SEQ ID NO: 485853 - DNA, 902 bp, Homo sapiens
  misc_feature (11)..(11): n is a, c, g, or t
  misc_feature (24)..(24): n is a, c, g, or t
  misc_feature (45)..(45): n is a, c, g, or t
  misc_feature (54)..(55): n is a, c, g, or t
  misc_feature (81)..(81): n is a, c, g, or t
  misc_feature (137)..(137): n is a, c, g, or t
  misc_feature (169)..(171): n is a, c, g, or t
  misc_feature (189)..(189): n is a, c, g, or t
  misc_feature (301)..(301): n is a, c, g, or t
  misc_feature (522)..(522): n is a, c, g, or t
  misc_feature (555)..(555): n is a, c, g, or t
  misc_feature (611)..(611): n is a, c, g, or t
  misc_feature (729)..(729): n is a, c, g, or t
  misc_feature (806)..(806): n is a, c, g, or t
  misc_feature (852)..(852): n is a, c, g, or t
tatgtttgttnatatttaagtatnaggatgtagagagggaaaggnaagagaggnnagtcaaacgttagtatgtaaaaggangaaatattaagaaaatgagaacgaataaataaaaagagcagagaaggaggagaaanaagaagaagggagacagtaaaaaaagaaaagnnnaaaggagaagaagaaganacagacggagagaaacggaaaaaagaaaacatcagccccactctatcagaactcaacacgaatcatcaccaagtggacaaataaagacaacccacttcggctcctgccaggnttctcgccctttacctctgcaccacccgctcctccaggttccgctggttccccctgtcccctgctcccctctatccctcgcctcacgcgcttccctctctctctccacacgctcccgctccccctatcgtcatcctctcgccccgccccctttctccatctccttttcccttcgccctctacttgacccaactcaccatctactcaaccactatacaatcnagttcctactctcttcttgcttttcttacttcntcggacgagctctcgccgttatgtccgttagtgtagcgtgcgattggtgtcttatncccttgtacgtaactatatcaatcattccctcatctacctccctccccccccctcccccccctcctccccagacccccacgtccttccatgtttatgacacatcttttttacattgcnaacaactaatcccgcccctcccagccaccccctccccgccctctaccgcccacccagactcgccagccagtgagccnaccgacccggtcgtcttgcccgtgccgtgcctccttgtacccaccncaccacctccccgcgcctccctgtcccacctctttcttcttcatctaatt

SEQ ID NO: 485854 - DNA, 296 bp, Homo sapiens
aggatgtgatgcatgtaggctgagatcttgccattgccttggggacagaggaagactctgtctcaaaaacaaaaatcaaacctcttaccacttaaggtgaagcatacccatcacatatttaggccaggaacagaggggtaaaaaagtcctacagccactgatggcccccaggtccctgcccactagaccacaggacagtatggttgtccaccccatcaattaccccgactcagatactcaatatattccacctgctcatcatttgtcattgcactccaagggagttcatctaaatt

SEQ ID NO: 485855 - DNA, 377 bp, Homo sapiens
  misc_feature (22)..(22): n is a, c, g, or t
  misc_feature (45)..(45): n is a, c, g, or t
  misc_feature (118)..(118): n is a, c, g, or t
  misc_feature (121)..(121): n is a, c, g, or t
cttcatagtatcactggtctgngtatttcagtgtgtttttgtagnggctggtaatagtttctcctttccatatttagtgcttccatatttaggagctcttgcaaagcaggcttgaggnggngatgaattccctcagcatttgcttgtctgaaaaagaccttatttctcctttgcttatgaagcctagtttggccagatatgaaattctgggttggaaattattttctttaagaatgttaaatattggcccccaatctcttctggcttgtagggtttccactgagagtttcagttagtctgatgggcgtttctttgtagatgacctgtatgcccctttttaatcttcacattagtactgacaatgggtggcttccagg

SEQ ID NO: 485856 - DNA, 905 bp, Homo sapiens
gagaggacgactgcagacttcggttgaggaaacgggtatttcatgtctcacggacgtaggttcgtgcagtccacagcttttctgttggtatgcagtaattaataattggagctggaaaggcagatcgtgtacattacacgagatggacggtcagaagaaccttgtggcaaggacaaggttgttagaacttcctgatactggcatgtagacatttaatgcaaccactggtcgtgtgctgttatggtgccagactctattgcctgctgctttcattgtacagtattcaggcattgtgagcgtctcagtctacatcgtccttggccctggtctcggtgaccatcagctttaggatatacaagggtgtgatccttagagctatccgagaaatcagatgagggtccgacccattcagggcatatcttggaatcgtgaagttgttatagtcgtagaggagttggttcagaagtacgagtcaattctgttcttggtcatgtgaaactgacgataaaggaagtcaggcgccccattcttagtagattgatggaggtggattctctgaagtttgcagtgttgatgtgggtatttacctatgttggtgctggtttaatggttttgagtcatgatgtgggctctcatttaaattctgcaagggtccgtgttatttattgaaccggagttatggcctgatagatcgattatctaggactttgcaccttagatgttacagatggtgtggtaaaatccaagctaaattcctggttgagaggtaaggtgattgtaaagccaatagtgagggggagcatttcaggggaatcctaggacaacggggaggggaggaaaaaaacttgtggaaaggtaaagctgagaaaatggcgcgctgtggggaaaacaggggcggggataaa

SEQ ID NO: 485857 - DNA, 1072 bp, Homo sapiens
  misc_feature (1072)..(1072): n is a, c, g, or t
gcacaaatgaaagaagctggggatggcagctaccactgctactgtactggcgaccgctctatagccaaggaaggcttcgagaagattagcaacaggtgctaatccaggaggaaatcaggagaggtgtgatgttagctgttggaatgctgtaattgctgaacttaaaaagcagtctaaacctgtgcaccacccctgaacgagattgcacagcgttgctacaatatctgctaaacggaagacaaacgacattgtgctaaatatcaatctctgcatgcatagtgagaccacatgttggaacgaaagggtgtcatcaccgctaaaggatggcagaacaccccctgccactgcctcgaattcacgacagtgattgatcggcactgaagtttgactcgacagagtacttttaactccaatacaccttcctcactaccctcaagaaggtcagcaagcatgatccattcctgggaatcacatatgtccctgattgacctgaacccagcaagcagcatataggaatcaaggcacaaactgaaccagactgcacagaaaatgcgccaccgcagcaccggaagacctaaggacagagagatagaaaaagtatgcgcaccggacgacaacactgtccaacccaaccacgacacacggagctaggtataaggtccgagacacaaggggcgaggcaacctagaagaccacaagggcgaggagaaacaacaaagacgacacagccatacaagatgaactacgcacacggaggagcgaacacacacaggaaagaaggaagcgacacagcaataagtaaaaaacaaaagggaaaaagcgaacaaagaagagaagcgaaacagaccagaagaaagaacaggaacaaaagaacaagacaaaggagcgcgaacaaaagagaagaaaagacagaaaagaggagcacagaagagacagagaaaaaaagagaagtacaagaagaagagaaacaagggaaagaaaaaaaacgaggaaacaaggacacagcacaaagacctacgaacgacgacaacacaacacgaagcaagaaaacaaacaaagaaaaaccataagn

SEQ ID NO: 485858 - DNA, 258 bp, Homo sapiens
accgttgactattctctccacaacttccagacctggaagcactatacctattattcgtgcgcatgagctggagtcctaggcacagatctaagcctccttatattcgagccgagctgggacagacaggcaaccttctaggtaacgaccacatctacaacgttactcgtacacaagccatgcaataggggatacaacaactttttttttaataaccaaacataactcgcgaagaaaatgggaaaacagactaagacccca

SEQ ID NO: 485859 - DNA, 238 bp, Homo sapiens
ctgcggtctgctctcgcggctccctgacgctggctggtttgccccagcgggctgctggacgcagcggcagtcggctgggccacccactccatctcaggtccctgctggcagggccagcagctgcctgcgcactgcccccgccactggtgcctgcctccccacggcccatcttcgcagggtcacgcgctcgcattcgtcctcctggtcctcgctgtttcccaccccccatgaaacacaa

SEQ ID NO: 485860 - DNA, 785 bp, Homo sapiens
aggcttgaattctcttctgtcagtagctaccgaacaatcacagaaggaaatataaaactgtgtattcgaaggccactgactctgtgacttccgttgtctggccttcatgaagccaggcggtcaaatgggacacacagaaactcgaatcattgagtccttcctccttgggccgtagaggccccggagaacattggtatcccacactaacgaggaaaaattcatgcaggttgctgtagttgatctgggtggtacttatgcaacggggttcccgttccgtgacacattccatctgaaactcgattcgacataatgtgttgactatatctgtcatgctattttgtgccttcgaatgagtagtataattgaaagacaaaaaattcacaaacatgatgagaattgacaatcacagatacacacgataagaaatcaaaggtggtgtgagctctccctgaatcattcaccctatctcaggaggacgggatgctaagcagctgcaccttgttggtggttaaaagtgggcgacgcactaagcgtccggctgcatgtttccaggccaggccatgaacactcctgttgtccacatagagctgacgtgagaaatatctttcagcccaggagagaggggtcctgatcttgaggccgtttcctgggtctcagacaactcagaaggtagtggggatcccagagaggtggtggaatacgaccggccctccttacttgaggcgatcaatgctgtaatggtggagagttgggcgacgacggagcagttgtcaagaaattgaagg

SEQ ID NO: 485861 - DNA, 175 bp, Homo sapiens
tgtgcacactggctcgactcccagctcaagcaagccttctacctcagtgtcctaagtagcggattacaggcatgtgccaccacacccagctcttttttaattttttttgcagagacagagtcttgctatgttgtctagtctggtctcgaactcctgggctcaagtgatctggctg

SEQ ID NO: 485862 - DNA, 119 bp, Homo sapiens
gcttgttgtagaacgaagtagttgaaggaccagaggctaccatcctccccgaagggatctgagtccaagtctgggttatagctggagatgttagagttcgagccagggctgatctcgct

SEQ ID NO: 485863 - DNA, 929 bp, Homo sapiens
tggagaggagtctcgctctggtcgcccaggcttgagtggcagtgggcgcgatctcggtttcattggcaagctcggtctcctggggttcatggccattctcctgcttcagcctcccgagtagtcccaggagtagctggggactacaggggtgcccaccaccacacccagcttaatcttttgtggtattttatagtagaacagtggggttctcaccagtgttatactccaggagtggtttggactctccgtgacctcggtgaatccgcccgcctgggcctcccaaaagtgtgcggggaatatatagggcggtaagccacgcgccgcgggcaaatttcgggtatttttcagatagaaagtggggtacacaccggtgttgggccaggaaggggtcctcaactcgtgaaccctgggtgaactcgtgcccaccctcggcccttccccacaagtgtggcatagcgaaatataccgtggggcgtgtgaagccccacgcaactctcctatagccgctatacagtggcactaacttcttctacagatatatctaccacagaggcttagacattgtgggtcagtgcacacacatgcgcctctgaggggcggtcctctataaatgataaccctataacctttttatacacgcaaacgtgtacgcacaccacgtgcgctgtgggcgcctctctaaagcgggcagttttccagcccgtacgtgggaccatcttccacaggcactgtggaaacccacaactttccacaaaaagtggtgggccgtgggtgcaaattctccccgggccagtaacatagctcccacctagccactcgcggccacctcccctgtgccgtgggacgaaaactacgggggaacaatgagggggaaacaatccgggggaacaccgccgcagaggccaccaccgtcccacccttgactgacc

SEQ ID NO: 485864 - DNA, 430 bp, Homo sapiens
caggaattcggcacgagtctactctcatggagttgagtgtctagtgagaagaacaaacattagaataagtaaatggaaactcccatgccttgttcatctcatgtgatatttattgcagtcacccaccctttggtttgaaacctcttttcttaataatgtgttgcaagacattcccatgagggtacttgagttagagcaaagttgagatcgctctgagttgtacacatttctctatgttccagccgtctctccaccccttcccacaacagactgttgccacagacggttgcatcagggcaataccagtgggaattgctgaaggaaccgaggcattgggacctcagtttggaagacctgtactgtctcacctctgtatctccttgtcttttcatggatgtgtattaaataaaggagtgttagatgctgaaaa

SEQ ID NO: 485865 - DNA, 814 bp, Homo sapiens
  misc_feature (8)..(8): n is a, c, g, or t
  misc_feature (155)..(156): n is a, c, g, or t
  misc_feature (169)..(169): n is a, c, g, or t
  misc_feature (193)..(193): n is a, c, g, or t
  misc_feature (223)..(223): n is a, c, g, or t
  misc_feature (256)..(257): n is a, c, g, or t
  misc_feature (296)..(296): n is a, c, g, or t
  misc_feature (301)..(301): n is a, c, g, or t
  misc_feature (360)..(360): n is a, c, g, or t
  misc_feature (380)..(380): n is a, c, g, or t
  misc_feature (383)..(383): n is a, c, g, or t
  misc_feature (404)..(404): n is a, c, g, or t
  misc_feature (427)..(427): n is a, c, g, or t
  misc_feature (491)..(491): n is a, c, g, or t
  misc_feature (493)..(493): n is a, c, g, or t
  misc_feature (504)..(504): n is a, c, g, or t
  misc_feature (523)..(523): n is a, c, g, or t
  misc_feature (532)..(532): n is a, c, g, or t
  misc_feature (540)..(540): n is a, c, g, or t
  misc_feature (564)..(564): n is a, c, g, or t
  misc_feature (612)..(612): n is a, c, g, or t
  misc_feature (620)..(620): n is a, c, g, or t
  misc_feature (665)..(665): n is a, c, g, or t
  misc_feature (687)..(688): n is a, c, g, or t
  misc_feature (737)..(737): n is a, c, g, or t
  misc_feature (810)..(810): n is a, c, g, or t
ttttctcnggtggtgttctctggttcccggcgcgttccttgctcccggctcttggcgggtggttggtgggcgcttggttttagcagctgggtgccaggtgcctgcttctcactggggaatgtgttcaggggggatgtcaacactggccgggaaanncatcgggctttcncctcactcatggcctccataaggngggcgctgtttgtgactgctgtcgtcaggnaattgaacctgttgcctttctctctgcccaggnnccggggggctgggttctcagagaatgttcaaccccccanggccnccaccaagatggggcgcagggactcactggccgccttgtcttccttagtcttttctgtnactgccaagtccctgccgtngcnccgccgtcccccctcctcccngccctgcccgcctcgccgctctngctcctgctctttgtttcggcagctctggggctcatttgctccactgaggacgttagctgtgtntnggggctctttntgatcattctcgccgtccncacgtgggntctttttntgctttttgctgatggcacgatanttgctcctcttggccagagaactgaaggcatcagtaatctttcctgcngccttgtnggtcaccagcttgctcactttactctccacggctgtgagggtgtncccgggggcctgctccgttagnncccagctcttcgcagattggagaaggttagcaggtgctcagggccatanctctgcagatactgtgttttcagagatcggtaatccttggggatcagaccattctcagtgatagacaaaggcnctga

SEQ ID NO: 485866 - DNA, 916 bp, Homo sapiens
aagcttgtaaaatgtactatccaaattagaagcggattggaaatgcaaactaacgtgcagcttggatatctaagtgcacgttagttgcatttccaaatccaagtgggtgagcttagccactcttacccatgctctttccctggaatccctggagacctgtcgcaagatgatttccatataccagcatagaaagatcagaactcaagagcaaactctgagactggcacaatccaagaagatttcctggctctggcttttagtaatttgggactccaactgccactgtactggactgtaatttataaatccagtagctacgcagggtggaggctgggctgaggattaccataatgaaatgtactaaatcttcatttaggtatgcaatgtgaagtgaaggcatctgctttctttacagtatcagagtccaagaacaggatgtcaccatagataaaagcctcatacaaaggcagaactacactccaaatttaatgtgtttaaatggtggggcaccagcagaaaatacttctagctcagctttactcttcttccacactaggctgggcccagcaatacaggagaggatgaagggaggagctccaggaggcgagggaagagccctagcaggaggcatcacaacactcactgagagttgcccttcttaacaaatgtatagatgactagccagtggtcccttccttctcttatctctctactgtcagaacagatatgaggcaggtgcggtgctcacatctggtatccacacttggaggtggaaggtgaatgcagagccaggagtaagacgccgggcacaaagaaccaatttaaaataaaaatgagaacatacctcaaacactataggagaacagaaacaaaaagcactcactgtatcagcaacaaacacagattttagtaaaaa

SEQ ID NO: 485867 - DNA, 305 bp, Homo sapiens
attagacttcaaggctgacatctggtcctgtgggatcacagccatcgagctgtcaatgtgtgagcctcaaactctggactccaccccatgcgcggtctgttccgtgattcccatgaacagacctaccacactgtagggcagcaacagcaatgccttcaaggagttcgtggagggctgcctcaataaagaccccccgattccgggccacgggcaaaggagctcctgaagcacaagttcatcacacgctaaaccaagaagacctccttcctcacgggaggctcatcgactgcttggattacaaggga

SEQ ID NO: 485868 - DNA, 488 bp, Homo sapiens
ttttttttgagatggcgtctcactctgttgcccagtctggagtgcagtggtgtggtctcagctcgctgcaacctccacctccctggttcaagcgattctcctgcctcagcctcctgagtagctgtgactacaggcaccatgccaccacgctgggctaatttgtgtattttttattagagacggggtttcacaatattggccgggctggtctcgaactcctgaccttgtgatccacccgccttggcctcccaaagtgctgggattacaggcgtgacacccgtggcccagccgaactttcctttccatttggatcacaagtttaccaacatcactgcctttagatcccattgtcaattttggcttttgttgcaattgcttttggcatttttgtcatgaagtctttgcccaccctgcctatgtcctgaatgttgttgcctaggttttcttctagggtttttacggtttggggttttacatttaagtcttta

SEQ ID NO: 485869 - DNA, 574 bp, Homo sapiens
ccacgcgtcggtgacatgtgcctgtagtcccagctactcgggaggctgaggcaggagaatcgcttgaacccaggaggtggaggttgcagtgagccaagatgtaccaccacactccaggttgggtgacagaatgggattctgtttcccccaccaaaaaaataaatgaaaagaaaatcaaggccaggcgcggtggctcacctgtaatcccagcactttgggaggccgagtcgggcagatcacgaggtcaggagatcaagaccatcctggctaacacggtgaaaccccgtctctactaaaaattacaaaaaattagctgggcgtggtggcaggcacctgtagtcccagctgctcgagagggtgaggcaggagactggcatgaacctgggagtcggaggttacagtgagccgagattgtgccacgtgcactccagcctgggcaacagagcgagactctgtctcaaaaaagaaaagaaaatcaaaagctcattgcggccgggtgtggtggctcacgcctgcaatcgcagcatttgggaggccgaggcgggcagatcacctgaggtcaggagttctagac

SEQ ID NO: 485870 - DNA, 422 bp, Homo sapiens
  misc_feature (20)..(20): n is a, c, g, or t
  misc_feature (54)..(54): n is a, c, g, or t
  misc_feature (94)..(94): n is a, c, g, or t
  misc_feature (320)..(320): n is a, c, g, or t
  misc_feature (361)..(361): n is a, c, g, or t
  misc_feature (386)..(386): n is a, c, g, or t
  misc_feature (404)..(404): n is a, c, g, or t
  misc_feature (412)..(412): n is a, c, g, or t
  misc_feature (416)..(416): n is a, c, g, or t
aagcctcgggattttttagnggccagttaacctttgccccgatgcctccccccnactgaaataaagcccccttcccttcctacaaccttggtgncctcagaggttttgtcctgcagccttgtccctgcctacagaagaaatttcctaagcagcaatgcattcaagagatgacttgggtgctgttaaaagcattcagttttaaatgggaaacacagcacaaaagtttggaaaatttgcagactgatggtgcaagagaaaagaaaaaaaacattttctgaggagaaattcaagctggctgcagacatttgcataagtaacgnggagccaaatgttaatccccaacacaatggggaaaatgtcnccagggcatgtcagacctttgcganaacccctctcaacacagncctggaantctnggaaga

SEQ ID NO: 485871 - DNA, 327 bp, Homo sapiens
  misc_feature (87)..(87): n is a, c, g, or t
  misc_feature (225)..(225): n is a, c, g, or t
  misc_feature (303)..(303): n is a, c, g, or t
gcgatctccgctcactgcaagctccgcctgccgggttcacgccattctcctgcgtcggcctcccgagtagctgggaatacaggcgtntgccaccactaatttttttgtattttttagtagagatggggtttcaccgtgttggccaggatggtctcgatctcatgacctcgtgatccgcccgccttggcctcggaaagtgctgggattacaggcgtgagccaccgngcccggcttaaacattttctaatgaagacactgccttaaagctggcacaggatttgagctggacttctgtctccttgntggtcgaactgcgatacgctttcg

SEQ ID NO: 485872 - DNA, 156 bp, Homo sapiens
atgccggtgatctgagaccccaagcgtgatatagactcatttaaatgtctcaggtaatgtatatgttgattagcttgatttagccatttcacaatgtatacatatttcaagaacatcagtgttgtatacaataaatacataacaattttgtgtcca

SEQ ID NO: 485873 - DNA, 1113 bp, Homo sapiens
  misc_feature (220)..(220): n is a, c, g, or t
  misc_feature (714)..(714): n is a, c, g, or t
taaacagttttcaaaagttcttaaaggcaagagtgaatttctggtggatttaacgggtcccagctttataggttcttataagaacactaacgaggactacatagaggctttttcagcattacgggtgtcgtctccggtgccagagtgttggcaagatcaccattagcaaagtggaaattcactttgtgaaagcccattagaactttacagggtgagtgcnaagcaatcttaagaagaagaaggttaactccaccactatagaaggcataaggtggcttatcagtttctcatttttcctaatgtgttataacaatcgtggtgtttttattaccaggtggttgggcaagttaagtgggggtgttagcctgtgagaaggtggttaagagggtggtttgtggggagggaacttcgtgtgtaaagtggtttgggcgtgtaaacacaagggtttccaacttccggcgtgaaagtgttgctcgaaaagcatgtggtgctggctaacagtttcaacaactccggggcggggctcattcatgggccttacttatactctcccatgtgaagccaggttagcgttgcaagggtggtattggaaaaagccgtgtattgccgtgtcaattctctggggtgtcattctcctgtcccgcctccccgatactccttccccagtatccttccccttatattcgcacggctaaacctcttattgggtcagantggtgatccttggaagataaattgggaataagtgagtattggaagtgggagcccagaataagaaattggattgggtcttacgtgaacagcatggaattagcatgtagctttacaataaacacagctaatttagagacaaaacaaaaaggtggcggtgatgacaaatcgccagaagggggccaggtcacgcctacccgcggctgctggtgcaacaggggcgacataatggcagggtcgtataataaagcgacagcgcacgaaaaaaaggagcagtcggaaaccaggcaaccggactttagtacagcagccctgtgggtggaaaaggcgagaccacagaaagaagaccgaggcaaaaagacatggacaacgacactcgacgtgcgaataacagccgaacac

SEQ ID NO: 485874 - DNA, 571 bp, Homo sapiens
aggtattcacaaacttccttgaccggttggtgggtcatacagaaaagacgacgttacagggtactttcccgtcccatttacctgcaaaaagtcagggcaaagacgttccccaggcccaacaccagaattaaagcgggggggccgccccgcaggtgttccattcgcaaagggcaaaaaatccaccagcggtgcggaagcgccttaaccaggaagcctatcgcccaaaagcgtccgttttttgcagacagcgaacccgccaggggcggccgggaccccagagccccgggagcccccttgaggaggagcggcagaccagcgttttaaaccgcagccggggtgcccccgcggccgagcgccgaccttatcctgaaaccctgcagggagagcaccaagcggaagctggcgttttccgtttgagggtggggggcagtccccagctagcgtttcggcccttgccgccccgtgcctttaaatacgttttttatagagcctgggtttggaagccgggggcagccccgaccccttttcaggcgggtccccccaccctcaataaatgttgcttggggtggga

SEQ ID NO: 485875 - DNA, 654 bp, Homo sapiens
  misc_feature (293)..(293): n is a, c, g, or t
  misc_feature (373)..(374): n is a, c, g, or t
  misc_feature (376)..(376): n is a, c, g, or t
cggggggagctggctaaacagtttaggcagacgctaggtgctggagagaattgcgtattctcggagagggaggtctactgtacagaagggagtgtttccgagacggttaatatgaaacctagagggggacgggtggatttgtgtgggatgggggtttttcaaaaaggctttattagtggtgtaaaaacaccgaaatgttgggtttgtgtagaacgcaaaagtttctctcctttcttggaaaatgagagtttgccgcccggaatcgacatctagtagacttcctcttgaggatntggggggcgttgcaattaagcttgggaaagcccataggccgggataggctgaaggggggcgtacttaagccggttttggnnanagggttgtgggttccttggggcgccgttgataggctactcccaaatccattgccggtaggggcccaggacgttttctctcttcttaagtttagaccgtacaggaggtcttgcaaaaatgcaaaagaagtgcactgggttctgtgattcgtcatccccagatcctttgatgtctatggaggagtcctccttgttctcaagatcagatgtttcaatgtaccttgtattgggccattgcactccagcctgggcgcagagcaagactccatctcaaaaaaaa

SEQ ID NO: 485876 - DNA, 744 bp, Homo sapiens
  misc_feature (16)..(16): n is a, c, g, or t
  misc_feature (65)..(65): n is a, c, g, or t
  misc_feature (78)..(78): n is a, c, g, or t
  misc_feature (104)..(105): n is a, c, g, or t
  misc_feature (124)..(124): n is a, c, g, or t
  misc_feature (176)..(176): n is a, c, g, or t
  misc_feature (204)..(204): n is a, c, g, or t
  misc_feature (236)..(237): n is a, c, g, or t
  misc_feature (244)..(244): n is a, c, g, or t
  misc_feature (250)..(250): n is a, c, g, or t
  misc_feature (274)..(274): n is a, c, g, or t
  misc_feature (292)..(292): n is a, c, g, or t
  misc_feature (321)..(321): n is a, c, g, or t
  misc_feature (323)..(323): n is a, c, g, or t
  misc_feature (350)..(350): n is a, c, g, or t
  misc_feature (354)..(354): n is a, c, g, or t
  misc_feature (372)..(372): n is a, c, g, or t
  misc_feature (377)..(377): n is a, c, g, or t
  misc_feature (381)..(381): n is a, c, g, or t
  misc_feature (394)..(394): n is a, c, g, or t
  misc_feature (403)..(403): n is a, c, g, or t
  misc_feature (408)..(408): n is a, c, g, or t
  misc_feature (418)..(419): n is a, c, g, or t
  misc_feature (424)..(424): n is a, c, g, or t
  misc_feature (427)..(427): n is a, c, g, or t
  misc_feature (436)..(436): n is a, c, g, or t
  misc_feature (442)..(442): n is a, c, g, or t
  misc_feature (460)..(460): n is a, c, g, or t
  misc_feature (465)..(465): n is a, c, g, or t
  misc_feature (470)..(470): n is a, c, g, or t
  misc_feature (472)..(472): n is a, c, g, or t
  misc_feature (492)..(492): n is a, c, g, or t
  misc_feature (502)..(502): n is a, c, g, or t
  misc_feature (511)..(512): n is a, c, g, or t
  misc_feature (525)..(525): n is a, c, g, or t
  misc_feature (544)..(544): n is a, c, g, or t
  misc_feature (551)..(552): n is a, c, g, or t
  misc_feature (587)..(587): n is a, c, g, or t
  misc_feature (592)..(592): n is a, c, g, or t
  misc_feature (596)..(596): n is a, c, g, or t
  misc_feature (603)..(603): n is a, c, g, or t
  misc_feature (612)..(612): n is a, c, g, or t
  misc_feature (614)..(614): n is a, c, g, or t
  misc_feature (710)..(710): n is a, c, g, or t
tcagttcaggggatgngttctaatactattaataaatggtcaatatggcccaccccctgccaggnttccccctatgcntatttttgggggggtgtacgggtggnngggttagcgggtttttggngtccttgggggcgagggggggcaggggtgtctgggggttgtgcccggcaggnggggcctgggttgcggtgtgcctggggngggggtggatgtggccccctggggccccgggnntcttggngttgcngtcttgtttgcgtttttgtggggnggggcgctttctgttggntttgtgggctgggttgtggcctgcgggtntnggtgttggccggggcttcctggctggntggngtggcgcgttggtggggnggtgngggnggggcttgggggnttggggccnttttnggggggtttnntcgcnttngggtttggngctgtngccttcggggggccggtncgggngctcntnggtctgggggtcccgggctncgttctggcnaactgggcnnttgacccttttgngctggctgggtgggctgcnggggttnngggctgtggttgtgctctactttgggtccttaccnctgcntttngtttgcnctttcttgntnggggggttgtcaaaaacagtcttatcttctagcctaggtcgtttatttgggaatgtatcttcagacccactcacatcctgggatggcatcacagangctgattccgttacttttgaagaatttctttggg

SEQ ID NO: 485877 - DNA, 320 bp, Homo sapiens
  misc_feature (280)..(280): n is a, c, g, or t
ggtgaccaccaggtcttcgaagatgcgaaggtccttgtagacccgacgatgccgacgtgcgcggcgttggcgacggccaccgtgtcgctggggtgccactcgacgcgatacccacccgacttgtacgggttcgggtttccgagggcgttccacccgttgtaggcgacgagcgtgaacgaaaacgtgtcggacggcttgtacacgccccgcacgccggagacgtaatacggcgtcccgtcggcgacgagcgcgtgggtgtagttccagttgctggtggtgngcgcgctctcgtttccgaagtgactgggcatgagccccgc

SEQ ID NO: 485878 - DNA, 210 bp, Homo sapiens
ggcggtttattaacatcaggtccttcacgcgggtggtgagctggtcgatgaacaggatgggcaggtaattgacggttttccccagctggattatcttcatgttacggatgcacatcgggaggcagggaggacccgtcaaaggaaaagttgtccgccatcacgttcagcgcccagcggcggtcgccaagtgtgacactgcttcatccaggg

SEQ ID NO: 485879 - DNA, 332 bp, Homo sapiens
ttttttttttttgtatttttagtagagacggggtttcacatgttggtcaggctggtcttgaactcctgacctcaggtgatccccctgccttggcctcccaaagcgctgggattataggctaagccactgcacccggttaagaatactttttttcaaggtattctaaactctccttaaaatgatcctaatccacttccctattaacgcacattttagttgcttctcagtgattgatcagtactcaaaaaaaggtcttaatgaatgaatattcatcattatctcagatactggctcaatgattaaccctgtagtaatttaattgatttattcag

SEQ ID NO: 485880 - DNA, 158 bp, Homo sapiens
aaaaataaaaagttttttttttataattcagtcggcttttggattttcatatatttaactttgcaaaaagatttcctttggacatgttccaggcttgattggggtaaatctttttataaatacataaataaaagaaaaatatgcctttttcttttcta

SEQ ID NO: 485881 - DNA, 277 bp, Homo sapiens
  misc_feature (195)..(195): n is a, c, g, or t
aggtgcagtgtacgatctcagctcactgtgacctctgcctcttaggttcaagcgatactcctgcctcatgctcccgagtagctgggactacaggtgcccgccaccacgcccggctaatttttctgcatttttagcagagacggggtttcaccgtgttagccaggatggtctcaatctcctgaccttgcaatctgnctgcctcggtctcccaaagtgctgggactacaggcgtgagccaaagcgcctggtccatagtactttttaaaaattaattatg

SEQ ID NO: 485882 - DNA, 449 bp, Homo sapiens
tccgtattcccggcgaggagaatggcaaagattactacgtattgtagccggtggaggtgattgcaacgtgacatatgcatgccggcgacttcatctgatgcatgccgaggtctcgggcaacctgtatggcatgtgcaaggtgtctgtatgcatgtgcgtgcaggcgatgaaccgcatctgtgtgctaggacttggacctgcagggttgtgcggaacatcaaggccaccgatctgcggccccatctacatctctgtgcagccgccttcactgcacgtgctggagcagcggctgcgggcagcgcaaacactgaaaccgaggaagagcctggtgaagcggctggctgcttgccccaggccgacatggagagcagcaaggagcccggcctgtatgatgtggtcatcattaaacgacagcctgggaccaggccctacgcatgagcttgaaggga

SEQ ID NO: 485883 - DNA, 838 bp, Homo sapiens
acaagcgagcgccaagtcggacgtgacgctggacggacgccggccgcgtggacatcggcgcggccataatattgtcttcagcgcatcgtggacatctcgcgagttcagcatgtacgtcgtgggctctcatggacgcactactgacgctccacggagcttcgtaccacgctcccatgcgccgctgtgcgcggccaccggcacccaagcgcgatgcactgggtgcgagggactgtactcgaggagacggcacttactactcgatggcgcggagcggcagtcccccacgatgctgaggacgcacgagcaatcattgacccctgacaggtactccgatgtagccacagcgaatcatgggtacacctgaggacgcagaatgagtagaaaaaactgcgtaggcagccagaagcctctcgtaccaacttgagcgtgggagtgatgggcctcgcacggagtgcagcacgcaccgatggcgttgtctccgtagccagagggcccacgctctgaagagcccaaacggcgcgaacgcgccgcacgaacgattgcaccctctacggactcgagtgtctatgaaggaacgtatctaatgagcgccacgtgcaatggtactgttagcctaatctcatgggctggtcgtcatactccgcgtgttacggcactcttgggcctgctacccgttggcactctgtggatgcgattgcgtgtgactggggtctaaccgcactacctgtgctgcattctacggaggggtatgggcctcccgcatgccagtcctgcgtctggatctgacctggcgggatcctgacatgacttaactccggtgaatgatcctccacccgag

SEQ ID NO: 485884 - DNA, 260 bp, Homo sapiens
cccctttttttttttgtccctcctccccggggcggggcttggatttttttgggccccccccaggggcccctttggttttggggttgggccccgggccctttgcaggggggggtggtttccccccgccttcccccccccccctccttttttttgttccctttttttttaaattgggttaagtttttttttgcagtttcttttttttccccctttttcctttttttccttccccttttaaaaaataaaaatgccccggggga

SEQ ID NO: 485885 - DNA, 404 bp, Homo sapiens
  misc_feature (404)..(404): n is a, c, g, or t
gtctcgagtatttctcttctttttctgtctaacacatgttattccaattgagtggaatgtcgagatgcacacactatataggcacatggtctgaaccaagccaccagacaagaacaacacctatgcgaggtatggatcggcatagctacgtgtgatccacatagtccattcgtcgattgtgcctctcaaacgctgagaattgctgtagttgaaaccactggtgtagcgggcaagtagaacggttgttgtgaccgactagttcataacctagctggacacgttataatctgatcctgaagtcggaccatcagctatatgacaatggttatatggtgggctaaacaagaaccagatagatactaaggtttatatgaacacactcagccacgcccttactaggtgcn

SEQ ID NO: 485886 - DNA, 387 bp, Homo sapiens
catcgtgtgtatgcacgactgaagccgtcctccctgcagtgtgcccagagcccatcgtgtgtatgcaccacgatgaagccgtcctccctgtagtgttcccagagcccatcgtgtgtatgcacgactgaagccgtcctccctgtagtgttcccagagcccatcgtgtgtatgcacgactgaagccgtcctccctgtagtgttcccagagcccatcgtgtgtatgcaccacgatgaagccgtcctccctgtagtgttcccagagcccatcgtgtgtatgcacgactgaagccgtcctccctgtaaagtgtgcccagagcccatcgtgtgtatgcacgactgaagccatcctccctgtagagtgtgcccagagcccatcgtgtgtatgca

SEQ ID NO: 485887 - DNA, 352 bp, Homo sapiens
ggacgggcatatgttcccatcgcacaagtgaaagatgtgtgcgtggtaacagatcagatttctgtgtttgtgactatgttccagaggaacgatcgaaattcatgcgacgaaacctttctcagagatctccccattatgtttgatgttctgattcatgatcctagccacttactcaattattctaccattaactacaagtggagcttaggagataatactggtctgtttgctttcaccaatcatactgagaatcacacgtatgtgctcaatggaaccttgagacttcctcactgtggctagagcaccaggaccttgtccgccaccgtcaccaccacccagaccttcgatcctg

SEQ ID NO: 485888 - DNA, 170 bp, Homo sapiens
gttcacttttgggatagctggaactcatgtattcggcaactatgcagagtcaaatggcagaccagtgggaatggcacctcaagcctagaacctgagaggccatacaagtccccctcaatactgtctacacagcaaagtcaccaccctggacagttctacagaataacacg

SEQ ID NO: 485889 - DNA, 1723 bp, Homo sapiens
  misc_feature (416)..(416): n is a, c, g, or t
catacgtacgatgaattagagaactagtgccaaggctctgtaggcaccttggtgtccgaattatccgaacaatacgacacccggttgcatttactgcatgatccactagtagtcatcaatggcgtactacagtcagaaagccccgcagcaagtcattgccgcgtagtgaatgatgtcttgacgtataaatagttgaggcagagacttgcagaatgtgctgcttcagtagtgacggagtgatggagtagatgtgacctggacgtcatgctgcttgtcaagcgtatctcgttgagatgacatgatacactgcgaagaatgtctcactttacttgggtgaacgaggtaccgtcaaggttcactcagaaagacgactggattcgatgagaatgatgtagggaaccttctatgcacagganatgtttcacggaaagaaattgtgaatttgacatgaaccgtggtgcatactaacacgaggtatacccatcagtacatttcgccgcacttgcccggaatctccaagaaggaggacgcgcatatgcaaagggcgacacaaacagacaacacggaagggcaattggggccactatccgacaagaaatgtttcccctttaagaaaggacaagggacaacgcccaactcgaaacacgacaattgtatgggaaccacatgcaaatgggtcaggcacggcatgaaaagcacacacactgagggacggtgcacggaacacggctgacaggcacagggaaaagccaccgatctgcgtatacacttcacaaagggccgagccataaggtacttgcaggtgtacgttcacgtcgagcgtggagcccatacttgcagacagggccgtggggggagggccatggcgcgaacacagcggggggctccacgcgagagggccgcgaaagatgcacggaacgtggagggaaaaagggcggaggaagaaggggcccgaaaaggaggactaggtgataggcccccataggttggcacacacccgttgggtaaggaagtacaaacagctcggagtatggccattgagcgcggctggttggcatttccaaaagggaaaaggtcttcggaaaaattggacacgaacttcacactgaaccacgagcggtccactccggggagtcggggccaaaacgaacaacagtgggtggacacgttgggaagtcctagtgtcgcacttgggcacaccaaccgcaatgttgcactgcttttggcatagagaaaacggtgcgctgagggagggtcacaagacagaatatcggagcccgcaggtggtaacaaaggaacacgacaccctgaggggtggacaggaccaaggtgtgccgcggtacattaggagaagacacgtgtcgaatacacaggtgtgtaacatgataattccacaattgagacacgtgtttgaagacgctaatggatactttgtaggacaaaccgcccacacattcgtggggccaaatcgaccaaacagaattgcgtaagatcatcaaataacggaagtcatggtgctgtcgcaacaagatgatcacactaaaagtcggtgacctctccaggtgaaaccagtcggaaggagagatcaaccaccgcttatgatgggcaacaaaacgaccgaagaacgatatgccgaagctggagaagggatgataatcaagagagtgagagagacaaggtcatgtgagaaaccggaagaaaagtagagtcgagcagagagaac

SEQ ID NO: 485890 - DNA, 751 bp, Homo sapiens
  misc_feature (607)..(607): n is a, c, g, or t
  misc_feature (688)..(688): n is a, c, g, or t
gaaaaaaccttatatttccccacaaaaaccctgccagataatgtattcagaaggtccgccatcaaagtccccccaaaaagttcctttttatacttagaattcccattaaaaaaaaatttgggttccctttcctttccaagccttccaaaaataaaaaatttttggatttttccaaagggcaaaagtttggtccttgaaaccccccaaacccgtggaaagaatccaaaaaaacccaaaagatttccccttccaggatttgaagctttaaatttgttaagatggccccccctcccccaggttgaacccgaaattgaatcggttttggccaaaaagggtttttttgattttggcccttcaataaatcccccaacaaaacccaaaggctttctttttcaaaaataaaaaaaccctcctaaaattcataggaattctaaaggaccttgaatgctaaaaccgctttaaaaaaagaacaaagtggaggccacatcccttcctgatttgaaacctggttcaaagctaaagcgtggtatggcaaatcagccatccagcccaccagaataaacagcccagaaataatcccttgcatatatggtaaatgcctatgacnaatggtgccacagtcatgcaatggggaaaggacagtcttttcaacaaatggtgcttgggaaaattggacattcacattcanaaagatgaagttggacccttacccaacaccatatacaaaatttaacttaaaactggataaaag

SEQ ID NO: 485891 - DNA, 107 bp, Homo sapiens
  misc_feature (84)..(84): n is a, c, g, or t
  misc_feature (99)..(99): n is a, c, g, or t
tcggcagagcaagaaggtgatgtttctggccaagaaagcgaaggacaaggacgtggagtgtaagagcagtgcattgaggggatnagcgggctgatctgnactggagg

SEQ ID NO: 485892 - DNA, 1573 bp, Homo sapiens
  misc_feature (416)..(416): n is a, c, g, or t
actgtgagtgaagatcccatcccacggaggaacgggcaagtccctgggaaagatgccggagtctaagtggaacgtttgaacacagtaccgtcactcgacgatgaatcggctgctgtggtgaatgacgctactgggacgccagtgggatgcgagtgcaccgcatgagtgacgtacgaagaacggaccactgacacggcagctactgtatctatgacttcgtaactaacgcgtgtgatggggcactggcctgtagctgcactggcctaacgactgctcgtggagccgttcaatgcacgggggtacgatgataggcacatgtcgtggcaatagcacttgcatgggtggggacgtaggaaggcatgagagaaatacggaggtgtaggattgaggtgcaggtacgggagagggtaccagangaggaggctgtgttgagagagtatgggggtccgaggagtcccacaccgaggcgtccatggagactaaaaccctctgtggtgggagcacgtgatctattcgatggacgggagaatattcgcacagagagcgaatacacagaccaaacccatgggctccgaggcagaggcccctgataacgattatgacgcaagagagagggagggccactcgacatggggtgctcggggggagatcaacctcaagtctaaggctagcatgtgataggaaaaaggattcggtgtggaggtgcccatagggtattctacggttatgggaattgaacgtggcaatagtgtatatacaacggcaatattggcgtccgcaattgaggaggcgcgtgtcgagttggtctaatggaaccgatagaattgacaccgggtgcagagacgttgtggggggagccaaagagcggacgtgggtcatatggacagtggttcgggggcaattgttcaataagtgccgaaaaaggaagttgtacaggcaccgtttagggaattttggccgttggggtagaaggtgtggagaagaacccattggtacaagttctggtggagaggttaaatgaaatagaacggaaaataatgtgcacccagtggagcttataacccaaaagagtcaattagggtaaatcgcggggtgggagacttgtggatgttgacacaatagggtttttggagacaaggcgtggttaaataacaccgtttcgtgtatgtttagcacacgctaggaaaaggggcacaaaaattggattgggtgggagagtttcgcgccaaaggaagagttggggcaccaagaaagcggtaagggcatttgagggaaaaggagttgggtgtaaaaacaaagtttcctttaatgtaccgggggacgctgggcatccacagtttgttaaagaacaaacacgcggggaacatatgtgagagagggcgcgagtatctttacacccaaaatgattaggaaacgaaatcaatgatgttatatgaagccggcgcactagtgtgatgatcacaattgggagggcagcatattgtgtgaagagatatggtgggatattaactggggaatataaaaagatccacgtgtatcatatgggtcacataaacgagagggagtgataatg

SEQ ID NO: 485893 - DNA, 472 bp, Homo sapiens
aagcgcaggggctgagtgagtatttatcttttcatacttgacagtcgtaagggcggttttattcatgccagttaggaggcatgttatcatatggcctagtttctgtctgtctgcagaagccacctgataatcccaactggggacagtactgggaatagcgagggttgtgactgggttatgggcagcatcttgtccgtggagggtgtctgcttgggcctgatccagatatgttccctgttctccagggtgagggaggaggagaggatgacagaaatgtcatgccaggtaaggtcataagattgagtgatatacagaaattccttgtggaaggatgtggggtctgtggaaaaggagtcaagtctcttgtcaatctgagagccatcagctacagagaaaggaacatgaactcagactatgccttcagtctccataacatcccccaatggggggactttaaagggcctctgggcct

SEQ ID NO: 485894 - DNA, 220 bp, Homo sapiens
tggctcggccgactgggatatgggagctacaatttaagatgagattgagatttgggtggggacacagccaaagcacatcaaaattatttttaaaaagtaaaaataggccgggcacggcagctcaagcctgtatcccggcgactttgggaggccgaggtgggcggatcacgaggtcaggagatcgagaccatcctggccaacatggtgaatccccggtcga

SEQ ID NO: 485895 - DNA, 303 bp, Homo sapiens
gctcatacctgtaattccagcattttgggagggtgaggtgggagaattgcttgagcccaggagttttgagaccagcctaggcaacatggggaaacctcgcctctacaaaaaatacaaaaattagccgggtgtggtggtgcgtacctatagtcccagctacgggggaggctgaggtgggaagatcacctgagcctgtggtgacggcagaggtcagggcttgcagtgagctgtgattgtgccactgtgccccagcctgggtgagtgagaccctgtcttcgggggaaaaaaaaaaaagagtttgta

SEQ ID NO: 485896 - DNA, 428 bp, Homo sapiens
attgagcccctggagccctctttggtcactatgcagatccggagtgcgtcccagtgtacacatctctctcagccgcagaaattaagacagtctttcagccagctcgcatggactctgtccaaggacagcggaacatgctccacattctgcatgttcttaaaaccaacctggttgtcaagcatgggctgttagatatggcatcttgctgagcctccaggctatgtaaggagtctctctggtcaagaccctactggatcaaagtctgtatacagcctccctttccttcttcatcaagtccaccgatgatgttgtaaacatattatggataagaagcgccttgaatacgggattgtcaacggcattgcagcaattgcccccgtagtcatggccttattattggagtgcttatacatctttagtcttgcttc

SEQ ID NO: 485897 - DNA, 247 bp, Homo sapiens
cacgaggactacccctaaatgccaaaatgggaaaggaaaacactcatatcacgattgtcatcattggtcacgtaaattcgggcacgtccaccaccactggcgatctgatctataaatgcggtggcatcgacaatacaatcattgacaaatttgacaaggaagctgttgagatgggaaagggctccttcaagtatgcctgggtcttggctaaactgaaagctgaccgtgaatgtggtatcaccattga

SEQ ID NO: 485898 - DNA, 815 bp, Homo sapiens
cggaaaagaggttctgagtgtacatcttcgatgtgcgttgtaaatgtcataggtgtgcgcgatctgttcctgtgaaggtcactggtgcttgcacacagaccgtgcagatacctgtaagacaggggcggttaagtagctgtggccttggtggtctcagagccccacacctgaggactgtgagctgtgagcagttctctgagcattttcactgaggctggttccaactggttaatgggtatggattgtgtgcacagagacatttgggggacagggctaaacagttttctttactgctggaattttcagaacctaaatcagtgatgtacacatgagtctccatgaagactgcagagcgaggggtgttatgctagtgtatttcctcacagagccctctttgtgtcaagaggcacatagtgggactagtgtctgtgaagcacatgttaggaacacagtttctcatcctttctgctaagcagctgtctgacttctcaagcacttctctgagtttccactggtgggtggaggggagttgtacatattaaacagttcttccctggccaggtacggtggttcacatttgtaatcccagcgctttgggaggccaaggcaggtggatcacttaaggtcaggagtttgagaccagcctggccaacatggtgaaacctggtctctattgaacaatacaaaaaatagccgggtgtggtggcaaggtgcctgtaatcccagctactcggaggctgaggcaggagaattgttgaacctgggaagtggaggttgcatgggtcgaagattgccattgactccagcctggtgac

SEQ ID NO: 485899 - DNA, 943 bp, Homo sapiens
  misc_feature (599)..(599): n is a, c, g, or t
agcgggtgcacgacgccgagacaagagctcgggacccgcctaggtcgatccatgataccagtcccaggtaactatccagctcatgcatcctaccctgtgcagcctcctgggaatcaaggtataccctcagacgcgttgcaatctgcctcaggcttcagccgtactccgactgccatcatgcctactcaaagctctatcgtcctgagctctggtgcacccatagtgggcatgccacatgtcgcgcaccattgatcagtcagtagtttcctcgcgagcctctctgtttcttcccttggcccaggtctgtgtctgtgtggcgccttctactgttccacggtccccatggcttcacttagtccatgtcaggtacccactctatctcgacctgtgtctccacatgtagctgtgtgtgaaggagatgggtatcaatgctatgtgtgacgcatgaatatcgagtagccgtgggtgtctacgtgacttggcgatacattcgcgtgcctcacaaccttctcattggaataaggtcactcttcaccaatcatgtctgcgtctagccttatgactagttctatgcctaggtgggagtccagaccgttccntgcggtaaatcttcatggcgagaacgcggggaagcgttcttgcatgcgagtggtctcaccgatgagtaggtctacaaccagtctaggttgaaggaacccaacgggccagccttctgctgccggggaagagactattcgacatagccttctactcagctatcgtcacgaatgtagactgactttagttcccatattgaacctgaaagtttgccagtctgaagacacattgtaagtcggcggtgtcttctctgggtgacccacaatcttttcaaggcgacgtctaacagagagtttcaactaacgtgcaacccatgtagatggatagacagtcacctcccctaaaa

SEQ ID NO: 485900 - DNA, 559 bp, Homo sapiens
tgcaaccaaaaggagggacaaaattctcccagggttaacccaaaaaccatgggcagcataatggcaggtcctttgtttcaaacccagttccaaagtcccaggaaaaaaacaaaaagttccccttccaaaggggtgggccccccccccccattttttaggtcaaaaatttggtttaggttttaaaaaccaaaaaaaaaccccctttcccttcccggggggtggaaaccccagccagtggaaaaattttttgaaaccccagcccatggaacccgggtgggaccccggctttaacattattggaggccaaaaacaatgtttttttcaaggaactgttttaaaaaatttggcccagggggttttcacctgttaaaaatccccccccctggccccaaggacgctggggacggtttattaaaaatttgagggttttgtgaaattccccaagggtttaattggaccccatgggatccttccaattttttggaaaaaaaaaaattacttttttttcccaggattcccaacccggccaaaaaaaaaaaattgggacccaaccctggtt

SEQ ID NO: 485901 - DNA, 142 bp, Homo sapiens
ttatactgcgagaaggagcagagcaacagggataacaaacatcctgctagcatgtgaagacgcggctggagcaggagatagccacctaccgccgcctgcttggagggagaggatgcccacctagactacagtacaagaaaga

SEQ ID NO: 485902 - DNA, 117 bp, Homo sapiens
  misc_feature (2)..(2): n is a, c, g, or t
tntcaagggatctcccgtgtagctggaactaccagcatacaccaacactgccagctccagtgaggttcttataacaacacaaaagcacagaatgctacagcacactgtggagaaggg

SEQ ID NO: 485903 - DNA, 402 bp, Homo sapiens
  misc_feature (316)..(316): n is a, c, g, or t
  misc_feature (367)..(367): n is a, c, g, or t
ggcacgagccaaaacattgctacatgacacatggccgtatttttaaccattgcacttggttttcttattttctataagtcttaagtcttactcttagtcctaccacatgttacaatttttttattattcacttgtgcaatcttcataaatctgtatttgtggtatttttgcacagtctaattttgcatctgattgtaggaacactaattatagggcctacctccttgccatttttcaatctttaaaattcttttattcagtggaagactcaaattgaggacttctgcaaagtgctgaatattagttcactttttcntttccccttggaacctaattgacgattgatttgcccttctctgattaaccnaatacaagttatacagtctaatatagcctattaaa

SEQ ID NO: 485904 - DNA, 189 bp, Homo sapiens
  misc_feature (17)..(18): n is a, c, g, or t
  misc_feature (41)..(41): n is a, c, g, or t
  misc_feature (46)..(46): n is a, c, g, or t
ggtgtacggttctcccnnttcaaatataatttattatcttncactnttgcccatgttggaatagtaaggattgattgtatggattgaattgtgtccctctaaagttcatatattgaagttgtaacctcccagtacctcagaatatgactttatttggagagagggtctttacaaaggtaatcaagttta

SEQ ID NO: 485905 - DNA, 110 bp, Homo sapiens
attgtgactgcatccactatagtgctgaagtcgtcacagtacatattggaatgaagtccctatgagagcatttcctggcatgttctataactcaaagtgaggctggcagg

SEQ ID NO: 485906 - DNA, 525 bp, Homo sapiens
cgcggtggctcacgcctgtaatcccagctctcagggaggctaagaggcgggaggatagcttgagcccaggagttcgagacctgcctgggcaatatagcgagaccccgttctccagaaaaaggaaaaaaaaaaacaaaagacaaaaaaaaaaaaaaaaaaaaaaaaaaaaaaggtgggggggggccggggcccgggaaaaggtttaaaaaccacttcgcgggggggcgcgcgggggcccaagtgggggacagtggaacactgggcgccaaagcggggtcccaagagagaacccgggggcacaagaaaaaggggcggggttcctccccaaatataaaaagcgcgcgcggggggggagaaacggggaggggtttggaggaaaactctcaaagagggagaggtcaagggagggcgcaaaaagaggggggcacttaaccaaagaggggggggccacaaggcgggagccccgagaataccaaatttaagccccgggcgcgggggggggcaagagcaaaaacgagaaaaaag

SEQ ID NO: 485907 - DNA, 196 bp, Homo sapiens
aacgggtgatgcggttgcggtgagccgagattgcaccactgcactccagcctgggcgactgagtggagcggaactctgtctcaaaaaaaaaaaagggggttttttaagacctccgccttccgttggggtaggggtttgttatgggggcctaaggacacctttgcttttttaaatatggccgggaaggccaaaagat

SEQ ID NO: 485908 - DNA, 231 bp, Homo sapiens
ttttttatgcttttaggagatggggcatctcactatgttgcccaggctggtcttgaactcctgggctcaagcaatcgtctcagcctcccaaagtgctgggattacaggtgtgagccaccatgcctggcctggtctgtaactttggcttcataaccttctaaatcatgggaccaacttgaatcaacactgcatactctttcaaaaagggatgaattactcattttgtcgacg

SEQ ID NO: 485909 - DNA, 342 bp, Homo sapiens
caatggagaaagccaggtactacataaaaatacatgagcccaatgtgcccagccatcatgtgtcttatataatttttgagacagagagatccttggaacctggatctattcacaagaggggccatgacccactatcgcagcagaacttcatgggcacgtctgaagggtcgtggagcccagcccatttctgtatgcttgggctgagttccagaaagggctcttgggccttgaggacacaatggcctctgatacagggcaggacactctccatgatgtgccttgcttgcttttcttttgctttctcccctcaagctttggggcataatgtctctgctagggagg

SEQ ID NO: 485910 - DNA, 99 bp, Homo sapiens
gcggccgcctactactactactactgctcgaattcaagcttctaacgatgtacggggacatgaccaaaaaccaaaagtgcattcaaccttaccaaaaaa

SEQ ID NO: 485911 - DNA, 155 bp, Homo sapiens
atcccaaatctctcattgcggtccccactttcaccctcaggtcgtatgcggtattagctaatctttcgactagttatccccactacagggcacgttccgatgtattactcacccgttctgcactcgccatcaatctagcaagctagatcatgctg

SEQ ID NO: 485912 - DNA, 472 bp, Homo sapiens
gcttcattccgtagcacgaaggcgtcaatcattaatctcgggtgattagtcctcaggcatctccctgctctgagctgaggggtgtggtagtgttgaaagttgcagtgctctgatcacgtggttggttcgactggtaactggtccctctctggcaagagccacctcatcagtatcaactcaggaatgctggaaatcattttatgaataaaaaataaagcccctctcaaaaaaaaaaagcttcattccgtagcacgaaggcgtcaatcattaatctcgggtgattagtcctcaggcatctccctgctctgagctgaggggtgtggtagtgttgaaagttgcagtgctctgatcacgtggttggttcgactggtaactggtccctctctggcaagagccacctcatcagtatcaactcaggaatgctggaaatcattttatgaataaaaaataaagcccctctcaaaaaaaaaaa

SEQ ID NO: 485913 - DNA, 394 bp, Homo sapiens
ttacgaaaagcaggccatttaaccagtggggtcttctctgattgctggttttctgtctgcttcacggacaccgttagtgtttcctttcttccaagcaaaggagggctctgagggcaattcctgggctggtgctctggaagaaagctctagttatagggatagagtgaaagttactcagagatgttagaatatagagtagagaaagattagaaagtgaagaatgcaaaggtaagcttggaatcaagtaaaacaatctcaacacgtccatttgatggctaagataatgaaactggaaccaaggcaacagaccaggaacctgggccctagctggagaggtttttgagagcattcctgcacactttgccttggaggaagttaccttaatgctacaagt

SEQ ID NO: 485914 - DNA, 160 bp, Homo sapiens
  misc_feature (91)..(91): n is a, c, g, or t
gttggcaagaacaagcgccgttacgaaaggcggcaaaaagggagccaagaagcaaaggtgggtcagtccagttggtgtaagcaagcggttnctagttagtgtcaaagacacagttgtagtcgtcaagtagtaagccacgtaggtgccaagcatcgttggt

SEQ ID NO: 485915 - DNA, 425 bp, Homo sapiens
gttttggtgctctgcccccaagagattcctgaataatactgtgaatttggatgtgagccccacgatgtgaatttattataaaagttcctctagttgattcctgatacacataaaaagttgaaaaaattggcccatgtgtggtgtctcacgcctgtaatcccagcactttgggagtccaagatggacagatcactggagcctaggagttccagaccagtctaggcaacatggtgaaaccccatctatctttataaaaaatataaaagttagccaagtgtggtggtgcacacctgtagtctcagctacttgggaggctgaaatgtgagggtcacttgagcccaagagatcgaggctgcagtgagccatgatcacaccactgcactccagcctgggtgacagagcaaaaccctgtttaaaaaaaaaaa

SEQ ID NO: 485916 - DNA, 114 bp, Homo sapiens
gccgtgtagcgggtaagggcgatcagtgtggggaggaatgggagtgggttctgtatgttcaaactgtcatttatatctctttaccgtatgttagatctagcgagtaatgtgatt

SEQ ID NO: 485917 - DNA, 397 bp, Homo sapiens
  misc_feature (149)..(149): n is a, c, g, or t
tatcgccaacaccaagacagctcaccaacattcattcactatggtttcttcagaaaggtttgtctgaaggttaaaaatgctttctatttctatgtcagtgacagctttttttttttttttttttttttttttttttttttttttttttngggggaaaaaattttttttttcccccccgggggggggggggggggggttttttgttttttttaaagttttttccccgggttaaaaaattttttttttttcccccccccggggggggggggtttcccggccccccccccccccccggttttttttttttttttttgggggggggggggtttcccctttggggggcgggtttttttaacccccgggggaaaaggaaccccccttcccccccccccaaaag

SEQ ID NO: 485918 - DNA, 603 bp, Homo sapiens
  misc_feature (598)..(598): n is a, c, g, or t
caacacttataatttatcttaatttattcttttccccattctactcatctttcccataaatttaacacctttttttccactaattcatcccttctattttatactctccaacctgttcttgctgctcttgtctgcctttgcatctgctcttgttcctcctattttgctgacctgaatgcatttccctgtttgtgtattccatcatcctctgtgtgaattaatttgtgttcttgtcatctgtgacaataattgactttaattgtatccctttattccttcatttccttccattacccccactcccttattttcttcaacattttcttcatttacactatcctgtaataacattacttaatcatataattgcctttaccataatcattaacctatacaatcacttttgcattttcttacttgccaactattgtattctctactgaccatacatataaatattgatttttctatcaaataccttaaataatcctttattcatcttgctgatttaaccatcttatatactataatatgcctttgtgtgctccatttcaatcttgtttgtccttgttattttttatataacatttctttcatntattc

SEQ ID NO: 485919 - DNA, 1334 bp, Homo sapiens
gaatggctctggtagtgccttcctctgtgccagcgagacctccatgcatgggaatgcccttcactctgtagtgtgctcgagccccaatcgagtgatacatgtgtggtgtggtggtgctggtgctggactacgcagcgtagactgctgtaggatttcaaacttactgttttttgattcctgtacattttacatgtcgcacagcaacgcagtctcacagcaatggcaggctagctccattcacagccatgacactgttctaactagtgatagacagctcttcagctgttggttattctctcttctatcgcgtctgcgtcttcactgtgcccacacaattcatacgtatacccgacacacatcctgaccccgatactacgccatccgcctatactctaatacacccagaattgactgctcatgcatatgctacatttgctatacttctacttccctaaacttggttgctgccaaacgattcaaccaatcctcaccacacacgaaaacgcgacacaacgccacttgcgagcgctcacacgccaagctcatgactgtcaccccaagacagacgacccacgtctccattgaaacggaggagcacacgcgacatgcgcaggccactgcagcatcctagcacgtaacgacacccaacacgcaaggaggcaccccaaccgaccacaccaatgccacccaaggcccccggccacgcaccactgccccccacgaccacatcccaccgtcctaccatcgaaaccttgacacagcactccacaaacggggccgaagcaccacaccgatgaccccaatttgactcgcccccacgaccattaatgggccacacacagtacatgcatcgaccaccacacgtaaccgtacgctatctccacctatctttggacgacactggaacaatcagaacacgggcacatgagtcggcaatacaatacacatccacccctcgcgtgagcaactagaacatactgtacaaactataagccgcgaacggtggaaatgactgcgtgtacactggacacaatacgatgattacgctcccgcttctatctcaacataccatgacatttgctaccttgcccccttccactacgccaacgtcacccttctgtcaccctggtccacagccagcaaacaatcgcctctacaaccgcgggaaccacaacctcattgacaccaaacccagccctctcaccataagggctacactacatccaggttcatgcatgcacaacaatgggtccatcctagtgcctcatgctattccagttggctgccaggtgtctaccttgcacatctagcgagcacggctacacggacacaaa

SEQ ID NO: 485920 - DNA, 832 bp, Homo sapiens
tgagcggagtgggaacggtgcccagcgccggacgaggcccagccagtctggggtctggcctggcctgcccctccagcctactggagccggcagcctggagccggagccggagccggagccggagccttatgccgagagctctgaggacgtctacctggcccagtcatcgcggtccggcgatgtgggccccgcttccctgtggcgcgttgccgcccagtgccggggagcgtcgctctacgcgcgagggtcttgaggctgcgggctgcccccgggggcagaggtgggaaggccatggcgcttgacggcccggaaacccttcttgactgggaaccgttccgaggacgtgggcccagtacattggccaccggataggtcctgcaggaatagcatgcaagactggtatcatccgaaggatcgaggccaaagacattttaaaccttgaaaggaattcttaacctacattggctacgacacacattcaataccattcttggggcacaaaaggcccccgtcccaaaacacaagtaagcgtgggcacaccattgtagcaggaagagaaagcttcgtcggttggccaccagtgcgacacccgggagaacccaagagcgcaacgaggacgaggaaaaccatgtttcacacactgtagaaggcacttgacaatggggggccccaaacgcgtgaagttcacaacagaccacgggagagagttgcgagtatagaaggcattggggcacccacgcgttcatagcccaggcgatcccacgaattaagggtagagcccctagggcatacgcagtgggaaccctccatacatagaagagcttggtaaata

SEQ ID NO: 485921 - DNA, 222 bp, Homo sapiens
  misc_feature (163)..(163): n is a, c, g, or t
ttcatagaggatcccccgggcgccacagcttctcagggatggaaacatgcccgcattgggctagctcttagacatttgaagagcccttgcccagcgcttcatggaaccttccatcgacaagggcacaggggctgatctgggactataagcgcagcgtccattnaatgagcctaggcctgccgatttccactagttgagggcgtggttcctcatggctggcgt

SEQ ID NO: 485922 - DNA, 151 bp, Homo sapiens
gacattggttaatcagtaattaaggcaaatatactgaatcatcagaagtaaaacaccattcagctactaattcacaggcagagatccaaggtcattcctcatactaaaactgtatcaaagcaaaaggatgcataaaatattaccgcagttc

SEQ ID NO: 485923 - DNA, 143 bp, Homo sapiens
ctttctcgttgccatatgaacaccctagcccctcctcccttgaattactggccctgatggagcatggacttatgctaacttgcaacagaatcacctaatggggccaggtattccctatggccttactccattgcctcacaggc

SEQ ID NO: 485924 - DNA, 533 bp, Homo sapiens
  misc_feature (107)..(107): n is a, c, g, or t
gtagctgacttgcaggagccccagggctcctctgaaagaagaattccaaccacagcaaccacagtgcccctgagtgaaataaacagaaatttcggcgtgcaccgggntacggagaccagaacccctggaggagaatggagaaggccagaaccacaactaagggacgatgtcagcagggagaagagctgggaatggggctcgcagttcgcccacggaggatatccagaaaccgagtcgggtaggcggtggggctggttgaatatccaccctcgggtatggacaggtgtgaggagtgtctaaggagctcgggggtgacagcccagctctactaaaaaaaatacaaaaattagccgggcgtggtgacacaagctgtcccctgacacagagaggcagaggcaccctctgcaggataacaagcaccctgtgcgctgctgggctttgcttgtttctctaccctgagtgaagcctggagacccttcctcaccggtgcctctgcagtgcctgggaggaataaagcctggagacccctcgtg

SEQ ID NO: 485925 - DNA, 873 bp, Homo sapiens
gcgtgaccactacccctagagagccactatgggtgaaggagataaggactcatatcacacattgtcgacatcgtgacacatacattcggagccagtgcaccactactgggccatcggatctataagtgcgatggaatcgacaaacgaaccatggactaatttgagaacgaggctgctcgatatgggaagagggcgtccttgtcagacgttatgcactgcagtcgtctggataaagcgtgaaaagctgaacggtgaacgtgcgtatcaccaagttgatatctcctagtgtacatactttagaagacacagtgaacgtacttatgttgacgtatcattagtatgcccccagggagcacatgagacgtttatcaatagaacatgattaccgggacaacttcaggctgactgtgctgtcctgatgtgtggcatgcgtggtgttggtgagatctgaaggctggtatctccaagagagtgggcagaccccgagagcaatgcccttctggcttacacactggtgtgtgagacaactaaattgtcgcgtgttagcgaatgtggattccactgaagccacccatacagccagaagagatatgaggaaagttgttagcggacagtccagccctctacatttaggaaatgtttggttgacaacctccgacagcgatgtagccattgtgtgccaatttcttggttggaatggtgacaaacatgctggagccacagtgcttacatggcttggttccaggggatggcaaagtcccccgtaaggatggccagtggcaggggaaccacgcctgttggagggtcttggaatggattctaacacaatcgttcaatgacaaagcttttgctggctctccaggtttttccaag

SEQ ID NO: 485926 - DNA, 210 bp, Homo sapiens
tatcttcccaggctcacacatgtgggaaatgaattgccatcgttagtacagctgccgtggtttatgatatttggatctggcagcccgatacagaggtagataccatgtgtagagagaaactggcagagaactaggagagttgaagggtaccccacccgtccttgatttctacatgaggaaatggaggctgtgagtgctggaactgagcgg

SEQ ID NO: 485927 - DNA, 655 bp, Homo sapiens
  misc_feature (164)..(164): n is a, c, g, or t
gctacaaagatgccatggagcagtgccacaggttacagagtgcgtctccctctgttgctgagcgcagtggtgcgccgtgcctttcttggactcacagaccggagtagcccagagcagttgttgacatctggatggataagcgatcaccgtgggtccaggattgngctccggtaaagctgtacttcctaccctgtcccgtgagtcttggtggaaaaagctgtgagatgcccatcgcacgactgatggatcacatgacgtttccgttccacagtcatatgtaatgcctagcacagcaggaccaggacctctgtatacgtagacggaggggcgcatgactcttcttcgagtggatcgcgtcgatgttaagttattacgagagacctcatgatgttggcagacgagcattgtatctcgcgcacattgtgggagcacacgtcgaagggggattgctcgctcggcggaaattctctccctggaaggtattggcagtggggattgggaagcaaagggcacttgggggaaccgtaccggtttttgcccgtggctttggaaagccaaaatccaggtacggtagtccgccgttatagagcccgtggatacccgttatggagatacctaggaatgcaacttttcccgtgaggacttgaactcgcct

SEQ ID NO: 485928 - DNA, 139 bp, Homo sapiens
ccgcggtatagaggatcccccttccccagtggttatagtggcctcatcacagccctccagtagatatcaaaggagacaacgccattcttgacgagatcactcccaagcgtattggagattgtcccaatacttatgacct

SEQ ID NO: 485929 - DNA, 314 bp, Homo sapiens
agctcggtacctggcactgcggttatagcacgacttaggtagctctcagctgacatcaccagtcagtcccctatgtcctctaactcagatcccctttatggtctccccatactaatccatcctggtcacatcctccccttccagtcagaagagttaacgtgccaagcatcttccttcatattgaagagctttaacggataactattacacattgggagagtactctgtgacggtagctcaaggactcttgccgtacattaagccagtcagttgcaatgtgcaagacaggctgcttgccgggccgccctcggaac

SEQ ID NO: 485930 - DNA, 1419 bp, Homo sapiens
  misc_feature (499)..(499): n is a, c, g, or t
  misc_feature (502)..(503): n is a, c, g, or t
  misc_feature (510)..(510): n is a, c, g, or t
  misc_feature (512)..(512): n is a, c, g, or t
  misc_feature (525)..(527): n is a, c, g, or t
  misc_feature (533)..(533): n is a, c, g, or t
tttggtgcccctcctccacccgctatcatgttcctcattacctcttttcattctcgcatggtcactacgtggattgtgttttctctgatgaattgttggactaccatcgtgatatgcattctgtggtttattcattgggtgctcccccatttgtttcctcgtaccgtgacctgttcctttggtcccggtgctcatatgggcgcacgacggttctgctcaaaccccttctgctcagtgcctctagttctcagtttgtagtcgtcttgtggtcacttcttgcttctccatcatctgcctccctcttctcccaggcaaggtcacaagcaacgtatgtcgtgtgagttctcaaggggtactccggtcagagagtgccagtagtgggttcagcgtcgctcacagaaccgttgatcaggacccaaggtcgctccctggaagtcactgcgtggtgctaagcgagggggatgggcggtagggctgtctttttctcggagagagactntanngccgagntnggacaaagctggnnncttgcncgggggccatggcgctgccatcccgaatcctgctttggaaacttgtgcttctgcagagctctgctgttctcctgcactcagggtcctcgtgtaccctgccgctgctggcagctccggtgtgtgtcctgatgtcctgctgtgtgatgctgttgagtgctgtggctgccctgtgtgctgttgtgcttgctgctgccatgatgccctgctgcatgtgtgttggtgacccatgtgacctgtgctgcactgacctgccatgctgctgtgctccactgtgtgacctgctgctgtgccctgtgtggtgttgtgcccctgctgctgtgctgccttgcttggacttgtacatctgtgctgtggctgatgcaggctgctgttgtactgatgtgccgctgtggacctgctgtgcctgccttggatgcgtctctgtgccctctgtgccttctggagctgactgtgcaagcttctctgcttgctcagtcctgctgctgtgttggtggatgtggagacgtgactgctgtgtggtgctttgttacaaccctttgcaacctttggcacccatcaacttaactttgcgcagcctttcttaaccgaatgatgacccttgggcccttggttccgtggcctgttggggaatgtggtacacgcttggacttgtggccccccgctgtggtctcaaccacccctctggcgccgtttaccttttgggggactgttgctggatgacatgtggatgtgtttgctttgggctgtgttgtgcgtgctgcctgtggttggcaacccccctgggtgggcctttttctttggaaccctttggtcggtttgaaccctggcgttggcgactgtttgttttggcccggacctgtgcactgttcggaagcgaagtgcttca

SEQ ID NO: 485931 - DNA, 762 bp, Homo sapiens
tggctagccccagacagtagtacgggctctcccggcaggtagcgatgcttacagtacctctagatggtacagaccatattgccaagcttgtgaggcctcctgtatcaggtatacggtcattgaaggtcgctatgcccaccagctctttattctgctgccatcaaaacagaataagctaggagcaagtagaaaaggcagttgtatgcagagtagcacaaatcctgcaaggcaacccaacagtggcatagctatctagtaatatagaatccctcatagtgcacagcgcttccattcaacagtagaaacagcctacaaatagcacaatcaaccagccacaacagcagcaggattacatcatacccacatccacctcaccgagaccctgcatccaatattgcgtatgccctcgcaacaacatggttccgatttcacacgcagcataaccctcacaggaagttacgctattactagccctatatatccttagcacatagccatacgcagtaggtcgcgataccgacgtgcaagcaagagtaaaccctattgccaacacaagatggaagccttactggcgaatacattcccactcatatacagcgaaaagggcaaaaggcgcccaacagaacacttcattctgtaagcaacagtgttgcagtcccacacacatgggttacccagtcacacaggcaaggccttatacccctgtaaaaagggtcgcaccaggggcccccaacacggtcaattttggaaagattataggcg

SEQ ID NO: 485932 - DNA, 399 bp, Homo sapiens
  misc_feature (1)..(1): n is a, c, g, or t
  misc_feature (32)..(34): n is a, c, g, or t
  misc_feature (36)..(36): n is a, c, g, or t
  misc_feature (39)..(39): n is a, c, g, or t
  misc_feature (61)..(61): n is a, c, g, or t
  misc_feature (65)..(65): n is a, c, g, or t
  misc_feature (78)..(78): n is a, c, g, or t
  misc_feature (89)..(89): n is a, c, g, or t
  misc_feature (114)..(114): n is a, c, g, or t
  misc_feature (136)..(136): n is a, c, g, or t
  misc_feature (190)..(190): n is a, c, g, or t
  misc_feature (198)..(198): n is a, c, g, or t
  misc_feature (210)..(210): n is a, c, g, or t
  misc_feature (226)..(226): n is a, c, g, or t
  misc_feature (229)..(229): n is a, c, g, or t
  misc_feature (252)..(252): n is a, c, g, or t
  misc_feature (255)..(255): n is a, c, g, or t
  misc_feature (259)..(259): n is a, c, g, or t
  misc_feature (267)..(267): n is a, c, g, or t
  misc_feature (271)..(271): n is a, c, g, or t
  misc_feature (277)..(277): n is a, c, g, or t
  misc_feature (297)..(297): n is a, c, g, or t
ngcgttctccgcagggacctcgagcgaaagannncnggncgcggcccagccctcgcctccntgcncaccgggcaaacngcgccgccacnccgaccccgctgcgcacggcctgtncgctgcaaaaaagcttgttggngtcttcgtcgccgcgctcgccccggggtactcctgagcgcaaaaatgagctccngaatcganagggggctcgcnttagtcgtgacccttntcnacttgaacaggatggagctctcnacntgcnccggtgcntgcnactgcnccctggaggcgcacaagtgngcgcagggagtggggctggtacgggaagggtgcggctgctgtaaggtttgcgcaaagagctaaaagaggactgaagcaaaaagaagcactgcgaaaaaaaaa

SEQ ID NO: 485933 - DNA, 186 bp, Homo sapiens
gaggattctgctgaattatgctgtgtacaacccagacatcggctactcacagggcatgtcagacctggtggcacccatcctggctgaggtcttggatgaatcagacaccttctggtgcttcgtgggtttgatgcagaacaccatctttgttagctctcctcgggacgagacatggagagacagctg

SEQ ID NO: 485934 - DNA, 224 bp, Homo sapiens
cttgaagccaggagttcaagaccagcctgggtatatagtgagactccatctctataaaaaatacaattacctgagtgaggtggtgcatacctgtggtcctagccactcgggagactgagacagaaagatcatttgaacctgggagttagaggctgcagtgagctagaattgcaccactgcattgcaccttggacaacagagtaagactccgtcaccaaaaaaaa

SEQ ID NO: 485935 - DNA, 177 bp, Homo sapiens
ccccggtgtttatcgcatgccagcagagggaacggcaacgcctttcagtgggatctacctgaataacaaggaagcaggaatgtatcattgcgtgtgctgcgacagtccactcttcagttctgagaaaaagtacggctctggcacggggtggcatcgataaacaccgggtaccgagct

SEQ ID NO: 485936 - DNA, 247 bp, Homo sapiens
tgacgtgtccatcatcagcgtccgctcgtaggtgtatgcagagatgtcactgttatgcatctccaccactccacctctggctcaaaggcgcagacggtacatgaaagacagccaggtccttctttcatcgtgggatgctgttgtcaatccattctgtggccacttgttgaaggattgcgccatcgcgggcactttccctccaagaccctttattgctgggcgcaagcaagtgaatggggccagaaag

SEQ ID NO: 485937 - DNA, 299 bp, Homo sapiens
cacgaggcctcgtgctgtccatgaatttcggtagccatctcgcatccgttaggaagagggatcgcgccctcgtgctcacactcgcagtcgccgatctgctgggcagaagtggggaacgcgtgggtcttctggggctcacagagccgacttcgagccggcgcgccgcgagccgcatcgcggaagacatcgactcgaattcggacgcaccgcaactcgcctccgggagaccgtcgatcgcgcgcgtgagacgcttctcgaggctcattctcgcgagcgatttccttgatccaatcgagacc

SEQ ID NO: 485938 - DNA, 327 bp, Homo sapiens
gagtcgtaactgtctgattcctaagctcataatccacaaactcttcacctttcactacagcacaggaaaaatgtaagaaaagaaaaaaaaaaaaaaaaaaagggaagaaaacttagggagggaaaaggtaaaaaaaaaagatgttattgtcggagaattattctgtacccccttggttacagtttggcggggtgtaattaaccatttcaaaattataattttctacaggaaaaaactaatttggtcttctccaaacactctcactttcaccaaagaaactttggggaaccccaaggaaaatttaggttgtggaaacttccgctatta

SEQ ID NO: 485939 - DNA, 166 bp, Homo sapiens
gtaacgcttcgaaaagtgactcttcgcatattcagatgagttgcttggcttttgtggatataaaagttcagagctgctatagtctttccatgatggggttagcctggtatatgtaagaaagttgatggacttgttgttcacgaagcgggaactccgctgggtggat

SEQ ID NO: 485940 - DNA, 967 bp, Homo sapiens
ctactcaggaggctgaggcaggagaatcgctggaacccaggaggcggaggttgctgtgagccgagtatcatgccattgccactccagacctgggagacagtagacaagactctatctcaataaatataaataaagaaaaaattgcggtgcaaaattcccgttattttcatagtcgtatctttttaaaggtattcatgatttcagtctggtggtcaggaaggtatgtgccttaaatcctctgatctctgaggacccaatagtttggagagctatattgagtttaaatacatgttcgtttgtagaccacgccttggttaccctttccccattttgatttgagggagaaatgactgttgtatcctgagagattccttctcataaaatggcctaatgtgtttcagtctaggacttctggggagggaacctctaccatggctttctgtcccactggttgtccaaggtcgctcagaatcagggttccccgtgtactataccttctgtgtaagagactattgtcctgttatctttggatgtccattgtatttgtctggtgggccgcagtagttacttttctggatcctatcatatgtctagagcatctctggtgccttcgttgaattgcccgcagttctatccatcttcctatttattgccatcttatgacgctattggttaggggtttaacgcgttgtttttgtccacctgtgtttaacatttcggtaactatttcgttggaagggtgtggcccatgtgttctggcctcttttggtctgtacaatttgttcccatccttgtaactatctcatcatggggggggattataaaacactggggggtttaaacaggtcttctgagcctattttatagggcccacccaggggaattgtgaggggggattagaactatcaaagaagctccacaggggggtgagtgtccggcaataggggctacaggggtttgggtcaac

SEQ ID NO: 485941 - DNA, 518 bp, Homo sapiens
cccaagagcggagcgcgcagcactgaagctcgagccgcctccgccgcgcgacccacctcggccgccgcgcctgcgccgtttgatccgccccggcctccccgagagcgagccccggccgccgcgaccaccagccgcgctaacctgcccgaccaaccgccaccgaggcgcctgagccgagagcacgaggagggaggaggcatgagtgatggcgggcgaggccacaaccaaacaccgaccacgcacccatcacacgacaagggactccgaccggcgcgcgggcacgccaccgcggcatccacccagagggaacccccgcaggccccaaaggaagccaccagcgtagggagcaaagccgcgctgcaggcagcccaagtgccagaagggaccccagggcagccccaggacgacacaaaccactcgcaactggacaaccccaccagagtgggagaaccggcggaccccccggccaggccacagcagcgcaaccgccggccagcagacactcgttaaaagcaacg

SEQ ID NO: 485942 - DNA, 292 bp, Homo sapiens
cccaggatttaagtgatacatcacaaacagactcaccaggaccacagacttgttttacacaagcacgttcttaccttagccacgaagtgaccaagccacacgtactaaaggttgaactcaaagcatatgtacagggtattaaacaaataccaaggggaccagttaacttcaatacaaggtcaacatcagcaacaagttctacaatccagtgctgatatcagatacaagcttcaaggacaatttcttttccgaaggcttataacctgttttgtgagaggtatgcacctgggta

SEQ ID NO: 485943 - DNA, 861 bp, Homo sapiens
gacaggactcgctaagtgttcgctacgcggggataccggatcggtcggaaatggcagaggtggaggagacactgaagcgactgcagagccagaaggagtgcggggatcatcgtcgtcgaacacagacagggcattcctcatcagagagcaccatgtgagaaccccaccccataacccagtatgccagcctctatgctacagctgttatcctgaagaggcatcgtgaggcacccgtgcgtgatatctgatcccacagaaagatgctcaccttcctttcgaatccgtctccatgaaatattgatatcatggttgcaccaagataaacgacataatattctctgggaatggttgaattcggagaattcccaagcggaataagccaacgtccgtcttttgtgcgtccctttggggtcattttccttttaatttgaaattgccccctccggaggaattgtttgaagtgggtcgaactcattgtcgggtgtgagctagcgacatttgcggtagtcggaggttggaacgctaagcatcaacactcaaatccaggtggagccgtgttgtgcgccatggcggcatcttctctcaccaagcaagggatagctccctgtgtgtcacaaatcgcttccccagaagcgtccgggagtggcgcctctcctcacttcccaggttttggtagcgcacgagccttgctgggaaagcccgcgacctcagatttcctttctgaccttcaagtagcaagttgtggtcggcctgtggagaacagctgtgttccttaactaacataatcaaaatggcagaaagatcgggccacaacaacgaaactttcgcggggcggcgcctcaggagagtgccagacactgg

SEQ ID NO: 485944 - DNA, 348 bp, Homo sapiens
ctgcctcctgggttcaagaaattctcctgccttagcctcccaagtcactgggattacaggtgcccaccaccataccaggctaatttttgtatttttagtggagatgcggtttcaccatgttggccgggcagtctcgaactcctgacgtcaagtgatcttccagcctcaacctcctgggctcaagcaatcctcctgcctcaggcctcacaagtagctgggactacaggtgcttgtcacacacctcactaattttcccatttgtgttatatgtggattcacaggactgactttgagaacttgagtatgcgtggattttggtatacacagaaatgggagagctggaactaa

SEQ ID NO: 485945 - DNA, 638 bp, Homo sapiens
gcttcatgaaatagatgagtaggaaacacctaccagcctattttattaagccagcattatcctattacaaatgacaagaaaactacagactaatatatgttagaaatgcttgtttttcggtgccataaagaaatagtacttgaacataaattcagtctcctcagcaaggccatttgtactttctacggaaagggtacactcgccagcagtttgtcaagagggtacaccgaacaaagaggatcattgtaacctgggtcatttataacctgatgcgtctaccttactgctgtgtctggtttccactggctggaacggtacctcacattctgtatttgtcctgattggctagcaacttagaagcttcttaaaagaggcaaaggcagaggagaacaaaggaaggaggaatgttgagaaaggtaaaatcaccttcaaataaggaagagcaacaggctatgacctaatgcatgcttggaccagcataagcatgccagggcaaatatttaggctgaattgtgcgagctaagaacataaagtactttgatttcctcattacggcagcagatatttaagaatgttagcacaggtctttgaataaattatgcttctaagagaagttagtattattcctaattagacgg

SEQ ID NO: 485946 - DNA, 586 bp, Homo sapiens
  misc_feature (10)..(10): n is a, c, g, or t
accaatcatntactgctctggtaaaattaaacggtcagaattacataattatttttcattagagataagaaaaaatcaaatgtgagataagaacatgcaaaataaggcaatcttccacaatgcttactttaggaaaagaaaaaaaggaagttttacttttttaagagaaaaaaaacactagaataagatgcagcttctgaagagacagccattttccttcacagtgttttcctcttccggcctaggtagttgatttgagtagctaagattccagtcagttctcacacacttttggtgtagcccattcattatggatgtgcaaaacaatatcccaccttccttatctcacagacagacttgcacaccttactaagaaaccttcccatggccatgaggtataactttctgccttagatcatgtagcaaataagcagttgtaggacatggaaattaaggttcataaaagaagtaattgtcactgaacccatttgcctgttcttaggcctgactagacaaatatttctatcgttttagaagcctcatctttcagtctaagtggttgaacagtttccacaacaaatgagag

SEQ ID NO: 485947 - DNA, 219 bp, Homo sapiens
  misc_feature (135)..(135): n is a, c, g, or t
aagctgcctaaagtgagaaagcttgaactcagtgaaaatagaatcttgggaggtctgggacatgttgagctgaaggacttccaacatctcagcacacctaagactgtaagcggaaataacactgaaaggatatcnagcacctatggaacctgttgaagaaagtttagaatggtctgcaaaaggcctggcacctcttctagactgtcgaggttgaccaag

SEQ ID NO: 485948 - DNA, 146 bp, Homo sapiens
cagtgaagcctcgatcacttgcccaagttgtttcgaaaaaggatagaaaggctcctgtggtgaaactgaaactgatgtagaatgggcctcctccgaattcaggaaaaaataagatgaaccaagtcgtaaataaccaaaaaaaaaaa

SEQ ID NO: 485949 - DNA, 210 bp, Homo sapiens
  misc_feature (7)..(7): n is a, c, g, or t
  misc_feature (54)..(54): n is a, c, g, or t
  misc_feature (56)..(56): n is a, c, g, or t
cgtgttngagcggtctcagcaatgctggatccttaacccactgagcaaggtcangnattgaacacacatcctcatggataccagctggatccacttccactgcaccacaatgggaagtcctccaagaaacaattttttgctaccattcacctatatccagataacccagcctttgccccagagtttagaggcactgtcttgctgtacccc

SEQ ID NO: 485950 - DNA, 408 bp, Homo sapiens
tcaatttctacacacagtagctggtatacagtaggcactcagtaaatagtggtaactatataaaggggtacatggctcagagcccttggaatataggcaccatgacatgaagtccgagaaaaaaggtgtatggtggaatagggcaaccagggaaggcttcctggaggaagggatcctggaaccaggccttgaaagatgaggcagagtctgggagaaggagaacagatagctttctgggtcacagtggcagagtgaggaaacttgttcagagtatgtttaggaaaccctgagagataggtgacggtggtagaagtttcatgctggggaaagttaggacttgattttataagcaatggggagccatagaaggcttctgagctgaggaatggaatgatggccataatgaag

SEQ ID NO: 485951 - DNA, 304 bp, Homo sapiens
tctgtatttagttactctatactgggcatactttttatggaatacacgcgcgctatatgataaccactggatgcttgagtgtaatacaaaaattcccaacccagcctagcatagacacggaaaatgattgggcagttgaatgaatgaaacagcagagcacgtggagtcaggataccatggggaagccacttagtctctctgtgcctttgtttgctcatctttaaaatgggactcagttagacatggtggctcaggcctgtaatcccagcactttgggaggccaaggtgggcagatcgtttgagc

SEQ ID NO: 485952 - DNA, 1016 bp, Homo sapiens
agcagcgcagctgcagtggttgttgttggtctgcgtctcgtgcaaacctggtcagctgcttgcagccatggctgcacccaactgcactgcaagcagccagatttgctagcaattcaacagcacagccttcttctccacgtcatttttgaccaacagcattggttgcatggcacacctcatacaccacacacaacaggcacattgtggcacacttgtcaaattgcagcatcctcttgtgcgccaagcaatccccaaccagcacagccagcagcttcctcagtgcacctatggcatttcacatggaacagttcagcataggcttgcattgggtcacattgtggcacaccaaatttggcactttcgccattgcacatttctcttggaaccacatctgcattgggcccagccaacccacacatgcatctgagccaccaccagccaccagcttgccacagcacagcaagacgtttcagccaccacagcccatttcccagctgattgctcggagtcatcacgaggggcattgggccacatgggcgcttcatcattccagacttgccctgcccagccaacactctcagccctaatggctgcattgcaccagacactcttttgggcaggcagccaagcttcaaacactgcaatgccataggccaaagtttggcattggaaacatgcaatcgccagcggccccattccaagccatcatcctgcaccgtgcctcgcagtgcgctccccccgattcacacacactcattctcaaatcgagcctcgcgggctcctcccaaattggctatttacacctcgtgccacaatggttgactacgaacccctttgttctaccactggcaacttgagtggatcaaaacaatattcgcttgggaacacacaaccatttgtgtataacctcattgtgccctcttagacaatatagcgatctcaggcacacctattaattcttggtaaaagacgtgtttccagtatgccccttacttgggacacacagagaccatcta

SEQ ID NO: 485953 - DNA, 206 bp, Homo sapiens
gaagagaggatatggcaatcgtcttctggtgtggaacgctgctgtgttactaaacagtaactggacttagggggactgcccccaacaccattgtgcttcttaactgcccctgtggcttcatctacatccatctcttcttcttcctcatgaatgttttcccacattcaccacatccatggggtttctctcctctttcagttctctga

SEQ ID NO: 485954 - DNA, 250 bp, Homo sapiens
attcaaagaattcggcacgaggcctcaccctaccaccagacaaccttagccaaaccaatttcccaaaataaggaaaggcgaaagaaatttaaacccggcgcaaaaaaaattggaccgcaagggaaagaagtaaaaattttttccaagccaataattgcaaggaccatcccccatatcccttgtaaaaaagtaaattcagaaaaaatcttttaaggggagccaaagccatggcccccgaaaccagacgagg

SEQ ID NO: 485955 - DNA, 512 bp, Homo sapiens
gggcacgatgggatgtgcctgtagtcccatctactcagtctcccaagtacctgggattacaggcggcgtgctcaagcaaagcctgtctaatgagctagtagtttctgtaagtggagatggggtttcacacacgatgtggcgcaagactgggtcgtcgaaacatccatgatctcaggtgatcatggccaaccatcagctactttgggaggcgagggctggggcggatcaccctgaggtcaggagataggagactaggctggcccggcatggtgaagcccagtctctactaggaatagaaaaattggctgggcgtggtgacacgtgacctgtagtcccacgctgctcgggagactggggcaggagaatcagcttgaaccctagaaagtggaggctgtaagtgagccgagatcgcactccaggcctagactcgtgtcgtcatagaaaagcaaatgtggtgaaagataatgtcgggaggggccccgtgtagatatcagcgtggtaaaggtccctaa

SEQ ID NO: 485956 - DNA, 766 bp, Homo sapiens
ccccacttggggggccccccccacctctcttttcttctttgggggccccactgtcgccccatacaatatttttctctgggagaccccccctttgtgattaaaggcccgcgcttgggggccccccccgtgtgggtgaaacctctcccccgagagttattgccccgctttggtcccccctgtgaggggatttctcctctctctcgacccgctctttctactatggggcctgccgccccaatatgtgccactgcacactctggagaaattggtttcccacgcggagtcttggagacccacaacttctgagagggagaaagagataatgccccctcttgttcgcgccccaccagctgtggtgttcgaccaagcccccttccttctgttgttgtggggaggacccccccacccccatttagagcacggcgcccacctatttctggaattctgggttctttccgaggcccaccgaagcttgcctctttcccctgagtccacagacatgcgccacacgtgggagactaacgaattcataacacacactggccggagaaacttggagttcctcggcacagcgaaggaggaaccccgaaccctgggtttcgaagagtactctttttcctcgcgagagggggcgccttcccccaagtgggccaaaccttccatccgggccagattttcaaatggacattttttgccctcacctagctgcctgcacctgccctttcagggagatgggggtcctttaagggaactgcacccattggaa

SEQ ID NO: 485957 - DNA, 127 bp, Homo sapiens
  misc_feature (53)..(53): n is a, c, g, or t
  misc_feature (64)..(64): n is a, c, g, or t
caagggttacgttctccagactcaggacgtgctattgctatcaaagtgagggngcttcctctcncattccgggtccagtgtagggtgcccgctatggcttccccaaacactccaggttctatcgtga

SEQ ID NO: 485958 - DNA, 468 bp, Homo sapiens
ggaggcggaggaatatgtccgagagggaagtgtcgaactcgcgccgggggaacagacatgctgggcagagcagaagctgagcagtgacgagacagcatcagactctctggagacgaaatgatgacgctgtcagtatgaaagtgtacaaacatgaagccctgataactaaaaagccaaatgcactggaagaaagtggggaagggactggaagtcagaatgctatcttcaatgtgtatagtctcaggaaatcataacaacatgttgagtcagtttactgcacagaagaaggagatccatagtgttgcaacgtggagccagagtactgttgatgtcattcaaagagatccggttgtgcatcttactgatgcgtgcgatgaaaatttacacttgtgctgactagatagcatagagcctccctgtggtgtagtgatctaagcatataggatataatctataacatgcgtgtta

SEQ ID NO: 485959 - DNA, 171 bp, Homo sapiens
cgctgtggagaacatgcatactacaattaagagagtgaacatatccatcatccctcaaagagccactcaacgagccacccaaagagccccgcaagggagccacgcataggaggcacaactgagccacgcaatagagccacactcatgagccgggtaccgagtctcgcaatt

SEQ ID NO: 485960 - DNA, 503 bp, Homo sapiens
tatatttgcaaaggaaacatatctaatccttcctatagaaagaacagtattgctgtaattccttttcttttcttcctcatttcctctgccccttaaaagattgaagaaagagaaacttgtcaactcatatccacgttatctagcaaagtacataagaatctatcactaagtaatgtatccttcagaatgtgttggtttaccagtgacaccccatattcatcacaaaattaaagcaagaagtccatagtaatttatttgctaatagtggatttttaatgctcagagtttctgaggtcaaattttatcttttcacttacaagccctatgatcttaaataatttacttaatgtactttggtgtatcttcctcaaattaatatcggtgctcaacactatatctactctcctcccatccccttcacaaacaaacttttactcaatgtaaggcacttttctatgaattttcaatataaaaataaatattgttctgattattactgaaaa

SEQ ID NO: 485961 - DNA, 250 bp, Homo sapiens
ggtgactcagaggatccccacgatggtctcatgctcacgatggtctagctccagcatcctcctgggccacaggacgcacttcagtgcagacacgtggctggagataatcacaacttttctttctttttttttttttttttttttttttttttttttttttttttttttttttttttttttttttttggggaaccggaaatttttggggggcccggggccccaagggcgcgcccgcgtgtggggggggata

SEQ ID NO: 485962 - DNA, 878 bp, Homo sapiens
  misc_feature (30)..(30): n is a, c, g, or t
  misc_feature (123)..(123): n is a, c, g, or t
  misc_feature (401)..(401): n is a, c, g, or t
  misc_feature (429)..(429): n is a, c, g, or t
  misc_feature (436)..(436): n is a, c, g, or t
  misc_feature (451)..(451): n is a, c, g, or t
  misc_feature (547)..(547): n is a, c, g, or t
  misc_feature (553)..(553): n is a, c, g, or t
  misc_feature (557)..(557): n is a, c, g, or t
  misc_feature (577)..(577): n is a, c, g, or t
  misc_feature (665)..(665): n is a, c, g, or t
  misc_feature (711)..(711): n is a, c, g, or t
  misc_feature (733)..(733): n is a, c, g, or t
  misc_feature (758)..(758): n is a, c, g, or t
  misc_feature (761)..(761): n is a, c, g, or t
  misc_feature (767)..(767): n is a, c, g, or t
  misc_feature (783)..(783): n is a, c, g, or t
  misc_feature (801)..(801): n is a, c, g, or t
  misc_feature (811)..(811): n is a, c, g, or t
  misc_feature (843)..(843): n is a, c, g, or t
aaaaacaacaaaaaaagcaaaaaaacattngggtacttgtcatgagtgcatcagtaaagatcacactgttacaaaagcctgcattttcagcagtacacaactgcaactctacataaatgccanagatgcagaatactgttttcttgctctatttacacagctgatatacctattctaacgaaggagggagaggagtaatgcacaagaaactcaggccaatgggggagcaagaagaaaacgaagaagtgcagtgcatgcgtcatcggtgtttaacagtcagaagcgaaacagttcagaacaaggcctgccctgtcaaaagaagagctaaagacagttatataaaaattaaggtgggctttcagactgggtaacccaacaacattccatgagtagatggtaanttatttttgtttatccatttcgttgggngcaaggncaaaaatgtaaatcnacaccttgcttatcaaaattgccgaaaaaagaatgctctgccttttaaaaaagtatcatgattttgtagaccttgttttccaatttaatatttggnaaaggngtcnttttcctattccccctcagntgccagtgttttgggctttttttccagggcgcgcggtttatttaacacgcgcttttgctcttttttattcgacaaaatatccttttcnaaacagcaaagaaacccaaaagagcacacctcaacaatgccctgtnaaaaattattagcttttacttntctctcaagtcaaggcgaggcgagngcntacggnaaaggcaagagatttnggttaagttaaattacantttttgtganttgctcccgcataccgtgaactgcaatgttcngtggagcgcccagccaaacgagaacaatgggtctc

SEQ ID NO: 485963 - DNA, 296 bp, Homo sapiens
  misc_feature (39)..(39): n is a, c, g, or t
  misc_feature (41)..(41): n is a, c, g, or t
  misc_feature (46)..(46): n is a, c, g, or t
tggtaagcatcgcgattgccgaagacgtaacagtggtgntnggccngtgggcaccgccgacatggtaacagagaaagaccaccacaacaaagagggcgaggagcagaacgccggcattaagaagacactagtgagcgcggggctaagcgcagagaagacacccctcgaggaatagggcagccgcaaggcgggctccgccactaaccgtaagatgacagggggtaccggtgcagtaggaagcgacagaggcggcactaaaaaagccggcaggagcgagggcatgaccagccacacta

SEQ ID NO: 485964 - DNA, 123 bp, Homo sapiens
tcagttgaagatagatggtagctgtggcccactagtgctggctccctgcatcactgtcacccctgtcccaaacatctcgacccaccacttacatatttcacctggctggctgctacatatgat

SEQ ID NO: 485965 - DNA, 208 bp, Homo sapiens
cccaggttgtctggtccccagttgtgctggtccccgagtgtctggtccggagttgtgctgggtccccagttgtgctggtccccagttgtgcctggtcctcagattgtgctggtccccagttgtgctggtccccggttgtgctggtccccagttgtgctggtccccggttgtgctggtccccagttgtgctggtccccagttgtgctgg

SEQ ID NO: 485966 - DNA, 446 bp, Homo sapiens
ctgacgaatcggctctctgggttataaagagcctgaaaatccaggtataaagccctttctctttttttttcaagacagagttttgctcttattgcccaggctggggtgcaatggcacaatcttggctcaccaggacctccgcctcctgagttcaagcgactctcccgcctcagcctcccaagtatctgggattacaggcatgcaccaccatgccaggctaattttgtattttttttgtttgttttttttgagatggagtcttgctctgtcacccaggttggagtgcagtggtgtgatctcagcttactgcaacctctgcctcccaggttcaagtgattctcctgcctcagcctcagcctgccgagtagctgggactacaggcgctcgccaccacgcctggctaatttttgtatgtttagtagagacagggtttcaccgtgttagcc

SEQ ID NO: 485967 - DNA, 353 bp, Homo sapiens
gcaggtctgcagatgaagggttttttgaatgaaatgccactgtgcattttcagaaaaaaaaatctctgataaacagactttgaatggatgtttgttcctcctgattctcttttctcttcgtggcgacttagagttggcggatattcggaactgtgaatgtacatagcgttgagttaaccccttttgtttaaaacagaacccagcaagcccctggtggttggggcaagaccgtgggcaggtgggcatggccctggctgcgggacctgctgggtttgaggcaagagggaggttgccatgaaggaacttgggattttcaatggaataagtaaaacataaagtctatacttgggaaa

SEQ ID NO: 485968 - DNA, 296 bp, Homo sapiens
tagacactgtacttactctgtcaaataggctagggtgtagtggtgcgatcgtacctcactacagcctcaaactcccaggcccaagggatccgactgcccctccctcccaagtagaaggatcactggagcctgggaagtcgaggctgcagtgagctatgatcacgccactctactgcagccttggtgacagagtaagacgctgtgaaagaaaaagaaagagagagaagagagagaatcaaagaactagagtttatcaaaattaaaaacttctgctctgtgaaaggtcgacgcggccg

SEQ ID NO: 485969 - DNA, 414 bp, Homo sapiens
  misc_feature (16)..(16): n is a, c, g, or t
ccccctgccgcctggntttctcacacttgttaatctcagcactttgggaggctttggcaggcagatcacttgaggtcaagagttcgagaccagcctggccaacatggcgaaaccccatgtctactaaaaatacaaaaattagctgggtatggtggtgcatgcctgtatttccagctactcaggagacagaggcatgagaatcggctgaacccaagacgtggaggttgcagtgagcccagatcacgccactgcactccagcctgagtaatggagtgagactctgtctaaaaaaaaaaaaaaaaagggaaaagaaagtttgctggttagcaatggggagctaatggggcagtaaaggatttttgggcccaagtttcaggaaagggaaattcaaagggctgaccccaacattgcaac

SEQ ID NO: 485970 - DNA, 1239 bp, Homo sapiens
  misc_feature (550)..(550): n is a, c, g, or t
  misc_feature (840)..(840): n is a, c, g, or t
gagtcctggtatagcctttcagggattagggattgggttttattttgtttctcgtcttttataatactagaatatctcagttgtttatagaaaggtagagttgtaaaatgtttattggtgccattgattggtaactgggcatctggaaagaacagtaggttttactccatgataaagtggattccagtaagaattttcagtagtataccaggtacctggaaagttcttcagataagttagtagatccaaggagatacatgcctcagtgagataaactggacctttttactagctaaactatttagccagagcaatactctgtagaactggtgcttttctaaagtaaagattatctggttctcaattttatgtgcataatacttttcctgggggctagcttgtgataggcaaaatatttggaccatgtgggtcccataatgatggtgctagtccataagcttggctgtatgagtgtaatcataaaaattatttccaagccagttttgccctttattctacattctgggcttgtcatatggaatctaacggnaataatatccccacaggtgggttcagacttcatgcaaagaaattcaagcatatatcttctaaaaggtttaggacgggctcgcaatttagggccccccttagggcttagattgaccctaacacatttgggactggacatttggtgtaccccacgtgttctaccgcaacttcgccgtcgtcagcgcagcagcgcgccacaggtgccacctcgacacccgtggacagcgcgtggtatccattctactcttctcatggtcttttcttactagtgtgctttcaatttattctctngggagcgctgcgataccgcaacccgccaacgcaggcctaccgaccgcgtagaccagcattaccgccgcaccaagacaacatatgcacgtcgctgctagacgacacaagcagagagaagagtcgcagactcgagaagggtagagtctaacgcagaggacgacaggccgcaacgccaacgactcaagagatcgcccaaagagccacatacagcagcggagagcggcagcacgacaggaaaagcgggcgcgggacggcacagagagaccaggcaagagggaccacaactcggccacgagaagaacagagacgtacgagccagcagcaccaccgacgaaccgccgaccgcacacacacaccagcaaaaccaaccgacgacagaacacggcaacccacaaccaa

SEQ ID NO: 485971 - DNA, 268 bp, Homo sapiens
  misc_feature (186)..(186): n is a, c, g, or t
  misc_feature (233)..(233): n is a, c, g, or t
  misc_feature (250)..(250): n is a, c, g, or t
gtacatatataatgaatggataaaaaattgtagcatatccatacaatggaatatcattcagccataagaaagaaatggcaggccaggcgcaacagctcatgactataatcccacgtgctttgtggaggccgacggcaggaggattgcttgtaagccatggagtttgagaccagtcctgaggtaacnatagctgagaaccccatttttacaagaaacttttaataaattgaccnaggcatgtgtggcacancctgtagtcccagtctat

SEQ ID NO: 485972 - DNA, 816 bp, Homo sapiens
  misc_feature (354)..(354): n is a, c, g, or t
  misc_feature (424)..(424): n is a, c, g, or t
tggcaaaaaccaaaacagctctttccaggcgggttggaggttttttaaaagctggaggaacgccagatttccaaaagggaaattggtgcgtttaatccccagccaatataccgaggggttccccccatttttggggggccgcgggcatttcaaccttgaagcaattgggcctcgaaattgtgggtgaaatcctgaaggccaaaccattttccctgtgagcacaacttctgtcacaggtgtgccccaacccctaatttgtcccgtcacaagagggcaccataacgtgtctgccgtcccccgcgtctcgcccagagtacattagagtgcatcccccggccttctgtaattttgcangaggagattggacaggctccctgggccgggggatggaaagcagcctcgctcttaggttcgtgttcgcacncactgtcaaaccccagtatggctcaagccctaacctgtagctgtggggcttctgtgtttgtaaatgggcagtcctgaccagagtgccagacatcgcgtgattcaggtggctccaagcgaagccaagggagctgagctggactttatactcctttaggaatttctaggacggaatagatcgtgttgttccatctcgctccaagggaggagttataggtggcaatttggaattgtgggaccctggcttttcccgaagggagacccccctttgctctcccccgatttttttttgccttcactcccctagacgtgaaaacagctctgggttgtttaaccatatatctctttgcacacatggcctctgctttttgtgcgccgaaaaataaaaaaaaa

SEQ ID NO: 485973 - DNA, 351 bp, Homo sapiens
  misc_feature (32)..(32): n is a, c, g, or t
  misc_feature (236)..(236): n is a, c, g, or t
  misc_feature (288)..(288): n is a, c, g, or t
  misc_feature (312)..(312): n is a, c, g, or t
  misc_feature (333)..(333): n is a, c, g, or t
  misc_feature (345)..(345): n is a, c, g, or t
ggcacgagcagcaaccggggaaccgcgccaanagctccggcgctttctccatcgccaccctgcggacttcggggtgggcaagcgaggcatcgaggagcgcatccaggaggaggcgggcttcctcatcgacgccctccgggaactggcggcgcaattatcgatcccaccttcttcctgagccgcacagtcttccaatgtcattcagctccattgtcttttgggggaccgcttttgantattaaggacaaagagttccttgttcattgtttgcgcatgatgcttagggantttttccagttttaagttcaaacntttcaaggggggcagtttttntggagatgtttntttttt

SEQ ID NO: 485974 - DNA, 900 bp, Homo sapiens
acttcattcggggccgggttttcgttgttaaattagctggtgcctcggcttacaatttaccacatcagaggtcacctgagaatcaacgggatccctgtggagagagctaggacaaagaccaaagtaccggattcagcgtggcgccctgatcctgagcaagtgcagccagtgacacaatggtgacccaatgtgaggccgcaacggacacgggctcttgctggccaatgcctacatctacgtagtccagcatgccagccaagatcctgactgcggacaatcagacgtacatgagctgtccagggcagaactgcctaccttctgtgcaaggccttcggagcgcctgtgacccaatgttacagtggctggacgaggatgggacaacagtgcttcaggacgaacagcatcttccccctatgccaatgaaaaccctgggctattacgagacctccaggaccaaagacaccggacgacgtactactgcctgggctgaccaaatgagcaaaacacaagttaccatcatggactaacctgaaggttaaaagatgcaagctcagatcacatcaggggccccgcaaggcaaccaatcgagaagaaaggttcccagggtgaccttcacgtgtctaggcctccttatggagcgcctcccttagcagcccagaattcacctgggcgtgaaggaaatgttcgagaaacctccagggaagctggggggacaagtgacaagttacttcaataagaaggatggagcgcctagttcatcacacaggacaggaacaacagagaccaaggcaactacaagataatgtgcagtacggacacgaataggtggaaaaaggaacactgctatgagacccggcactacacaactgattagccaacacaaaaaaaacaaaaatgata

SEQ ID NO: 485975 - DNA, 106 bp, Homo sapiens
tggggggccccccccccccccccttttttaaccaggggttcttgggccggggaaatttttccgtttttggtttttttaaacctttaaattaattgggaaaggggga

SEQ ID NO: 485976 - DNA, 278 bp, Homo sapiens
  misc_feature (47)..(47): n is a, c, g, or t
  misc_feature (78)..(78): n is a, c, g, or t
  misc_feature (91)..(91): n is a, c, g, or t
  misc_feature (191)..(191): n is a, c, g, or t
ccttggaatgctttccccggatatgtggctctgccctggagaacatntgcaacacaaacgagttctacatgtcctatnacctgttcattgnggcctgtgcaggagctggtgccaccgtcattgccctgctgatctacatgatggctactacatataactatgcgggtttgaagtttaagagtcgggaagantgctgcactaaattctaaattgcataaggaggtttagagagctatgctctgtagcatgaaatattactggccttcagactaaagcag

SEQ ID NO: 485977 - DNA, 356 bp, Homo sapiens
cgtaccccgagaagactgctcacacccaccagcgtcaccgaagtccgtcccaaagccaatgacggtatcccgcgcagcagcaacgttgatgtgatcgcggtaatcatggactgcccgccacgtcgttgaacaccagcttgtccgtcgcctggtagccgatcacccggatcattgccaaactgcccgctgaacaaaaacgtgttgtacccaactgctgtcgcggacgtggtgtcacttgcccaggaccaccattcgataaacgtccgacgccccatgccgccatttgactcaagatcagtcgccgatcgcatgccgactgatgaagagtattgcccagccgagcagacgatttcggg

SEQ ID NO: 485978 - DNA, 350 bp, Homo sapiens
  misc_feature (1)..(1): n is a, c, g, or t
nacgtagagttcaactctttataacccgcttacaacaccagttccttagaagccaacatcacaggtgggtcagatttccatatgagaaccaaacctggccacttacagcaaaatatcaaaatgggtaagtccttccttcctcttcctcctgattatatccaccatatctcctttcaagactattatttccttcatgcttattccttcacaattctaacccttaaggtgatatgaaggaacccaccctcaagaaaagaaacctcaattcaaatatgaagaaacctgccaggtacacaatacacccacagagcatctcaatatccgtggcacagtacatattcctctcgtgc

SEQ ID NO: 485979 - DNA, 90 bp, Homo sapiens
accaagagggagcctttaatagagaccggcacagacaggagacacaacacccaggccctgcaagcacaggctggggcctgagcaacagag

SEQ ID NO: 485980 - DNA, 100 bp, Homo sapiens
gccccccccccccccccccccggggggggggcaaatttttggcaattttttggggggggttccctggcccgcccggggttaaaaccccgggggtttttga

SEQ ID NO: 485981 - DNA, 1720 bp, Homo sapiens
agagtgcctcagagtgtggagaagatcgctactgaatttggatggtggtgtgccctcagccatgggcatgcctcatgtgactgtgtggacccatgtgaatgtgtggcgtgtcagtgaccctgtggtgaggcatgtgcatgccctgcctgcaactccctgtggacgccatgggctggcctgacaatggtgatggaacgctgtgagtgaatggttgtgactgacgtggttgctggtgtgacatgatgcattgctgtgttgtgctcatgtagtgcttgtgcttgccacaatgtacactattgtgacccatatgacactgtgtgtccaccattgccccccaatctgtgtgtgcagacccacaaatggccttgggaccacatgtagacggaacgaggggtatgaaggacggacaccacgaacgggtcgaaactgtgggacccaacaatggaacggtagccccctgtgcgcagccctatcagtgcactgaacccacaatgggaccaccaatgacctcagagcccaagggaccacttgcgacggcgcgagcaccgaacgcgcgatgcacagaagtcagcccccaactcagggcagggaccccaccctaagcagcacaccacagacacacaagggaccaggggaacccattgccacgagagagacacatgagggcgccagagcgcagagagaacgaccacgaagatcagagaacggagaccgcacgctagtgagagcccacgtcggaccaacaaggaccaactggcaacacatcggcaataggccgaggcaccgaagcgcacaagggcaccaggacgaacggcctcaacatcgggcggagaggagagagccgcgacgaggacgccacacacgaccaccctctgctgagcagtcaaacaagcactactgaagcggtagggcacagaagccacatatggtgcgcgcgttagagtacttccgcacgcgagagtcgatggcgaacagaacgtacgacctcggggtcgtcaggctaagtcggagctcccccacgttagagcgtggggctagcaccactagaccacagcagtagcagaccacatgccgcgtacctcacagacctccggatttaggcctttcctcctagctctgcgagtattaggtaagctaccactggttcgcgacaggccactactagcctacgccgtgtcgtacggtgcactctgctttatcagacatagtctcgatctagacattcctatcactgcagcccactagtctcactttaccacccaactctttcgtgtctacacacacgctagatccgactgctgaatagcgcaatcactgactataagcgcgtcgctcctccaccatcactcccgcacacctatgcgtcagtctccctctttcatctggcacgcggcgaggacgaggctactcagcagcacccgagcccgcggacgagcgacgcgagaggacgggagctcgcgacgagggaggcagccgcgccgcggacgagcgcgcaccgccggcgacggacgagcgcgtgaccggagacaagacgcaggcgagacggcgacgagacgctgactcgaacgcgcggcgcgctccgacgcgcagcgaccgccgccgcgcccgccccgcagaccgatccgatccgcgcgcgccgacgcggagaagcaagaccgatgacggacgcaccgagcggccgcgccgagaacagcagccacaacgccgcagcgccgcggcg

SEQ ID NO: 485982 - DNA, 612 bp, Homo sapiens
tccattggatagcggatagggatggtctgggtatggcaggaacgaaggctctagataaacagggagcgcttggagcctggcccctcctgctggggcttcttgatgtttccgtgtggaagggctgaaagcaaggagagggtggttggcccgtctttcctagcctgctcctccctccattcttcaccccacaaggcctagactgtgcggctggctaggaaaggtccagggagttcacccaggccctgatctgggggggcaagcagcttccagagccaaatgggtagggagagccgagtgacagtcagagctagaggttcctctgcccagtcagcccaggcatcccttgtctacccgccaccatggagccaaggctgtggtggccaccctcagtggatcttgtaccctccaaggcagcctaggagtggggtgggagtgggcggcatctgcagcctgaaatgggctgaggaccactctggctctgaggcgtgggggcctgtgcatcagatcccgtccaggcactctagggctggaggaggggcaggccacgccggagtccctccttcaggaactgcatgtaggtggccgtggacgggtcttcaaaggtggatgaga

SEQ ID NO: 485983 - DNA, 115 bp, Homo sapiens
ccttctagttgatgttgtctagcaatgctccttgcctccgctgtgtcgctctgggagggatgtctagccctccctggctgtcagagcaggctctgcctgaggatacctccatccg

SEQ ID NO: 485984 - DNA, 270 bp, Homo sapiens
cggagatgttaatcaaagacaccaaatttcagctggaccagaggattacagttcaacgagatctatggtacatcgtgatgactacgttaataacaatatattatgtactgtgaaaattgctaagtgcagatatttacagtgttctacacctacgaaaaaaaataagtatatgtgatcatgcatatgttaaatagcttgatttagccatccacgatgtatacctattttaaaacatcatgtagtccactataaatatatacatacaatttt

SEQ ID NO: 485985 - DNA, 872 bp, Homo sapiens
cagcgccctcctgcaacgctcgctgcacacgccccttgcggcaccgcgcaagcccgcgcgctgcgcctgccattcgcacggccaagcgccgcccccccgggcgcccggcttcccgcgcacgggccctcgcactcccggcacttctaccagccactgagcgtttctgcccgcttctgcctgagcagcgacgccgactctagctccctgcaacggccaaggcgaactcaggccactgaacgtcacttcaacctatcaacccctgcaacacacactacagcctgcagctggcttctttaagcaaacacactccctttggtctggtgccagcttctggcaaaaccagtcacgggctcagctgatctacgagtctgccatcacctgtgagtacctggatgaagcatacccagggaagaagctgttgccggatgacccctatgagaaagcttgccagaagatgatcttagaagtagttcctaaggtgccatcctcggtaaggaagctttattacgaagccaacataacgaagactatgatgggcctaacagcacgaattccgcaaagaatttaccaagctagacgaagctcctgactaatatcacaacaagaccctctctggcgtgcacaccctatcccccataaatgaatcctcctcgtgcccggtttaacggctgtacccacagacttaaaagcagggttaacccaccctcaaactgcaccgcgcggcgcccccaaggaacccccgaacccaccgcgccaactccaaaacgccggcccacacaccacacaccaccaccagcgcaaccacacagacgaaaaacacgggacctccgacgaaacaaaacgaggataaccccccccgccacagcacagca

SEQ ID NO: 485986 - DNA, 297 bp, Homo sapiens
gctcggcctatcttagttcggggttgggcgggatggcgagatggggttggaggggcccaggatccgggcaggccgagtgtgagggtccccccaggctgggacatctcgtcgctgaacctggccgaggcgatgcggcgcgcgaaggtgctggactggtgggctgcagcgagcaacctgtgtgcctgcactatgtgagtgccctgctggcccctggccattcttgtttacatccccagaattcatcagcggccaaccagagcgcgcgcgcggacaacctcatcccaggctcgcgtgcgc

SEQ ID NO: 485987 - DNA, 133 bp, Homo sapiens
tttttggtagagccgttaacacttgtccgtatttagaggtaacttgtgacatttatatactatcagtctcacactgcttgctatgcactaccgacagatgtggattactagtatttcattcactcctggaggg

SEQ ID NO: 485988 - DNA, 662 bp, Homo sapiens
tgaaaaaaaaaaaaaaagaaatttttaaaaacaaaaaaaattttaaaaaaaaaaaaggagaaaaaataaacaaaaaggaaagaaaaaaaaaaaaaaagaaaaaaaaaaaaaaaaaagggaaaaaaaaaaaaaaaaaaaaaaaaaaaacacttgtggcccccttggcccaaaccgtttttaactggggccagttttttcctggggcccaattttggggtcatttggcccattcccccttttgggggggattttaaaattccagggccggtgttttaaaaccgcgggactgggaaaaccctgggggtcccccatttaaacccctttggaaaaattccccttttgcccgggggggtaattgcaaaaggcccccacccggaggccctttccaaatggtggccacccctaatgggaaagggaaatttgagggggttaattttggcgaaaattcccggcaaatttttgttaaactcccccattttttaccccaagggccgaaatttggaaaacccctttattataaaaagaatttccccgtatagggttcggcggtttctccaatttggacccaagggcccctttttaaaagccggggctcttcaacgctaaagggcaaaaaccgcttttttagggcggtggcccctctcgtggaccccttcccctta

SEQ ID NO: 485989 - DNA, 156 bp, Homo sapiens
gatcatctgagcatcccccgtattgacattcaacaccccacaatactatgctccctttcgtgatcgtggggttgtacgtattgcattcaacacaccacaatactatgcttcgcacggttagggaggctaggaaagatagtgatcgtggggttgtaa

SEQ ID NO: 485990 - DNA, 632 bp, Homo sapiens
tccaatattggtcaaaaccaattaatattttgtgggaggaaaaatctggcttacccagtacaatctttattttctccgaggcaaataggttctacaaatatatcttcctggtctctttggagacaagaaactctcagtcttcaccactttggccagccggggaagcccttgggaaggggaatctgggccgccatctggcccccagtctggcctcttccccagggggcaatcttcaccaaagtattgtgggaatatcctggggccccccccacacaggttcaggtcatatcgctctccattattcttctcctgtgagacacccacccacctctctccatctctgtggcctgtgctctcccaccaaccccccaagacacgcgggtgtggcgcccagggctctccagggccagtgtcgccccacatctcagagattactccagacacgttagagggcgatatcttctccccaccggtcgctgtggtgcgtggaggagagaacttttccccaaatctccttctccttcctctcttgtgtgttccaaggaggctgtccaagagcttggagggggccccccagctccgaggtgtggaaacggaggcccggaggctatcggggaatataagaagtggta

SEQ ID NO: 485991 - DNA, 129 bp, Homo sapiens
cgcggtcatacagggcctgttcaggcatcgagcacgaagtctgtactcatggtgttgctcacgcgccagccgacgatgcggcgagcgaatacgtcgatgacgaagccacatacagccagccttgccagg

SEQ ID NO: 485992 - DNA, 142 bp, Homo sapiens
ccggatcttatgtatcccacccccacaaaacaaagtagtataaactcccccccgcataagttacacatccaaactctacatttacaaaacgaattcagggtgaggaagtaaaaacaggtcatctgggtggggataccagggg

SEQ ID NO: 485993 - DNA, 583 bp, Homo sapiens
gaggagaggtagagaggacgcagacagagcatatgtaccagtatttgataagggtctgaaggaggacagtgctccttggatgaaggaactacattatgtagcagctgtgtgagcagccagtttccttgattctcctgggctggttctggttgtatctgaggtcaggaagctacttaatgatcatattgaggaagccctgcagagctgtagaattttacaagttaggtcttaaaagatcagatcactggtagccatggagtttttccaaaaatggttgactagaaatcattaaggaagaaataaatatatagtaaaattcctttctgccactgaagaagccttaacttgggaaacatacagaagtttcggtgtgtcccatttacctggtaaaaatcacattatgacattttttatgataggaaagttgttaagactatatcaagctggtaaacttatgagttctaaagaatactttcaagatagttttattactggaaaaaatataagccactgttgcccagcccatcaaacagttttatcttcagagatgggattatcaaatgaacagacacaaagccattat

SEQ ID NO: 485994 - DNA, 317 bp, Homo sapiens
tgtctatcaggacgtgtgtatccaggcagcagtggctggggccagtgtgcggtgtgggtggggagtgatttccaccaggactggccctgtacggggtgagctgtgtcaaagtagctgggagcagctggtgttgatagtggcataagggacgtggagagcagcctgggaggcctgcttgggtgcccatgctcgtgctctcagcgcctaggagctgctgtgggctggctgtgagcctagggggtttttgcgggttgcttcctgtcggcaccgccgatgaaggcggtagccacagttcaaagagaagggctccttgagac

SEQ ID NO: 485995 - DNA, 252 bp, Homo sapiens
cttcaggaaattttcaagacattttacttaggcaagcacagtggcaggaaactccagtggcagtcaaccttgggacactgtgtgctaaaagctgaatttaaagagggcaaaaaagaacttcaggtctctctttttcaaaccatggtgcgtgctaatgtttaatgaaggagaagaattcagtttagaagagatcaagcatgctactgggatagaggatggagaattaagaagaacactgcagtcactagcctg

SEQ ID NO: 485996 - DNA, 125 bp, Homo sapiens
tcgatcaggagcaggaagcattacagaactcagccttcttgaaactggcaaactccgtcaccgctcagtgacttgcaaacgggggttcagtataacatcactatctatgctgtggtctgctgcag

SEQ ID NO: 485997 - DNA, 370 bp, Homo sapiens
cggacacaggaacgccgtctccttcattggggacagtgcgtcacacttaccgccgccgagagagggacccaaatacagaccgggctaataatctgacttctgggattaccacacaccaaaccaaagcatccacaggaatgaaagcagcagcactaatccacttccctgaactacagcccatcacagaacactggtctcgtgacgactcggactcatctggactgaagagtttgtttactaaaataggtactttagggtcaggcgcggtggctcacgcctgtaatcccagcactctgggaggccgaggcaggaggatcacctgaggtgagtgattactaaatcaagctgctaccaacgagagaaaacttcc

SEQ ID NO: 485998 - DNA, 120 bp, Homo sapiens
agttctctgaagtcatccttatggccccttccacagagccattagacgcatcccggcactcaatggattaccaaggctggtcacaagctcagttaaatgcgcggcctcacgtaagcgggc

SEQ ID NO: 485999 - DNA, 366 bp, Homo sapiens
ctgcaaggttgggcttacacctctgaaacaaagcacgagctatacttggccttttagcgtgctggagcaaagcagctgggattcagggcaacattgtcctgaggcagcacagagcagggagaccctgagcctggccaaggaaaacatttttctctcccataggagtggctgccatgaaagtctctgacatgcgcagagatttttttcccattgtcttggagattaacattcagcttctcactacttatgcaaatttctgcagcgggcttgaatatttccccagaaaatgagtttttcccttctatcacattgtcagtctgcaaattttctaagctttttatgttcgttccatttcgggtaccgagc

SEQ ID NO: 486000 - DNA, 332 bp, Homo sapiens
  misc_feature (255)..(255): n is a, c, g, or t
gtacaacgtatgaataaaagcagccttggggcggggcggggcggttaacaaaatgcatctcagcaccagcctagagaaacttttctgtgtgtaaacagaagaggggttaccatgcgagaaattcattacaggatttcggagagggctttttccttcagacatagcagtgacaaagaataacgtcgtggtgcaactaaatctggatactggacgctggtgtcgacttagaagtccggtccacaaagttcatcttcnaggcaattatgcctagagtgatcaacttacacattcttctggcaacacggtgacacgtaacctgttgcagctgtgct

SEQ ID NO: 486001 - DNA, 888 bp, Homo sapiens
  misc_feature (25)..(25): n is a, c, g, or t
  misc_feature (61)..(61): n is a, c, g, or t
  misc_feature (73)..(73): n is a, c, g, or t
  misc_feature (109)..(109): n is a, c, g, or t
  misc_feature (130)..(131): n is a, c, g, or t
  misc_feature (134)..(134): n is a, c, g, or t
  misc_feature (138)..(138): n is a, c, g, or t
  misc_feature (171)..(172): n is a, c, g, or t
  misc_feature (185)..(185): n is a, c, g, or t
  misc_feature (188)..(188): n is a, c, g, or t
  misc_feature (192)..(192): n is a, c, g, or t
  misc_feature (195)..(196): n is a, c, g, or t
  misc_feature (201)..(202): n is a, c, g, or t
  misc_feature (208)..(209): n is a, c, g, or t
  misc_feature (211)..(211): n is a, c, g, or t
  misc_feature (213)..(213): n is a, c, g, or t
  misc_feature (216)..(217): n is a, c, g, or t
  misc_feature (240)..(240): n is a, c, g, or t
  misc_feature (242)..(242): n is a, c, g, or t
  misc_feature (246)..(246): n is a, c, g, or t
  misc_feature (270)..(270): n is a, c, g, or t
  misc_feature (310)..(310): n is a, c, g, or t
  misc_feature (340)..(340): n is a, c, g, or t
  misc_feature (386)..(386): n is a, c, g, or t
  misc_feature (413)..(413): n is a, c, g, or t
  misc_feature (420)..(420): n is a, c, g, or t
  misc_feature (423)..(423): n is a, c, g, or t
  misc_feature (433)..(433): n is a, c, g, or t
  misc_feature (474)..(474): n is a, c, g, or t
  misc_feature (521)..(521): n is a, c, g, or t
  misc_feature (882)..(882): n is a, c, g, or t
tattttgctatatctgtttctcagntaagcaggaacagctatcctaagctgggacattacnatacctataatnaccctcagaacacaagttccattaagtagaaaggangcatcatatgtgttctttttnnggngagngccccccttgggggggagagacatacccctaannatcttactctacngtncaanggnnggggnngccacnngngnggnntcaggggactgggattggggggngngatngggggaggggggagaggggcgagnggccactctggactttgcatcttggagtttcaattttgcnttaggatttagaccccagtttataattaanaccaaatcattcccacattattatacttatgtaggaaagccttgcngtgtccactgttaacacaaagataganaatggcnaanagtttaagcnagtatttggcagaccacagacatgaaacagtgccggcgganacggaaacactttagtgttttagaggtgagagagagtgaggggtgtnagggcagagggcgcagctccttcttctacatctttcagattgagtacttccaaagaacctttgcctttagtttccttttttattagctcatcaatttctcggaagcagcccgggtcaatcagacatacgatttctaactgttggccataatcttcactttctatgaccttgatcagtggcttgagcttttctttcagcttcttgccttcattgactggaaggatgaaccgaagcctcatgtgagcacgttctatcttcattttctcttttaactgctttatcacttccaaagcctgctgttttgtactcttgttgggtttcaccgaatagtggatgtccttcatggctctctcaataaggntcacgg

SEQ ID NO: 486002 - DNA, 125 bp, Homo sapiens
acaggaaattcttcactccagattcctcctttcaaaagcaaccttcaacagactcatataatatgtatgctgggcaggagtctggagcacattcttacagatgatgtagtttacagtgttatgat

SEQ ID NO: 486003 - DNA, 918 bp, Homo sapiens
  misc_feature (18)..(18): n is a, c, g, or t
  misc_feature (66)..(66): n is a, c, g, or t
  misc_feature (68)..(68): n is a, c, g, or t
  misc_feature (75)..(75): n is a, c, g, or t
  misc_feature (79)..(79): n is a, c, g, or t
  misc_feature (93)..(93): n is a, c, g, or t
  misc_feature (143)..(143): n is a, c, g, or t
  misc_feature (183)..(183): n is a, c, g, or t
  misc_feature (188)..(188): n is a, c, g, or t
  misc_feature (197)..(198): n is a, c, g, or t
  misc_feature (310)..(311): n is a, c, g, or t
  misc_feature (375)..(375): n is a, c, g, or t
  misc_feature (383)..(383): n is a, c, g, or t
  misc_feature (397)..(397): n is a, c, g, or t
  misc_feature (399)..(399): n is a, c, g, or t
  misc_feature (467)..(467): n is a, c, g, or t
  misc_feature (484)..(484): n is a, c, g, or t
  misc_feature (499)..(499): n is a, c, g, or t
  misc_feature (506)..(506): n is a, c, g, or t
  misc_feature (510)..(512): n is a, c, g, or t
  misc_feature (529)..(529): n is a, c, g, or t
  misc_feature (531)..(531): n is a, c, g, or t
  misc_feature (536)..(536): n is a, c, g, or t
  misc_feature (542)..(542): n is a, c, g, or t
  misc_feature (658)..(658): n is a, c, g, or t
  misc_feature (663)..(665): n is a, c, g, or t
  misc_feature (670)..(670): n is a, c, g, or t
  misc_feature (675)..(676): n is a, c, g, or t
  misc_feature (691)..(691): n is a, c, g, or t
  misc_feature (704)..(704): n is a, c, g, or t
  misc_feature (716)..(716): n is a, c, g, or t
  misc_feature (835)..(835): n is a, c, g, or t
  misc_feature (917)..(917): n is a, c, g, or t
cattcttttctcatccgngtcctttaactgctaatattacctttacagagacaaacattataaaangngcctgantggnaatttattaactcnatctgtcaagtgataatattctgtaggcagcctttgaaatgatgtgttgngaatttatttacaaccattgaacacagatggttttgtaanactgncaattagcnngcgccttaaactcacaacatacatatatttcaatatttaaatagcctgttttcttcaaaagtaattttctactgctttttcataaaaatataaaaaagacaacatttatagnnttaaaaacctatatttaacccaaatcaaatgtttttctacaaatgatacctctttccaaaaagngaaaaagncatcacagaatacngngatgttaaaccaaagactcatcacaataacagcgttttacttttaagaaatattgtgcagtatctccnttttaacctttcatgcnagatttcaactatgngtatccnatgnnnacggcgggcagtttgtngngagtngttcanatatatgcagtagactgtcatatatgaccagttaccatacaaactataataccatattttcaaaaatagcaaaaagcaatctttatgaaagcttaaaaaaagcttttaataaaagncgatnnncattnttttnnttttcagtaaaaatnacctcttcttccnacctttcccccngctttgaatggtaccttttattgcatgttaatacacaaagatatttctagcacttctacttaagtgagcctcttacatggctgctttcttttctgatacactgacttttaacagaaggnaccaagattagactcctaagaagtttcaatttttgttgtcccttttttaggttcctctagaataattttcctcagaaaaggnt

SEQ ID NO: 486004 - DNA, 1272 bp, Homo sapiens
ccctagagagccctgagcagccccaccgcctgccgccggtcctagttaccatcacaccccggtgaggagcctgcagctgcctgctagccggcccctattctaccatcactcgtcataccatgtagcatgctgatggcctgataccctagcaggcctgcttcgtggttccccttgtgtgtggtcccatccgtcgtccaagattacctaattgcccttgcgcacacatgatagagcaccgatacagcacgtcactcaggtagcgcaccgatcgtgccgcagcaggaccggccttgtacaagcactaatattagccatgccatgctcatgcatacgcagagaagcgactactaggtaacgaataaagacacacgtataaagcgttagatcggtggatcccaccaccgtaaatagatataggagcaacacaaaagagtacgcataacatcagggcgcgcgcgagcaatcaataggacaacttaaacaaaatgggtaaccactccgcttcgagaattgctgcgcaccccacaatagggtccatctcacgcggagtcaatcacctcaggctagagacatctatgattctctactggtcgacccaacctcgacgatgcaggacccaccccacactcatcacactcccaccctctagaacgcgcacacagcaggagtaaatcctcatttcttccctacgccgaccataccagtacctacacacgagaacgccgcagctccggacgacccagcccccacacacatacagcacaagacgcgtcgtttacccgcacccggcacacggtctgcctgataaccaaccaagcgcgcgcggcgcagaccactacacactagcggcagagcacactcccatacgtagtcgacagtagcagaccatgaaggaacacgcccgaaccagacaccacgctgcccactaggggtagtagttgttagtatgagacacctactattaacgtcacttagacggcaacacagccaacacatacacagtacacacgaaccaaacaacactaaaaagcgtcactatcaataccaagtcgaacagccccccccatacaagatctatggcacaaagcaactcctccacctttcaacggacagtataatcctattattacagagcagaaagtgtcgataatgcagtaccagcatttcgctagtagactatgccacacaccaaagagcacgcaccccactcacggatacagaaacagaactgcgttattggagcaacctatacacgatagtcagcgcaacaaa

SEQ ID NO: 486005 - DNA, 1045 bp, Homo sapiens
ggagagaactagttcgagtttttttttttagggtccaaatggctccaaaaaagaagaaaaataaggggaaaaaaggtgttggagccttctcaaagcactgctgccaaggtgcccaaaaaagcgaagacttggattcctgaagtcatgatcagaaagcagatgttgtcagcttggaaggacctgtttgtccccaggccggtaactccgaagcactcagcttactaaggctatctctgcacccacaaccaaatccaagccctgaccttggcacctgccatccgtgacaaatgtggacatccttggggctgctgaaaacaggaaggtgggaaaactctgtgcctttgtgccatcccaagtgatttcatgcggtgttgcagtggcaaaagcaggaatgctgccccttcactccaagtaacaccgaagcaccaccgtggagagaccagaaactgaggccggagctgagattagaatccaccaggcaaggctgaagctgagtctgatgcatgtgcctgaggaatactgtaatgtgaaagtgaagcactgcccagggatatggcaagccgaggccaaagccaagactggaggcactgtctcaaaccaggggtaagctcttgggtgacagataatgctggtgaagggccttatccctgatacagggagaaactgttcccaaacagattgagaatgaggagggaaatcttgataaagaagcagactgggaactctaagaacaaggagtagaatgaacaaagggaaaacttgaaagggaatttcaaaagggtccatttgttggacattgttactgaatcacatattagagagaagcgtggacacgacaagtgttcaaaaaaagcacaaattgaatgccttagtgcacaagttaccacgaaacataaacacactggaaaataagagtaatagaagaaaattccaccagcaacaaagcgcaacagggaatgtgtaacccggtgagccctgagcaaacggggattggacaaaccaagaggcagtagagtgggagaaaaaatacacacaacagcctaca

SEQ ID NO: 486006 - DNA, 289 bp, Homo sapiens
tacgtacttagtctctctatacttcaacttctagcactagatagcgtactatgtttggcctctaacttcctatatacttgtcactataacaggctgatgatcgaggcgtacggcccagcttagtacaaaacttcataccactcttcatcgtccccacagataatgtattcagagaggtccatgctcttcagcttccctacttccttctagtgtttctcctgaaattcctttgctgcttcatctaggtcgtcactgagggtcttcatcgtgggccaccataacactgacc

SEQ ID NO: 486007 - DNA, 1072 bp, Homo sapiens
ggcacaagcacgcctcgacgtgcttggcagggccgcatctagtgctacccaggcgctgacgatgcagttggcactatacggatcagaggctgtgcttgacgagatgatccgtagctggtggtgccggaacaggagaggctgtactgtgccacaaatgaagtggtagaggtggagacgccgtgctggtgaatgctgtagatagaaggagctggcgtgcgagaacgctagactagtgtgcaagcaattgggcgctgtgactggtacaaagatggcgtgcagaatgggtgtgcctatcgccgtagtcagctcgataaacacatgttcgtgtggctagttgcaggttctagaacatgaaataaggccattctgtgagtgtgacgggatgtgaatgtgctatgctggatatgccagtccagctatcagagtcagccatggggaacacttagtctactaatagaagactggaagcgtctaagtcatcccctggatcggtgtccgtgtccttaagatcatcgaagtactgggtgcctccggacgctgtggaagactcccccaagtatgatctgtgttgatgtaccagcctggagatgaacgagtggacgattgacgcgtggctactgtgtgaccgacctgtacctggtagggagtgtgggctctaggacgtgtgttaatcccaaggggagggctcgacagatctttggcgggaggccttggggattgggcggtggcatgcctcataacaagaagttcgacctccggggggatcaccttacctaagcaagatggaggaagtactacaaccaagggggggcactcagccactgaacactggctgcacgcgagggataagccgactccttcaccaaacgaggacacagccgacggagacacaatcccaaagtacaagacgcggaaggaccctccgacgtcccgagaaccttggatgtacaccaaaaggggcgcatccaggaagagtgacccaaaggggaagtcctgcatggcggccggaacacttgcgacctgaaaagaaacagagaaaccacaaacaaacaaaacccacgaaaaaaaaaca

SEQ ID NO: 486008 - DNA, 182 bp, Homo sapiens
agattcatcagactatgccactcttctgctccaaaaccttcccaaagcttgtcacctcactccagagtaaaaaaaaaagacctcagccaggcacggtggctcacgccggtaatccgagcactttgggagtccaaggcgggcagatcgcctgaggtcaggtgttcaagaccaacatggccaac

SEQ ID NO: 486009 - DNA, 256 bp, Homo sapiens
  misc_feature (12)..(12): n is a, c, g, or t
ccggtggccaantggcatctctcatgagaaaacttctgagtgcagcatgtgctggggcgacactgttgggcttcagcaaggtgcttccaggtagatgtggtggtcactcagagccttgtagacatgagcagcaccttctcggtcacatactggcagctgcttcaagtcatggtccgcatccggcaggatctcaggctccatgatgggcacaatgacattctgctggtagatactgtgatagtggcagagcggggta

SEQ ID NO: 486010 - DNA, 258 bp, Homo sapiens
gacttagaatgcccccatacaaaacaataagctaccgatctctcctttgctgtcatgttcttactttttccctgtgtgttaaaaatttcagcccatgtccttttgatggcgacagccacattgtttcagtttataaggcacattcgaataccttttcccacttgctactcacacccatcacttgaggtaggcagtttgggttttatcagagagattagatgatttgaccaagaccccacagatgactaggtagacaaa

SEQ ID NO: 486011 - DNA, 1272 bp, Homo sapiens
  misc_feature (380)..(380): n is a, c, g, or t
  misc_feature (547)..(547): n is a, c, g, or t
  misc_feature (575)..(576): n is a, c, g, or t
  misc_feature (603)..(603): n is a, c, g, or t
  misc_feature (605)..(605): n is a, c, g, or t
  misc_feature (713)..(713): n is a, c, g, or t
  misc_feature (724)..(724): n is a, c, g, or t
  misc_feature (798)..(798): n is a, c, g, or t
  misc_feature (938)..(938): n is a, c, g, or t
ttctttattactattatttattatttctactattcttttaaaaaattattatcgttacacgcagcggttttaggcactatgaagtgtttattgcctcggggctgggaacctttgcgcccttcttcagctgtgctctcaggcagttaccggccagacccggaccggaaccttggcgcggtgacgctagtttccggcgggctacttagagcgccgaacagctctgggccaaaggaccatgagagggccggagccgggtccccaaccgacgatggagggagacgtgctggacacactggaggcgctggggtataaaggaccattgttagaagagcaagcccttacaaggcggccagagggtggattatcttcacctgaatttncagagctctgtattggttaggctctcaaataaaatcattatgcaacttggaagaaagtatcacgtctgctggaagagatgatctagagagcttccagcttgagataagtggctttttaaaagaaatggcatgtccatattctgtactcatatcaggagatattaaanatcgtttaaaaaagaaggaggactgttnnaacttctattatttttaagtacagaantncaagcttcacagatattacagaacaagaaacataaaaattctcaattagataaaaatagtgaagtttatcaggaagtcaagctatgttgatacacttggtatacccangtcaacaactnctgacattccgcatatgctaaaccaagtggaatcaaaggtgaaagatattctctcaaaggtccagaaaaatcangtgggaaaaccactgctgaaaatggatttaaattcagaacaggcggaacaactggaaagaatcaatgatgctctttcctgtgaatatgagtgccgcgacgaatgttaatgaaacgattagatgtgactgtacagtccttnggatggtctgatagagcaaaggtaaaaacagatgatatagcaagaatttatcagctaagcgttatgcttgtcaccaaagaaaaacgattacaatgggaaatctactgctggtcgtgaagatctaatccagatcataggaccagttctgggacagcggaaaaaacgatgtgccctataaggcgccggaagggcctgacaggaggcgggactgcaattggaccccctcgaaggcctggaaaaaaaggaggaaggggagaaggagaagaaaaaaacgggagaagaaaaaagagacgagaaaacaacgacaaagaaacaaccgaacaaagaaaacaaa

SEQ ID NO: 486012 - DNA, 482 bp, Homo sapiens
ttctttattactattatttattatttctactattcttttaaaaaattattatcgttacacgcagcggttttaggcactatgaagtgtttattgcctcggggctgggaacctttgcgcccttcttcagctgtgctctcaggcagttaccggccagacccggaccggaaccttggcgcggtgacgctagtttccggcgggctacttagagcgccgaacagctctgggccaaaggaccatgagagggccggagccgggtccccaaccgacgatggagggagacgtgctggacacactggaggcgctggggtgagtgcttttggagacgccttttccctgaaaacgcaacctctccttggcctggctgcttagcctacttcccttgggcctctgtgggcctgggcggccatgtgtaggcctccttccctgcctcgatccctccggcgccgacggagttaagcgggaggcgggagagaaatctattt

SEQ ID NO: 486013 - DNA, 442 bp, Homo sapiens
caatactagttctactactacataaatgtgaggaatactatattccactcacagaaactgcattatagtttgcaatcatgtatgtttcattgccagaaacgcttactgtgtatttgactgactgtacgtcacactattagttcataagattatattttcccatacttactacacttgttatatcctcactaatcatttggcttacattggactcatttccagcacttcgtttttgttcatctcgtgattaaaaaccctactagtgtaatttgatttgagccataaaacacattttaatattagcttgtattatagttattaagcttgtttttgtggaaaaaaacttactaaaacctaggtaactctagattaggccagttcaggtgtattttgtatcttagtaatggatcatatcgtacaaatagagataagttgggaagat

SEQ ID NO: 486014 - DNA, 313 bp, Homo sapiens
  misc_feature (14)..(14): n is a, c, g, or t
  misc_feature (22)..(22): n is a, c, g, or t
  misc_feature (165)..(165): n is a, c, g, or t
  misc_feature (210)..(210): n is a, c, g, or t
  misc_feature (287)..(287): n is a, c, g, or t
  misc_feature (306)..(306): n is a, c, g, or t
gggaaggctctggnttgggacnaaagtgtcatggcattacggctcccattgaggctcaagttcggctaaagggagctggctaggagccaaaggcagcgcatatggtttgcgggcgccgattcctacaaagatgctgtccgggccatgtttgcccggttcactganatggagtgagagagagagagagagagagatgacaaggagcacaanaagtggtccatctcccgaattcgctgataccgctgtctctttaagggcatgccttgtgctgtttagatcttagggtnaccacttcattctgcgggntctccct

SEQ ID NO: 486015 - DNA, 484 bp, Homo sapiens
gagtgcagagcatccagctgctgctgcaggcagcaggagctgtcaacagcagcaccatggtcagctccacaccagcaagcaaccttgcaaggctcatgtgggcattatgccaatctaccccaacatccaagtcatacgagcaacaatcaggtgcaagcagcaggtattagcacattccacggcttcatgggtcagtaggagtgcaatcctaggcattagggcacacagatacagcacaacttcaatccaaactaccattacataaccagtcacaaggagtcttgcatattatctcccaggagataatccacaggtcactgtcctcaatagcacatataaaaaaggacgtgatacaagagtggagaacaaaagtcccaggcagataaaagaaatcaacagcagaccgcgctggcaaggataccaggccagtggtcgatggacgtacaagcatacgatagactgtggagtaaagcccgcaagagaa

SEQ ID NO: 486016 - DNA, 338 bp, Homo sapiens
  misc_feature (75)..(76): n is a, c, g, or t
ggtattcacagatacatttattaatgccacattataaatggtacttagataagtgtacagtgatgttccatgttnncatctaacaaagcttgctcaagtttagccgacgtcttcatcttgtggattcggagcagttagtgatggccatgggcaggtgcaggacctttcaaagctttacttcttttatcagcactcctgattttatatacgatgaggctcattaaccccactcctacccaaatttcctggtaaacctgggtatagtagggtttcatggggacccagactttttgaatcaaggtttgaaacatctgtccaggctcgtgccgaattcctgc

SEQ ID NO: 486017 - DNA, 352 bp, Homo sapiens
ctaaaattggaaaaaactgtggcgaagatgagagcgccggcaagggcgtaggagatggaggccagcaagtcactcgaggtagatggagacaagcaggtggagagatgcatatggaacttgatgaggcaaagaaatagaaacttagagcaactccaacggttttgcaaatgagcttggcattcctgtttttgcaaaaaagtctataaaactcctatctaacggtttggcaaatgggctttgcatttttgttaacttggcaaaatcctgggatggattggcatatatgcaagctcgcgatcggcttggcattccgtctcatgcgctactcccgcgtgcgctcttccctctcacg

SEQ ID NO: 486018 - DNA, 374 bp, Homo sapiens
acacccccctttccgctaccaggagtttctgtgcctgaccaaggcacagatggtccagtagtagcttccaagtggacgattgagaaaactatataagtgaagcatgcaccctcgtcacaggcctcacatatgagccttatcgttagggcataagtcggtttgttccttaggtcactcaccgcccagcgggaatcaccaatgaagggaagtatggccggtctgggccaatccaggcattatgtcgtgtaacatagcagcgcttgttcttaacggagggtctggtccacttgcacccctcctcttgatcacgtgctatgtgtcacaaaaagtggcgccatgtgtccgcgttagcacaacatccactaacaccgtct

SEQ ID NO: 486019 - DNA, 168 bp, Homo sapiens
acagctcctgattagctggtcagctacaggcgcccaccgaccgaaacctgggtaattcttgtatttttagtaaagacggtgttttaccacgttgggcaggctaggtctcgcactcctgccctctggtgatccaaccacctctggacctcccaaacgtgctgtggatta

SEQ ID NO: 486020 - DNA, 883 bp, Homo sapiens
  misc_feature (6)..(6): n is a, c, g, or t
  misc_feature (83)..(83): n is a, c, g, or t
  misc_feature (94)..(94): n is a, c, g, or t
  misc_feature (96)..(96): n is a, c, g, or t
  misc_feature (123)..(123): n is a, c, g, or t
  misc_feature (125)..(125): n is a, c, g, or t
  misc_feature (153)..(153): n is a, c, g, or t
  misc_feature (158)..(158): n is a, c, g, or t
  misc_feature (206)..(206): n is a, c, g, or t
  misc_feature (210)..(210): n is a, c, g, or t
  misc_feature (239)..(239): n is a, c, g, or t
  misc_feature (247)..(247): n is a, c, g, or t
  misc_feature (287)..(287): n is a, c, g, or t
  misc_feature (302)..(303): n is a, c, g, or t
  misc_feature (336)..(336): n is a, c, g, or t
  misc_feature (348)..(348): n is a, c, g, or t
  misc_feature (363)..(363): n is a, c, g, or t
  misc_feature (366)..(366): n is a, c, g, or t
  misc_feature (399)..(399): n is a, c, g, or t
  misc_feature (420)..(420): n is a, c, g, or t
  misc_feature (430)..(430): n is a, c, g, or t
  misc_feature (438)..(438): n is a, c, g, or t
  misc_feature (494)..(494): n is a, c, g, or t
  misc_feature (523)..(524): n is a, c, g, or t
  misc_feature (526)..(526): n is a, c, g, or t
  misc_feature (529)..(531): n is a, c, g, or t
  misc_feature (534)..(535): n is a, c, g, or t
  misc_feature (537)..(537): n is a, c, g, or t
  misc_feature (542)..(542): n is a, c, g, or t
  misc_feature (714)..(714): n is a, c, g, or t
  misc_feature (769)..(769): n is a, c, g, or t
  misc_feature (799)..(799): n is a, c, g, or t
  misc_feature (810)..(810): n is a, c, g, or t
  misc_feature (869)..(869): n is a, c, g, or t
tatctntctgctcccagaccacgtgtgatgaggcaggatgggcagctcaggtggtgtctccattgaggtcagggtgctttgangggctggggtngnttctaagacccccgcgtccttggagananctgcaggctctggtacagcatccctcanctgancctgagttctctccatctcatttaggcggtgctccaggtttttcagantgtncccttcattgcttgttaggttgtgctctnaatcaaantctgattctcccagcacggagcctggatgtccagatcctncagctggccccgcanntgctccttctgctccgtcaaggcccggatttgngtgctcatcgantccactaggcggganagnactttctgctcctcacgcatagcggctacctcncattgcagctctgccaacttnttcacaggtnggtgcgtncccagtgctctggtttcggttttgcggttgttttatttttcgctgccagggtacgncggcttccgaggcagcgaggcggagtccnntnttnnntgnngngcgcngggcgctggtcccatgctcagggagcctttgggtcgcggccagggccccgcagattggcggcggcgggcaggacgccggaccgggacactctgcgtgcgctgcaccggccggggccgccgcaggcgccgctcttcgtccggccgtggcgggcccaactctctgagcggcgancctgcgcagagactggctcttggagatgagaggggtgtgcttggggaggtcccgnggggccaggaagccgggcttctcccctgcngagaggctggngtggacctgggccgggggcagtgcgagacgcattgcactgacacaagcacaggctggcnctctcaatggctcg

SEQ ID NO: 486021 - DNA, 715 bp, Homo sapiens
cgtggaaggtttctcgacgtcccccgaggggcatggccagtgtctgtctaatccttctggcccatctctgtgtggtgatggagcctctctggtgatagcgtcccctcactcctctcccagccatcgcgatttagtcattcaccacaggtacagaagggggcccctctccaggacctcacacacattaactttcactcgtacacatggcaacagacaagaccatctgctagcaggcctggaccaaggagtatccaccttatcagaagccatgccacgttgctcatagctagcattgctaatctccatgtggaccacttgccgtgccactggacccacattgcaagcatcccatcccttcatatccaaacacctactttcatggagccttcatcacacactacacagggatctcagcacgttgcaccccaagtggattgtgccttggcatcgtgaccaccaggctcgcctgctctgacgaacgtcccaaacaccgcactcagatcctggccctcaacaagcatcaagggggatggaacccttgtccacactaatttccacgaaactacacacaagaggtacaaccccaaacggacatgtgagctaacgcatagtctggccacagcatacttagcgattggaacatccgctataatcaactttaccactaatatctggcgcgaacgataaccatcaacgactgtgatacccgtctata

SEQ ID NO: 486022 - DNA, 125 bp, Homo sapiens
tctctccacactggatacccatagtagctgcacacagtaggaaccccagaaaagacttgccccttctgtccctgcagatgacgtcacggctcccacggccggcaggtctgccgtcggcatgagct

SEQ ID NO: 486023 - DNA, 415 bp, Homo sapiens
ggcacgcgagttatatttttttaactcttatatcaggttcacgggtacatgtgcacgtttgttatataggtaaattgtgtgtcttgtgggtttggggtttggtgtacacattatttcaccacccagtaataagcataggacctaataggtaggttttttggtttggtttggtttggtttggtttgtgaccgagtcttgctctgtcgcccaagctggattgcagtggtgcgaacttggttcactgtgaccttcggcttccaggtttgagggatttctttggcttaggcttcctattagctggaattacaggcatgtgccaccatgcttggctttttggattttcagtgtagaccgagtttcataatgttggccaggctgtgcttgcccctgagcttgggtgataccctgtcttcgg

SEQ ID NO: 486024 - DNA, 334 bp, Homo sapiens
tatatataataatagagtttgatactatcacatgaagttataaaaactttaaaggaaagattcctgacaggtgaaccaaaatcaatatattacaatacagcctacatcaaataatccatatttaacagtgacaattctttgcacatatcttaatcatatgactgcgttggatagcaccacaagaagtttgggttcaaaataacccatacttttatatcttaaaaaaacaaatcttaaaggaaggtctaaacttttataacctcagacaaagaatcttaaagaaaggtctaaaaggcatatattagaccttctacgggaactctgtatatttccg

SEQ ID NO: 486025 - DNA, 1097 bp, Homo sapiens
tccattttaaagggggtgcccttttattcaacgggtctcaagtcagggtacaggtaaccccgggcttgccctccacccacttcccggggagaccaaaagccttcatacattctcaagtggggggacaaaaaggggggaaggggggcgcacgaagggctcatcatctcaaaattaacaacacaattaaaacaagtattaggggcgaacgattaaaacaattttggcattacttataattttacacgaaaagcaagtgcttattcaccctccccgtggtgtgtggcactggggagaggcacgtgggccattctcctttaggagagaaggtggggtgggactttaaggagtggcaagggacttccgtgttaacaacgcatcctcatattgggaagtgactattataaaagaaacaccaagtggtgccacactcaaagttccctcggccacattgggtaacccttggggggaatgcctcgctttccaaccgaatggccgtgctccaccttttcacgcgtcccagctctttacaaaactcgcgtgagagtctcacagccccaaaaaaaaaacgcaacagaacagacacccaccaacaaccacaacaagaaaacaacacccggggggagacactctattagactgcgggaggcgcgggcgaacacacacagcggcgcacacacaaaaggggcacccacagagggagcccaacaaccgcggtggttctcgtaggaccccacacaacataactctcggaacccacaacgcgggcgccaacaatcctcaggcgcgggacacaccccccaataaatagcagaggacccccgtcaaactccctcgccgaacaccaccccgggtgttcaaccccgggacctaaacaggacaccaggctgccacaaacgggatgtcacagcgcacacacacacgcccgacaagcgccccaccgcaggggcctcaccacaaccgctgccggggacccaagagaagacacacacgaacactcaccgaccccaccggcaccaccccaaacacatacaacacacaacgagcaactgaacaccctaatacgatacacgacaccaccacgcagcacgcagcgtacg

SEQ ID NO: 486026 - DNA, 268 bp, Homo sapiens
tcagaagctgagatatctcatctagatcttttgatgtagctgtttatctctttggaactttatagaccttgttccatgttctgaaatttccaggaatgcccaaaaggtctttttctccatagttttgatgggcctttccaacctggaactggtagccttaggttctgggaaatctttctcaaatggttttgctgatgattttctcccctccactttctttgtcttttctttaggaattcagacatgtgactgtctggattgctggggc

SEQ ID NO: 486027 - DNA, 122 bp, Homo sapiens
taggactctctacctgcgatcccctggtgatagtggtaaccaggatgatggtccgtcaggcagataccaccaataccaggaggccatcagcgccatcgctcccccacctccttttcaaaatc

SEQ ID NO: 486028 - DNA, 372 bp, Homo sapiens
ggtctctaattctagtgccacttatttccttcttcccccaggtccgtgactctggctttgagacagctgctttcccaactctcattcatgggaaacccaccctaggtgagcttcccacctcagagcaaactggagagaacccatgccaagtgcttcagcagtcgcggggatgagagtcctacgcaaatatgaaatgtggcatgcagtctcacagaagaacatgttctcaccaaggattgttacagagagctgccttgttcaaaggtccaaaacagctttggcaaagggtatctttctttccatatttggccagaaatatgagctgacagcaaatgctatgattttgaaatacatggcatattatttttgcga

SEQ ID NO: 486029 - DNA, 291 bp, Homo sapiens
  misc_feature (161)..(161): n is a, c, g, or t
  misc_feature (176)..(176): n is a, c, g, or t
  misc_feature (189)..(190): n is a, c, g, or t
tggagggattcacggcgaaatgagactgttcgtgagtgatggcgtcccgggttgcttgccggtgctggccgacagccgggcgtgcccggggcgtgttttgaggtgctcatcagcactgtcggcccggatgattgtgtggtcccgttcctgacccggcctanggtccctgtcttgcngctggattgcggnncctacctcttctccactagtgcaatctgccgatatttttttttgttctctggctgggagcttgatgacctctctttcctgtggctggtctgggacgcgacc

SEQ ID NO: 486030 - DNA, 123 bp, Homo sapiens
acgtagtccctgtctacccacaccaagaactctgctctgaaacagcagtccaagagctcctacccagaagaacgatctttagtccctcaaggtcgactgaaacttcattagaggagtttagag

SEQ ID NO: 486031 - DNA, 266 bp, Homo sapiens
ccaacgtctcacacaataggcaccaagacgtgaaacttttctaaaccaaaaggacgaagaaaaaacactttcaagaaaaaaaaaaaagaaaaacccaaacctatatttggccacttttaatattccgtccacccatttttaacaatagggtaaacggaatcaactctctgccacttgttgagcgggttggcccatcgctcccccacccccgggttacacaatttttaattttttcagaacctcactccctctcttatatccatcca

SEQ ID NO: 486032 - DNA, 1004 bp, Homo sapiens
aatgaaagataacaaaactaatgaacaactcaagatgccatagaacaaggctgcttagtagaggccaaggctttatataaccatatcaagcttataccacgctatcccagtggcactgaattctctacagatggtcatacctcgctacaccaccacagcactcgcaaactgccactactgctgctgaacctggcactctaacgacagatgcctactcaacgggcacactgcactgctagcagctctcactatcacgcacactgcactagcgctctctctttcctgctgacccctgctgcgctgcctgcgaaaccacatgctcctaaactccatgtgactaccacttctacgccctggactagaagccgtaagcaccgaatgcactcacagcaactaccaacatcaatactggagctcctggcatcgcaagcccctactaagccaactcctacagctaccacttggcccagcccaccacaccctggcacactaaccccgactccccacctaaacaacgcaaaaccacaggctccacagccccaacatcgcccaacaccactccactcaaccctccacacagacccagcgtcacaccacccgcggacacgcacacgcaactcctacacccactaactccacgccccccaccaggccacaccaccgcggacacgaccacgctcggcacctttcaacaccacccgcgacctaccccaacacgggccccccgctccggaccaccccaactgacaacgcccccccggccttacaccctaacaccaccgcaacccggtgggcccacaaacaaataaatcggggacccctcaacgtggcaatccctcaaagaaagccctacgcgccccggttcaccaaagcaccaaatcaccacatgcagcctccaccccgacccgtcccgcaccgcggcgcacacccgccaccgcccggcacccagaccaaaactaccacggccctgccacaccacccgaagaaacccacgagctcatccc

SEQ ID NO: 486033 - DNA, 344 bp, Homo sapiens
cactatctttcattcacacacacaaaacactcacacacacacacacgacatacttattacctatgtatcatgtattctgtttaaatctgtctctatgactccgcacccaccctctggaaaccagacagacaggagcaggacctatgcatgtgcctcacacattatagtaataacataccttatctacatgtttaaatgtacatttgcacacttgtgacacttattgagaaaaccaaattaagcaatgaatgggaaactactttgggaatatattatcagcatctgtacagatggaaaaccttttttaaaccagtttttaattttctaatttgtgttttctcttt

SEQ ID NO: 486034 - DNA, 375 bp, Homo sapiens
gctcgactgaaatcaacatgtcaaaaagatatctggattcccgtgttcactacagtgttattcacgataaccaatacgtggcaacaacccaaatgtctgttggttgatgaatgaataaagacaatgtggtacatatatgcaatggaatattattcagccataagaagcaggaaatcctaccagttgagacaacagggatgaaccttatgctcagtgaaagaagcaagatatagaaacacaaatactgcacttctgtgtggatctgacccatatgtggaacctaaaaaagtcgaactcacagaagcagagagtataatggtggttgccatggtctgggagtttggggcaatcgggagatgttagtcaaagaatata

SEQ ID NO: 486035 - DNA, 452 bp, Homo sapiens
tctagaggataccctgcttgtcctgcctctggaaattttgaacagaatgatcagtgaagaataattacaatgatatatcatttattaattcatttcacaagtatctactaaagctgcaacataccaggcccaatgtgagtaccaaggattcaatgacaaataatttgtagcccctcgtctatggacatttgtttgtatgtagtcaggaatcataacacagtgggtaacccggtaatcactccatgcctggagatgacatgggaaggacacgtcttctccaccaaaaaaagtgaggcttccccaggaggtaatgtataaactgagacctaaagatgactatgagctagcaaaagtgaagaccagtgaagaaaatcaaaagcggcagcacgggtaaaatcctagacaggatacgatatgggatatttagaaatctgaaaacagtttagtggctt

SEQ ID NO: 486036 - DNA, 671 bp, Homo sapiens
  misc_feature (110)..(110): n is a, c, g, or t
  misc_feature (112)..(112): n is a, c, g, or t
  misc_feature (497)..(498): n is a, c, g, or t
  misc_feature (504)..(504): n is a, c, g, or t
  misc_feature (506)..(506): n is a, c, g, or t
  misc_feature (511)..(511): n is a, c, g, or t
  misc_feature (514)..(514): n is a, c, g, or t
  misc_feature (518)..(518): n is a, c, g, or t
  misc_feature (520)..(520): n is a, c, g, or t
actcccgcaggaacctggggatggctggagagtaactgggagccacaggagggtccctgaggcctgggggtgaagagatgcaagacacaggggtggagcagcgtgaggcncntgagtttgtaggtgattcctgggtgtggggggctgactccagctgaaatctggggttgtttggagagtagctgggagacacaggagaccccccgagagctgggggtgagctgctgggtgatggcagtaagaacatgtggtatattattgatgaacgtggggactctgaggagtcctcagaggaggacacggcagagcccaatggcttcattgattgcccatcacggtgaggacagggaaatgggagcttgtgggattctggtgatgacagaggtgagtgtggtgaagccctaggggatggtgaatggtagttccggatccctggtgaggagcttccccttaagcctgagtttctgagaggggagagggagaagctgggtgaggcnngcatgnancttgnggngtcngngctgggggaccgctcatattctcccgagacctgtgagtctctgggggactcctgggtgcatggggctgactcccgcaggaacctggggatggctggagagtaactgggagccacaggagggtccctgaggcctgggggtgaagagatgcaa

SEQ ID NO: 486037 - DNA, 438 bp, Homo sapiens
  misc_feature (7)..(7): n is a, c, g, or t
  misc_feature (24)..(24): n is a, c, g, or t
  misc_feature (291)..(291): n is a, c, g, or t
  misc_feature (429)..(429): n is a, c, g, or t
aatttantgggacggagacagtgnggacaaaggaaggagaaggtcccagataaaatttagaagggatcatggttaaattccccatacacagttattattgaaaaaagggaataagtaatagaacttctcctacagatagtgaaagtatatcaggcccagacgtggtggcctcatgtctgtaatcccagtgctttgggaggcccaagatgggtggattgcttgagccaaggagttgagaccagcctgaacaacgtggtgaaactctgtttctactaaaaatacaaaaattanccaggtgtggtggtgtgtgcctgtaatcccaggtacttgggagactgaagtgagaggatctcttgagcccaggaggttgaggctacagtgagcagagatcacacttattgcactccagcctgggcaacagagtaaaancctgtctca

SEQ ID NO: 486038 - DNA, 163 bp, Homo sapiens
cgtggtagcgtatactgatgtatactgatattaccgtacttgtggccttcaaagagcctcaacaacacgcagatatacgttatacctatgtcattgaacattttatggggttagcagatggagacaatagagctttactaggatacagtagcggagcagggga

SEQ ID NO: 486039 - DNA, 90 bp, Homo sapiens
gaacaataattgtaaccgaataggaggagagaggcgtcccacctggcactcttgaaatcacctcttcccaaatgcaaagcacggggtgag

SEQ ID NO: 486040 - DNA, 113 bp, Homo sapiens
tactccatccagcctgggtgacaaagcgagactccctctaaaaaaaaaaaagggacggaaaaaggggggaaaaagaaagctgggggcaggggctcacgcctgtaatccaagca

SEQ ID NO: 486041 - DNA, 368 bp, Homo sapiens
catcagccagcagtgcaatgggtagtacgactgtgttgacggttccgacgaggcctcctgccccaagggggacgtgcgtacttgtaccaaacacacctaccgctgcctcaatgggctctgcttgagcaagggcaaccctgagtgtgacgggaaggagaactgtagcgacggctcagatgagaaggactgcgactgtgggctgcggtcattcacgagacaggctcgtgttgttgggggcacggatgcggatgagggcgagtggccctggcaggtaagcctgcatgctctgggccagggccacatctgcggtgcttccctcatctctcccaactggctggtctctgccgcacactgctggctgatgaatt

SEQ ID NO: 486042 - DNA, 632 bp, Homo sapiens
  misc_feature (110)..(110): n is a, c, g, or t
  misc_feature (112)..(112): n is a, c, g, or t
  misc_feature (497)..(498): n is a, c, g, or t
  misc_feature (504)..(504): n is a, c, g, or t
  misc_feature (506)..(506): n is a, c, g, or t
  misc_feature (511)..(511): n is a, c, g, or t
  misc_feature (514)..(514): n is a, c, g, or t
  misc_feature (518)..(518): n is a, c, g, or t
  misc_feature (520)..(520): n is a, c, g, or t
actcccgcaggaacctggggatggctggagagtaactgggagccacaggagggtccctgaggcctgggggtgaagagatgcaagacacaggggtggagcagcgtgaggcncntgagtttgtaggtgattcctgggtgtggggggctgactccagctgaaatctggggttgtttggagagtagctgggagacacaggagaccccccgagagctgggggtgagctgctgggtgatggcagtaagaacatgtggtatattattgatgaacgtggggactctgaggagtcctcagaggaggacacggcagagcccaatggcttcattgattgcccatcacggtgaggacagggaaatgggagcttgtgggattctggtgatgacagaggtgagtgtggtgaagccctaggggatggtgaatggtagttccggatccctggtgaggagcttccccttaagcctgagtttctgagaggggagagggagaagctgggtgaggcnngcatgnancttgnggngtcngngctgggggaccgctcataagaagagccagacaagaccctactgttcgataggtgcagacatgattaggaaacctgcagctcccatggggcccccactaatgttctaactccg

SEQ ID NO: 486043 - DNA, 511 bp, Homo sapiens
  misc_feature (101)..(101): n is a, c, g, or t
  misc_feature (115)..(115): n is a, c, g, or t
tttccccaggaaacagttatgatatgattaggattttaaagggtctccctaaaggaattttggccctcgaggccaagattccggctcaaggttcaaatatnaggcatgacatgtnagttctccctccaaattaacccatcaatgcattctttcgggaaactactggatgatgaattccactataacagataaaaaccaagaaaggagatgctgtgcatcccaagaaacgagagatctaatacagcagagaggagcaacagctttccaggatagcaacaactcaaagtcagaggatgtcagctctgcagaaatccaatgcatgctggagcaaaatgacagacagtaatttgagagaggtgattgtttatttgatagatttcattatattacattttttgacttgagagctatttgggaatgtgaggaaaattatcatagaagcattgaaaactaacaaaataaaatacaaggcaattattaactaaaaaaaaaaaactttgaaactacgaag

SEQ ID NO: 486044 - DNA, 94 bp, Homo sapiens
ttatcatcatggattggctggtgcagtacagctaggcttaatagggactcgaattcgaggctcgaataaaaacgttagaagcttgaattcgagc

SEQ ID NO: 486045 - DNA, 438 bp, Homo sapiens
tactcgcatctacgtcgacgtcgtcatccgtctcgatcatcctcttcttcatctatcatcctcaggcacatgcttgggatcagaggaacaacttgtatgcagcatttctttcctttggctggtgtagtctccatagcttcttcttcagagtcatcttcctcatcgtcatcgtcatcctcatcatctgcggcatcctcatcgtcctcatcctctgaggaagagggcagcagctgctgctttcatcgctgctggtacaatttcatcttcatcctcatcctcgtcctcgtcatcctcctcatcctcctcactgtcatcatcctcctcttcatcactgtcttccttcttggcattcttgccattcattgcccccttggctgggatggcagcacccttcttaccaggagttgctaccaatgctttgcctggtgtggccccttt

SEQ ID NO: 486046 - DNA, 130 bp, Homo sapiens
gctaccagataacccgccgtcgttcaaggtggagagacgccaacgatcacgccgctcgctcccgatactagcaactccatctcagtgactacgcagaaccgtccatgatccagtgactccggactcatgg

SEQ ID NO: 486047 - DNA, 514 bp, Homo sapiens
  misc_feature (514)..(514): n is a, c, g, or t
ccactactgcctcacacaggcacaactggctcccgctgctgccacaggtggtgccgcaatgggcagtgcctcaggccgaagcctcaatcccccatctgagccaggcctaatctctaatagtgatggttggattgtcctcccataactgcaggtggattcccctggggatggaggctgcagatcaggcgtctggtggccctgaacatcccgcttccactcactgtggatggaggttgaagcctttagccctagagagctcacgggcccgcgagcacaacgtggtcaaccaacaaccccggtgccgacacagccacaatacagacaggcgaccaaacagagaagggagatccaaagcaaaaatgagacaaagacaactcgaggaggaccaacaagacaaaagaagagacagagaagatcgcgagagaacccccgacagagcggacacgacgatgagaaaaccaccggaaggacgaggaggtcaaattatgctctccacccccccggtcaggaggcn

SEQ ID NO: 486048 - DNA, 223 bp, Homo sapiens
acacgtacactggtgtgccatgcatgcgtatttttgtatgtttctttagtagagatggggttactcctgacctcaagtgatctgcccgccttggcctcccaaagtgctgggattacaggcatgagccacggcgcccagcctactttttcaatatttagagatttggtcttggtatattccccaggctggccttgaactcctgggcacaagcaatcctcccacc

SEQ ID NO: 486049 - DNA, 1127 bp, Homo sapiens
gtatctacagccggggctcccgagcggcagagcatgttccgaccatctctctggccgcttgggttgaggcgaaagccaggatcgtggcctggccatccgccaggatatggacgctactgtcgtcaccgctccgcggacgatagaacctgatcggatcctccgtagggctctctgcgtgctcactttgcgcacaagggactgagcttctatgacagaacccgatggtaatcgagctccaccggacctgccgcttcttccgaacgagcctggtactccgacggcctgattgcatcgtgtgggcgcagctctctgaaagagccactgagacgtacgcactcctggctacttacacacctgctgggtatgcgctgtcagagctccagagaacccctggtggcagccatcagattgaagtgaaccagcatgctataagtagccgggcagtcggtcccacaagaccgtgagccacactacctatgagctgtgcgactctgtcttagcctcttatcttgtgtggtgcacattgcaaaagtgtcagttgcaaggctggcgagaggacgtcacgcaataaacggacgctgaacactggctccgttgaaaatggccctcggacggcaacccgaattgcaggccggaacgccggggcagaccctgtccccgttgaaaggccaacgagagttacacacgtgaacagaggtcccatttgtggatggaagcaagccatcggagtgggcaggccttggacgaccgtgtcacgattggcaaagttcgacagagaatcccgatcgcggtatatggcgaccaccacaagtgcgtccggggacaggacattccccttttgtccgggactaatagacagccaccgacttacactagcacataagtaagttctcggagagcggggggacctcatttgacgatgagggacgtaacttaggccttagactaggcgggaactcccataggggtagccggctccggtagaggcaacacaccgctattggagtcagcgcccggagagaggcaccgagacacatttacagtatgttgccagccccagagggggccgcccggagattgccctcccactcagatgaggtacccgaggcccgagacaggagtgaaag

SEQ ID NO: 486050 - DNA, 239 bp, Homo sapiens
atcacattcgatgatgaactcagctcactcctagcgctgctaatctcaataacacaggctattctagcatgactactaacagacgctcaacagcttttatcattcgcccatcacttggggcggaatatgctgatcaaccctaccttacgcaatgcgctcaatattcttatatacccttccaacatagggcgaggcctattacgggcactctactatctgagaccgtaacacagggatat

SEQ ID NO: 486051 - DNA, 927 bp, Homo sapiens
gagccactggatgaagacatgagcaagtagaaagcatctgcagaggtcaagtaggaccatgggagatccagattccatttaaacaagaatgccttaaagaagtgggaatattatagtactgagtgagagaaaatgctctatacgtctgtgtgtgatcaggaggaggagaaaggaggacaaagttaacatcaagtgtgatcagcagaccagtttgatagagctactgtgtctcgagaggggacagatttgatttatacagtttgacaatggtggagccgggatcaatgagtgaacattacaggaaggaatattggggtcaatatttgggctcaatattttgggctcgaataattgtgggctcaataaaggaggactttgcgcaataattacaagcgttccagacttgtaaagtggggtgtctcagaaaggagtgagtgccctgttactgaaaaggattataggttagggtaaatagctcatgcaattcagggtgatataatgagattcctgtgactgtttccaagaagcatctggtgtgcatccagtcaatgtcagattcttaagagagcaggtgagcagcaaaagaggaatcacttgcctccgcttcaaagagcttccgggtgggccagagactgacatgtaaccaaccggtgatcatggaattgggttaactgtgccatggcgtgacgggtgcccaggacctggggccacattctactcgtgagagagaaaagcggatgcccgtaagggagcaggggtcgagaagtgaccgcgagatccgggcaagggagtggccacatcgcagcatgggcgattcggggcgcattgtcccctgcggcacaagaacccgtaacggggtggggggcgaacacacggaccagcttccgcccgcggaaccatgggcgggcaggcggcaaacaaaccaat

SEQ ID NO: 486052 - DNA, 278 bp, Homo sapiens
tattctaagaaacaattaactcaattaaaaatgggctaccaactagaataaacatttctcaaaagaaaaataaaactaccatacgatccagcaatccctcttctgggcatatactcaaagtaaatgaaatcaccaccttgtaaatatatctgcagtccgtgttcattgcagcattattcatagtagccaacatggagacaactgaagtgtccgttgacagatgaataaagaaactgtgtatatatatgcctacacacaatggaatattattcatccct

SEQ ID NO: 486053 - DNA, 268 bp, Homo sapiens
  misc_feature (43)..(43): n is a, c, g, or t
  misc_feature (127)..(127): n is a, c, g, or t
  misc_feature (233)..(233): n is a, c, g, or t
gaaaccttctggttgtagctgaaggaaatctgactcaaatttntttaagaaaaaaagagaattctagtttcctataactgggaagtctcgctgtgagttgacttctgtatatagggattcatctgtntcttactagttcagtcagctcctttcctgtgtgttggcttcattcataggccatctctcctcttacagtggcagggacggcccctgcagccctaggctgacccctncccttatagccagcgatctctgtgcaaagagcagg

SEQ ID NO: 486054 - DNA, 348 bp, Homo sapiens
  misc_feature (303)..(303): n is a, c, g, or t
ttgggacacaaaaccacaaggggctgaggcagggtgggaggaactggaatgaagagggagagatggcggagctcgctggagcttggaagtaaagtgttaagcagaggaaaaagtccaaaacaacgccaagctttctagtaagaatgatgaggaagaggatggtgtctactggtgtcagacactaaaaataaggagggagagctgattgtctgggaagtacagaggccccagggaagctgttgggctcaattctgggcatgttgaatttggtaggatgataagacattaaaataaaataaaacnccactttgttttatacatggggtgagttggaattgacccagagta

SEQ ID NO: 486055 - DNA, 108 bp, Homo sapiens
ctcacgcatggacaaagaacactgggacatggctgtctcgtctatcttcacgtcctatgaaagaggtgctgctgttaccgtccttctagccaggttaagatctcacac

SEQ ID NO: 486056 - DNA, 840 bp, Homo sapiens
ggacgcgtgggcacacttatcccaccttggctatcgatcacccgatgaggcaaccacagccagaacgcctgaacgcaggcacatacttcctattctacaccctagataggctcccttcccctactcatcagttcatctgaatttacactcatcaagcaccctaggctcactaaagcattctatctactcactctcgctgcccaagaactatcggactcctgagccaacaacttaatatgactagcttacacaatagctgaaatagtaatagatacctctttacggactccacttatgactccctaaagcccatgtcgaagcccccatcgctgggtcaatagtacttgccgaaagtagtcttaaaactaggcggcgttatggtataatacgcctcacactcattgtcaacccctgacaaaacagatagcctaccccttgcttgtgctatccctatgaggcataattataacagagctccatctgactacgacaaacagacctaaaatcgctcattgcatactcttcaagtcagcgcacatagccctcgtagtaagagccattctcagtccaagaccccctgaagcttcaccggcgcagtcattctcataatcgccacggaattacatccgtcattactattctggcataggaaactcaatactaaggaacgcaatcacaggcgcatcagtaatcctctctcaaagactggaaatctactcccacataatagcttttgatgattcgtagcaagactcgctaagactcggcataacccccaatattaaacgaagggggaaattatgagataggaagcaagaacctgtgaatataaaccgaaac

SEQ ID NO: 486057 - DNA, 847 bp, Homo sapiens
gctctctcgctcgctctctttctctgtctttcgctcgctgtctcttgctgtagggtccggtcgggcgttcctggcgacgcctggagtgcatgaacattacctggctccggggagactttcggatccggatcccaacgagcgcctagccgacctcgacgaccaggggatccgttccaacccggcccgaccatggacgtgctccccatgtgcagcatcttccaggagcgacagatcgtgcaggagaccggcatacttctcggcgcatgacgtcatcatggaggagtacgaggagaacagagacgtgcatagaactggaacgtaaccattccagagcgagccctgaatatgtttcagcctcagaaatcaaaaggaaagacaggaagatctgggaccaaaatcatgctggcatcgggagaaaaaggaggccaatccgaactgaagatactctgccagatcctccagaggacactctcatcagaacgagctaagggacgacgtgagagaccaacagactgaactcaagatgtcagcagcgaatcctctgacagtcagaggaacatactcccacggacaagttacctccgacccatagcgaaagtagccaagctcgggaaaatgagctcatctgtcaacctccagccatccaaacttctcaggaaatgacagggaaacttaataaacagtggaggaagatgccgaggagatgcacatcgccaggaaaggtcagaagaggaatacgagaagcaaggaaggaaaaggagacccacgaagaacaagggtgccggacataagagagaaagaagcaaagcaaagaacaccagaagaaagaagtaaagaggaagaaagg

SEQ ID NO: 486058 - DNA, 255 bp, Homo sapiens
ttggagcgcagggtgcatctcggtctgcaacctccacctccaggttcaggcgattctcctgcctcagcctcccaagcagctgggattacactacacctggctaatttttttgtatttttagtagagacagggtttcaccatgttggccaggctggtcttgaactcttgacctcaggtgatccacccgcctcggcctcccaaagggctgggattacaggcgtgagccaccgcgaccaatcctagcattttgggacg

SEQ ID NO: 486059 - DNA, 1090 bp, Homo sapiens
agcggacgggcgctgggctcgcggcgctgcaaggcggcgaggcccgggctccgccgcctgctgcagccttggtcgcggcgtgccggcgctgagcgcggcaggtggcggggcccggccgcccgtgtagggcccagatgtggcggggacgcctccctgccgggtcaggttctcagagacgggtctccggtcggcggccgacgggggccggcgccgcgcgtgacgcgccgaagatccacgccgttctaattcactagtagccttgttgctctaaggctggcggggctcaccctttctcctagaccgggttgaccccagggggaggttgaattgcagtgtggaactcttcatcgttgaaaagtgcctaaatggccaagcacgatttatttcaagagcttgagttgacctctttaaaccgcttggccgtggggaaccaggcgaagattttgcggggaccattcgcacatgagcagttggaccaaattgcatgaacctttccggatacacgcgaagattgggaattggcattcggagcagtggggaattggtattcttgtaaagaccagttgcagggcaagctacttttttaacctacatagttctggggaaagatcacggtgagaacgtttacacaggagggctggggccattggaaccacatttcaaagaagggcaaccccttgaaggaagccccccttttgaaaggaaacccaacattgggacaccacttccgtttggaaaaggctcaatttacgtccttccttttgccctatataggggttgttgaaaacaagggttagttaatcctgggtacccttttaccttttaccaggatagggttttccgtggtccactaaattagcatcctttggtacccaaagaagccttggagtccccccaaaaaacaaggttggggccctaacctggtaatccagtccccataatatttgcctttggcgccaggagtaattattggaaaagacgggccaaccacatgggcattttttggccaagcggggcttcctaaattccagaaatcacaggagaacataaccaacttgagtatgacccgggtaaaaatacagcggccacg

SEQ ID NO: 486060 - DNA, 110 bp, Homo sapiens
atcataggttcgcaggacagcacgtactgatgtagaggctacatgcacgttatccagaagatctagccaatgtgctcattgatgtaggtggctacattacgcaacagatt

SEQ ID NO: 486061 - DNA, 255 bp, Homo sapiens
gatagctccacgctccaaaaatataagaaaatggccggatatgtggtgtgagcctgtggtcccagctgcttgagaggctgaggcaggaggatctctttagcccgggagtttgaggaaacagtgagccatgatagtgccactgcattccaggctgggtgacagaacgagaccctgtcaaaaaaagaaaaaaagaagtgagagtgagagtgatactttacaaaaaaaaaaacagaaaaaattaaaaggggaatagga

SEQ ID NO: 486062 - DNA, 268 bp, Homo sapiens
aaggatcgttagctcagtgatctccctgaccaatcggctctcctggctcactggctctccccacccgccaagttatacttaaaaactctgctccccggcactccagcagcctgggcgacaagatcaagactctctcaaaaaaaaaaaaaaaaaaccttttgctccgaaattgctcaaagaaatcgattggagtaatattaaaccataaaactcgggtctcccgcacagccagctctgtgtagaataacctctttctcatatggcaatt

SEQ ID NO: 486063 - DNA, 654 bp, Homo sapiens
tgtatatacttatttttggattacacacacttgaccgaggagtttataattatgtaaagattacgggaaatgcaccttgacagaaaggggatagaccatagctcactccacagattgtgtcacaacatagaccaaaaaaaaaggtttattattaaaagtaggattactgattttttaaataagagatggataccaacagttgaaaagtgcagaaatgtgattaagtgtacatgccagggaaaatatagatagaaatctttatgggtaacggttagtcctatgtagcataattttcatgagtggagcaggatttcttcctgattagaatctctcttttgatgggtttggctcagttaatataaggagccttatggagcatttcctctccaccagttttcaccccaaaaaaaaaaaaaaagagaaaacagaacaaacactgttgtggcgaccggccgatgacgacccctgtggaaaacgacgtttgaacaacccaatttgtgttgtgggacgcgcgggcccaaaatagtgaatcagaagaacagggtggccaaaaacagggtcccaaagggagagaccgggggcaggagaagacggccggagtatctccacaataaaaaaacgccggggggacaacagcggtcgagaaacaatgcg

SEQ ID NO: 486064 - DNA, 168 bp, Homo sapiens
cgatgcgccgaccaatatgcacatgtacattccacaagcattgccatacttctattactcacttctagctgtatacctttgtaagctgcaaagaggttggatcaagtttaactgactgtgctgccccttatcacatcaaagaaatactgacaacgaaggccgagcctg

SEQ ID NO: 486065 - DNA, 188 bp, Homo sapiens
gcatataaatgtacctcataatgttctattaaaaatgggacaggagccttatgttttcataattacccaacatatgcgccgccatatttttgcctcgaaggtaaaggttccaacatgatgaaataagtacttcccaacttcccccgttgttaaaccttatcctcataatagacccaaatgtttgtgtg

SEQ ID NO: 486066 - DNA, 296 bp, Homo sapiens
gctcggcccactcctgcctgggcataagagctgtctattatttggaacagactttacttacttaccttattgattgagacagggtctcactctgttgctgtaggctagagtgcagtggcacgatcatggctctctgtagcctcgacctcctaggttcaggtgatacccccaccatagcctcctgaatagctgggactacaggtgtgcaccatcatgcctggccaatttttattttattttattttttgcgttttttggtagagacgaggtctagctcttattgcccaggctggagt

SEQ ID NO: 486067 - DNA, 365 bp, Homo sapiens
  misc_feature (8)..(8): n is a, c, g, or t
cccccccnaaaaccccccaaaaaaaaaatatttctttaaaatccctgccctaaaaggggccacaaggaagggcttgccccactcagaggattagactcctctcccagagtcactcacaggcaattatttcccattccactcagttctggctaccagaagatgctcccctctcagctgggtgaggctgctgatatctgtcggatgggtatcacagcgtaatttcatcatagggcttttctttataagatttgggtccaaatcacaccctttgtgatcttaagataatcaagaaatgcacagtaactgatgtaacttgggctgcagtctgtaatccacctcttcagctataagtaggggacatgtta

SEQ ID NO: 486068 - DNA, 225 bp, Homo sapiens
tgcacgagagcacacactacgtgactattacccgcactgtctgcgctccacatacttaggcctatggagcggggtaccataagtgccctgtacctcggggacacctaaccccctctgcacacagccagtgagccacggggcacataaccacgtggcagggaagcccgacaagagagctttgccggacccacctctgccccccgagaatcaacccctgggccattg

SEQ ID NO: 486069 - DNA, 138 bp, Homo sapiens
tcgctgacgtcggcttggtgctgtgggtgcccacgtatgctgagggtggtggttgtggtccactttcctcgatgtcgagccagctgcctcctttctgcaaggcgcagggtccaggcttgcattcgggcaggctcctca

SEQ ID NO: 486070 - DNA, 376 bp, Homo sapiens
  misc_feature (18)..(18): n is a, c, g, or t
ttttttcaccacctcctngagatccagcttggaacgctccatttcattgaggttgtcgatggtcattttcaggtcactttcagctttccgacgagccttttccacctccgcccggatttttttttcctgctcccagttatcctccagctacaaagacaagaacagcaagagaaggtagacgaggaaagtttgaggtcagaaggcaagaaggaaccaaactgggtccgatcctttaactgtggcatcaaaagggccctcacgccccgggggatgtgttggtccagttttcaaaactaattttcggaccccgtgcccccaaagggatttggccttggagttgtaaaggtggccacagcaatgggtattacctcatgga

SEQ ID NO: 486071 - DNA, 918 bp, Homo sapiens
  misc_feature (74)..(74): n is a, c, g, or t
  misc_feature (88)..(88): n is a, c, g, or t
  misc_feature (145)..(145): n is a, c, g, or t
  misc_feature (156)..(156): n is a, c, g, or t
  misc_feature (185)..(185): n is a, c, g, or t
  misc_feature (189)..(189): n is a, c, g, or t
  misc_feature (194)..(194): n is a, c, g, or t
  misc_feature (227)..(227): n is a, c, g, or t
  misc_feature (231)..(231): n is a, c, g, or t
  misc_feature (239)..(239): n is a, c, g, or t
  misc_feature (259)..(259): n is a, c, g, or t
  misc_feature (270)..(270): n is a, c, g, or t
  misc_feature (273)..(273): n is a, c, g, or t
  misc_feature (918)..(918): n is a, c, g, or t
ggcggcggcggcagggcggcgacggcgacatggagagcggggcctacggcgcggcaaggcgggcggctccttcnacctgcggcgcttnctgacgcagccgcaggtggtggcgcgcgccgtgtgcttggtcttcgccttgatcgtnttctcctgcanctatggtgagggctacagcaatgcccacnagtntaagnagatgtactgcgtgttcaaccgcaacgaggatncctnccgctatngcagtgccatcggggtgctngccttcctggnctngggcttcttctttggtgggtgctgcaagacgctaatatctcccccatatcagacaacgctgatgaccagtagctagctggttcgatgggtgacctgctcttctcagttctctggaccttcctgtggtgtgtggggtttctgcttcctcaccaaccagtgggcagtcaccaacccgaaggacgtgctggtgggggccgactctgtgagggcagccatcaccttcagcttcttttccatcttctcctggggtgtgctggcctccctggcctaccagcgctacaaggctggcgtggacgacttcatccagaattacgttgaccccactccggacccaaactgcctacgcctctacccaggtgcatctgtggacaactaacaacagccaccttcaccagaacgcggagaccaccgatggtaccagcgccctgtgtactgagcggcggttagcgtgaaagggggccaaaaaagggcctcccctctgcctgggattccgatgagctcgggaatggagccttctctttcactgtccatcgggcgttgaaacacaggtagggcccctagctggggcgcggaagcacacccatgttggccaaagggtaaagtggcaccccacggacagaaggaggggcctcgaaaacacacggn

SEQ ID NO: 486072 - DNA, 155 bp, Homo sapiens
ccggaagaccttggcttgttgggaaaacgtggattttctggaccactggggggttactggaagacactggacttttctggaccgaccctggacttttctggaacaccgtggactcttcaggaagacactcacttgagctggaacaccctggactt

SEQ ID NO: 486073 - DNA, 347 bp, Homo sapiens
gccgggcacagtggttaacgcccgtaatcccagcactttgggagccagaggcaagaggattattacatgagtccaggagtttgagaccagcccgagcaacacagcgagaccccatctcttgaaaaaaaaaaattagccgggcgtggtggtgggcgcctgtagtctcagctgctcaagcggctgaggcaggagaatcgcttgaatccgggaggcggaggtcgcagtgagccaatatcacaccattgcactccagcctagatgacagagcgagactctccaaaaataaaataaaaataaaattttccatgatcccaaaggatagagtatgaaaagaagaaaactagtaa

SEQ ID NO: 486074 - DNA, 417 bp, Homo sapiens
  misc_feature (370)..(370): n is a, c, g, or t
cacgaggcgctggtcgtgctcaaccaggaccaggcgggtaaggtcacgcagttattccccaacagcttcagcgcctccacgcaggcaggcaaagcccgcgagatcatccacgccggagagaccatcgagattccgggcagcgatcagagcttcatgctgaaggcctcgccgccggcggcccgcaacaccatcatcgcgatcgtggcgcctcccgatgcgaagattggggatctggtcgatccatcgaaggcgctgcaggagattgccgatcccgtggcgctgcttaccgaaatcacgcagcggagcaatgaggctgaccgttcgcgcggcgtcgacgtcgtgggagcggccaaggtcgggcgtgcagtanggaaacggtcgttcgatatcgtaaccaattagcagaacgtcaacacg

SEQ ID NO: 486075 - DNA, 248 bp, Homo sapiens
  misc_feature (97)..(97): n is a, c, g, or t
ttttttttttttgggggggggaaaccccggccctttttccccccccccccccccccggggggggttttcttttttttccacgggggggggggggttnaaaaaaaattcccgggggtttttaaaggggggccccccccccctggggtttttttttttaaatggggggtaaaaggggggggccttttttttttggggacccccttttccccgggcaagaattttaaatttttggggggttcccccaaaca

SEQ ID NO: 486076 - DNA, 215 bp, Homo sapiens
gagctcggcacgtttgggccaggtgaggatgctaaaaaacaaaaacaaaaaccctggcggggcacggaggctcacgcctgcaatcccagcactttgggaggccaaggtgggagaactgcttgagccccggcgtttgagaccagcctgaacaacatagccagccccccatctcgtcatctcgtctcttctcttgtacatctcgtccttctcttgta

SEQ ID NO: 486077 - DNA, 499 bp, Homo sapiens
  misc_feature (186)..(186): n is a, c, g, or t
tgctttattaaatcgatgtacttcatcaacaaaaataccagtagacttactttggtataaagcaaattgcgcctcactcacagcttctctaatttctttcacccttgaaaagattgctgaaaagctgattaaatgcgcttgactttctgcggcaagtaaacgagcaattgtagttttaccgactcntggaggcccccataaaatcattgagtgcacttttgccatgtcatacatcaagcgaatcggcccaccatcacctaatagatgactttgtcccacaacatcagataagattgtggggcgcaatctttctgctaacggctgttgcagcgactgctggaaaaaatcactcatcttaaaaccttattggaaattgaagttaaaaaaacaatcctaaaattaagcaaaattttattataccttaatctgtagaaacctttgaaagccctttatcttgctacttaatactgaataaactagaaacttttcatgtcgacgc

SEQ ID NO: 486078 - DNA, 315 bp, Homo sapiens
  misc_feature (39)..(39): n is a, c, g, or t
  misc_feature (54)..(54): n is a, c, g, or t
  misc_feature (92)..(92): n is a, c, g, or t
  misc_feature (224)..(224): n is a, c, g, or t
  misc_feature (230)..(230): n is a, c, g, or t
caggagttctagaccagcctggctaacatggtgaaactntgtttctactaaaantgcaaaaaattagctgggcttcgtggcatatgcctgtngtcccagctactcaggaggctgaggcggaagattcattgtacccaggaggcggaggttgcagtgagctgagattgcgccattgcactccagcttgggcaacaagaacaaaactccgtctcaaaaaaaaaaantaaaangagaaatttcataaaaaaaacattttcatcactaacatatagatacatatgcatgttttacacttcaccccacacacatgcattt

SEQ ID NO: 486079 - DNA, 771 bp, Homo sapiens
ccactgcgtacaggactctgaaaactacggtgctcaaatgggagcctcgaaaaggggaaggaacaagatcgagtaacagaaacacggtcaatctagacctcgggagctcagagtgacatgtatggagagaatgtgatatgatcgtcgcgcctatattctttgcaatcctttcgattgactagcttttacatgtactccatttgtctaggtgatgcgtatttacttggtctagggagaagctcgatcttggcccggtgatgacatggttagggagtgagacgcgtgaagaggcaatacctgaagcatgattccttgcatcactagtatggcttggccctagtgagtgcttggccccaagggaaatggtgggccgcgaggcaggtgctaatcgggcacgcgtcgctgtaatcaatcgcacactcaccagcgatccaaaaacgtgcacgggagcctacgagaagcaggagaatcacgtgacgcaacattagccgcctggactctggggcgggtccaaatgcgcgtctggtccagagccgctgtgatccagctactcgggtcatggaatgagacgggatcgtgcgatcccgcacgagatcgtctcctcgcaccatccacccttcgctgaacgagcgagcgtcggctcggcaagggggagcggctcgcccgttggggaccgcacagacttgctgtaacaaacgtattctcctctagtaaactaatattatctggcttatcattaggttagccctgttcattagtaaaacatgtttc

SEQ ID NO: 486080 - DNA, 285 bp, Homo sapiens
  misc_feature (102)..(102): n is a, c, g, or t
  misc_feature (128)..(128): n is a, c, g, or t
  misc_feature (173)..(173): n is a, c, g, or t
  misc_feature (177)..(177): n is a, c, g, or t
  misc_feature (180)..(180): n is a, c, g, or t
  misc_feature (188)..(189): n is a, c, g, or t
gggggggaagggagggagccagggggagcggggggggggggggccggaaggaccaggggcggaagggaaaggaggggggggggggggccgccgggggggggnggggcgggcagcaccagggggggcgncgcggcggggcgggggggggcgggggggggccacaagaggggcanaagnggngggggggnngggggaggcgccctcgggttcatacacctatcccccattctcctcctatccctcaacccggacatcattacggggttttcctcttaaaaaaaaaaa

SEQ ID NO: 486081 - DNA, 348 bp, Homo sapiens
tcttctcccgtagagatgatgagagagtagattttacgtgttttcaccacaaaaaagtgatgattatgtgaggtaatgtctgttaaatggcttgatttagccattctaattatatatatctttatcaaaacatcatattataccccataaatatatacaattttttacttaacaattaaaataactactttttttaaggagcaaggtcttgcttagtcacctagactggagtgcggtgatatgattatagctcactgtagcctcaaactcctgggctcaagtgatcctctcacctcaccctcccatgtagctgggactaaaggctcatgccacaatacttggctaatt

SEQ ID NO: 486082 - DNA, 121 bp, Homo sapiens
ctttgctcatgtatctacaggtggcttatgtcaacagctatgtaggacaatgcaccttgagcctcaaagctggcacatcgtccaaattcttcaagcctgccagaccgtctcctctctttgc

SEQ ID NO: 486083 - DNA, 421 bp, Homo sapiens
gcagcccctggtagcaaccactccgctccgagtctgtgaacctgactgctttaaacccttcatgtaagtggagttacacagcgtgtgcctgtttcttcagtctgttgtctccctctaatcttcgggtaagtggagttacacagcgtgtgcctgtttcttcagtctgttgtctccctctaatcttcgtgtaagtggagttacgcagcgtgcgcctgtttcttcagtctgttgtctccctctaatcttcgtttaagtggagttacgcagcgtgtgcctgtttcttcagtctattgtctccctctaatcttcgtgtaagtggagttacgcagcgtgtgcctgtttcttcagtctattgtctccctctaatcttggctcttctttctccagttccttaggcgtgagttgaggtaactccacttac

SEQ ID NO: 486084 - DNA, 191 bp, Homo sapiens
agtgatctagaggatcctcgttatgttctgagccagctgtaataggtaatccattcatgtggttcacaacatcataacagtagttggcagcctttcttgagatagctgcggctcaaacatctgtcttaagacatcaagagcttgcttaaatgatcacgacagttgcagccacacatcaccactggttctca

SEQ ID NO: 486085 - DNA, 1026 bp, Homo sapiens
gagcatgtaccgatctcacttctaggaatactagtatatcgctcacaccggtcatatcctccctactatgcctagaaggaataatactatcgctgttcatgtatagctacggtctcataaccctcaacacccactccctcttagccaatatgtgcctattgccatacctagtcttgccgcctgcgaagcacggtgggcctagccctactagatctcaatctccaacacatatggcctagactacgtacataatgctaaacctactccggaatgctaaaactaagtcgtgcccagagcaattatattactaccactgacatgagctttccaaaaaagcacataattggaagtcaacacaaccaggccacagcctaattattagcatcatccccctactattttttaaccaaatcaacaagaacctatttagctgttccccaaccttttcctccgaccgctaaaaagaccccctcctaataataactacctgagtcctaccccgcagaatcatggcaaagcgaaagcaccagcttatccagtgaaccatatcgacgaaaaatactctacctgctctatactaatctgcctgacaaatctgcttaatggataacattcacaggcacagaactaatcatattggatatcttcttcgaaacagattattcccacgtggtatcatcaccgagaggggaacagcagaagtctggaatgccgggacatacctcctattctacaccctaattggttcccttcgcactattcagtgggacttaattagatacaagaacctaggtcgtaaaatttagtatcactttaggccagaatattaaattccgagcaacagtataggaagttacacaagtcttaaaggaaccttagggagcaattagtcctagaagtgtgacccaccgggtaaaatgtggcacataaaggcggtaatagcactatcgcaaaaacactgtgcatggaaagaccggcgaaatgttgatcgtggacgcgggtaaataaagcctctcttacatgtgg

SEQ ID NO: 486086 - DNA, 174 bp, Homo sapiens
ttttgggggggggcccttttttttaaaagggaaccccggggggggggggccccccccccccccccccaggggggtcccccccccccctttttttcccgggggggggggaaccatttttgggggtttttttttagggccctttggccatttccccccccttttttttccccccca

SEQ ID NO: 486087 - DNA, 830 bp, Homo sapiens
  misc_feature (124)..(124): n is a, c, g, or t
cgccccacatccgagcctgggacgatgtgtctgtcccgggtgaccgatcgcattgcccgcggacggaacttcagaaaccgaatgaaaacaccactcctcctatgtgtctgaagatttcacgtgntgatttatgaaatctaagggggaaatggatcacacggattgtctttaaggggaattaatcacaaatgtataaaggatattacggcttttacagcaggcaataggattatcttataggaaatgaaaaacctgttggtaatggtatcaagtacaatatcgagttaaatgtaacaaggtgtggttcatgagttaagatgacggtctatgctgttttatgacctgttcattaatcccgtagaatttgtaatgggtgggatataaattagttttataatatattctcttaaaaaatcgaaaagatgagtctcttatcatgttgtgccaacctgttatgatgtgcagtggaaaagtggttaagccaggtagttgagtacttcctttacaaaattatcatgatagctgtatgggatattcgttacattatgtgaactttgtggaaatgctagtaatgtgttcaaacagcaagtatgggtgggccactgtatgtgtgtccttacggaggttacgctatgtcaccggttatgctgaggattgtaaaatacatcggaaaaatgtaaaaaacggagtttttttactgtgaaatttgggggaacgtggaacaggtccgaattggactggttggagttaaggcgttaaggggatatgcctttaatcttggcagcgaaaagtcttgagaagcttgggcaaagtatgtaggaggacaaatg

SEQ ID NO: 486088 - DNA, 163 bp, Homo sapiens
  misc_feature (99)..(99): n is a, c, g, or t
tcagactctttgcttcacacacaaagcagaatagtatttttatatttaaatgtaagaccaaaaactatatttatggttttagtgaattatgtgtgtttntgctaaagagaaaaaaccatccaggtcacggggcaccaatatttgagacaaatagtccgattag

SEQ ID NO: 486089 - DNA, 234 bp, Homo sapiens
gccaggtgtagctgcggagtacatttgcgcgtaacgttggcgcgttgccgcaacagcagctgaccatgctaatcatagccagccaggaggaggttcacatgatagtggggtccgactccgaagacagtcagccaggtttcggcgtgtgaagttagctgctgccgtgggagacaattcatatccatttcgcatcttatacagttgcacgtatttctagaatatattctagcaaac

SEQ ID NO: 486090 - DNA, 192 bp, Homo sapiens
  misc_feature (115)..(115): n is a, c, g, or t
  misc_feature (171)..(171): n is a, c, g, or t
ctagccacaagcagagcagttgcctgatgaggatgccccggcgcatgtgcagggtgatgtagtgggagccgtctctgccgttggactcccaaaaggtcctggtgccggggtgtgncagcccgccggcccggggcgggtttttttttttctccaccttctcccagcacttgncctccttctcttccacactgg

SEQ ID NO: 486091 - DNA, 575 bp, Homo sapiens
cacctgtgaaggtgtcagagagatattctgcttaaaaatcagagtgactccggcttaaatagcagctgggtgagataaggctgagacctactgggctgcattcccaggaggttaggcattctaaccttctatcaggatgagatagaaggccagcataagatataggtcacgaagactctgctgataaaacaggatgtggtttaaataaatgccagccagaacccaccaaaaccaagatggtgatgctcattctcactgctcattatatgccagtataatgcatttgcatgcaaaaagactctaccaccagtgccatgacagcttacagatgccatggcaagatctggaagttaccctgtagcctctaaaatggggaagaaccctcagttctggaaaatttctgcccctttcctgaaaaactcatgaataatctaccctttgtttagcatataatcaagaaacaactataagtatagtcaatcgagcagccaatctcaccgctctgtctatggagtagtcattcttttatttacatctctaataaaattgctttcacaaaaaacctcacccccaca

SEQ ID NO: 486092 - DNA, 1116 bp, Homo sapiens
acgttacatgactcacgccctcataatcattgtccttatctgctacctattcctgtatgcccttttcctaatcactcatcaacgaaaactaactaatactaacatctcgagacgctcaggacaatagtaaagccgatctgaacttgatcacttgccctgccgattcatccatagtcctctatcgcccttcccatccctactgcgatccgtttacgataacagacgaggtctacacgatcgcctccccttaccatcaaatcaattggacaccgaattggtacgtgacacctacgagtgtacaccgcacgtaacggcggaactgaactcttcaagctccgtatcataacgttccccgcgattattccctaggaaaccaaggacgggaccttgcgagcctcccgttgcacgtttgcaccaaatcgagctatgatactctcccgtatgttgcatacgcccccgccaattactgttactaatttacacttcaccattcgaacagatggaactgttgctttggcaacttccagttttaatgcccttgctcactcgcaaccgactttgaaaggggctttcacaagagataaccgatgcgatttgcccaaagtttccccacaggagcaactcggttccttacaatagaccccaaaaaatcgccgcacgcaatctagtccaacgcctgggcgttcaacccaacctagaaacccaccaggggaggcgcggtaaatagccgtgaacactgcggtatccaaacacttaggccgtgtccgcttgcgacgacgaatttcccctttggatggacgcgaaggcgccgaaatattgatgggccaacccagaggggttactattcccacaggtgtgccctagcaccaaaagtatcagggagttcccccagtttacatgggaacaacatctcctgacacagcttggtatgcagcccgccatttaactgagtcgcataaagattgcctttgtgaatgggcaaaaacaacatcttacagacgggagggtccccccggtcatgaaacttatgagctaaaaccaccacccgattaaaatttaagcgtcaccaacgagaccctcccacagactgttacgcttttaaaatcccgcgccgac

SEQ ID NO: 486093 - DNA, 183 bp, Homo sapiens
  misc_feature (29)..(29): n is a, c, g, or t
gaaggcagccaaaacccccgggcaaattncggggggtttctaaaggttttcaaacattcaaaccaaaaattgggtttttccccttttttggtttcccccttaaaaacaaaaaaaaacgggggtaattttttttgggggaaagggggggaaaaaaaaaccccaaaagccccccggttgggggga

SEQ ID NO: 486094 - DNA, 109 bp, Homo sapiens
acgcaccaaatagagttttttttcctcttttaaaaactctatttggtgcgtgcccacggtgctgcgtcccgtcagacatacctgtatagagttcctaaaagaggaaaaa

SEQ ID NO: 486095 - DNA, 357 bp, Homo sapiens
  misc_feature (114)..(114): n is a, c, g, or t
  misc_feature (120)..(120): n is a, c, g, or t
  misc_feature (124)..(124): n is a, c, g, or t
  misc_feature (158)..(158): n is a, c, g, or t
gtcgaccctctcaccccacctccatttctagcaacatgtccctctgaccccacatccatttcgcatgaaacatgcccctctgaccccacctccatttctagaaacatgcccctntgaccncacntccatttctagaaacatgcccctctgaccccacntccatttctagaaacatgcccctctgaccccacctccatttctagaaacatgcccctctgaccccacctccatttctagaaacatgcccctctgacccacacatccatttctagaaacatgcccctctgaccccacatccatttctagaaacatgcccctctgaccccacctccatttctagaaacatgcccctctgac

SEQ ID NO: 486096 - DNA, 417 bp, Homo sapiens
ttgacttttccttacaaggaaataaaacagatcatgtgtgtgtataaaattaaaaagtaatatcctaatcatctgccacttacacaaaaagaaatttattacctttagactaaaggaaaaatataataggaatgcaatatgtctcggtatgtgcagtcatgtgccacataattatgttttggtcaacaacagaccacatatttgatggtagtctcataaggtaatggagctgagaaattcctatgcttatgtgcttatgaaactgtcattatgcgggagcgatgtccgtcgcttgcagtttcgtggtcatggtagtgtaaagaaggacatgtgctcagttatatagacgaagagctcaggtaagttatgtacagagccttagccttcatgaatggacgacagagcaagtggctgttg

SEQ ID NO: 486097 - DNA, 916 bp, Homo sapiens
  misc_feature (132)..(132): n is a, c, g, or t
  misc_feature (136)..(136): n is a, c, g, or t
  misc_feature (145)..(146): n is a, c, g, or t
  misc_feature (151)..(151): n is a, c, g, or t
  misc_feature (153)..(153): n is a, c, g, or t
  misc_feature (155)..(155): n is a, c, g, or t
  misc_feature (162)..(162): n is a, c, g, or t
  misc_feature (186)..(186): n is a, c, g, or t
  misc_feature (392)..(392): n is a, c, g, or t
  misc_feature (608)..(608): n is a, c, g, or t
  misc_feature (655)..(655): n is a, c, g, or t
  misc_feature (659)..(659): n is a, c, g, or t
gttttacaccgtgttattctttgcggtaactatggaagtgcataatattagtattattattattaacaaggtgtcttacggccaccaccggcggttgtaccgtaggactctcattcgggatgattggaatanactnctggaattnntcaanantngggtatntttaatctgttatgtactagtgtncttgtttgttattgtttttgttaattacaccataatgctaatttaaagagactccaaatctcaatgaagccagctcacagtgctgtgtgccccggtcacctagcaagctgccgaaccaaaagaatttgcaccccgctgcgggcccacgtggttggggccctgccctggcagggtcatcctgtgctcggaggccatctcgggcacanggcccaccccgccccacccctccagaacacggctcacgcttacctcaaccatcctggctgcggcgtctgtctgaaccacgcgggggccttgaagggacgctttgtctgtcgtgatggggcaagggcacaagtcctggatgttgtgtgtatcgagaggccaaaggctggtggcaagtgcacggggcacagcggagtctgtcctgtgacgcgcaagtntgagggtctgggcggcgggcggctgggtctgtgcatttctggttgcnccgnggcgcttcccagcaccaacattgtaaccggcatgtttctgaggcatgcatagacgatacatatagactagatacatgaaagtctagaaattaaattggtaaaagcccaaaaagctgatgctagcagacatgggggtccacctaggagcccttctgggccctctatgctgttcagggagaagtcccatgtgcgtgcagtttagggggcgtcagtacaagattggggagctgaattcttgaagacgaggtagccacatg

SEQ ID NO: 486098 - DNA, 971 bp, Homo sapiens
  misc_feature (14)..(14): n is a, c, g, or t
  misc_feature (115)..(115): n is a, c, g, or t
  misc_feature (117)..(117): n is a, c, g, or t
  misc_feature (136)..(136): n is a, c, g, or t
  misc_feature (145)..(145): n is a, c, g, or t
  misc_feature (161)..(161): n is a, c, g, or t
  misc_feature (186)..(186): n is a, c, g, or t
  misc_feature (217)..(217): n is a, c, g, or t
  misc_feature (241)..(241): n is a, c, g, or t
  misc_feature (447)..(447): n is a, c, g, or t
  misc_feature (663)..(663): n is a, c, g, or t
  misc_feature (710)..(710): n is a, c, g, or t
  misc_feature (714)..(714): n is a, c, g, or t
ttttattcatttcnctgcagcatagctttttcttatcagcatattatttttagcatcttttttatgcttttcttttatctatttaattttcataattattattattattattatnancaattttttgctagcttgncagccgctnctttttgcctttattncgcgcatgctttattattttaatanctgctttaattttttgcaatttttttttatntttaatctgttatgtactagtgtncttgtttgttattgtttttgttaattacaccataatgctaatttaaagagactccaaatctcaatgaagccagctcacagtgctgtgtgccccggtcacctagcaagctgccgaaccaaaagaatttgcaccccgctgcgggcccacgtggttggggccctgccctggcagggtcatcctgtgctcggaggccatctcgggcacanggcccaccccgccccacccctccagaacacggctcacgcttacctcaaccatcctggctgcggcgtctgtctgaaccacgcgggggccttgaagggacgctttgtctgtcgtgatggggcaagggcacaagtcctggatgttgtgtgtatcgagaggccaaaggctggtggcaagtgcacggggcacagcggagtctgtcctgtgacgcgcaagtntgagggtctgggcggcgggcggctgggtctgtgcatttctggttgcnccgnggcgcttcccagcaccaacattgtaaccggcatgtttctgaggcatgcatagacgatacatatagactagatacatgaaagtctagaaattaaattggtaaaagcccaaaaagctgatgctagcagacatgggggtccacctaggagcccttctgggccctctatgctgttcagggagaagtcccatgtgcgtgcagtttagggggcgtcagtacaagattggggagctgaattcttgaagacgaggtagccacatg

SEQ ID NO: 486099 - DNA, 763 bp, Homo sapiens
attcatttggtgtaagggaaatgagatgatgtatcccaagggctttgctagaactacttgtgtgtttcagaataaaaccttattattttttagactgcacatgctgttgcctcaattggtgaattataggcaatgtgtatctttttctgaatgatgcaaaaagtagtgtgacttgctcattggtgagtgagttctacaaagtttcctgttaaaagagctgaaagcatctacttgtttcttaacccaagtgataataaacgaatattcacaacttgtcttaaattgtttaatgtcgggaaaccaagggttttttcaaatatagaagctagatgattgtgggtcacaaatggttaacatttgtcgatcctttgtatatacttgggatatatattaaaggcaaaatatctctggactaactgatggattcatttactaaagcacagctgtatgtatttttgaatacctattatgatcttgagactttataaagtcaatttcttatgactttatgcagtgtatcgggattatgcctttcaggctctatagggatcatgcgcttttataagtaccatagtatatccacagaggatttccacatggttgcggcatggcaagcccttcttgctgtggcaatcaattttccgaccctatgtgttgaatcctcgcgataacaagcattataggcggcacacgaccggggggcacacgagggcccctcaccatcctcaaaggggggccccgacacacatcttttcaagggggg

SEQ ID NO: 486100 - DNA, 754 bp, Homo sapiens
  misc_feature (132)..(132): n is a, c, g, or t
  misc_feature (136)..(136): n is a, c, g, or t
  misc_feature (145)..(146): n is a, c, g, or t
  misc_feature (151)..(151): n is a, c, g, or t
  misc_feature (153)..(153): n is a, c, g, or t
  misc_feature (155)..(155): n is a, c, g, or t
  misc_feature (162)..(162): n is a, c, g, or t
  misc_feature (186)..(186): n is a, c, g, or t
  misc_feature (392)..(392): n is a, c, g, or t
  misc_feature (608)..(608): n is a, c, g, or t
  misc_feature (655)..(655): n is a, c, g, or t
  misc_feature (659)..(659): n is a, c, g, or t
gttttacaccgtgttattctttgcggtaactatggaagtgcataatattagtattattattattaacaaggtgtcttacggccaccaccggcggttgtaccgtaggactctcattcgggatgattggaatanactnctggaattnntcaanantngggtatntttaatctgttatgtactagtgtncttgtttgttattgtttttgttaattacaccataatgctaatttaaagagactccaaatctcaatgaagccagctcacagtgctgtgtgccccggtcacctagcaagctgccgaaccaaaagaatttgcaccccgctgcgggcccacgtggttggggccctgccctggcagggtcatcctgtgctcggaggccatctcgggcacanggcccaccccgccccacccctccagaacacggctcacgcttacctcaaccatcctggctgcggcgtctgtctgaaccacgcgggggccttgaagggacgctttgtctgtcgtgatggggcaagggcacaagtcctggatgttgtgtgtatcgagaggccaaaggctggtggcaagtgcacggggcacagcggagtctgtcctgtgacgcgcaagtntgagggtctgggcggcgggcggctgggtctgtgcatttctggttgcnccgnggcgcttcccagcaccaacattgtaaccggcatgtttccagcagaagacaaaaagccaaacatgaaagtttagaaataaaattggtaaaccccca

SEQ ID NO: 486101 - DNA, 455 bp, Homo sapiens
ttgggtctcttttttggacagtggttcccccctttcccgggaggagtagacccttccagggtttgggttaacaagggaaaaattagggggttttggcccaaaaaaaaaacccccctttttttccaaccttgggatgggtggggggcctttttttttggcccccccaatggtccccccggtttcccattatatcgcagggttgggggcccattttccgggctttcccccagggcaaaaacaaaatggggggggggttttttttacaaaagggccttggtggccaccctttcatgttttttgcggggaggcccccagatttggttttctgcccccggtttgccccccaaaaacccttgggactggggcttttcaaaggggccctgtttaggtttaatggggccgtttattaaaggggggggaaagccccccttaaaaaaaaaggttttttgttttgt

SEQ ID NO: 486102 - DNA, 484 bp, Homo sapiens
  misc_feature (2)..(2): n is a, c, g, or t
  misc_feature (429)..(429): n is a, c, g, or t
  misc_feature (470)..(470): n is a, c, g, or t
  misc_feature (480)..(480): n is a, c, g, or t
anattcaatggtcgcgtccgtagcctggtgaatcgcgcggatctgatcaagattcagctctcgcgccaacaatctgcgtgaagcaacatcagagaggaacttcgctttttcaactgtacgaatgtcgcactgctactggcgtgcagttcaatcggcggaatatcaagttccagaatccccatatcctgaacaatcagcgcatcgacaccggtctggtagaggtcagtaatcagccgttgcgcgggttccagctcatcatcatgcaaaatggtgttaagcgtgacgaaaatttttgcaccataacgatgggcaaacggcaccagctcggcaatatctttcaagctattactggcattatgacgggcaccaaaaccagggccgccgatataaacagcatcggcaccgtgcaaaatagcttcgcgggcaatngcggcatcggttgccgggcttaaacagtttcaagtcgatgnaggaagatanggtt

SEQ ID NO: 486103 - DNA, 219 bp, Homo sapiens
ggcgttaccccgctggcccgatggcactcttacagccttcttcctgggcatggagtcctgtggcatccacgaatactaccttcaactccatcatgaagtgtgacgtggacatccgcgaaagacctgtacgccaacgacagtgctgtctggcggcaccaccatgtaccctggcattgccgagaggttgcagaaggagatcactgccattgggccagcggg

SEQ ID NO: 486104 - DNA, 614 bp, Homo sapiens
gggctttgtctaacccttgatggggagacaacatagcataggagacacagagttcctaggccctaagaatagccccttatatgacacacagaaatacagacaaatcttcccaatgggggacgtgatctatcccatgcagtcattctctgtgcagttactcccatgcgaactttgccgtacaagcaagcaggcacatgacaagcaattagaatctgttattagggagaaaagtcatatcgtagagatgataaaatctctatgctcaaggaccgaggcgcagtggctcacgcagtgtaatcccagtacttttgggaggcacgacggacaggtggatcacttgaggtgaggagtttgagaccagtcgtggccaacatggatgaaaccccgtctttactcaagctaccaaagaggtagctgggcgtggtgccaggcgcttgtggtcccggctactcaggaggcagaggcgggagaattgcttgagcctgggaggtggaggttgcagtgagccaagatcgctccattgcactccagcctgggtgacagtgaaactccatctcgaaaataaaagaataaaagtatgtctgtcatccagctcctatgtctgttatccagct

SEQ ID NO: 486105 - DNA, 277 bp, Homo sapiens
gtgagctcgacccccaccgcaggttgtactgggtagcattatacacacaagtcccttttaaacagaaagtctgttttaactttttgccctacctcagtctgaggaaggtcagttgaagtccttactgtacaagtccaaaattttaggaaaatgagtcccatgatgagtttcctcatgcttcagccatgcacggaccagtcagcttccaggtgtgactggagcagggcttgtcatcttcttcaaagtcatcttgcatgggttggccaagcttggtctc

SEQ ID NO: 486106 - DNA, 377 bp, Homo sapiens
cgacggtctgtaccctttaacttcccgtgtgaaacctgatcctccacattttataaacctctccttccactatgatgacctatattgctatgggagaatccaacagaattttattagcacgatgcctattttatgaagtacaagtcaataacagccaatctgagacacattatgttttctacgtccaataggctcaactgtgagaatccagaatgtgagagaaatgtggagaatacatcttgtttcatggtccctggtgtgcttcctgatactttgaacactgtctgaataagagtcaaaacaaaatagttatgctatgaggatgacaaactctggagtaattggagccaagaaatgagtataggtacagaccgtcg

SEQ ID NO: 486107 - DNA, 897 bp, Homo sapiens
  misc_feature (455)..(455): n is a, c, g, or t
tgcccgtttgtccaccctcctcctgtgtgtacagtggctgtcgcctctctaacgtctgccggaatgccctagccagggtgttgttttgtttgcgcggcgctcccctctctctccggcaagagtctcgtttctcggtctctataacaatgtcgtcttctgtgtacccaaactcatcgtgtctacggtggccccttcaatgattttgcctcgcctatttttatattggctccgggagccgctcgatggtggtgtgcaccgacacacacaccgtgtggtttatgtccgcgccctacgactccttcttgtgggaggaacggcttgaagacgtttcgcggtgacgagcgatatccccctcgcggtggagttacctcagcgaagttgtttccagcggccccaccttcttctggggccccaacacattgggtggtgttatcccccccctttctgtttgtcgnggagaatcgccccgtccgttggtagccccccggcgccttggtggtgggcacaacgccccttgggctttgccgcgccaccccttttgggtgggccgccgccctgcgtccgtggcgctgattctttccccccatgtctccaagcgtctcttgcgggctccgccgcctgttgtcaaacactggggtagaaactcccttctttcctgttcaaataatcacgcagaagtcacgccgcccatgtgtggacgaaataacctccggtgatgccgccatgatcatgctactgagtaaggtcgtgccgaccccacgatattgcattaggaccaccgcggggggccaccaggggctcccccggattcccacgattgttccctctgtcacataccccaaccttggggctggacgcaagcagaagccgatcccttctggttcctaatcaataaca

SEQ ID NO: 486108 - DNA, 625 bp, Homo sapiens
  misc_feature (625)..(625): n is a, c, g, or t
aagtaaccctatttaatatgctctgcagcgattccgcttaatgtttaaattcagtaacgtacttgaaaggcaaatttcagagcttttgtatgttggaggagggcttactgatgcgtgctaagaccgatttctgattgagggatgaaccttgggctcatttttttcttgtgaaggctctttctagaaaaaattttggttttggtctttttaaaaaaaacatacctttttgaatgtatcatgtcttcattaacaacacaaaatacacgatgtggttacttaacttgtttacgacactaaaaaaattactttttatttttagtagcccagggtgagttttatacaagagagatttttcttatcttgggggatagtgcttagccaggagaaattaaacccgatttttttgtgttggaaagacaggtttttattcaccgctttttcttgtttgtagaaagggggaggattggtcccggggtactaacccttttgtaggctggcccctcaattcctttgtcgtatattggccccaaccccccaagggtcctcactctttattttttccaccgcctttttcagccacattatttttgaccacccaccccctattatactcgccccccctccn

SEQ ID NO: 486109 - DNA, 174 bp, Homo sapiens
ggtctgtcttttccccctttgtttaaaaaaaaaccaaaaccaaaaaccccccctttggtgggggggtatgggacgtagcttttttcctaagcatgtctgccaatcccccttcttgctgattagctttcatatgcctatattaaatggaagtatttttgggaaaaaagaacccca

SEQ ID NO: 486110 - DNA, 417 bp, Homo sapiens
  misc_feature (65)..(65): n is a, c, g, or t
  misc_feature (68)..(68): n is a, c, g, or t
  misc_feature (303)..(303): n is a, c, g, or t
  misc_feature (326)..(326): n is a, c, g, or t
  misc_feature (333)..(333): n is a, c, g, or t
  misc_feature (342)..(343): n is a, c, g, or t
  misc_feature (365)..(365): n is a, c, g, or t
  misc_feature (389)..(389): n is a, c, g, or t
  misc_feature (402)..(402): n is a, c, g, or t
gaatttctgacctcaggtgatccaaccacctcagcctcccaaaatgctgggattataggcgtgcnctngcacctggcaaaaaattttttttaaaaaaggagaaagcagtttaaccacaaacagtgaaacagagctggcagacgcctgaaactccatggaaccatgcagctgtaccctagggctcctcccagggaaaagagagatgtcaacgtgggcccaaggtgtcctgaaggcactggggattgggattaactcgaggcgatggcctttcccaggccctccgtgctggcaggagccttttgntcggttagggctggcctttcatnttcactnttgtgttgnntgtggccttgtggcacctgttntttgttcaataaactggcatatantttgttgttttgncgtttgcctgttctt

SEQ ID NO: 486111 - DNA, 875 bp, Homo sapiens
agcggaggggttcgcgcggcattacctgtacccattcaccgcgcggctaccggcggcggcgcgcactgtgtcaggcggcagagacccgccgccaggaatgaatctgaatgtctgctgcagaaaaacgacagaaggctttcatcatgtgttgcttgcatagaatattcaagagacgtgttgtaagctagacgtgctgtatgaggaactagggacaggccgcacaggctactgtctgatctcgaagcatacagagaccagcctggtgtggctctatcaaccctccaatctggtgtgtgcaatgctgaggaacatggctcaagaaactaatcacagccaagtgcctatgctatggttccagctggctgtggagtttcactggaaaccctcgtgacaaaactggcagtgtgttcacgtatgctagtaaaggaacatcttccaagacagaagtagtagtaagtgggtagaagtaagcgccacctgcatacctctgtcagtactctgtctgaatcttttgacgcatgttcaactggcacacgatggctagtgtgccagaagcccatgtcatgccattagactctacatcttcagtcttatgcagcccagccctgtatcaaatcagtcacttttatcagaatctgtaggcatcattcgtcaattggacagtgagatctgtggacgaagcagtacctgaaaccagaagatgtgcaggcttcagtatcagacacaagcacagcagtcatctgaaagagcaaagcaagtctcttggaaaaacctgaacaaactaaagaattcgctgtttcatggtgcaggaagaaagtggggacttactgggtttgaattgccggtgttgggactgtttaactggggtgttaccc

SEQ ID NO: 486112 - DNA, 131 bp, Homo sapiens
tgtctgtgtagagtgttgtgtcctctgtgtggtgtgtctgtgtgttgtgtgtccatgtgtggtacgtgttgtgtgttgtgtatgttgtgtgtcgatgtgtgtgttgtgtgtcggggtgggtggagagcggt

SEQ ID NO: 486113 - DNA, 223 bp, Homo sapiens
  misc_feature (155)..(155): n is a, c, g, or t
  misc_feature (165)..(165): n is a, c, g, or t
  misc_feature (184)..(184): n is a, c, g, or t
  misc_feature (218)..(218): n is a, c, g, or t
gactctattgaggatccccggcaggttcgaggcacgcatcacaggcctcactgtgttgcttccacactcgtcagcaatcaccatcagtcagcagcaacagcatgaagtattgctggggacaagcccattcatgtctgaagcagatcctcctcctnaacccctgcnaacaccccagccacacatncccacactcataagaagtcccttgttacaggccnggtgc

SEQ ID NO: 486114 - DNA, 829 bp, Homo sapiens
  misc_feature (163)..(163): n is a, c, g, or t
  misc_feature (178)..(178): n is a, c, g, or t
taaagagaaaacagctgggccccggggaccactaccacaaagacacggagaccggtagtggccctgaacggctgggctcgctgatatttattgcatacaagacaagggggcaggataaggagggtcagtcttctaagtgattgacaaggtgaagcaagtcacntgatcacaggacagngggcccttccctcttaggtagctgaagcagagagagaaggcggcaggcatcagcgttttcttctatgaacttataagatcaaagactttaagactttcactatttcttctaccgctatctactacgaacttcaaagaggaaccaggagtacgggaggagcatgaaagtggacaaggagtgtgatcattcaagcaccacagggagggggttcaggcctccggatgactgcaggccaggcctggagaatatccagcctcccacaagaagctggtggagcagagtgttccctgactcctccaaggaaaggagactccctttcacggtcggctaagtaacgggtgccttcccaggcactggcgttaccgcttgaccaaggagccctcaagcggcccttatgttggcgtgacagagggctcacctcttgccttctaggtcacttctcacaacgtcccttcagcacctgaccctatacccgccggttattcctaggttgtattagtaatgccacaaagagtaatattaaaagctaatgactaataatgtttataataatgatggataattgttcatgatcatcgctgtatctaatttgtattatgactattcttattctattttctttattatactgaaacagtttgtgccttcaag

SEQ ID NO: 486115 - DNA, 319 bp, Homo sapiens
  misc_feature (5)..(5): n is a, c, g, or t
  misc_feature (38)..(39): n is a, c, g, or t
  misc_feature (64)..(64): n is a, c, g, or t
  misc_feature (74)..(74): n is a, c, g, or t
  misc_feature (86)..(87): n is a, c, g, or t
  misc_feature (94)..(94): n is a, c, g, or t
  misc_feature (98)..(98): n is a, c, g, or t
  misc_feature (108)..(109): n is a, c, g, or t
  misc_feature (120)..(120): n is a, c, g, or t
  misc_feature (153)..(153): n is a, c, g, or t
  misc_feature (229)..(229): n is a, c, g, or t
  misc_feature (239)..(239): n is a, c, g, or t
  misc_feature (251)..(251): n is a, c, g, or t
  misc_feature (253)..(253): n is a, c, g, or t
  misc_feature (281)..(282): n is a, c, g, or t
  misc_feature (287)..(287): n is a, c, g, or t
  misc_feature (304)..(304): n is a, c, g, or t
  misc_feature (313)..(313): n is a, c, g, or t
atgangacacgtgggtgctgaactcgggcgccgtcctnnccggcatggtcctcccgagctccgncagcattacntcacccggcccnntctgttncccnggtccagccnngatggcgcgcncctggtctgtctgattcccctagccgccacccngcgtttctgtaccgggtctctgcagtgttaaacggacgtgtaaatagtggtaaatagtgaaagcctgtccttcccnaaatgtaaanccatctgtccgncntaaggacgacaccgtcagctgtcggacnngcacncgtttaataaactgacncttgcattncctggg

SEQ ID NO: 486116 - DNA, 785 bp, Homo sapiens
ggctaggtagaggcccgtggttatcggccgaggcagagtatgacggggatgtacgatgctggtgtggcgggtgctgcacgcgctgctctgtctgcaccgcagttgctcacctcctggctccgcgttcggttcggcacctggaactggatctggctggctgctgctgcctgcgccgcctctgcctgcggtcctagcgccgctctgtgcttcactgctcctgcaatgccccctgtgcagtctggcatgtgaacctgcctgtcaccacctggcaccctgctgctggggtggtctgtgcctggcagcctgcacaccacctgtgattgctgctgtgctgctgctgtgactgtgtctgttccttggagaagctgcctgtgcatatgggcctgtgtgatcaccgaggtggatgcaggaacccagcttctcggacatcgcgagcctacgtggtgtggtgtatggccgtgggcatctcctacattagcgtctacgaccaccaaggtattttcaaaagaaataattccagattgatggatgaaatttaaaacaacatgcaagaacttctgggcctagatagtcaaaatactcaccagaattttgcaatagtaatgacaaaggatgatcaagtataaaattgccatttggcagtgaaggtgcttgactccggacaatggaaaagcagatattgtacgagcttgtcagggacttgccagtaagaaccaaaagcaaagaaccacagatttgctttgatacggaagcagtacttaattaatgtgtctatctgatagaaa

SEQ ID NO: 486117 - DNA, 503 bp, Homo sapiens
gatgcagaatggaggatgtcataccaggagaaggtgtggagtcagcgctcaaaaacaacagtcgaagatgtgcggttgtgccgggactccaagcacccaggcactatgccgtctacaacctgtccccgaggacctaccggccctccaggttccacaaccgggtctccgagtgtggctgggcagcacggcgggccccacacctgcacaccctgtacaacatctgcaggaacatgcacgcctggctgcggcaggacacaagaacgtctgcgtcgtgcactgcatggacgggagagccgcgtctgctgtggccgtctgctccttcctgtgcttctgccgtctcttcagcaccgcggaggccgccgtgtacatgttcagcatgaagcgctgcccaccaggcatctggccatcccacaaaaggtacatcgagtacatgtgtgatatggtggcggaggagcccatcacaccccacagcaagcccatcctggtgagggccgtggtcatga

SEQ ID NO: 486118 - DNA, 865 bp, Homo sapiens
gaatgtccttgacaacaaaaagaggacagctctgacaaaggtatgcagtagccaactatatcagcatgaggccgtacaatgccaggaagatgaatgtgcgttaatgttgctggaacatggcactgatccaaacattccagatgagtatggaaataccactctacactacgctatctacaatgaagataaattaatggccaaagcactgctcttatacggtgctgatatcgaatcaaaaaacaagcatggcctcacaccactgctacttggtgtacatgagcaaaaacagcaagtggtgaaatttttaatcaagaaaaaagcgaatttaaatgcgctggatagatatggaagaactgctctcatacttgctgtatgttgtggatcagcaagtatagtcagccttctacttgagcaaaatattgatgtatcttctcaagatctatctggacagacggccagagagtatgctgtttctagtcatcatcatgtaattgccagttactttctgactacaaagaaaaacagatgctaaaaatctcttctgaaaacagcaatccagaaaatgtctcaagaaccagaaataataggatggtgatagagagggtgcaagaagaaatgaagaagctgaacgtatatgtgggatttactagaaaatctgattaatggggtactgctggcaatggtggtgaaggataattcttcaaagagagggaactgaaattgaatttctgaaacgaagtgaaggatccaggtggggtggggcgcactgggattcaggcttgtgggcggaggggcaaaaatgggtttttgtagaaaagctttttttaacgaaattttttgaaactggggggggaattaaaaaggg

SEQ ID NO: 486119 - DNA, 147 bp, Homo sapiens
  misc_feature (19)..(19): n is a, c, g, or t
  misc_feature (142)..(142): n is a, c, g, or t
gggagggcagcatgcgacnttgatctttgagcccactcgtctgcatttgttctttgggattatataatctagggccaagaagtttactgcctgtggagcgggcaggaactctagccacctttctctgttacctgcagctganttggc

SEQ ID NO: 486120 - DNA, 366 bp, Homo sapiens
ggaaacctccgccttcaaggctcaagcgattctccgtggctcagcctcccgagtagctgggactacaggcgcattgccaccagtgccgggctaacttttttccacctttcagccagaaagggggcgtcacagtgtgggccaggattggtcccaatcccctgactctgtgatccgcccgcctcggcctcccaaagtgctgggaccacaggcgtgagccatggcgcggggccacaattctatttcttaggcagaatcaggtgataccaaaaacggcaaggtcctagggtcaacctaatatatagagactgggagcttacttgtacttcggaccacgagtacaaccggccgggggggggactcctctaa

SEQ ID NO: 486121 - DNA, 655 bp, Homo sapiens
aaagccgccgctgccaaagctgccgccactagccgggcatggccatggcgtccccggccatcgggcagcgcccgtacccgctactcttggaccccgagccgccgcgctatctacagagcctgagcggccccgagctacctgccgcctgcccccctgacctggtcctcgctgcctctgtgtccctggcgcccctctccactgcgcccggggctgcgctgagggtgcgcagcgccctggagggcttgcccgggggaacctggagcccccgccccgggcctcccgacccgctctgcccgctccggacctggtctgcagcagaagactagcggcggcggcctggagcgccccagcccccgcagacgatgcggagcatctatcgaagcagccgcatggatcccagagtccacggacggagcgacggcagaggggcactgcttcgccgaagttggtgctgccgggcggacctcggcatggtgtgacctgtgacggacgagcaggtgctgcgagcaaggctgcatgcgctgcacataacatgtaaaattcaccctgtcacccagaatgcctgcagacctgatccagtggacatgcagtcagcacggaagggtatatacccgggacagaccctctccagaaagacacctcaacagtgagcttc

SEQ ID NO: 486122 - DNA, 1979 bp, Homo sapiens
ggtactcatgtaatgattgttactagtgtagttggtgcatagggatgggtgaccctgcaaaaaaggggcacagcaaactctatttcaggtacaaatggaccttatctttaggcaaatccttgaaattttggcagggggaatcaggttttcctgtgagttttttgtttttggcttttcatagacatctacatgaagtctctgctttagaatcttaaaactgtagcttcagaggccgggcacggtggctcatgcctgtaatcgcagcactttgggaggctaaggctggaggaccacttgagctcaggagttcgagaccagcctggctaacagggcgaaatcctgtctctactaaaaatgcaaaaattagccagacatggtggcgggcgcatgtaatcccagctacttgggaggctgagggaggagaatcacttgaatcctgaaggcagagattgcagtgagccgagatgacaccactgcatgacggaatgagactccatctcgaaacaaaaaactgtagcttcagggattcacttaaattatcatttataggccaggagaggtgtggctcatggcctgtaatccaagcactctagaaggctgaggcgggtggatcagttgaggccaggattttgagaccagcctgggcaacatggcaaaaccctgtttctacaaaaaaagaattctctgggtgttatgatacacgcctgtagagacagggtctcgggccgggcgcagtggctcacgcttgtaatcccagcactttgggaggccgaggcgggcggatcacgaggtcaggagatcgagaccatcctggctaacacggtgaaaccccgtctctactaaaaatacaaaaaaattagccgggcgtgatggcgggcgcctgtggtcccggctactcgggaggctgaggcaggagaatggcgtgaacccgggaggcggagcttgcagtgagccgagattgcgccactgcattccagcctgggagacagagcgagactccatctcaaaaaaaaaaaaaaaaaaaaagacagggtctcactttgtcacctatgttggagcacagtggtgccatcatagctcactgaagtcttgacctcccaggcttaagggagcctcccacctcagccttccaagtagctggcactataggcatgtgccaccacacctggctgatttttgtatttttagtagagatggtgtttcgccacgttggccaggctcgtcttgacctcctggactcaagcgatcttccagcttcggcctcccagagtgctgggattacaggtgtgagccactgtcctggaccaattttttttaaagaaggaaaaataaaattaattcagttctacttaaaaaaaaaaaaaaaaaacggtcaggcacagtggcttacgcctgtaatcacggcactttgggaggccgaggcgggcagatcacgaggtcaggagatcaagaccatcctggctagcgtggtgaaaccccatctctactaaaaatacaaaaaaattagccgagtgtggtggcgggcgcatgtagccccagctactcagtaggctgaggcaggagaatggcatgaacccaggaggcggagcttgcagtgagctgagatcgcaccactgcactccagcctgggagatagagcgagactccgtctcaaaaaataaacaaaaaaaagctctttaaaggaaacgtgcccggcacggtggctcacgcctgtgatcctagcactttgggaggctgaggcaggtggatcacctgaggtccggagttcgagaccagcctgaccaacatggagaaaccccgtctctactaaaaatacaaaaattagccgggcgtggtggcgcatgcctgtaatcccagctactcaggaggctgaggcaggtgaatcacttgaacccaggaggcagaggttgctgtgagccaagatcgcgccattgcactccagcctgggcaacaagagcgaaactccgtctcaaaaaaat

SEQ ID NO: 486123 - DNA, 315 bp, Homo sapiens
cgcgttcaagttacctccgacaagaagatggaattacgtggacacttaaaggcctgtagcaattcactgtgcaatggatttacactttatgtaagagactcatctttcagtaacatattacatagtgggatgagggcagaggaagagtggaagaatagaagactctgttcttctctggacctcatttactcttttatgataatatcattgtaatgacttgctgtctaagatatacttttgtggtatgcagaagaatggccccttgcctacgtccttgcctttttcctgtgttcctgttgctttgacgcgtgcggt

SEQ ID NO: 486124 - DNA, 177 bp, Homo sapiens
tgaaagtatatccgtaggtatatgcagagctgacagtgacactgtagaggttcctggagagggtggcaatgccctggtccccaggcgaaggggagataggcgatgaagtagagtggtgcggactgctgagtgaactcctccagcttctccaggatagctgagtagaaggcagcactg

SEQ ID NO: 486125 - DNA, 659 bp, Homo sapiens
aggatatggaacataagattaaatctgatacatatgttagtttcggagatgctatgatggctatagtagagtgcctgaagtacaaagtatgactattgagctgtaaagctgtatgacgcgatgaatgacttgtgcactcgagataacatgctcatcagagcgatgggtacctcagcaggaattgacatggcgtatatcctggcgcacttcaagagactctatggatagtatctgtactcgaacatcatgggtgacacatctggagactacaggaaagtactgttagtactatgctgaggagatgatgaaactactgatcctagaacgacaggacgatgctcatgactatgaagtcttgtaacatcattgttctacgactgctatagtattatctcaggatagctatctacgactcgcctacagctggcgtctagaatatagactgcatgactattattccactatcattagtcattaggatgctttaaagctgtacttgcttattcaaagcctataagatgtaaacggcagatgttaagtagaacatgatatggataccatggatttcagagacttccttctactgttgcgtgtacatacatcgacttgttaaagtatccagaatgtcgttttaacgaaacactttttggactctgtct

SEQ ID NO: 486126 - DNA, 1574 bp, Homo sapiens
ttactaccagacaaccttaagcgcaaaccatttacccaaataagagtataggacgatagaaattgagcacctggcgcgaatcagatatagctaccgccaaggagcaacagatgcaaacaacttcataacctacgcaataatatagccaaggagtaacccactataccattctgcaatacatgacatcaactcagcaaataacgtttgcaaggcagagcacaaagctcacagacccgccagcaaacacccagcacgcagcatcaccatcaacgcacacggagcatacacaagcagcacaacacacggcctacatggatcagcacaacacatcagactggagcaagccacccaactcagcgctcacgcaggcgcacccagaaccctcacactgcagacccaatgtgcatgcaatacgcacctggcatagcctcacacaaagagattaagaacagctcacgagacgcatctcaaacattaaaaaagctaaagaccccaaccagcaacaccactcgcaaaaactcaccacactagactcacaccccacgcgaccactgcacaaggaacgcaaacagaacgagcacccagccactcatccagaacacccaccacccaccgccgcgacacacccctaagccacagcacccagcagccacccacacaccctcaccacccaccccacactacgaccaaccgcccaccacaagcaccacacacccccacccccaagccccacaccacaacacgcggcatcccaccccgacacaacgcacaaaccaaaacaataacccgaaaacgaccacaagagtgaacacacaaccacaaaacaactacaaacctcggacaccgtacccaacctaaccaccaaccaacccgagggcgcgcacaaacacgtcccatcccacacaccaccagatcatacacgacacgaacagcctaaacctgactacccgaatccacacgcagaaaacaaccgcaccaccaccgacaccatacgccacccacgcgcacataacagccacccggcccgcctcaagccacaacaacacaccaggaacgaacagactaaccaacccacgcacccgcaacgccaaagactaacaaacaaacgagaccaccacaacacagccagcacgacaataacgcccccaacacagccaaccaaccaacacccgaaccgcacacgaccaactcaacacagaccacaagacatcacagcaaacacaacaccgagaacacacaaggactagacgcacgcaccagcgaccacgtcacgctcgacgatcaagaacgacgacgcgaaagcaacgcgcagcatcgcgaaaggaacgcacggcagcatacgaaagaagctcacacagcagcgaccagcgacaaagcgagagctacgaacacctcgtagcaaccgcaacacgcaacccagaggacgagacagacaccagacagccagccgcaacgccaagaccagcacaactaccgccgcggcagacgacagcctgcgagcagcgagccccgcacgccaaacacgcaacccacaacagcaagcaagaccccacccgaagcgcggacctacccac

SEQ ID NO: 486127 - DNA, 350 bp, Homo sapiens
gagcatacaacagaactagtataaatccatagtagccattcattatcttacccagaagtttaacggtcatatttaaagcatcaaatagggactcagtgttctgagtaccctgctcgtctcagagtcttcaatccaccccccagcccaccggaagaagccgtttctcaagtgatctctttaaggccaatgtactgtgggctctagtacctccagcaatggccaggctggtgttgcttgatgagagagcactgacgggcaccagcggcatgtggccccatgtgacccctcagcctatggtgttgtgcctgtaacctggggctctccacggagctctgacgaagacctcagta

SEQ ID NO: 486128 - DNA, 134 bp, Homo sapiens
actcagatcatgtcctgaaacacatgcacagccttcaatgttaggaccacagccaagatggttccaaaataacacaagctagacactctggtgggagcctgctctctctcagcctcctgtcctctatgtaccat

SEQ ID NO: 486129 - DNA, 231 bp, Homo sapiens
tgacagctgtacctgttgtcacgtattctctgctcatagttctcagtctttagctgtaatacttttactgcagaatctctataccatgcctgcctgccggaagtgcttctaacgctttattgagttgatcgccaatagtatatatccattcctcttcgtcctgtagcatcactataaaggatggagtacatgacaggtacagttcgcgcttttagctgcaaacacacaatg

SEQ ID NO: 486130 - DNA, 243 bp, Homo sapiens
agcgcgtacagaataataccctaaacacaggccgggtgcagtggctcatgcctgtaatcccagcactttgggactccaagacaggcagatcacaaggtcaggagttcgagaccagcctggctaagcattgcgaaaccccgtctctactaaaaatacagttataattttacatacgatactaaatttcaatcataagcacgttcagaataataccccaaaacacaggccggtttgcagtaggca

SEQ ID NO: 486131 - DNA, 454 bp, Homo sapiens
tcagtcgacctttaaaaaggatttttgtgaagcaattgatttatcaaagcaaaaaaattaaaaatagaaacttgctttatggatgttttattttataaagctcatgtcaccaaaagctgcttctccattttatgtaaaacattgagaatgttttcatgttttctggtgacatgtagggtctgtagtcacccctgcatattgagaaactaggaccacactgcatcggactagtcaggtccattttatgtaaaacattgagaatgttttcatgttttctggtgacatgtagggtctgtagtcacccctgcatattgagaaactaggaccacactgcatcggactagtcaggtccatttacatgtccaagaatcttttcttaaattccttactttgttcattcattggctgttcaggctgaaaatggaaacaggtagcttttatgttttttattata

SEQ ID NO: 486132 - DNA, 159 bp, Homo sapiens
cgtgggcatgtttgcattgagcagagccccacactgagccaccactaggcgacaccccactgctgctggagtagtagcttccactgctacctccggcaagactccaccgaggcgccgcaagacctccaccgaggccaccggcatagccacttgcactgc

SEQ ID NO: 486133 - DNA, 211 bp, Homo sapiens
tctagctgatccttactggcagagctggacagttcgagagtactattgattcaaactgccaaaccaccgggcagcgaaaagactatggaaagtgtgcgtggagcatcataccttctacatggcttgttttctccatgagcatgcaccaaaagccaagttcctgaacttgggggtcaaatttccgcttatagtgtgcgcacccaagtcacag

SEQ ID NO: 486134 - DNA, 104 bp, Homo sapiens
  misc_feature (46)..(46): n is a, c, g, or t
  misc_feature (65)..(65): n is a, c, g, or t
accttggaattgtttccagtttggggctactgtaaataaaactgtnaggaacatctgtgtacaanccactgtgtagacataggtttccctttctttggggtaaa

SEQ ID NO: 486135 - DNA, 109 bp, Homo sapiens
gggaaatgctggggaagcaagtcagcagtcgagcctgcaggaggcagcaggaggtgtgcagtgaggacatgcgtgtgaccacgggacgtgggacgagggggggcatggg

SEQ ID NO: 486136 - DNA, 322 bp, Homo sapiens
acagtttggatttccatgattgtgtagttcttttaagaatgagcctgggggcagtggttcacgcctgtaatccagcactttgggaggccgaggcgggcggatcacaaggtcaggagatcgagaccatcctagctaacacagtgaaaccccgtctctactaaaaatacaaaaaattagctgggcgtggcagcatgcgcctgtagtcccagctgctgggaaggctgaggcaggagaatggcgtgaaaccgggaggcggagcttacagtgagccgagatcgcgccactgcagtccagcctgggcgacagagcgagactccacctc

SEQ ID NO: 486137 - DNA, 190 bp, Homo sapiens
caatggtggaatttcaggccctgtgactgtcaagctggcaagggccatgattgcgggaatggaactggggcttacctgggaggtggtctcaagcagacacggaatggcagaggaggatggcaagtcccccccaacgcctattccatcctgaaattctcagtgtctgaatggctattactgtacttgctat

SEQ ID NO: 486138 - DNA, 642 bp, Homo sapiens
  misc_feature (70)..(70): n is a, c, g, or t
  misc_feature (72)..(72): n is a, c, g, or t
  misc_feature (117)..(117): n is a, c, g, or t
  misc_feature (132)..(132): n is a, c, g, or t
  misc_feature (146)..(146): n is a, c, g, or t
  misc_feature (195)..(195): n is a, c, g, or t
  misc_feature (203)..(203): n is a, c, g, or t
  misc_feature (257)..(257): n is a, c, g, or t
  misc_feature (344)..(344): n is a, c, g, or t
  misc_feature (366)..(366): n is a, c, g, or t
  misc_feature (375)..(375): n is a, c, g, or t
gaaccaaaatgagaaggcaatgaagagccaaagtcctaaatttgtaataacaagtttatgaaaagtctananagtaacaggaaaatcatagaattatctacttagggagcacattgnaagggcaactgcatntatgcacacctaantgaaaatgatacttattcaaataaatgatatgctctacaggggtgctgncattctgnccttgttattcttttaaatactcataatttatctaagtttatcatgctgttcancttaaaagcactagcactaccataactcatgattcctcctttaagttatacttacagttggagcaggagccataatgctcattggtncaggaatcattggggtccctangaaaagaanaaccacactgattttacatgactgcattctctatcaacaacatgccacacaattaagtatccttactcataattaacataagtggaaatataagacaaatgaaagtgaaatactgataaatactatcttattttcaaaaggaatgtggtatcaggttggtccatataaacttacaaaaaagactatcctgaaaacaaaatggccacctcaatatgcttttgacttaaagagcataaaatcctggatagttatccattcgggttcatg

SEQ ID NO: 486139 - DNA, 103 bp, Homo sapiens
tgatcataaggactagtataaatgatttgccataataagataataacgtggatttatattgtactttcatatctgctatcgtcttgttttgacaacaccctag

SEQ ID NO: 486140 - DNA, 336 bp, Homo sapiens
ctgtaattaaaaaatgggtagtttctggtgcattataagaaaaaactggccgggtgcggtggctcacgcctgtaatcccagcactttgggagaccgaggcgggcagatcacgaggtcaagagatcgagaccatcctggctaacacggtgaaacccatctgtactaaaaatacaaaaaaattagccgggcgtggtggcgggcgcctgtagtcccagctactcgggaggctgaggcaggagaatggcgtgaacctgggaggcggagttgcagtgagccgagatcacgcaactgcactccagcttgactctgcagtcagccagagcgagactctgtctc

SEQ ID NO: 486141 - DNA, 218 bp, Homo sapiens
gtgggtgtcagatgcccaaaaagttcgagcattgttatccgctgcaggctctccaagtcatcaacgctgtctctactcatacttcgtcgcacagaccacgactcatgagacactagccacaggccatttcattagcgtcatccacatttagatgcagctgagcaaaagtttgcaatcatcgccatctgttcgagccactaccacctgccggatcccat

SEQ ID NO: 486142 - DNA, 1002 bp, Homo sapiens
  misc_feature (47)..(47): n is a, c, g, or t
  misc_feature (989)..(989): n is a, c, g, or t
  misc_feature (1002)..(1002): n is a, c, g, or t
aacagttttatatcgcttacccctcctcacgaaccagagcactttgngactacagtctgggtgcttaatcggaaatagcaacagataagctttcttttcctcttaaaaatattacgtcgaaagaatatctgctaaaatgatagccaggcaacagcacacgaaagcttcgaaaacaccacctgaccatagtaaaagatttactccatacttatgtcgaaacgcacctactcgatctctaactcgaaaacctataacagccacctcttatcctgaaaatactgatcatcggatattacccataatctgtgaccgagagacactctcctcctaattatactcacgagagtcggtgcggctctgacccctcgccctggaaacatgacatctacaataccccaacccccatggctatcgtaatctgcagtaccctaaactccctctgccactatcccgaacttctccgggcaaccggaccaggttaccagcctatctacgaattcattctcctatcacaacccactatgaatatcatagacatagaatataatacacttctccatggacacactaccccaccccgcccttgccatgaaccacacaccccacctcgcacccgcccacacccccgccccctcagccccctccccctcacccttcactgccatccactctacgaccctactgcgtcgccgacaacgtccgccaccgggcctaccatgccgcctcctagtccagtctcacgtttctgtccgcgcgacacctcacccacacgctactactctatcctacctcctctcctatcgcccctcccccctgaaccagcggtccactgcagtctctagatgagtcgttcctacgtccttcaccgttctgccctcgacaatgcatgactcctccatcacgatgtctgacatatacacgtagtcaatcgagtcgaccgccccacctctcgttcgtggatcgtgatcatctcgcgtatcgtcactatntatctcgttgttn

SEQ ID NO: 486143 - DNA, 1322 bp, Homo sapiens
  misc_feature (1)..(1): n is a, c, g, or t
  misc_feature (7)..(7): n is a, c, g, or t
  misc_feature (12)..(12): n is a, c, g, or t
  misc_feature (48)..(48): n is a, c, g, or t
  misc_feature (143)..(143): n is a, c, g, or t
  misc_feature (181)..(181): n is a, c, g, or t
nacaaancccangccgggttgggaccagcctcagcagctgctgccagngtaccagcagactcttccggccacccatgtcccagatgcctccgaccccaggcttccgacccatagtccagagaatggtaagtgccccagagctngccggaagatgatgtgggaatgagccccggatccccanccaggattaaaatcctccagtaaaataattttacccagttagcctgggaagctggtccagctctggggggattaagggccaaattatgcctgtcatgaacctgtcccaccactgacgtctgccaaagcgaatatgaactttggtagatccattgtctgttctatttatttttcccagtgaaaagtattttgatagagcttttcattttataaatacactgagttaaccaaatatcatggatttccgttgttcttaagacatgcaattcaaatgtaaatacagtagagtattacttaggtagaaactcgtggtgattttaagattggaaaagaatctgaggaagagttgaataacacacattctaaagactagaacattttattgtatgttgtaaaattgggtagaaatttgtgtttgtgaaaactgagcattaaaaccttacagagaccgtttctcgtttacttaagaaaatgtgcggtgtgttgtctgttgttaattccattccctccgtgtgtttccttaaaagcttctgtctattagtggcttcctgtgctctgggcacttaactcctaatctttcaaacaccgggatgcaaacagcacagggattagacctgtgtgcaccctgacctggagggtgagctttgcctgctgtctgctcgcttggctctttatacagactgaggctcagtctgcctgcccgtctctggggtgttccatctcagcattaggtcagttggttctgttgagtgtcttcaggtccacctccagctggtgattatttcagaataaccaaaaactgtacttggttatattctgaatttgcatgtttgcctgacttatatttctcattaaacctcttagtggataatttcttggtccgtgctaccgatgttgaagggattcggttccgcgggtaattaccggagtctccctaggagcggggggctcctcgccacgtgtttggggttacccaatttcctccccccaagggggtgtgttttccgcccggcattcctcacccgccttgttcccatctttcccggtccgagcacgtcggaacagagaggctccctcgtgtcacacggcgtctcggggacgcccccagtgtgaggcgctctcgtcctgcctcgtcgtctcct

SEQ ID NO: 486144 - DNA, 159 bp, Homo sapiens
  misc_feature (53)..(53): n is a, c, g, or t
gattactggtaccgctgtcgctcgcacgctctcggtgagtaccgtgcgcaacnatgaagcagaacctcatgttcgccttcctctacaacgcgctgggcatccccatcgccgccggggttctctatcccctcacgggctggctgctgtcgccgctgatcg

SEQ ID NO: 486145 - DNA, 470 bp, Homo sapiens
  misc_feature (26)..(26): n is a, c, g, or t
  misc_feature (40)..(40): n is a, c, g, or t
  misc_feature (63)..(63): n is a, c, g, or t
  misc_feature (80)..(80): n is a, c, g, or t
  misc_feature (222)..(222): n is a, c, g, or t
  misc_feature (230)..(230): n is a, c, g, or t
  misc_feature (258)..(258): n is a, c, g, or t
  misc_feature (298)..(298): n is a, c, g, or t
  misc_feature (395)..(395): n is a, c, g, or t
aggtttttccaagggtttccccccgngcccaacccgagangcccaaaaccaaatccagggaanaatgggaaaacccgtgnggtaattttaaaaaaaccaagttgaccttttccagttccctgaaacggttaaagggtggatttaaaaaaccaagacagtttaagttttgggggaaaccagaagcctcctcctccgtccttaagcccagattcctcctgattncttttagnacgtcatagctcccttagttcctgactncctgtcgcccctaaacttggcatgggtcaagttgaagttncatccttagactgtcagcgttctgagcatggctgaagtattaaaatgtttcatattttttagagcaaaattgatggaaagcatttggctgaatctanccacctgcagtcagattcttcaatgtggtttacccaactggagtagtgataaacaccttaatcataaaatgaata

SEQ ID NO: 486146 - DNA, 915 bp, Homo sapiens
gattttagtggcccgctatggctggcggtgttgatggttgggtcctgggatgcggggtctttgactgaaggggtagtgccaagtggagcgtatcagggacgtcgcgcggcacaagaagaggaccagcctggacgcctggggacgctgtcatgtactgtgctgcgatgctgtgtggtgcctgctgcccaaaacggctgagcaggcaaaagctgtgctgcgacaggatgtgatgtgcctggtggctcatgtgctggtgcctgtgcggtggggggcagacgatgtggagctcttggttttcggctatgcctgcaagcttgttcctgtggacgacgagctgggccctggctcaggaacagggacagcacctcatcccctggatgcggggaccacaagatcctcatcgacagatatgatggacgtggtcacctgcatgaccgtttctgagtacgatgctgacgtattaccacagtgcaacagagcattatcaggctgtctgaagcaggaggcgcgaaatagaggtgcccatttgatgactgaacgagagagctagtggagccattgcagtaacggaatatgccattgaaggcacggaccgacaaagagcaaaacgaaactgaagtgcaaagacgcacaagcaaggtagaacagcccggaagaccacgacaacggcacggagggaacgcaaacaagaaaggaccagacgaaggcaaaaacgcacgtacacaccgacgcaaaggcaggcaacacacaaaaaacagcaccacgagggccagaaaacgcgcccaccgaacagtacgcgaaggaagcgacaaacgaaccagacaagacaagcacgaaacaacaacagagccagagcccgaacaaagagtccacgaagcacagagcgcaacaacccccaacgggaccaggccacga

SEQ ID NO: 486147 - DNA, 169 bp, Homo sapiens
ttccttaaacactgtgctgcggtgtttgcctgcgggtccagtgctggcgggcacggccagtcgggtcggagcggtcggttcgaccccccatcccgagcgccacgaacgcagctggaagacccacgccagcacttccgccaccgcggtatatagctcgcccgggatttct

SEQ ID NO: 486148 - DNA, 707 bp, Homo sapiens
cacctcccacccgcctcttggctcctctcctctagggccgtcgctttcgggttctctcatcgcttcgtcgttcgccaagtgttggaggagaaggcgcagcgaggccttcagggatagatgggaggcgaggagaagccgatggtgctggtgaagagacagcaaaaggaaggaggcaaaaagacgaacaccagaaggatctggagatggaggtcgagctgagttgaatcctgggcctgaagtatatttacacacgtcttgagatgtataatatactaaaagcacgaacatgattccattctgggcagaaaaggcggaaaacagatagcaagccaattaaagtcacttgcctgatggtaaacaggttgctgcggaatcttggaagactaacgccatatcaaatttgcctgtggaattagtcaaggcctggtcgaaaataacgttattgctaaagtaaataatgtggtgtgggacctggaccgtcctctggaagaagattgtaccttggagcttctgcaagttgaggatgaggaagctcagggagtgtattggcactgctagtgctcacataatgggtgaagctatggacatgagtctatggtggatgtttatagctatggtccgtcaatagaaagtggattctattatgagtgtacctcgaagaagggggggtgttagcaatgataatcttatctggagggagtgtagaa

SEQ ID NO: 486149 - DNA, 345 bp, Homo sapiens
  misc_feature (334)..(334): n is a, c, g, or t
caacaaccccggggaatatcggcctgcctcccaactgtgttgaaggtgttaaagaaaagagccataaaattaaaaatgatcatcctgaggccctttatagtctctgcctcaagagactagagttttcccattccttaacctaaacacccaaatatcttaataattgggcaaaatctaaatatcagagataattttatcttgaagattgttaaattataatggtgattcactagcttgccacgtctctgagtcaaaaattaggtctttgtttaggaatcaatcataatctgcaatttggaaataggaagattttagaagactcagacattattanttcttgtgtgc

SEQ ID NO: 486150 - DNA, 308 bp, Homo sapiens
ccacagatacgtcccaacactccatacttccttttccagcaaaaggacctatgcggggggatgggatctaccccagggctgagtaaagaaacccggacacggtgtaatgcttctagcaagttgatcacactagagcccgacccaaaaccccaaaccactctccatcctccccagcctcgcagaatgctggattctaccaagccatacattaccttctagtctgtctcctctgctgagctaccatgtgccgctcctatactcctccccattctcccgtataatctgtcctcagaacacttcctcatatc

SEQ ID NO: 486151 - DNA, 129 bp, Homo sapiens
tgtgcatctgttgtagatattagaaggatgtatactgtcagtttgttctgctatcctcacaaaaaatggtattgccagctgcacaataatatttgattcatccacccacccctgttccccacccgatcg

SEQ ID NO: 486152 - DNA, 895 bp, Homo sapiens
gaagatggcggagctgtcgaagcggaaagcacccctactcctaatcccccgactagagaagcaggagaaaacggtaatctaatcgagtgaggttgctaagcccaggaacagctatattacaggatccctctagcagaagcagatggtggactctggtatgtgacaactgataaaagcaaaatttggccagcgaaaacctgcggtctgactctccaagattctgatactgtttgacgagttctgggctctgtacaagcatatccagttgtctcagttcattttacatgcctggcatgtgatctacctcacttattaaggatggtattgagcctatgtgccggaagagtgagaaaaacaaatggggtggacgattggctaggttacatgtgagacaaacacgcagcagatgaagtgacctcgatcgcttcggctaggagacccttctgtgccttcatgggagaatcttcggtgatgactacagtgctgatgtcattgtggcgctgtgttaatgtaagagctaggggtgatagatagcgagactggactactggactgttgaaaacagagatcgctgttgcaactatagggagggtatacaaggaaaacggtgacggagttcctccaacgaagtagtgaagcgatactaagtgccaagcagaacgcaggattatgtaagaggcgggtcctgacactagaatagggttagtggataagaagagctcttcatgagtatgccctaggaaggccgtatgcagtgagactgtgggcagaacaagccttcacagcaaagtgccgggttaatgaggtacttatgcacagagtaggaacactgcatgggacccgcgcaaacaaggaggcaaccacaaaaggggccgcagtatgctgccgaccgcac

SEQ ID NO: 486153 - DNA, 1030 bp, Homo sapiens
  misc_feature (251)..(251): n is a, c, g, or t
  misc_feature (345)..(345): n is a, c, g, or t
  misc_feature (922)..(922): n is a, c, g, or t
agcgggcctgtgtctgggagggagggaagatggcagccgtggacggcaggcgtggctggtgggaaatggggcgcgacatcagcctaacggccctgactagcgccacgcgatccccttatatcaatccgtcaatacgtggactgttgggccaggcaggtggctctgtacaaccttcggaccataccgggccaagcaagtgggaggacaaatctgatgtggaagtgaaccttattcgtgttatacaaagtctngacttcatctccaaagggccactgggatttcacacactatcattgagaatacgtggcttgatgccactggaacacattcatgggaactacgaancacctacttttacattaggacgtacctattggcactctcttccaaacttccccaggaccactcctgtttcacttcgttcgtaccgagggacatatcgtcgcgacgcactttcgttcccagtccgtattgtgaagagtatgtggtgctatgtttactcggattatatggcaaggtaaatttggggcaaataggaggaaaaattaaggcgacggagcggcttgatcggacatagagatccagtacaaattcgagagtacttggaaacaaggcttcttgatacagggcacgacgttccaatcggggagaaaatcactcgcgcaaacgacgcaacgagaaaaccttatttctcccccccacagatggtgcttcgcgttcgaaagatatccacagggacagaacagagggccaacagaggaaaaaggttagacaatcacctttttttacccggaaaactggccatccagttcgaaggcgggggcgcccatatggagaagcagaaaaaatgagcgaccaaaatcagggttgggcttatacagaaccccctggggtacactcctggacggcccccgagactgtnaacgaccgcaaattacgaccgccaagggtgagataccaccatactttgggggcccagcttccctttagatgcagcccatcagtcccgaaaacgagtcacgtgccattc

SEQ ID NO: 486154 - DNA, 246 bp, Homo sapiens
gaccagcctgaccaacatggcgaaaccccgtctgtactaaaaatacaaaaatcagccaggcatggtggtgggcacctataatgccagctactcaggaggctgaggcaggagaactgcttgaacctgggaggcagaggtcgcagtgagccgagattgcaccattgcactccagcctgggtgacagagtgtcttgaaaaaaaaaaataataaaatgggacctccacactgtgaaggcccttgccagtc

SEQ ID NO: 486155 - DNA, 150 bp, Homo sapiens
agttgacccagagtcgcgcgtatattattagtatttagaatttataaaaaatttatttatttatttatttattttagagacagagtctctctctgttgcccagtctggagggcagtggcgcaatgtcgacccactgcaacctccgcctcc

SEQ ID NO: 486156 - DNA, 426 bp, Homo sapiens
gtgcaggtgtctgaaaccactggcagtccctctcacatctttgctacctgtctggccgtcacggctttaaggttgtttttttgtttgtttgtttgttttgagacagtctcactctgtcgccaggctggagtgcaatggcacgatctcagctcactgcaacctccgcttcttaggttcaagcaattctcctgcctcagcctccagagtagctgggtactacaggcaggcaccaccacgcctggctaatttttgtatctctagtagagacggggtttcaccctgttcgttggccaggctagtctcgaactactgacctcaggtgatccgcccacctcgtcctcccaaagtgccgggattccaggtgtgagcccccgttcctggccacaagttgttttaaacagcttgattgtgcattctactttttct

SEQ ID NO: 486157 - DNA, 990 bp, Homo sapiens
ctgagaaggaggagctgagcaaggatgcgggaggccctgcggcggtccaatcgaggagctgaggtctgcagtgaagaaggcggagagtgagcgcatcaggtgagagcggcaagggactgcctgcttcccgtgccccattctctaactcagtggccctcagccttcctaaggctgtgacctttaatacactcttcatggtgtggtgaccccaaccataaagtcatttacactgctaccttataactgtagttttgctactgctatgaattgtaatgtagatatctgataggcagattgtatctgatatatgacttctccttcatcccgcaaagggtttgtgacccacaggtagagagagaaccactgctctaactgaaccttggcccggacctcacttcaccccatggttagggaatcatgtagatggtgccgcctaccacagagagtggacaggtggcagcagagagattgggtcacactcaggcctcccctgtgtcggtcaccctggaaactgaaccccacacagagacactggtgtgcctctcttcctcccaaggttgttcccgagccgcactatgtcagtgcaaggattgtcatatgggcaggtgcttaggctatctcgagggccaggacaaacgtcaagaccccagggcacagcctttggggcaccacgaactactggtcccaagaacagactcctgcccttgcagactggaagcctgccaactgacgacaagggaagccagaaagtaggcccatcctggaagaaaggctacgagatggctgacagccaaggagcgctggacgcactggcgggctcccaggcaggccacggacacagacccacgccggagggcacaaacagcacagcaagaaataaagcgcaaagaaggaacacctggagaccgggaacacgcaggtgtgacaccgagacagtgacgcccgacggcaccgagccccgaggagaagcagaaaaagcacaaagaacga

SEQ ID NO: 486158 - DNA, 304 bp, Homo sapiens
agaaaataattaatttcatgggactaaatgaactaatgaggataatattttcataattttttatttgaaattttgctgattctttaaatgtcttgtttcccagatttcaggaaactttttttcttttaagctatccacagcttacagcaatttgataaaatatacttttgtgaacaaaaattgagacatttacattttctccctatgtggtcgctccagacttgggaaactattcatgaatatttatattgtatggtaatatagttattgcacaagttcaataaaaatctgctctttgtataac

SEQ ID NO: 486159 - DNA, 212 bp, Homo sapiens
acggttgggccacgcaccgtgatatggaaggattggtgaagagatgtcagaatttctttggtctgctcttaggggaggacgacgcttctgatttattgactatccagtccccttgaaaggaggctccttgctgtatagcaaagctttctcggtgggagagttcttgggtaggattgctgggataacaggaaggagacggtgcgttggcccaa

SEQ ID NO: 486160 - DNA, 1097 bp, Homo sapiens
gcgtttcctctgcagggcacacacacccttaaagctgccagttgaccctgaactgagcaatcactcagaagaccagacatcaactcagacttgttctctcagtctgtggcctgggatctacttctgaggaagtggcattaaatgagctctcagaggcctcccagcagtgacccagaatgaggaaggagctggggccataccagagtcagagctggaccgggagcacggcagggcccagccatccacagcctccaatttcagtactctctaacaacctgagagcctgagccttcggatcttcttgattcctactttgataaagagagggatggggttggaaggacctggcatagagattggaccagtccggcattgacagagccaggacctggggtccggaactgagctcagctccaggctcatctgaagtcaccctgacagcctgaggatggagaccttatttccattaacaggcatggcggttggcagggactggccccagctgagcacggttttccaagtacacagctgggaattaagtcttctctgccgccctcccctgtagtcttgcctggatccccccagtcatctactcccagtaccaaaaaatcctgtattcttgaaaatccgtagtactgagaggtgacagcttgctggagtcctcaaagccctcgctcgtctcggcgcctcctctgcctgggctcccactttggcggcacttgaggagcccttcagcccaccgctgcactgtgggagcccttttctgggctggccaaggctggagcccgctccctcagcttgcacggaggtgtggagggagaggcgcgagcgggaaccggggctgcgcgcgcggcacttgcgggccagctggagttccgggtgggcgtgggctcggcgggccctgcactcggagcagccggccggacctgccggccccgggcaatgaggggtttagcacccgggccagcggctgcggagggtgtactgggtcccccagcagtgccgtgccactggcgctgcgcttgatttctcgccgggccttagctgccttcccgacgggcagggctcgggacgccatgcctgagcctctcaccccg

SEQ ID NO: 486161 - DNA, 115 bp, Homo sapiens
tgtgtcgttccgtggctgcgacaccccgatgtcgcacgtctgccctactcaactttctgatggtagctcgcctgtgcgtaccagtggctgaccactgggatgacgagagaatcag

SEQ ID NO: 486162 - DNA, 343 bp, Homo sapiens
taatcgcacaagggattatttgtggagggtacagagggacactgaacagaatcacaaagcaggaaaaactttagttctctccctccctgtgggtctctttggtctcccgggttttcccgatgttccacagaggtagattgtccctaagttactgcttgatcagagtgctgctcttattaaactcttcattcagcgtatccaattccagcaatggctacatcaatgtccgttttggccaggctacgggccttttcaggagagtttagaatctcatagtaaaagccggaaaattttagtgccagaccaagacaatgtggggtgtgtaggcggcattccttcctta

SEQ ID NO: 486163 - DNA, 245 bp, Homo sapiens
tgctgctgaggtcgtctaaggatccccgcgctagcggcattaatgacgcatctctgcatataacaaggaatttagatctgggccactggggaagtgcgatgggaaagacttgttctcctctccgagggcagcctttgaacgtgggaccatgcattatccccagtgacaaattaagactgttgaggatgcacacaggagctggccctaggacaccactggcattccgtcacttaatgccgctagcg

SEQ ID NO: 486164 - DNA, 172 bp, Homo sapiens
tgtatgtactcccaggtagggcctcatcgcccatccccaagcgctgtccctacatggcgcagccggtctgttatggagccttaccagacctgaggtcatgctcatacttgcaggtccttgactggtgctgttcttcgaactcattgaacatacctccagctttgcgggacac

SEQ ID NO: 486165 - DNA, 120 bp, Homo sapiens
cgctacctgtcccaaacgactgtataccaccaaatgctggttagcatgtggaacaagaactctccttcattgtatgaaaatcaaaatacaacaatccacatgggattcacgtaatggggt

SEQ ID NO: 486166 - DNA, 250 bp, Homo sapiens
tacttctgagggaggcctggaatgacttaagttctatagcaaatagtagctggttgactgtcaagggtccaaagaaagcaccaatacggaaacatctacctgaggctgagatctgtgtaacacataggggctgcagggatgtcggacggtcagatactgtccctcaacggaggtgcagtcagagaatgctagatggataagggttaagcacctctgtcaaggagtgtgcgaatttctgtgcccatttcaa

SEQ ID NO: 486167 - DNA, 431 bp, Homo sapiens
  misc_feature (6)..(6): n is a, c, g, or t
  misc_feature (12)..(12): n is a, c, g, or t
  misc_feature (96)..(96): n is a, c, g, or t
  misc_feature (114)..(114): n is a, c, g, or t
  misc_feature (300)..(300): n is a, c, g, or t
  misc_feature (364)..(364): n is a, c, g, or t
  misc_feature (375)..(375): n is a, c, g, or t
  misc_feature (395)..(395): n is a, c, g, or t
  misc_feature (418)..(418): n is a, c, g, or t
  misc_feature (424)..(424): n is a, c, g, or t
ccctgnaccaanccactccttgcctggggaccaaaaacctttgtaaaactaacacattgggccacaagattagaaatgacggctcaggagtcatgncaccaaaggcctcgagancatgaacctccccaattgctcctgtagataatattattatttaaaacctaacatgggtgtttgaggtatttttcagaccctgccttctgatggatcagctggcaccacccagaccagtaaactggctcatctggtcttctggcccccacccaggaaccaactcagtgcaagaggatagcttcaacnccttatgatttcatccccgacccaaccaatcagcattcccgcttcccgagccccctgcccgccnaactacctttnaaaaaccctagcctccaaantttcagggaggctgatttgagtnataatnaaacccc

SEQ ID NO: 486168 - DNA, 155 bp, Homo sapiens
tgagtcggttccagtatgtggtgtggtgtgaaattgtaaagcacatgtaagagatggggatctgatgtaatgggttaatggagagggcggcgaagaaggacccgcagcttggccagggaggcaacagccgattggttgacgaagggcaaagccaa

SEQ ID NO: 486169 - DNA, 345 bp, Homo sapiens
cgagagggtagtgcaaacgggatcggatgtatcgtatctacaagtccctttagaacatgttgagagaactcgttcaaatgtagtgcaactctcccaccccgaccaatgaatccctacggaccagcggtggcctgggagactgagtaatgaaaacatcctgtcaatgcttcaagactcttggggcatattgggactctgcagacccgtgggagcacgaaaggacgtaagatagcgcaggtaaccgtgttcggtaaccgagagcacatcgggccacagggataacttgcaaaattcccagaaccctgcttctggctcttaaagccagtgcacagagttgtcgagatt

SEQ ID NO: 486170 - DNA, 170 bp, Homo sapiens
ctacagcgtacaccagcttaaacatctgagacagagtgaccacattgtactgctgggctgtcctcttcgggtaagggccacggtcagtcggtatcctgttatttgggcccgatgtggagtccatttaccaggacagtagaatcagtttcatttaccaacttggaggttag

SEQ ID NO: 486171 - DNA, 942 bp, Homo sapiens
aaggcaaaatcaattctgctaaaattgtagcaaggacaaacatcaaattgatggtgaaagttgtgatgtggaagaatggtgaaatcattgatactttacaaatagtttatggggacaatgccccaaagaaatcagtagcagtttacaaatgcataactagtttaagacgaagcaaagttttagatgaagcctgcagcagcagaccagtcacatcgatttgcaagggaaaagttaatcttgtttatgccaacatctcaattggttcagcttacacaattttgatggaaaattaaatttgagcaaactttccactcattggatgccacaactgtacacccagatcagctgaagacaagagcaaagctttcaatggaaatttaaacaagtgtgatcaagaccctaaaggatttctttgaaaaattgtaacaagagatagaacatggctttactagtacacttttgaagacaaagcacagtcaaagcaatggctaccaagaggtggaagtggtccagtcaaagcaaaagcaggctggtcaagagcaaaggtcaagggcaaaacaggtttttggaatgctcaaatcgtttgcttgttgactttctggagggccaaagaacgataacatctgcttatgagagtatttgttgaaaaaaattagcaaagctttagcagagaacgcctgagagagcttcacaaaagtactctacccaacatgagccagccctcatcaactaggcagttggccaaattgtgggaactttaggcttacttggccgatgatctctacgtgatcaatttccacttttttagcccttttcgtgtgtaaaaagcttgacgacatccgaccggctaagagaaggttagcacagttgggtccgaaagttttcagtcatgacacatatgacaggagatcagcggttgtgtccaaaaaacaatgctgcgga

SEQ ID NO: 486172 - DNA, 393 bp, Homo sapiens
  misc_feature (7)..(7): n is a, c, g, or t
aggaccngcggatgatggctaaagatgaaagatggtgaagaaatcttattgtgtacatatcactgaattggaatgggcggctctttgaaataatatgtatgcctagcaatcttatcaatttaacattacttaaaacaatgtatcttttcagtctcttaaaaacacacttttttcttatcccacataattactgcctaggaaaattcactcattcacatggcttgtatctcaaatttgcatcactaaacctagcatcgcattgcgttccatgttacttgcacacatccatcacatcaaattcaatatattcaaaaccaactaagctattttttgccaaacttttatactataccacaatgctttaatgacttcattcctttaactaccaaaact

SEQ ID NO: 486173 - DNA, 453 bp, Homo sapiens
aaggtagtggtaagtaggaagaggtacatatgctgctgttatcattataccagcaaaccacctgccatgcattgcattgacagcagcaatagctgcagcaaattgatgggcacttcacatacacattgccctgagctgaatatatgtcaacataaatatgaataactcctccatgtctattacattcttcaatcacatcatccattaatctcggtatcccatccaacttcttcttctgagagagggttaaccatgtaagagagtaggaaacatagtgtagcaagtggctgaacagaggcagctgcagctaaagctgaagctacagtctgctgggaacgtcttgtcagcaaatctataacaaaagagaatcctgacacagcaacaaaatgccaaagagccaatacatctgtagggcttgctgtgctgctggcggaaatctgcaaacatgtacct

SEQ ID NO: 486174 - DNA, 1050 bp, Homo sapiens
attcggcgcatgagctggagtcctatgcacagttctaagcctccttagttctgagccgagctgggccagcccaggcaatgcttactacgagtaacgtaccactatctacaacgcttgatcgacacacgtccatgcatttctcgataagtaaggtcttcctctcagtacatcaataccgcactcaatacaatctggcatgagctatatgagcagactcgcacatatgttccccataattaatcaggatgcccccgatatggcagtttccccgacataaacatctataagcttctgactcttaccccaccatctctcgctactccttgcctcgctatcttgctagtagatggaggccggtagcaggaacagggttgagacagctcgtagcccgtcccttagtcagggcaactgtactgcgccacctcatggtcagaccatccgttagtaccataatccatcattcttacctttacatccataagcgagagtatcatcctctatcttaggggccagtcaactttcatcaacctagacacatttatcgaaactataagaagacgcgccttgccgatacaccgcacatacacaagacggccccgtcttcggtctgatccggtccgtaatcacgagatagttccgtacttcttcccaattctctcccagtccttagtctgctggcattcacatatactactaacagaccgcaaccatgcaaaccacctttcattcaaccccgccggagcaggaagaccccattcatataaccaaacacctaattctgactttactcggtcaccctgacagttaactatgcttatcctaccaggcttcggaattattctccccatattgcaaacttactaactccggaaaacaccgacgtaaccattctgggattaccgtacggtagcgccctgagcgtacgatactccattggctttcctaagggctaacccgggttgacccaaccctatattatccagtgggcaatcgacgtagaacccggaaagcacagttcacactccgtaccagaagtcgacgggatgcccc

SEQ ID NO: 486175 - DNA, 129 bp, Homo sapiens
ggatcacatgagccggggagccgaggctgtagaggtgggaggatcacatgagccggggaggtcgaggctgcagaggtgggaggatcacatgagcctgggaggtcgaggctgctgaggtgggaggatcac

SEQ ID NO: 486176 - DNA, 246 bp, Homo sapiens
ataaaatgatagaaattaaagttctttatgagttttctagatccatagccaacagaacataaaaagtagcaaatgtggccaggcgctggtggctcacaccatgtaatcccatgcacttatgggggctcgaggctgggtggccctatgacggtcacagagatcaagcaccactcctggctcaacacttgcaaaaaccccgatctctactaaacaatacaacaaattagctggctcatggctggcaca

SEQ ID NO: 486177 - DNA, 199 bp, Homo sapiens
cataacagcacttcgacactagttatatttggttgcagaagaagagaaaatccaagtcgaaattgccttcaacaaataaggaattgattggctcacataagtgaaagctgagagaatagatctcaattcaggtccaatttgagtccagaagttcccaagggctccaatagactccctctcaccccccggtacatgcaag

SEQ ID NO: 486178 - DNA, 152 bp, Homo sapiens
  misc_feature (5)..(5): n is a, c, g, or t
  misc_feature (64)..(64): n is a, c, g, or t
  misc_feature (125)..(125): n is a, c, g, or t
cttantctggaaaaggggacacagctgctgcagtaggggttttcataggactatgggctcaggngcgttcgaggaattgcagctgcagcagggtttggtacttgagatgcactgtcaaaggactntgatgagggtttttaactagtaggagt

SEQ ID NO: 486179 - DNA, 887 bp, Homo sapiens
tccgtgctctccagaaatccgcagccgtagttaagagaatctgtgttttgaggtggagtctcgttctcggccgaggctggagtagagaggtggctgtgagctgagatggtgccactgccctccagtctgggtgactgaccgaggactcggtcctgagaataatagattaaagggcagagtgtggtggctcacgccctgtaatccactagtcagtttgggaggcagaggcgggacggtggtcacaacgggtcgaggtagttcggagacacggtctaatataataatttttggcaggcgtggatggcgggtgccgtgttgatcccgagtcgtacattgcggcaggcgtgctggcctaggtagtaattttgcattgagcccgaggaaggttggtggattgcagctgagctgagatcgcagtcactgacactccaaagcctgaggacgtagcaagagtccatgacgtcccatctctcacaatccaaaacagtagaaccggaggaaagacgtgcctccctcgaggtacgttcgtagtggtggagcattgtggtggtagaactcctgagacgatcgggcgcccgcgtgagcgtgggtgtttatcaaaaaacacccaggatggactgtgttgtgccctgaactcaacgacgcaagatgtccctggctccttgcatatacacatgatatccgcacatgggtggcgattactggaacaaccccgcaacgagaccgcgattatgaggcgagccccgttcttgggtctaacaggggcccgattaacgagtgagcatgttgaccagaggcatgtgaggtgctaagaaacgttgggcgtggacaatgagcttccggccaccgggaaaggaactcacgatgggggagaggagggcgcccca

SEQ ID NO: 486180 - DNA, 409 bp, Homo sapiens
  misc_feature (47)..(47): n is a, c, g, or t
ctttccccggttcccacaaaaagcgcctccaatgggggcggaggttncccttgtttttttaaaaccccccccccgcccccccccacccacttttggccttatagggggttgtgcccctcctttaaggggggggggccccccaaaatccccccctccccccaaattcccccccccttaaacccccccgcggttttttaaggggggaatttattttttttttttttaacccccgggccctgggggggcccgggtttttttttggcccccttcccttttggtttttttgaaaatttgactgggggccctttcccctttttgggcccccccccccaaattatttttcaaagttttttttttttcccaatttttcttttttttggggaaaaaaacttttggggcccaagcccca

SEQ ID NO: 486181 - DNA, 412 bp, Homo sapiens
  misc_feature (412)..(412): n is a, c, g, or t
cgcaggtggtgactcaactgtatacacatgctcaatagtcaggctcgagagtgatgtgaggacacattacacgcgtgtgagccgatactgagctgggcattggcaccatatcttgagtatacactttctcttttttctctagtgtgcctatggtgtggcaatagcattcactgtgggattttgcagagcttaagaagtgggacgttaactttgaaggtgcttggttggattaactctggtagggttacctttacaacgtagatattcaacagctatgctgactgacacttcattctaggtcttaagaattttttttcagaacccccctttcccaggttgacatacgtagcatactttcatcttatatagactttctgtgacctggtggtggttttagacctcctcctcagtn

SEQ ID NO: 486182 - DNA, 261 bp, Homo sapiens
  misc_feature (55)..(55): n is a, c, g, or t
  misc_feature (75)..(75): n is a, c, g, or t
  misc_feature (118)..(118): n is a, c, g, or t
gtcgactgaaactttcagttttcccatctgtgaattaggggtaataattactgancctcacagcatgctttagtnaatgattaagaaattattgcaaccaacagtattaggacctagnctgtgtttctcaacaagggaaacatgggggtacattccctttgtgcaagcctgttgcatacactttaaaatattaagtatttcaggaagctgagttcaagatgtcagcatagtgcccccagtcattgaggcagccagatcggt

SEQ ID NO: 486183 - DNA, 128 bp, Homo sapiens
gtgatccgaggctgggaagaaggggttgctagatgagtgttggtcaagagagcaaaactgactatatctccagattaatgcctatgtgccactggcaccaggcaatcatccaaccacatgccactctc

SEQ ID NO: 486184 - DNA, 288 bp, Homo sapiens
gcgccgtggacgttcgtaccgcttcctctcgaactctctacagaagcacaagctaccctggagcactgttggcagctctagctttgcagtcgtgtcattatgcccaagtcatctgtttttctctgcctcactttccaccacagtgtctcagagtcatagtgagcctacgtgtcatctcctggggtgtgccagagtgctagatccccaggtggttattgtgctcacacataaaaagcctcagtgcaccactgacacacacaacaaaaaaaaggggatacaataaaacgt

SEQ ID NO: 486185 - DNA, 143 bp, Homo sapiens
cttctagctcggtaccctctctctctctctctctctctctaatgattcaatttttgcaaatttggtctctctcctttccttcaatctccacctcactttttagttgcttcttactcattctcactttcatgcacttctgacag

SEQ ID NO: 486186 - DNA, 169 bp, Homo sapiens
aagaacacatcaagcaggtagaaagccaattgattatgtcactatggagggtttctcgtatgccaaaccgaaactgtgacagcaaacgacagagacatgagagatcatcgacaccttgtagatagtttgcataatcttacgataaaggatcaagcctcttattacgaag

SEQ ID NO: 486187 - DNA, 926 bp, Homo sapiens
gccccagcctcggcgggcctcccgggagccgggcgtggcgttccagctagtgagccgtttctcccctgggctcggaggcggaagcttgaggggcgcggggaggagcttcgcgtgcgggtgaacgcccgtctacgtgctcgttctcttcgcgaccgtgcgcgcgagccccgtgtccccacggcggcagcagctggcggcggcgagggtgaacgcggagggggcggagggagcccgcggcgggggaagcagcttacagcgaaatggcggagaccgtggctgacaccgggggtggatcaccaagccggagaactgaatgacgcctacggaccccccaggaaactcctcgagatcggattgtgaagcaacccgcaaaacggtggggggtcggccggggccgttttccccgacttaggaaatcgggggttcaggacaaatcttccttattttccaaggctgaagcgaaattctcgctgttagaagaggatacccgggggacttttggatgggctgcggaggtgaattacgacagagagagcagggttcgtagtccccccggctcccttgggaacaggcggtttgggcgtcagcttccttctagaggacgctgctgccatttttgttgacacttttggaggaccgacaaccagggctggaccgtttataaccagtgtcggggtatcctcgtggccagaacgagcggtgcttcacttgtttcgacgtgaccttcttgataagcgttcctctaataaggatgctgacttggagaggggcaccggccttactggtggagccgggaaaggttctttgtgggccgacggtaatgctcgtacaaccatcgttgtgtggcggacagctgcttaacccactctatactgggggggcgccaccctccgacggcgggggggtgatatacacgtcgcacacaa

SEQ ID NO: 486188 - DNA, 246 bp, Homo sapiens
gcagcaggcacctcttaatcccagctactcaagtgaggcttgaggcaagagaatcacttgtaacctggtaggcagaggttgcagtaagccgatatcgcgccactgcactccagcctgggtgacaagagtgaaactctctcaaaaaataattattattatttagccaggcgtgttggtgtgtgcctttaatcccagctactcggaggtaacagagatcgttgatcctgagcagagtgcagtagcgag

SEQ ID NO: 486189 - DNA, 427 bp, Homo sapiens
tgttcccaataggcaaaatgtcccccagctgcgggatggataaacacatgtggtccatgcaggggaatattattcagccatgaaaaagaacaaagcagggaccccccccccatgggcaaacccagcaaacgtttccgcgagggaaatcccctagacccagaaggccccttgtccgatgaccccctttatatggaatgtacagaatggggaacatccatggacagaaagtagactcctgggggtcatctagccctaaggaagttggggggaacgggagggtgacacctaaggggtgtgttgtccctttggggaaagtgagggtgccagctgaggggtgtgttgtccctttggggaaagtgaaaatgtcgtcaatttgattgttgtgatgccaagcccaactgtgtgaataaaagcccgttaaatccca

SEQ ID NO: 486190 - DNA, 361 bp, Homo sapiens
  misc_feature (126)..(126): n is a, c, g, or t
  misc_feature (174)..(174): n is a, c, g, or t
  misc_feature (221)..(221): n is a, c, g, or t
gtagtctagagatccctttgctaggtggagtgagtggagatctcagctcacgaactctgctcctgggttcaaagtgattctcttgttcagctcctgagtagtgggattataggattgacactaggnctggtaatttttgtattttcagtagagatggggtttttccatgttggncaggctggtcccgaactcctgaactcaggtgatccgcgcacctcagnctcccaaagtgctgggattacaggcatgagctaacatgcctggccttctcatgtgttttctgattaaggctcttgacttccaaggctgtgtggggagatggggtgggggcccttggacttgatataaaacttttgtcaaa

SEQ ID NO: 486191 - DNA, 479 bp, Homo sapiens
tagtcccacacctgcaccggtagtcccacacctgcaccggtagtcccacacctgcaccggtagtcccacacctgcaccggtagtcccacacctgcacctggaagtcccacacctgcaccggtagtcccacacctgcaccggaagctgcccggcggttcattgaaaataacgccgccgcatcgccggtcggcatcgtttatggtcggaactacgaaggtatctgatcgtcgtcgaacctccgacttccgttcttgattaatgaaaccattcttggcaaatgctttcgctctggtccgtcttgcgccggttccaagaatttcacctctagcggcgcactaggaatgccccctgacgtccctctaaatcatggactcagttccgaaaaccaacacaatagaaccgcggtcctattccattattccttagctgcggtatccaggccatgattaagagggacggccgattcaagtgtgggactc

SEQ ID NO: 486192 - DNA, 993 bp, Homo sapiens
ctggactccccctcttggtcctactagagacctctcaacagatcgtgtgggcccagtcagttgaggtattatcaggtgcttaattgtgaagctaatgttggtacttgccacagaatctacaagccactaccttctgacctccccacacaccgtcactgaaccccctatcatcttgaaataatgcatgtggggcatagagacttccggaatgatcgagcatgatatcctcatgagtcttgtccccaggggtattagcggcctctttttatgaagcagggaattggattcgaagatttggacgatggtgctccatcatgattgatctagcgtaactgggaggctagatgggccatttcatagcacatacgctaagcgcgtcccgtcgcgtacgtcacgccatgtcgtctgggaaaacattggcactgcctatgatgttaatgcaagacgatctatgtttgcctacccatattgcgcctgcaggagctcgacgagtacagatgtttcgacgcaacggcccacaattgtggcacaggagatatttccagtgcgaacatcgaaggaattgcatctaactgtctttctatgtgcgtgtatgaagcaagaagggaatttaaaggatatccacttcgcatgcctagttgtcgctcccatttcatgtttcccttcgcaaaagattcccgtgacccatgaatagattttggtgggtgtgaataatcccaaggttcccctaactgagaagcggcaatcaaacgtaggttcaggaaggattttcggacccatccaacgtttgttagagagcccctcgatagacggtagatcgttgttcagaatggttccattttagatgtgcgactgaacatttccagaggaggtccaggatacctcggtatttataggcaattgggctcagatctatagcgagtagtgttgaagacattataagccgtaggatgatagcaagaaaaattgtcatgtagtaacaaaaggaatcag

SEQ ID NO: 486193 - DNA, 132 bp, Homo sapiens
atgagcctggtccgccacgcgataacaccacactcagaaaagtagcgtagagaggtctgagtggacgaagttgttgcgcaacaacttcgtccactctgatttagcgcatagtatggactctcggcgtgtgca

SEQ ID NO: 486194 - DNA, 252 bp, Homo sapiens
gataagcagacgatagttatctgtttcttttgacttaatctcatattggtgtgattttcctttttttaggctttcctacctcctacagactgtctaaggcatgtaacgcacactcaataattgtcatgagagagaaaagcatgtgtcatgcatgaggaacttaactgaggtggctcttgctggtacatacctggtatgttaggcagttagtcatctttgctctcagttgaacctgtatacctgtacaaggtg

SEQ ID NO: 486195 - DNA, 101 bp, Homo sapiens
catcgcttcataaattattcagcttctacactataagagtttacacaagcaccaccccagtcatacgtctttgcgagccacagctagcaatcgcataccgt

SEQ ID NO: 486196 - DNA, 183 bp, Homo sapiens
tgacgtaaactaaaagtatttacagctttctcaagttaacattttggtagtatacttcagagtgatgttatctaagttacgtagttaagtatgttaaatgtggatcttatacaccacatcacagtacacagaaagtataagtcaaggcctcaccacttcctacagtattagtatcgtgtctca

SEQ ID NO: 486197 - DNA, 614 bp, Homo sapiens
  misc_feature (566)..(566): n is a, c, g, or t
  misc_feature (578)..(578): n is a, c, g, or t
  misc_feature (604)..(604): n is a, c, g, or t
gtaaagctaaggagctcaccaaaatagctatagatgctggtttccatcactttgattctgcttctgtctataatactgaagatcatgtaggagaggccatcagaagcaagattgctgatggcactgtaaggagagaagatatattttacacctcaaaggtttggtgtactagccttcacccagaacttgtgagagcttccttggaacggtcactgcaaaaacttcagttcgactatgtggacctgtatctcattcattacccaatggccctgaaaccaggagaagaaaattttccagtagatgaacatggaaaattaatatttgacagagtggacctctgtgccacctgggaggccatggagaagtgtaaggatgcaggactaaccaagtccattggggtgtctaactttaactatagacagttggagatgattctgaataagcctgggctcaagtacaagccggtatgcaaccaggtagaatgccatccttatctcaaccaaatgaaacttctggatttctgcaaatcaaaagatattgtattggttgccaaggtgtctaggacncacgatatggangatgggtagaccagaatcccctgtcncttggatgac

SEQ ID NO: 486198 - DNA, 519 bp, Homo sapiens
tggaaagggggtttctttttgacccccaaatgggagtgcaggggttaatccgggcttcacgtgaaaaccctttacagcccgtggtgttcaacgcgattctccgtgcctcagccctcccgagttaataatgggaccacaatggtgcccgtgccacatacaccgtggactaattatggtatattataggtaaagacagggttttggccagtgttgggccaggtgtgttcctcaaactccctaacacccctcgagtggtgactccgagctttatattagagaggataattatacacttcttactcggcgtgtacaataagggcaacattgtgtggtctcacccagaagaacttctccctcccccacaacttctattcgcccttatacccaggctatacttcctatacctatattctctccccttttaattactataattacattctttattaaacaaaaaaacaaacacaacaaacacaaacaacaaacaaaagacaagaccaccacaaaaaaaaccaggcg

SEQ ID NO: 486199 - DNA, 988 bp, Homo sapiens
tgtccccggtgttcaacctgtgggccagctatcagcgtttgccgcatttacggcgtgatgccttgtcgcctgccgcatagtttggggaagaaaccctactgcttgcagagggtaatccctcctctgccatgcggggttcgccccactacaccacgcgtaggatggggccctgtctcccccctcgcggaataaccaatcgttttaccgttggccggcccccgaaatcctatagcccttgtgcgaaaaattctgccctcctaacggggaccaacaatgtgtcttttcccggcgctaccccaagaagaaaaggtttgacacgacggggtttggaaactagtgggccatgggcccccgccttcccccccccaagtttctaatctggccgccccccccgcctggtcggctggaagaggaagaggaacaagagggtcgcgacccccaagtgtaacatcgacccgccatggggctagcccgacttgctgaaacaacgcttgacccggagtaatcttcccggagggcttacctgggcaaaagcggctagttctctttagagtgattgccccggaccccgcgattgtgcacagtggactaagatatgttgttacaaggaccccgcgtattgtccttattccggcctctggtttctcccctggagaaaaaagataattctatccacaagatggattgttcgagatcaccagcccacgatctctacaattaggtatttcgtgtcgcgcccgtcacgtgctattaatatcccccctccctctctgattttcttgaatattctttccttcaaactctcttattcttcatcttcgaaacaccttctataacaagtggtgatagtttaatccgagaaaccatacttgtctaaacagacaagaaaatctaaatatttcctcgggcaggaacccaaaaggggtcatctatttccttaagagaaagtaattataaaaggacaaaaaaagaactgtcaaacacgaca

SEQ ID NO: 486200 - DNA, 303 bp, Homo sapiens
gttttttcatttttgtggggggctagaaaaaacataaaatgaggcagtttaataatagttaatgaaggtgtgctacagaaaataatctggtgttcttgctaactttggccttcactgttgcttaattgtgtagcaggccaaaagctatatgttatggcttattgtgtgaaggttaagctaagaagtggtgttgcatggacttcagagtacatacatgcggtagtgcatatttgagtttgagcatttaataagctttgctggtaaatgctgtaaaaaagaaaagcaagttttgctagtgtgcta

SEQ ID NO: 486201 - DNA, 221 bp, Homo sapiens
ggaagactgttgaacccaggaggtcaaggctgtagtaagccatgactgcaccgctgcattccagcctgagtgacagagtgggaccctgtctcaaaacaaatgaaagtaaggatcccagagaatcaacttattttaagatttaaaagatcatttctgcagagcatggtggctcacgcttgtcatcccagcactttgagaggccgaggtgagtgcatcacaag

SEQ ID NO: 486202 - DNA, 601 bp, Homo sapiens
  misc_feature (599)..(599): n is a, c, g, or t
tagcggccgcattggcagcaacactctgctgactagacttctgcccttactggggtccagtccagttctccatgactgactggtcttggagctgctaactcattagacagcctgagtcctctccattctaactccctccagcgctgtgtaagggtactttgggaggcagtatgatacagtggccaaaaccagggactttgaagtcagacaactctcagcttcacctcttggaatctttaggacctttgtcatgtaccttaacatctttaagccttcatccccttgtgtgtaaaatggaaataaaaatgtatttatcttgtggagtattttgaatactgactgagataatgtacttagcacaatggttgtaatagagtaacactcaataagtatcagcaattattattagcaacagtctacagcagggggtagagacattggttcctcctcctcctcctcctgtacaaggtcagagacagccaggaggagtaggtaggtgccagaatggcaagtttgccaaactaagctgtgaggcttccaggctggactggaaggcaatgggagagcggtgcattagagtgtgctgccaattgcggccnct

SEQ ID NO: 486203 - DNA, 167 bp, Homo sapiens
tgagatgggtgaatcagcatagtaagttccagcgcaataatcatagggggaagagactgaagaaaagaggagaagagagaatactgccccagggtggctattaagaacaagactacaggctggaaaatgagccacgtccagtgaggtgccctgtggggaacctaaaa

SEQ ID NO: 486204 - DNA, 1078 bp, Homo sapiens
ggggagcgggatggagcgggcgcgcgggccgcgggccgagtgccgacgcgcctgaggaggaggaggaggctggtgggcggcatggctgctgtggtggtggcggctgcgggtgtgcgcgggaccggcggtcctgcagtgtggccggtctctaccggggcctgtgctgcggtgcgcagcctgcgccctgggcctggggctcgtgtcacccgcgcagttgcgcgtcttcccagtagcgccccggctcagggccggagcccgagtgggggccgccgactggcaaggcaagggtccgggggcccgagggccgaagctcaaaggcccaaaaccttttcttaaagagcggataccgggacaaagaatccaagtctttgcattgcgccaggttcaagaccccaggtgactttttgagttccccgcccttgtggagaaggcggccaggttggacattttgcgagaaaggccaagccaggttggggggcattttcccgagggccaaagggctgacttttactccacaattgtctgtggcaaaccaggaaacgaacaggattgacctttggggggaccaccaggtcttgtagaacacaggaaggatttcactaaagggacaaagaagtcctcaagttcggaatcctttaaaccatttgggagcattggtcaacaagaaaaaaaattggaggaaagaatttaagcagcagcatttttgggcaagcaactattttggcaggaaaaaagaattaagggtcttaagcgccaggtttatttccgttgcgaggaacaacgttggatgggaatcatgggaaagcgggggttcaagtcactgtgtcaaacaaattgacatattggttgccctcgtggccaaacaaagggggaacagggtcaactggaaggtttagtggtggtaagggaacaacctgggcacaagggtcaactatgaaatctccagttttcacattggcgagtttactcgacgtttttcgggacaccacggaatgggggaaaacttgcaaggccagagcacgagttacaaattatattacgtaaaggtatccctgacactttcaggacaccaaaatgg

SEQ ID NO: 486205 - DNA, 210 bp, Homo sapiens
  misc_feature (20)..(20): n is a, c, g, or t
ggtttttttcccccccctcncccccgcccccgggcccccggggggggggggcttggcccccccttttttttgggcccgggggtttttgcatggcccccctttttgccttcccttttttttttccccccccccggccacttgggggtttcccccccccgggtttgggttctttgggggggggccccccaaaaattgtaagggggggggcca

SEQ ID NO: 486206 - DNA, 1249 bp, Homo sapiens
ggctcccactctgctttcctgagccctgcttgcacctcggcgatccccgactcccttcttatatggctgtcgttcctgtgcttgtgggccgaagctggcctgtctgcggacaatcgatcctcagacgccctgggagagatgatcaatgtcgaataactgctcggaatatttaatcaatgtcgcattcctgctgctgttgatatgagcgaggttacccttcaccggacgaaacgaattatcggagaagtggacccgcaggatacatttattacagacccttaacagatgcaacgttcagcgtaacaaccttgtttccatacggctagcagtgccctattagccatccttccctccgggaacgggactaacttccgtatagcttggaccaaaggataacagtgcatacaaggtaaacgcaggcaaatgcgaacataacagattgggaatgcggcgataagggggaccccccagatggcgcaggataattcccccacggctttcccaatggcgcacacattaccgctccagttaacattgcagaaaaaagaacccttcccgcgactggcacacccaagggatagttaacaacacacaaaagaggtcacaggactgaatcaccacaacgccaccaattatcggcacctgaggcaggcccccataccagttggatagtagagaacactatgggagtaatatcaccgccgagtgacgtacatgaacgaaacggaacactgggtaaaagtatccaccaatatccataccccccaaattcctttcatgtggtcaatattcgcggtgagtgcacacccaggaatgggcaaaaaatgggatgctatgacagaggatcaaggtggtggtagtacactaggaatacctggaatccatatcggtctcgaacacgagttatgcacaattatgagtaccccccgggaaaccaccaccacagctacagcacaggcgggaaaatccggtgggcgcccctcagtccacgaggacaacacaagacaaagaaagaaataggacataataaagagaaccaaaaaccaagacttatgcgaagacggccacaataacagcgacaacatgaaaaacaaagaccttacaatcaacaaaacaaacgacaccaccggaagaggggaacagctcgcagcacccgcacaagatagatggactcagaacatacacaagaggaggagccaacaaaacacttgtcacaggcaagagagacaaacacacaagtaggcagaac

SEQ ID NO: 486207 - DNA, 271 bp, Homo sapiens
tgaccctagaggatcccggaacacaaaagcggcacaattacctgtacctgaaaaaaatatatatatgacagctgctacattagagcatatgtgatgctctcctgggacctcagtaccctgccttctggactggtttctcttaatcagtcctctccttcttcaagtggtctggaagaatgtggataatcttaggcgtgaatgtaaatgccttaatatcgaaggtcctgattagaagcatgatataagacatccactggaccgcttttgggtt

SEQ ID NO: 486208 - DNA, 113 bp, Homo sapiens
aacttcagatcgatcatattaagtgtgatgaagatgacggacattgagcacagtcttcagtgaagtgcgtgggtgtgatgtgacatttgagtggaaaacaaaagttgtctgcc

SEQ ID NO: 486209 - DNA, 437 bp, Homo sapiens
  misc_feature (51)..(51): n is a, c, g, or t
  misc_feature (92)..(92): n is a, c, g, or t
  misc_feature (140)..(140): n is a, c, g, or t
  misc_feature (148)..(148): n is a, c, g, or t
  misc_feature (205)..(205): n is a, c, g, or t
  misc_feature (238)..(238): n is a, c, g, or t
aaaaaaaaaaaaaaaaacaaacaacaaaaaaaaaaacacaaacaaaaacanaaagccaaaaactccaagaaaaacaaaatcagaaaaacagnaataaaagaaaagaaagataaccaacaacacaaaaaataaacaacatnaaagaaanaagccagaaacataaaaaggaacaaaattaatcccacaaaacataaacaataaaaancagaaatatacggtgaaaaaaacgcaaaactgnacaggaaaatcatcctccaaggaccagacataaaatgctgcaagcttttgaactaatggcgaaagtagtaagaaaatgggctctacttcagtgatcctgtggcaggacgtggatcaagacttggaaccgcagaaaacgaaatcccatagtagcacaaagcttggctgttcagtgaataacattataaataatggtaaaa

SEQ ID NO: 486210 - DNA, 383 bp, Homo sapiens
tctagatgatccccctcccaacggataaggaattgactgacatgtcgcgaaccaaccgatgttggacgcaattctcccttcagagagtatcaagaaacctagacgtgtgatgactggtgagagcgggctgactgcaatggagtgtgcattacatttggacaacaattgttcttcagtcactagtggaactgctcaatcgggccattgtccaaaatgacccccaatgagtgtgagttcattgatgacacattaccgtgaatgcgcatggtaaagccatcaaagaattggttgaccagggttaccaagttttgcgctacatggtagcgcccgaagtctggcttgggggaaaaatctcttattacgatatctcagtccttgggagt

SEQ ID NO: 486211 - DNA, 300 bp, Homo sapiens
atgcttccacggtgacttctgagcatgtaacataaacatgtggctgagctcaagagacagcaagagaggacaggtatacagttacaactatatgggctaacaaatgaaaaggtgttctacccacggagaaggaaatctaagtcctagaaggttccaaccaagcctatctgcactcaagactccccaccactcttagaccaagaacaagaaccattccgtggcttaggagttcccctcagcaagccagcccacgcagtgcgtgtgtatatgcgcgcgtgaacgtgccagaaccacggggtc

SEQ ID NO: 486212 - DNA, 324 bp, Homo sapiens
  misc_feature (95)..(95): n is a, c, g, or t
aaaacgaacgagatctgatgtactagtacgcgacccgagcgtcgcgtcccaacttcttagagggacagtgcgtcatgccaccgagattgagcatnaacaggtctgtgcatgccttagatgtccggggctgcacgcgcgctacactgactggctcagcgtgtgcctaccctacgccggcaggcgcgggtaacccgttgaaccccattcgtgatggggatcggggattgcaattattcccctatgaacgaggaattcccagtaagtgcgggtcataagcttgcgtagattaagtccctgccctttgtacacaccacgaacacagtg

SEQ ID NO: 486213 - DNA, 549 bp, Homo sapiens
  misc_feature (3)..(3): n is a, c, g, or t
  misc_feature (17)..(17): n is a, c, g, or t
  misc_feature (34)..(34): n is a, c, g, or t
  misc_feature (38)..(38): n is a, c, g, or t
  misc_feature (48)..(48): n is a, c, g, or t
  misc_feature (75)..(75): n is a, c, g, or t
  misc_feature (81)..(81): n is a, c, g, or t
  misc_feature (106)..(107): n is a, c, g, or t
  misc_feature (114)..(114): n is a, c, g, or t
  misc_feature (125)..(125): n is a, c, g, or t
  misc_feature (128)..(128): n is a, c, g, or t
  misc_feature (153)..(154): n is a, c, g, or t
  misc_feature (158)..(158): n is a, c, g, or t
  misc_feature (161)..(161): n is a, c, g, or t
  misc_feature (168)..(168): n is a, c, g, or t
  misc_feature (170)..(170): n is a, c, g, or t
  misc_feature (188)..(188): n is a, c, g, or t
  misc_feature (191)..(191): n is a, c, g, or t
  misc_feature (199)..(199): n is a, c, g, or t
  misc_feature (207)..(207): n is a, c, g, or t
  misc_feature (212)..(212): n is a, c, g, or t
  misc_feature (216)..(216): n is a, c, g, or t
  misc_feature (225)..(225): n is a, c, g, or t
  misc_feature (229)..(229): n is a, c, g, or t
  misc_feature (236)..(236): n is a, c, g, or t
  misc_feature (271)..(271): n is a, c, g, or t
  misc_feature (294)..(294): n is a, c, g, or t
  misc_feature (296)..(296): n is a, c, g, or t
  misc_feature (311)..(311): n is a, c, g, or t
  misc_feature (313)..(313): n is a, c, g, or t
  misc_feature (316)..(316): n is a, c, g, or t
  misc_feature (319)..(319): n is a, c, g, or t
  misc_feature (334)..(334): n is a, c, g, or t
  misc_feature (348)..(348): n is a, c, g, or t
  misc_feature (364)..(364): n is a, c, g, or t
  misc_feature (373)..(373): n is a, c, g, or t
  misc_feature (378)..(378): n is a, c, g, or t
  misc_feature (397)..(397): n is a, c, g, or t
  misc_feature (431)..(431): n is a, c, g, or t
  misc_feature (445)..(445): n is a, c, g, or t
  misc_feature (454)..(454): n is a, c, g, or t
  misc_feature (456)..(456): n is a, c, g, or t
  misc_feature (467)..(467): n is a, c, g, or t
  misc_feature (476)..(476): n is a, c, g, or t
  misc_feature (487)..(487): n is a, c, g, or t
  misc_feature (531)..(531): n is a, c, g, or t
tanaaaaaataaaaaantttatttttttttttantttnaaccaaaaanacccttttctgaaaaaaaaaaaaacangcacanagacggcatttttaaaaaaaaaaannaaaaaanaaactgtaaanaantaaaaaaaaaaaaaaaaatttaaannaaangtnaaaaaantnaaagggaggtaaacggcnctnaattttanaaaaaaantaaantaantataaaaanaggntaagganaagcttctaattttccaaaaattttgaaaaaaaanttttttcaacgactgttttttananaccttttgtgaaaanantantanagttctatgaaaccnaaaattcaagttancttatgcagggaaggntaccttgtnaaaangagtaaaaatccacaaaantccaacagtattccctctaaaagttcaaatttanaacaaacccattanattcaaaananattaaatcccngttcttaanaaagaaatggnattgatctaaattttactttacagggaagaaaaaattacaattnagcatgggggaattttca

SEQ ID NO: 486214 - DNA, 388 bp, Homo sapiens
tggccccaaaaagattggggagttgttttttaatggtcccctaaaacagctgctaaaaaaaagttgaaataaaattttgcatttggtcaaaccctcaagcatttatcatttgcaaaaatttttccctccttattaaaaaacaggaacttttaggcttttaagatcatgtgggccaaagcaaattaaagttcagtttgtgtcccaattcattgccaaacttcattggaaagctttgtttgaaaaaggaagttcattttcagctttattttcaaaaggttaaatgggcaaagaagtttaacttcagggtgaactttttcatgtttaatttcagggtaaaagtaaaagaaatttgtaaagtttgaaaaaaaatttgtttactcctttttga

SEQ ID NO: 486215 - DNA, 359 bp, Homo sapiens
tcaaaaccgtatcagaaccctcccgggtcaagcaattctcctgcctcagcctcctgagtagctgggactacaggcccgtgccaccacgcccagctaatttttgtatttttagtagagacaaggtttcaccatgttaggccaggagggtctcgatctcttgacctcacgatccgcccgcctcggcctcccaaagtgctgggattacaggtgtgagccaccgcgcccggccagaagcagcatttttaaacttgtttggccctccctaacaccaaccttggcagttcctgggctgcagtaagccgagacttggaaatacattcgccatggaggttctgatacggttttgagggtaccgagct

SEQ ID NO: 486216 - DNA, 270 bp, Homo sapiens
ggctcgtacttgctgatactgtggcgctctgtgatacttagacgttatcagaagtccactgaacttctgattcggaaagttcccttccagcgtcgggtgcgagaaattgctcgtgactgtaaaaaataatctgcgcttccagagcgcagatatcggtgctttgcaggaggcatgtgaggcctatctggataggccttatagaagacaccaacctgtgtgctatccatgccaaaagtgtaaaaattatgccaaaagacatccagcttagca

SEQ ID NO: 486217 - DNA, 215 bp, Homo sapiens
agcttttagcagcgctgtcagcatttcagcagctagataggctttctcaactctcggatcagtgtgagccctgagaaacagggtcctgatcctcaggcattctgcatatcaccccataccaccatcagccagattaatccctcttgctcaaacttaataaatactgagcaagggacttaatataacaaacaaaaccagaaatttctatgacttcc

SEQ ID NO: 486218 - DNA, 134 bp, Homo sapiens
caatcagctcgtcccccggtagactaaccatcttctcctcacacagcagtgtctcctctatcttaggggccatcaagtttcatcacaacaatttatcaatatatgacccccttttttaacccactacctaagaa

SEQ ID NO: 486219 - DNA, 1464 bp, Homo sapiens
ttttggtgttgagcgttatatagtatgtgtgtgtgttgtgattttgctacttatgctgtgttatgctgtctgtgatttattgttgtatttatgtgcttctttgatgttatgttttgtttattgtcttgtgtaaagatgtttgtttcttgtgatggttggtattgttgtatgtgttatgtgttgtgattgttgtatgtttggagtgtgtatgtgtgtttatgttatgtttgtggtatgttcagattaataatgttttgtgttttgtgagttgtgtaagtcttagttgctttgttctccgtgtttctcattgtccttgctcttcgcttgttttcgttctccctgtctgagtgttcgtcttccgctgtgtagttctatgcttagtcttgcttcgcgagagctactgtgtgctgctgctgtttgttgttgtttgtttattgttgttttggtcttggtgatgttctttgtgtattctttgttttgtttgtttttatttgggacacgcacacaccacatcagcgcggacgcgcgacggggggacaaaggccgagaagactaccgcggctcggtgtgactgttggctggttagccgaatcttctcgcgatggctttgcacggtgtcggcgccccttggggcgcgcccgctccctgggggccttcgcccccgtctggtcacatggctggtagacactggccaatggttccgccgagagccacaattcttggccaataacttttgcctgggcaattcaggccggtgtccccaggctggacgttgcacccgtgtgacgggggttaagaccgccaccgccaggtctctcttgggagctgatcggagtcttgtgagagtgaacccccgcatggtgactcccccctggctctcctgcggaggatccggccgagtcgggccacccagggactctttgcaggcttccttcctcggatcatcaaggctgccccctcctgggcccatcatgatccgcccctatgagttcggccaaagcttcttccagaggctgaacccggaccggcttttggcgcggctgaaaggggcacaggaggcacaggaccccgtctctcccaccggatggggagaggccaaggaggagacccagcccagtgccttttcctcagcacctgagggagggggcttgtttcccttccctcccggcgacaagctcccgggcagggctgtccctctgggcggcccagcacattcctcagacacaacattcttcctgctgctcccagtcgtggggatccatcacttaccccacccccccagttcaagacccaaatcttcccagctgcccccttcgtgtttcccctgtgtttgctgtagctgggcatgtctcccggaacaccagacagccctcacacctggtgtagtcatccctgaccccttgttaattcccttaagttctcaaagatggatgcaacattcttaaagaaaaaaaataaattaaa

SEQ ID NO: 486220 - DNA, 350 bp, Homo sapiens
ggggggggaaaaaaacccccttttttttttttcgggttttttaaaaaaaggaaaaaaaaagacccccccccggccccgggggggtttggggttttaaaaggggggcaaagccccccccccccgcaaaaaaaaacaagggtagttggccggtttgtgggggggggggttgggggaaaaaaaaaagggggaaaaaaattccccttttccaaaaggaattttaaaaaaagggggggttggggggtaattttgggaaaaaagggattccccattttaccctgggggggaatggcaaacaaagggggctttcccccccctgaagggtagggattaaaggggaaaaacttttccca

SEQ ID NO: 486221 - DNA, 804 bp, Homo sapiens
gtgcgacggagcgggtgaccttccgtgaggcgggcgcgagcgaggaggcccgggagcgccgagcgtcgccgccgccgccgccatgaactatactcgggcgcctgacgagatcgggaagctcttcgtgggcggtcttgactggcagcacgacccaagagactctgcgcagctacttttcccaatatggagaacgctcgtacgatcgtgttatcactgcacgataaacaccaccaaccagtctcgatggctcttggcgtctcgtccccctcttcacagacccacacactgtcgtgggcgacggtgctggccagcagaccgcacatgcatagatggccgacaaccatcagaccccacagccaatgccacacaccctgcggtggcatgcaagccgcgcagcagaacgacagtgcctgacaggcccaggcatggcacgaaccggacccatggcagcgaataagcgagctccccctccacgcgtccagactcatcctgtccgcgtgcgacctctcgctcaccaaatccggcagagctgagcacagtagcactcaggagcacactcctttcacagcaaaactccgcgcactgcgccaccggcagcgccacagacaatggcatccttactgcatccgccccagaccagccacgatcaccagcggccaccagacggactatagtgggccactctacaatctaacctctaccgcaagcgaaccgaccagcaaacaccagccggcgacccaagtgacctagacctcactccttccaactaacccacagaacgacttccaacggcgcccaacactc

SEQ ID NO: 486222 - DNA, 510 bp, Homo sapiens
gctggcgtcatgaccaaggacgcggacccccgcttacgaccccggtggaaggtgatcctgacgtacttagtgggtgctgccatcctctggctgctctgctcccaccgaaaggaaaacagaaaagagccaacaaaccaacaaagcaaaacaaacaggaagagactagaaacaggcagcaagacatactgcatacaaagaaattataaacgcaaaagaaacaaacaaaaaggaaacaggatgacgataagacacaaaaaacgaaaaaaaacgaagaccaggacacatagatcaaagaacaccaaaaaagaaacaaaaaacaaagagaaaggaaacaaaggcaaaacggagcaaccagaaaacaaggaaatacaaaggaagcacaaggaagacaaaataaaaaacagaacaaaacgacacaaagaaaaaacagacacgcacaacaacaagaaacaaagaaacacaggaagcaaaaaaacagagaaaagaaaagcgaaacgaagcaaagaaacc

SEQ ID NO: 486223 - DNA, 893 bp, Homo sapiens
gggggccggcggcggggcgactctggacgcagcagtcctacttctcctatctctcccagtcctagctgctggatcactatactactaacagaccgcaacctcaacaccaccttcttcgaccccgcggaggaggagaccccattctataccaacactattctgattttcccggtcaccctgaagtttatattcttatcctaccaggcttcggaataatctcccatatgtgtaacttactactccggaaaaaaagaaccattggactacataggtatggtctgagtatgatatcaaatgtggcttccctagggtttatcgtgtgaggcacaccatatatttacagtaggaatagccgtaggcacagagcatattcactcgataccataatcatgcgctatccccaccgcgttcaaagttattaaggctgactcgcccaacactccacggaagcaatatgaaatgatctgctgcaggtgtcctggagccctaggatccatctttctttccaccggtaggtggcctgcctggcatcgtatcagcaaactcaatcactagacctcgtatctacacgacacgtacctacgtggtagcttcaattccactatgttctattaataaggagtgcactgtggcatccatagagggtacatcattggttttcgcctattctcagggtacaccctagacgaactagccaatgccattcatatcatattcaccgcggacactacttcttcccacaacattttcggcatcgggaggccactattcaccgatggcccagatacccatgcttaatatgtctcacaaaaacaaaaaaatgggggcgcgaagtaaaacttggggacgcaaaagagtcagacacggtgtggtcaaaggcgggaaagatcacg

SEQ ID NO: 486224 - DNA, 143 bp, Homo sapiens
agagaacctcattttacagcatagagaaaacgggacgaaggaggttaaggaaagttcccacagtcacacagactaacaagcacgtggagccagacattctggcttcatagtccatgctgtttaccaccatggcagtgccgctg

SEQ ID NO: 486225 - DNA, 152 bp, Homo sapiens
gagagaacgagtgagagactcgttgtgtatttgactagccatctcctaacttagatgtacatggcgaatgtgccttgccgattacatatgagtatatctagtctttgggacgtccagaaatccccgcagtcaacactcatctcttggaccgc

SEQ ID NO: 486226 - DNA, 274 bp, Homo sapiens
agtggtccattgttgaaggcgtggcgtgatctcggatcaccacacctctgcctcccagattcaagccattctcttgcctcagtagctgggattacaggcatgcgccaccacgccctgctaattttgtatttttagtagagacggggtttctccatgtttggtcaggctggtctcgaactcccgacctcagatgatccacccacttcggcctcccaaagcgctgggattataggcatgagccaccgagcccagctgattatgttactttttcccc

SEQ ID NO: 486227 - DNA, 987 bp, Homo sapiens
  misc_feature (598)..(598): n is a, c, g, or t
ggcattctactcggttggcagagaacactcacacacggggaagctgagccatcagtgcaggagttaattcccgtttgcaataatactaaggatgtcgcattcatatatactcaatgagcactaaaggaatcataggaatatgctctcacaggagataatgtagccacagtagataaaggaggatgtcctggaagaaggggaaccttttttaagccaagggagaaaaccactgaaaagtaaatctttgcatgtagctgtgcagctctgcagatctaaaatctgtgctttttaaaagtatactctgtggagtagcagtccacatcaaaaggtcacagtttaaaagttttgtattgtgcttgggttatcccttaagatgttagttatatcatcacaaaagaacaagagtaaactgtaatttactatttttggagtatttttttgttgttaggcatttgaaggatgaggtgcacagtgcccaagagtatgtcacagcggcaatttccactttatgcagaattaatactcaattacttatctgcttacctggaccttgagtgaataatagattcctaataaagggtttttgagcaaatggacnaaattggatgcatttatgttatagcagccacaacagcaaaagaaaatcaaacacttacaaaacagaagtcaatcaagttttaactagaggagacaccaaagtatcatacagtggaggaaaaattcaaatgttctgcgccaagctcctatcatgccaattgtacatgtttgtgcgtatgtagggtagctagggttggatgtgtaatcatccctaaaattcatttggtgaagaaaaatacattttatttgaaatcattgtctatttttattcctgccaatattttgtataacatagaagtctgccccagagtgtaaataaataatgaggaaggtcacagatctaaatatactatcttggttcaataataaaaagagaattttttcctcgta

SEQ ID NO: 486228 - DNA, 153 bp, Homo sapiens
  misc_feature (83)..(83): n is a, c, g, or t
gagtgaaatgaagtgagagcttgaagagaatgctttctcaaatctttaaattcataggatgtctcaacgtgtaaatattctgngttgagcaagtttgactcatgactaaaggtgttcccatagtctgtaccttcacaggatttgcactattag

SEQ ID NO: 486229 - DNA, 418 bp, Homo sapiens
ttcaagccttggggtaatgcgtgaaaaacttttgttagccgcaagggaagggccgccgtcgttccatctttcctgatcatagcaagaaatgccgtgtttgccttttaccgcaaaagaaacaaatcctggtttcttttctaatgttatcccctgggtcaaggaaacatgttacccctttttttttttggaaaaacggcttgccggttttaaagggacatttggttgattttcattaatggccccctgggcttaaagtgatccggccctaaaacgttgttttgttggggtttctttagcaagtttttgtttaaattatcatttatttggtgggtgaagtttttaacatgctttgctgtgtgaaatttaaaaaaggggtgtttttccagggtggaacaataaatttggctttgccgtttta

SEQ ID NO: 486230 - DNA, 153 bp, Homo sapiens
aacgccagtgtctgagaaggtgcattttaaattttatttttattacttttttgtagatgaacttgagctctgtaacttacacctggaatgttaggatcgtgcggccgcggcaggcgagctgcctggcggggttggcccttgtcttttcaagta

SEQ ID NO: 486231 - DNA, 270 bp, Homo sapiens
ggcgatggctgctgtggccgtggctgttcgcgaggactcgggatccgggatgaaggcggagttcccccctgggcctggggcagtggggagggaaatgaccaaagaagaaaagctgccagcttcggaaggaaaagaacaagcagaggaggaacggaaggaagaaagggggcagaccagagacttgctctctgtatctgcagccaatgtcaagtaggccaaccagagactcccagatcgggcattcagttggcactctcgggagaaagtcca

SEQ ID NO: 486232 - DNA, 234 bp, Homo sapiens
cctgtggtgacctgctggttcctttaggaggactgcttccaccagaagacacagttgaactaaattccattgaactagaagttaagactgccatccaaccactttgggctccttatgcctctgagtcaacaggccaataggggagttatggtgttggctggggtaatagatccagactaccatggggaaatctgacataaaagaggtaaaaaagaatatgtctggaacttttgg

SEQ ID NO: 486233 - DNA, 667 bp, Homo sapiens
  misc_feature (389)..(389): n is a, c, g, or t
gacctctgggggtgagatgtagacacggcccgacagcgtggagacacaccgtctgtactgataaactgaaagtatgtgggcagggtggtgcatacccgtggaggcagccgctcaagacgctctggctggggaatcactagaacctgggaggcactaggcgcagagagctgagatcgcaccactggacttgagcctatgcgacagaggtagactcctctcaaatatataggcctgtattctctagctttatggagacaatgaaactaagagtcgcgtgacagatcaccgggtacatcctgcttttgatagaaagctagcattctgaaagatgcggcaacacactttagagatcagaaccttaccctagtccataggagccgactcagggnctgtcctctggtagcacaactaagcagggagctgttccttgtatcactggagcaggagatcacgctagccttgttcatactggccatgcatagggcatggtattcagcgcaagagcatatactatactgctggcactcaccaatgcagggcatgcaataagcagaacctggacgatgtgaaggtctctggtcagcccctgctgccttatggaagcttgtgcatgggatcgtatccctgctgcttggagaaacacctcactgtgaggcgatatcttcct

SEQ ID NO: 486234 - DNA, 754 bp, Homo sapiens
aggaacccgggcggggccaacaagagcaccccccgcacgcggggccccccacacagggccccggcaaatctgccacgctctgccccactcgtagaaggaagacgcacggcgcacccattacgccgcggccacaacgcagtgcggggagggggaggcccccgcacacatgtctctcccgccccaccctctcggtgggagacacacagcgtgagggtcacacagcagtagagaaactatgtcctgtgtgttattcacctcagcgagagagggcgtgagagagagtggatcagcacgggcagtgcccggagagatagtgttcagactcgcaccggcgggccgctctctcacacccggccgtgggcgcacacagcctcctgacaagggaagtgtttgtggtgtcacgacacacacacagataacgctcccacatggaacgaactatgagggataggcccccgaccgcgacacatcccgcgcccccgcctcacactgaccgcacgtccgagatagattttgtgaccgctgcggtcctctccgtgtgacaattctcctcccaccctcacacatacatgctttgttcactgcattaaaaataagtacaatactctcattcatagtgcactcatatctgtttgcttcgcacagaatacctccatgacggacaggtcccacgatccatttgatcacccactgtcgtcaccgctaattaatcaccacatatcagaacaagttcggtccccatcaatagtacaga

SEQ ID NO: 486235 - DNA, 604 bp, Homo sapiens
aatccaatccaaggtttcccaaatcgcccgcacatccacgggttcttacgaattccgactcgccatcggcataataaccataggttataaccttcgcgaacacctacgtcgcacgaagctcccctctaggaaccatacgagtactctaaataggcctcgtcgtaagcgcatttacctcactaacgctaaccgctagaccacccgcaagagccctactactagaaggaccatgcaaccacggcggaccactcgtctccgaagccgtagtaggaggcgtcctaaaccgtactatctgccgacttaccctcgtcttcgccctactctttattaacagaggagtattccgagtcagcgacaaagaaggcacacccctacgttcaccgccctcgaggcgttgcgccgtcgtcttcggcgccttcatcgtagtacgactcttcggcagagtcggcacccacggagtccgcaacagacacggtatctttagcaacgtcttccaaggccccgtcttctacgccgtcatactaaacgcctttaccgtccgagtgataggtcatacgatttaagaaaggaccgttcgactactctccgctacgactaagccgat

SEQ ID NO: 486236 - DNA, 214 bp, Homo sapiens
gaaccaagttatgatcagacaacaaagaggaaaggagaaaggaagggacccacagactaaaataaaatacataaaaaagacgggcacctctcagtgagtggttgtgatggccgacctgctagggctcttccctcgcctcctggagctcctcccttcatcctctcctgtatagctgggcccagccatcagtgtggaagcagagtaaagctgagct

SEQ ID NO: 486237 - DNA, 1025 bp, Homo sapiens
atccgtctcgaatctggaaactagcagaaagtgtggccagtgagactgtgtggacagaactgctccaggaatgtagtgcatggtttcaccctttctgagatgttaagttgataccgtaaaggtgggcattatttctatatctagcctccaagactaacagctatgctaatgtcttggtatcatccagtagaagtctgctggtgacttaacacctgatttccggaaaacggctatgcgactgtcattgagccttgcgagacttgcgacttgggcagctgtggcaacgtaacccccattgtttgctgggcgctatagaatctgcaagtgacgggccgtggaatgggtaagtctgcacatgtgtcaacttataatgcatatattgtgctgccagggaccttatgattgattgtccctgaacagggcagtgtgttgtcgtctgaaagagcgttgtaccttggagtctcgtgtgtgagagctgccgtgttacatcttggcgccacaagagactttagtaagtttctacatctggtgactgatgcctgctgaaggaggagtaaccttgacttgttgatactgcatggatcaagggttagcggaattaccggagggcgtagacgcactactatctctgtggcttttttctcggcgcaaatgatgggcactcccacaccctcaacccatttggtgcttcgcgtgggggcatgcagaacattccgttcacccccctgtccatcgttggcctggtgaatgtctctacgatattacggggcttggtgccttggaggtcctgtgctgcctgttgttcccccttccaggaccgtcgccttggtcttgtcagcttggtatgggctgttaactctgtttgcggtgttacttcctcgggtcgaactggggtcaccgctgcgccccccctctcgccgttctgttgaccccgccggtactgccccccgcatgcgcgccctcgttcccgcgtaacgagtttcgcggcctccgctcggccggggacccattgttgcgcgcgttcc

SEQ ID NO: 486238 - DNA, 232 bp, Homo sapiens
gagaaagccagctgactttattctgttttcacatctaggttgttggggagagtgatagacaaagttctggattctgggcatcgtcggcgcatgcttgtaatcctacttgggaggttgagacaggaggatcacttgaggctaggagttggaggctgcagtgtactatgttcgcatctgtgaatagccactgcactctagcctggacaatatagtgagaacccatctcaaaaaa

SEQ ID NO: 486239 - DNA, 325 bp, Homo sapiens
tgctcgactctgaggatcccttacaacccagatcaccaaaagaagatacgtaaaaccatgtcaggcgtggcggtatcgcacctgcaatcgcaggcactcggcaggctgaggcaggagaatcaggcagggaggttgcagtgagccgagatggcagcagcacagtccagctttggctcggcatgagagggagaccgtggaagggggaggagagaggggagaggggattttgtattttttgtagagatggatttcaccatattggccaggctagtctcgaactcctgacctcaagtgatccaccctcctcggccttccaaagtgccgg

SEQ ID NO: 486240 - DNA, 254 bp, Homo sapiens
ctacagggagacagtgatacgcagcacagagtaatagagcaggctgaggcttataacttcacttgcaacctacagtggagattgcagtatgccgggatggcacattgcactccagactggcgtgatgcacgaaactccatctcagtgtgaaacaaaacaaaaaaaaaaggacttgatttcctccttaaagtgtgaggtcaccatccacttttatatcctggtatacacgcacaatgtatgtctataggcctaag

SEQ ID NO: 486241 - DNA, 227 bp, Homo sapiens
gtaaagctcattccaagagcacacaaaagtttgagcataaaaatagacaaaatttagcagtacagaataagattaaagatactgagtaagttgtttgacagaaacctgattatccatggtgatcgtttgcaggctgaattataaagattaaaagatactgagtaagttgtttgacagaaacctgattatccatggtgatcatttgcaggctgaagtatttatactac

SEQ ID NO: 486242 - DNA, 418 bp, Homo sapiens
tacaattttcatccctctcttcaacactacgacggcgtccctcccagagcagtggtgaggcttactcaaagtctggtgtatccatgatctgtctaccatgtaggtacactgaagatcctaaggctgtacaacaaggtgttgactgagccagtgagcagtatggacatcacttgatgacagaaagttcctgtacggccgacataaggacataaacgctgactgaactccaggcatcgaattgccaaacatcataaagttacctgaagtcctatactactgtatcaaacctgacaaccaggagctcaggctcaagcttgtaaaactagaactccgagagccatgcgcactgctaagacgaagtcaggaatcggagaccagcatgtgtactacagtgaaacccagtttctactgatactgc

SEQ ID NO: 486243 - DNA, 266 bp, Homo sapiens
  misc_feature (1)..(1): n is a, c, g, or t
nagttgtagcccggagaagtcacatattggtatagagtgtgccgcacagaagaactccctttagcagtatctccccttaaatgaagttatagttagggcaggtaatcgtagaccagactagttaaactgtgtttttagttagctttgttttgtattttatcattctgtcctcagtatctagcacatagtaggtattttaaaaactatattcattgaactgatgttaggatatgacataatatattatttctaacttttatagttta

SEQ ID NO: 486244 - DNA, 249 bp, Homo sapiens
ctctccccgcgatggacaacgtgacagatgtgaaggtgggcctgacagacacacggcctgcagcagaccagccagtccaccacacagcatcgagccaagtcattcaaaaaggatttaggccactgcctttttctgagggaggagcggccagcatgtgccccgcggctcactgggcctgtctaatcacacagcagtggcaaaaggagtatctgccagacgcttcctatcactctattctgtctcctcatc

SEQ ID NO: 486245 - DNA, 311 bp, Homo sapiens
  misc_feature (5)..(5): n is a, c, g, or t
cacanactagggtcagttttgcaggtggtaagccatttaccaagatagttgtaggtaaagaagggcagatttattagagaaattgtgaaaatatgttgcagtgggcagctcagcagagaaggggctacctgcaaagaggcaagggctggaggaaagttttatagggtcctgctgaagggtgctacgtgtggaatgaggtcattgtgcccgcaggttgtttgtgattagctgtctctaacaattgttcatacaataattgttcattattgttctcaacttggggctctccccaacctggggacccttcctta

SEQ ID NO: 486246 - DNA, 256 bp, Homo sapiens
caggagaatcacttgaacctgggaggcagaagttgcagtgtttgagatggagcaagactcctatctcaaaaaaaaaaaaaaaaaaaagacaaagccttgctctgtcactcaggcaagagtgcagtggcgcaatcatatttcactgcagcttcacattcctggagtaaagctatccccccaactcagcctcccaggtacctgggactacaggtgcacaccaccatgcctggcgaattaaaaaaaaaatttttttagt

SEQ ID NO: 486247 - DNA, 559 bp, Homo sapiens
  misc_feature (73)..(73): n is a, c, g, or t
atgaacaatgaagaatatagatgaatattcacaaatttggcatgagaatcaactttcagattcaagaagctgnagtgaaccccaaaaaggataaagccaaagatatatgttccatgacacataattaaacttctaaaaactaaaaaaaaaaaaaaaaaaattcttgacagcagcaagaaagaaatcataccttagctatagggtaaaacaatttgaatgatagtagatttctcatctgaaaccataaaggttagaaggaagtggcaaaatatttttcacgtgctgaaaaaataattgtcaacccagaatcccatgcctggcaaaaaatatcttccaaaaaatgaaaggcaaatcaaggcattctcagatgatgaaaaactaacagactctgacacaagcagagttactctaaaagaatggttaaaggaagttctttaaacaaaaaggaaaattaaaaaaaaagaaaccttagaacatcaggaaagaaaccagcaggtaagcaataggaacccctcctgaagttcctaaattatgtgtgagcggtcacggaaaaattata

SEQ ID NO: 486248 - DNA, 233 bp, Homo sapiens
tgggaactgaatggtgtcactatgaggtgatacgtgggttaaggctgtagacaaggcctgagaatggggcaaattttgaaagtgcggggggaggccttctgatagtagattaggtgccataaggggttattaagaagctgggaacctctatgtgagagattagcattgtagacattctggaagaatccaggcacacaaatgccaagggtgatccattcagttgcaaattcaag

SEQ ID NO: 486249 - DNA, 666 bp, Homo sapiens
gtgcactatagcttgtaagatgtcattgaggtgcatctcaccgtgtgggtcatgactgaagctgaagaagagaccacagagaaacagaaaacctgctcaatgcaagggaccaacattataatggtttaatgatgggagtccagtgtatatcccttccagtacagttttaataatcatatttttattgagccatataagtgttaccccactacttttgcaaggaagccctggcctctgttcacccacatactgtggctcgaacctgggacctcagcgctcacaaggcaagctctgtactgctataccaccaaccctttgtcgtttttctgtttgtgatataatagtgagggagtactactgtccaatctaggctgagagttattctaacctgaatcacatgcctgaactgtcttgatcctaggccgcatccgagtgcatggtatcggtggaggccacaaacagaattatcgcatgattgactttctacggttccggccagaaaaggaataggcaccagaaccgtttgaggagaaggttgtggtagtccgctatgatccttgtaggcaagtttgggatgggaaatgatgatggtgtggtctgaattgtagtttgtagcttctcagaaaatgtgggcttgtccatcatcctgaacaggtctgcgacata

SEQ ID NO: 486250 - DNA, 1031 bp, Homo sapiens
gggccaatgctcagcccgatgctccttcagtgacttctttgagggcatcggcaagaacacaagaaggtggtggccgtggcacgccgctgggtgtcgggggccctggccttactgagttgtgggcacccacgcaatacgtgggccggggggaggtagacgctgtgactgtgagaaggccagaagcgcaagatgacggtccccggaagaatgggactctgttcccatagcaggtgcccagtggcccagcgcttttggcgtgaggcaggtgcctgagctgggccaggggactaagggtgcgtggcctgggccccttcaccatgggcactccaggccgcgacaacgtgtggccgatagactcgtggcgtttgcacgggagccgaatgcccctggagccctttggccatcacgatcgtggagacttgtgtagaggtggcaggcctcgagagaccggatgcgcctaggcataacataacaaggcaacagtgggtgcctagcctcttcaaggccctagaagccgtacgtctctagcgcagggcactccgtcccagatatgcgccttgcgtttctatccggggcttcacatattctcggctccgcctggactccgtagctccggggcattggcatcttcccttcgcgtattgcttgcttttgagaaatcttttagcctcgctgctatcggaggcgcttgcttcggagcccacaggaggttcccccgggcacacagagcagctctgcggcaccccttagtcgcagagagggccatacccaacgcgaagttgccccccttgccctttgacccgcaatgccgtggtggccccttgtgccaaaacccgtttcccccttatgccccgcgggggacggccccaactgggcccaagggtccccaggggtggtgacaacgttgcggagtaagccaatgcctgtcgcggccattgcgcgcgccggggaacgccccctttcccgtttttgcaaaggcccttggttcccgtggtccccggccggcctggcccgagggaaccctttccgcc

SEQ ID NO: 486251 - DNA, 547 bp, Homo sapiens
taaaagcgagcacggcgcggaggagcccggccggcccatggcgctgtgtgcgctgacgagtgctctgcgctctttgagcctggcatccgcggccattaccgcccgggttccgactctgctccctgctgcccagatacagagcaatgtcctccttcagctgccccctgccttggtgtcgccctcttaccgcccagtgcatatgtctgcggaccgcagtgccaagtttgtgtcctggaagagtcgtaccaagtacacagttaaaccagtgaagatgaggaagtctgggggtcgagaccatacaggccgcatccgagtgcatggtatcggtggaggccacaaacagaattatcgcatgattgactttctacggttccggccagaaaaggaataggcaccagaaccgtttgaggagaaggttgtggtagtccgctatgatccttgtaggcaagtttgggatgggaaatgatgatggtgtggtctgaattgtagtttgtagcttctcagaaaatgtgggcttgtccatcatcctgaacaggtctgcgacata

SEQ ID NO: 486252 - DNA, 234 bp, Homo sapiens
ctatgctcccacttgtgccaggctgagtaagtggtgcaatctcggctcactgcaacctctgcctcctggactcaagtgatactaccaccttagcacccaggtaactagggactacaggtgcacataacccaagtctaggctactattttctgcattttatagtaagagaacaggggtactcgtcatagttagcccacggctaggtctacgaactacctaggactatgagtagat

SEQ ID NO: 486253 - DNA, 302 bp, Homo sapiens
ccggtcgtgccgacaaagataccatcgaggccgatgaaacggtcccagccgaggcggatcgcagcttccaccgcaaccttgaccggagcctcgccgatcagcgcgcgctagtagtcttcgctctgctgttcgaagagttcaaagcagggcacggaaacgacgcgggccggatgaccatccttttccagctgcgcacgggccgccagagcaatttcgacttccgagccggtcgcgaaaatcgtcaccgcagccttgccgctggccggagccagttcataggcaccgtaggcgcacttgttctc

SEQ ID NO: 486254 - DNA, 143 bp, Homo sapiens
ccccttgatttttttttttaaaaggaaaaataaaaatttggactggcctttcccttggcccatttgggttttaagggccaagttccagctttgtgtttctggactgactgtgtcacttattaaatacttttgtgccatgaaaa

SEQ ID NO: 486255 - DNA, 923 bp, Homo sapiens
  misc_feature (7)..(7): n is a, c, g, or t
  misc_feature (50)..(50): n is a, c, g, or t
  misc_feature (87)..(87): n is a, c, g, or t
  misc_feature (90)..(90): n is a, c, g, or t
  misc_feature (102)..(102): n is a, c, g, or t
  misc_feature (114)..(114): n is a, c, g, or t
  misc_feature (126)..(126): n is a, c, g, or t
  misc_feature (132)..(132): n is a, c, g, or t
  misc_feature (134)..(134): n is a, c, g, or t
  misc_feature (169)..(169): n is a, c, g, or t
  misc_feature (173)..(173): n is a, c, g, or t
  misc_feature (193)..(193): n is a, c, g, or t
  misc_feature (195)..(195): n is a, c, g, or t
  misc_feature (198)..(198): n is a, c, g, or t
  misc_feature (209)..(209): n is a, c, g, or t
  misc_feature (212)..(212): n is a, c, g, or t
  misc_feature (242)..(242): n is a, c, g, or t
  misc_feature (308)..(308): n is a, c, g, or t
  misc_feature (370)..(370): n is a, c, g, or t
  misc_feature (388)..(388): n is a, c, g, or t
  misc_feature (405)..(405): n is a, c, g, or t
  misc_feature (413)..(413): n is a, c, g, or t
  misc_feature (422)..(422): n is a, c, g, or t
  misc_feature (425)..(425): n is a, c, g, or t
  misc_feature (429)..(429): n is a, c, g, or t
  misc_feature (455)..(455): n is a, c, g, or t
  misc_feature (460)..(460): n is a, c, g, or t
  misc_feature (512)..(512): n is a, c, g, or t
  misc_feature (521)..(521): n is a, c, g, or t
  misc_feature (525)..(525): n is a, c, g, or t
  misc_feature (544)..(544): n is a, c, g, or t
  misc_feature (558)..(558): n is a, c, g, or t
  misc_feature (579)..(580): n is a, c, g, or t
  misc_feature (585)..(585): n is a, c, g, or t
  misc_feature (609)..(609): n is a, c, g, or t
  misc_feature (646)..(646): n is a, c, g, or t
  misc_feature (653)..(653): n is a, c, g, or t
  misc_feature (660)..(660): n is a, c, g, or t
  misc_feature (664)..(664): n is a, c, g, or t
  misc_feature (681)..(681): n is a, c, g, or t
  misc_feature (687)..(687): n is a, c, g, or t
  misc_feature (689)..(689): n is a, c, g, or t
  misc_feature (705)..(705): n is a, c, g, or t
  misc_feature (707)..(707): n is a, c, g, or t
  misc_feature (709)..(709): n is a, c, g, or t
  misc_feature (716)..(716): n is a, c, g, or t
  misc_feature (720)..(720): n is a, c, g, or t
  misc_feature (816)..(816): n is a, c, g, or t
  misc_feature (835)..(835): n is a, c, g, or t
  misc_feature (903)..(903): n is a, c, g, or t
cgcgctntcagactggctcgcaggcggcgcggccggcggacccgttcganacagcgcgggcggctcgggtccccttgggctccgcancangaggacgccatngacgacaagganttaatttaatantttaantntcagatgaaagaagatcctgacatggcctcagcantggntgccatccggacgttgcttnanttntttaagagagntanaggggttacaatccagggtctgagggcgantctcaccagttccatagaaaccctgtgtggtgtggactcctctttggcagtgtcctctggcggggngctcttcctcctgcttcatcagtcttgcctccctggtaatactccgattactccaaatttanaaagattatgattgagcngggagaactttttctcnggtgattntcactgttnagnaacnaaattgcagatctgttttatactttnatctnagattgagtgacaatattgactcatcgcctactctctgtatatgtgttctgnagagtcctnggangcagccgttggcgggccanggaagcgattttanttgtatacgtcactgagtcanngcctnaatttgtcaggtaagaaaattggncaaagccctctgccacctcaacgtccctgtcactgtngtgctanatgctgntgtnggctacatcatggaganagcagntnttgtcatagttggtgntnanggagttnttgnaacggaggaattattaacaagattggaaccaaccagatggctgtgtgtgccaaagcacagaacaaacctttctatgtggttgcagaaagtttcaantttgtccggctctttccantaaaccagcaagacgtcccagataagtttaagtataaggcagacactctcaaggtcgcgcagactggncaagacctcaaagaggagca

SEQ ID NO: 486256 - DNA, 326 bp, Homo sapiens
gctgtactctagcctgggccacaaagtgagaccctctctctctaaaaagaaaaagtaaaaaagaaaggtgttctaaaattgactgtggtgaagcttggacaactttgtttgtatactaaaagccaatggctgggcacagtggctcacacctgtaatcccagcactttgggaggctgaggtgaaatgatgacttgagcccaggagttcgagaccagtctgggcaacacagggagacctcatcgctataaacaaattcgaaaagttagcagacatggtggtccagctactcggaggcgaggtgggagaactgcttgaacccaggaggc

SEQ ID NO: 486257 - DNA, 116 bp, Homo sapiens
gcccgaacaaaaacaaacttgccccgcctgacttttttgtcccctgttttgcaagaatagtattttgttacaaacccctagtttttaaactcttcaaataaaggggccatggtttt

SEQ ID NO: 486258 - DNA, 217 bp, Homo sapiens
gtcccccttttttcccccttttattttatattatttgggtcataccttttctgttacggaagtgtttatttttctggtctttttggggccctttggggattttatgttttgttaggtttttttcccgtgttcttgtttttcccccacctgggtttttaagctatcccagctttttaaattaaattttaaaaccccccagcctgggtgagtgtgggga

SEQ ID NO: 486259 - DNA, 110 bp, Homo sapiens
caatttcatgggccccttgatcatgttttaaccttcccttaaccttgggggtcccaagccaaagtcaaggtttgacgcccccccaaggtggcagctcatttccagcccag

SEQ ID NO: 486260 - DNA, 957 bp, Homo sapiens
  misc_feature (7)..(7): n is a, c, g, or t
  misc_feature (172)..(172): n is a, c, g, or t
  misc_feature (183)..(183): n is a, c, g, or t
  misc_feature (198)..(198): n is a, c, g, or t
  misc_feature (429)..(429): n is a, c, g, or t
  misc_feature (434)..(434): n is a, c, g, or t
  misc_feature (490)..(490): n is a, c, g, or t
  misc_feature (492)..(492): n is a, c, g, or t
  misc_feature (507)..(507): n is a, c, g, or t
  misc_feature (513)..(513): n is a, c, g, or t
  misc_feature (519)..(519): n is a, c, g, or t
  misc_feature (523)..(523): n is a, c, g, or t
  misc_feature (532)..(532): n is a, c, g, or t
  misc_feature (557)..(557): n is a, c, g, or t
  misc_feature (577)..(577): n is a, c, g, or t
  misc_feature (583)..(583): n is a, c, g, or t
  misc_feature (587)..(587): n is a, c, g, or t
  misc_feature (589)..(589): n is a, c, g, or t
  misc_feature (593)..(593): n is a, c, g, or t
  misc_feature (608)..(609): n is a, c, g, or t
  misc_feature (621)..(621): n is a, c, g, or t
  misc_feature (625)..(626): n is a, c, g, or t
  misc_feature (629)..(629): n is a, c, g, or t
  misc_feature (642)..(642): n is a, c, g, or t
  misc_feature (651)..(651): n is a, c, g, or t
  misc_feature (658)..(658): n is a, c, g, or t
  misc_feature (666)..(666): n is a, c, g, or t
  misc_feature (668)..(668): n is a, c, g, or t
  misc_feature (675)..(675): n is a, c, g, or t
  misc_feature (680)..(680): n is a, c, g, or t
  misc_feature (853)..(853): n is a, c, g, or t
  misc_feature (940)..(940): n is a, c, g, or t
gggcaangggattaagaaataaaaattcattgcactacttagtaaagcattactagtaactttcataaaaaatgtacaaactttgttaaaaatttatcaagccttcaaatgatttggttacagatatttataatacatacatttaaaactatatgttaactgatacaatggnatatgatttgngaaaatgactcagcnaatgattccaaaaaacacgccctgtgagctttcacaatctgcaaacggcaaaactgaggtaccaaatgtaccaacagggggacaaacaaacagctttctaatgaaaaggcccaaagataatctgtgaaaaatattctcacaagtgagtcggtagatctcattcaaaattattctaagaggcgcgcaaagtttaagaatcttaacaaatcacatttgcgagtattagtgatnatcanatctgagaataatgctttcgacgttttcccgcttttgctccaaaaatttagggacngngaatgctctcaattntgagcnctttgntcanctggggggncttcatttttttggaggggctgggnggttcaaaaaaacacccaanttggcnattncntgcncaaaaaacaaaccannaacccacaaaanaggnnccnctgtattaaaatngttaaaccnatttttnttttagangnaagaagncgtangccaatgaaccaacatctgcctgctatctggtgcatcacccaaggtgaccaatggctgggcacaaataaacttctcttttgctagccacagagttgctcactgtggcaagcctgagctggtcagaacacctgtgtgtgtgttcctgatacacactaaccacaataagcaagtntgcacacatctctatgagccccatgcaaagacaagacattcccaaagatcagtcactagagtgcacaacgaaattcaagatttgacnaaaacagaccctactgc

SEQ ID NO: 486261 - DNA, 864 bp, Homo sapiens
  misc_feature (235)..(235): n is a, c, g, or t
caacaagacagagctggcctggatgtccggcggtctggccgcgatgagtaggtgattgtctgacaagcagaggcatgagctgggtccaggccaccctactggcccgatggtcctctgtagggcctgggggaggcacctgcgagggccgccctcacaggaacctcctatctctcaggtccctacgcgcagctccctcgcgggcctccagctgacatgcgcaggctgcccatagctnctgaacatgtccctggattacccagcccaccggaaccccggctagagtgcccaccaaggctcttggtgccctttgatggacctgtttgaggcaggcgcctggtggggaagcggggacatggcgagcgtaccctgcatacgcgtgcctaaatgtattcgcggagcacagcgtgtcgtaagctggtggccacacattgactttcagtctacctggcccgtgtcgaccagatgcgtggagtatgcgtgctcgaagcgtggacctggctgtgttacaaaacatgcgtgactcaaaacatctttccccagagggatggtcatatcgcggccctcagtcagacatcgatctcagcgcgcatctagtcggtccacttatcccttcgggagcaagagactgtgggaataggctagatcctggaagcaaatggagaaccaacaggtgtaatagccccaagcaagggagcacggtgaactctaccatgcgatagaattcaagaattcttagggaacagcgaaaaagactaacccctaatgctcaacgatagagatgcggcctgacaatcctgtggataccactcgaatacatggagacgttcaaacacaatatccaattggcccgggaaccctgaccca

SEQ ID NO: 486262 - DNA, 914 bp, Homo sapiens
gagttgcaatgagggccggtggcccttgtatcgcttcattttttgtggtacaagcctgggtcaatcctactcagtcctgctaccagccgtcatagcctcctggtgaccaagaattgggtcccccacactgatgctttttctctctcaagggctggacgcacggatgggctgactcgggcgtgccatactgaagtgcgggatcatgttccccagccggttttttcaccagatgaatgtgcctcgctttggtcccgggcttccatacgtgctcccccagatgggaagcccaactacgttgaagggtctttctcaagtgacttaacaggctgcccaagcctgtgacgtcttgccaagagctgcccacgcgttttttccattgctgctggaggccgtgtccgtgccctgactgtgtggggcagcttgccaccctcaggtgcgcttcagcctggttgtactggaagcacccccagtcatgagtcttcacgtggacaccctcgtcgacccaggtttttggaacactcagctttagccccttccataggctttttcgggttccccccattccaagtgcaaagcatagctctcacatcgcactgccacacccctgtgctgctgccgtaccaaaccacaaggtgattcgggccttagcccaaacccctggatgacaagaagagactggtgcgcacaggaagacagtgtcagcccgaggggataggttttctgttggggagccctggcacctgagccctcaggatcctggcctagactgttttgaccatctaacctgggattactaactgttgagccattttcccccaagccgggaaacccctggtctctgactgcccttcccacagacacagcaccaatgtaggcctctgttgcatggctgtaccaagaacataagagtccca

SEQ ID NO: 486263 - DNA, 192 bp, Homo sapiens
  misc_feature (19)..(19): n is a, c, g, or t
  misc_feature (26)..(26): n is a, c, g, or t
  misc_feature (106)..(106): n is a, c, g, or t
  misc_feature (121)..(121): n is a, c, g, or t
gcctctagcgccactactngagaccntgcccagagggtggtgctggtgttgcgggaacgttgtcttttctcccgggcgggccgggtgctgctgggctcgagggccntgagggagcggcacntaggcctgatgggctaccagctcctgccgctacccttcgaggaactggagtcccagagaggcctgccccag

SEQ ID NO: 486264 - DNA, 324 bp, Homo sapiens
cactaaccacgcggtgtcactgtgtacgtggtaggcatgagatcctgatgtagcgctcagctccgctctgaaggcactgtgttggtgctgcgtgactggagagctgtgtggaggccatgtgtgccccgtgcgaggatcaggagggcgggtgagggaccgagcaggcctcttgcccggtcgggtcagccctagtggttgactgcacacttgtagacgtcccagggcctgtgctgtgatacacctgcctttggaccacattagtgtatgctcttagagatcgagctcctcaagtggtacctgaagcctttgcttccggaaagcgcg

SEQ ID NO: 486265 - DNA, 418 bp, Homo sapiens
  misc_feature (6)..(6): n is a, c, g, or t
  misc_feature (35)..(35): n is a, c, g, or t
  misc_feature (84)..(84): n is a, c, g, or t
  misc_feature (109)..(109): n is a, c, g, or t
  misc_feature (137)..(137): n is a, c, g, or t
  misc_feature (192)..(192): n is a, c, g, or t
  misc_feature (290)..(290): n is a, c, g, or t
  misc_feature (313)..(313): n is a, c, g, or t
  misc_feature (317)..(317): n is a, c, g, or t
ccttanggcctttgttgtatggatcaaataagatnatgaagtgtaccctgcctttgtaaatcatgaagccagtaatttttaaanaccttttttcaagaaccttcttaanaatctgatgaaaggcccaggcatgatgncttatgcctgtgatcccagcactttgggaggccaaggcaggtggatcacttgagncccaggagttcaagactacccctgggcaacatggtaaaactccgtctctacaacaacaacaaaaacattagccgggcatggtggtatgcacctgtaancccagctactcaggaggctgagncagnaaaatcgtttgaacccagaaggcagaggttgcagtggaacccaggttatgccactgcactccatcgtgggcgacagagtggactctgtctcaaaaaaaaaa

SEQ ID NO: 486266 - DNA, 566 bp, Homo sapiens
gtgtctagaggatccggtggttcttgaagaagaataaaacagaccctgtctctcaccatatgcaaaacaacataagatggattaaaaacataaacataagacctaaaaacataaaaacccagaagaaaacctagggaataccattcaggacatagggcgggggcatggatttcatggattaaaacaccgaaagcaatggcaacaaaagccaaaattgacaaatgggatctaattaagctaacgagcttctgcacagcaaaagaaactatcatcggagtgaacgggcaacctacagaatgagagaaaatttttgcaatctatccatctgacaaaggactaatatccagaatctacaaggaagttaaacaaatttacaagaaaaaaaaaccccatcaaaaagtgtgtgacggatatgaacagacacttctcaaaagaagacatttacacagccaacaaacatatgaaaaaaaagctcatcatcactggtcattagagaaatgcaaatcaaaaccacaatgagatatcatctcaatgcagttagaaaggcagcattaaaaagtcaggga

SEQ ID NO: 486267 - DNA, 887 bp, Homo sapiens
ggcttcaaggccgctgtgtgcctgacggggatgactgtggccggcgtggttctagctgggctcactcgttcagtcggaaatgaccagactactgaccatccactctaccactccctacccccgttcgtctgctccaccacatcctccgttccagctcgcgcgagttgctcagccgaggagtaaccagctagcgatgcatgctcgcgatgacccaacactggcgccgatcacgagggttgtggagcgccgaagactcgtggatcgcctttgtcgaaggcatacgtattctctaagcaagtttacttcacaactgtgcgtggatgagggacaccctcgacagccttgcgaagttgcccctctgcgtgctgctagcatatctcacgaaaagactcttcccagctagagacaatcttgtcgctaacacgtgaggtgcctcggtcacgtggtactggaacgtgagtatatgttgggctaggcgagggcaaggacggggtcccgtatcatggatccgttgcaggccactataccccattagcactacccatgaaagatagtttggctggccatggagcttgataagattctcaggaacactcttccccagaaaggagactgaccaattgtcgtttgattcgagtgtctggtaggtcgtgcagaagtagagacagtatacgccgccggaagtctgccctagcacgtaactctgggttcgcctttcctttcccagtcgccgtaggccccctaaggaagccagtttaggggggccacctttttgatctagggaattcacggcatgttggggactagaagatgcctccgacactaggactccctgcctcagcttctgggacctgggtagaggtcctccactcccaggtccacatgtc

SEQ ID NO: 486268 - DNA, 172 bp, Homo sapiens
  misc_feature (113)..(113): n is a, c, g, or t
cggccgaacatccattttcaacgctcactcagcaaaacagaaagtattaaaaatttgaatttcaggagcattctcacagatttaggagggcactaactttattttaaatcaangactgggaaggtccagcgtggtacatatagctatagagaataaatcaactatcgttaaa

SEQ ID NO: 486269 - DNA, 162 bp, Homo sapiens
acatcttcacataaaaactacacaaatgccttctgagaaacttctttgtgatgtgtgcattcatctcacagaattgaacctttcttttgatcgaacagttttgaaacacttcttttgaaggatctgcatgtggatatttggatcggtttggggcctgtggtg

SEQ ID NO: 486270 - DNA, 1063 bp, Homo sapiens
  misc_feature (357)..(357): n is a, c, g, or t
  misc_feature (380)..(380): n is a, c, g, or t
  misc_feature (382)..(382): n is a, c, g, or t
  misc_feature (404)..(404): n is a, c, g, or t
  misc_feature (527)..(527): n is a, c, g, or t
  misc_feature (560)..(560): n is a, c, g, or t
  misc_feature (583)..(583): n is a, c, g, or t
  misc_feature (588)..(588): n is a, c, g, or t
  misc_feature (598)..(598): n is a, c, g, or t
  misc_feature (612)..(612): n is a, c, g, or t
  misc_feature (623)..(623): n is a, c, g, or t
  misc_feature (647)..(648): n is a, c, g, or t
  misc_feature (655)..(655): n is a, c, g, or t
ctgtctgctggactgctgtggtccttctgttagctagagccgaagcctgtgggatataccactggcagatgatcccataccgcataggcagcctcgggcgcctgctcttgcttgctgaccgcctggctggtggtgacgcgctgagtcgctgttgcccacgcgctgccgcatgatcatcgaagttcgatcgaaatacttcaactcatcttcgtcgagaatcgtactgggcaagtggtcacaaccctggccgatcggcttcgcaccatgcccctgtgatgatgatgatcatggtcaggatgacagtgagctccgctggatgcttgggagagggcgctacagaggcggtgagatcagtcntgaccagcactcgttggcggaangntgtctgtgaggagacgtctggngcttatgagaaaacagatactgatgggaagtttctctatcacaaatccaaatggaacataaccatggagtcctatgtggtccacaccaactatgatgagtatgccattttcctgaccagaaantcagccgccatcatggacccaccattactgccnagctctacgggcgggcgccgcanctganggaaactctnctgcaggacttcanagtggttgccnagggtgtgggcatccctgaggacnncatcttnaccatggctgaccgaagggaatggggccctggggaagcggacccacaagccatcctaattccagaaatccggaaggttttctttccccagaagaggaagatacaggggggggaaactgggaacggaactcccaggaaaagaaattccttccgttgggctatctggccggccttgtatggaaagaccaccaggtttttataaagggccatccagggccgggaaactttcaaaccgggggttattgggacagggaaaattttttcaaaaaagaggggtttgaaacctcccaaatggggggttgaaattcccaaatacgggggccctgggaagcttttataaatttggggtttagcggtaaggggaagaggccttttcccttagggggtccagggagggaaaaattttctt

SEQ ID NO: 486271 - DNA, 100 bp, Homo sapiens
gcgataaggtcgcggcatcttcaggccggtgcgggatgtcgccacgggcgtcttccgttgttggggatcactcacgagtctctgtctgctctgagctcag

SEQ ID NO: 486272 - DNA, 465 bp, Homo sapiens
acatgatctctaacagcctaagtgttgttccatgcatggttagctgctacacttcatctgcaccaggtcagtagcaccaagggtttcactatgcattatcttattttatcctcgccacagctggttccctgtggtgaaattagtttccatttcacaagcaagggagcgaggctgtgaggcacatggaagtgggacgaggagccggctctgatgcctgcagagaccatgggcggatggcctcacacttttttgcttgtcaaaattgccctgcagtggccagggccctgcccacctcactccctggctgcctctttgccccataggctctgaccagtggaagatggccgagaggaagctgttcaacaaaggcattgccatctacaagaaggatttcttcctggtgcagaagctggtgagctgggctctgtttcagggcaaatgagggccaggagctgcctgtgtgac

SEQ ID NO: 486273 - DNA, 383 bp, Homo sapiens
agctgccacctcatgtcacacatatctttctcaccgtttatttgcaatggagtctcgcgtctcttgcccagagctgaagtgcaagggcacgtcctcagctcagtgcaacctccgccatcttgggttcaagcaattctgctgcatcagcctcccgagtacctgggattacaggcatgtgccaccacgcccggctaattttgtatttttagtagagacggggttttgccatgtaggccaggctggtctcgaactcttgacttcagatgatccatctgccttggcctcccacagtgctgggattacaggcgtgagccaccatgcccggcctctttctcacctttacacctgtcttcttatcctcacatctgtattcacatttggcg

SEQ ID NO: 486274 - DNA, 153 bp, Homo sapiens
ctgaggtattctgcgataacgatcactctgactcgttcttcttccatcacatctcctacaaaatctcctgcctacctcttgcacttacaagcatccttgtgattacattgagcccagtcgaatcctccaggattaatctccccatttcacacg

SEQ ID NO: 486275 - DNA, 457 bp, Homo sapiens
ctttttcctatcacaggaagtttatacttatgtttgcctgttgcattagtacatcccagccacttattctgtccttggcatacttaattcctatagtggctgtcttatcagctctagtcgatgtctttctagagcaacaacaccaaaacagaaatgaatgtttcatcagcattatagacttgttctggcatcaggtcttcatcagcgataatcttggtatactcattaataaatttatctacagcctaatggtcagcagatgctttatccccataaatctttaaaaatgtaatgccatgacttttcttaaatttttgcaaccaatctgtttaatattcagagttctcttcaattttctagttcattgtaatagatctttgctaatgtcatgatccacacaccattaagtggcatgctttataaataaagcatatttatttttagctttattaaaaaa

SEQ ID NO: 486276 - DNA, 255 bp, Homo sapiens
  misc_feature (52)..(52): n is a, c, g, or t
gatgtcagtcaagacaggctggctttggcgtctaggaggcaaactgcacatnctgatatgctggtaaccaaagctgtcgtatacagagaaacagacccatccccagaggagagggacaagaagccacaggaatcctgacctctgtgaagagatcctggcatttactggtccaacaccaagccagagaaccattaagaaggggccttcattctgattctccgaggcaacactgacgtcccgaaacgaagaggggga

SEQ ID NO: 486277 - DNA, 268 bp, Homo sapiens
tctcttattgtttgttcggttatttttgacggcaggttctcacgtttgtcacccaggctggagggcagtggtgcaaaaaccacccactgaggcctcgacctctcgggctcaggtgttcctgtcactttagcctcccaagcagctgggactactggccatgccatcacacacagctaatttttgcgtattttttactaaagacagagtttagccatgttgcccagtgctggtcttgaactcctggacacaagtaatacctacatcagca

SEQ ID NO: 486278 - DNA, 337 bp, Homo sapiens
  misc_feature (128)..(128): n is a, c, g, or t
  misc_feature (291)..(291): n is a, c, g, or t
  misc_feature (329)..(329): n is a, c, g, or t
tatgtgctaaatctaatatccttgggctagcattcaaaactctccatgccattagtcctaacacagtatttctttttttttttggagatggagtctcgctctgtcacccaggctggagtgcagtggcngatactcgcctcactgcagcccctgcctcccgggttcaggcgattcttttgcctcagcctcccgagtggctgggactacgggcatgcgccaccatatccagctaagttttgtatttgtttttctttttttttttttagtagacagggagtttcgccatgttgncccaggctggtttcaatctcctgacctcaggtgatccngaggtcat

SEQ ID NO: 486279 - DNA, 127 bp, Homo sapiens
atgcagtaattgctgggttgatagtattggagggattaaggattttatcaggaaaaatagacccgctgcagaacaatttttttgaataaacaaccaaacccaggaaggaggcttcttgtgccttgct

SEQ ID NO: 486280 - DNA, 174 bp, Homo sapiens
taaaaatagataaagaaggagtcagatgagtgtagccatttaaaccaaggcagcacattggtaaattcctacaacttagtctcagcgatacccatggtattaagccaggtccaccaccaagtgtcagaaacggcacagattcctcccggtccagctgggtagggagagcactcc

SEQ ID NO: 486281 - DNA, 301 bp, Homo sapiens
ggcgcagtaaacgctcccttatactctagtctaagccagttacctctggtcctatacttagtgcgtatggagaatagctggtcgccaccctctctgtgccaacccttcatagtacgtgaaacccatgcaaggggtctgcccctcagtgtgtgtctgtcgccaggcacattaatcccagttcctttagttttccatcatagatcttttttcccaacccttaaatcatcttggtgattcctggaaaaaatagcagaaaatattctgattacttcatcagaaagtaagaccaacgtcaggaatg

SEQ ID NO: 486282 - DNA, 348 bp, Homo sapiens
agatctcggcttcccatcgatatgatcgtccctgctcggaaactctttaccacgatgtgagatattcaaactgactgctggaactagaagctctccaggatgccaccactgatgtaaaatcgcagcctcctcaaattacctctgtctaatttcacatgttagggtccaaggaagccctctgtcgcacacagatatgttttgaacccagttcattcagaaaccatggttggtggtcatcatcctacttgtattgtgaagaaccagaaattccaaattcagctcttcagtcatggtctttacatattatttcagaatgtgaaacttatgctgtgtgcccctccttttatg

SEQ ID NO: 486283 - DNA, 185 bp, Homo sapiens
  misc_feature (32)..(32): n is a, c, g, or t
  misc_feature (156)..(156): n is a, c, g, or t
  misc_feature (167)..(167): n is a, c, g, or t
gggagcttggcgcctgacccaggatctagaancactctgggcaggccgcgctccgccacgaaggtcccaacctctgggatagatcaggaagcgatggtagaccattttaccatttcgcgaggctggtacccctctccatcagggcgtttgagacgnaataacggttnaagatttgcccggtggcg

SEQ ID NO: 486284 - DNA, 440 bp, Homo sapiens
ctgtattcccagctactagggaggccaaggtaggagaatcgcttgaacctgggaggcggagttgcagtgagccaagatcgtgccactgcactcccagcctgggcaacagagcaagagtctgtctcaaaaagagataaaaaataaataaataaataaataaataaataaataaataaataaaagtacaccgtgtataggacacttaccatgaatagagattgcaggactggaaggtgctctcggtgagtcagtgggtgagtggtgagtggatgtgaaggcctaggacattactgtaaactactgtagactttataaacacctagactacattaagttcataacaatttttttcttcaaaaatgaattaactttaacttactataacatttttattttctgaacttaaatttttttttaacactttgacttgagtcatgtag

SEQ ID NO: 486285 - DNA, 801 bp, Homo sapiens
catgcaacttccggcacgaatcacggagttcaggagtctaagcggagatcgccaaatccagtaagtagatttgtagatgagattttcaggaattagaggagaatttctcggcctcccgcaccccatattgtaggaggagatccacctatgaggatgatcccggacatacgcattttgatcccccctaaggtcccggtttatcaactaaaatatgtgcctcctaataaattagggtccctcacaccggggctatttgtttggatatcctgaagatccatgggccagctgccatgactctcccgccccggtattattgtccattgccagccactattggccagctgcagagcccagatgatcccccggatgctgtagtagccaatccagtgacccaaccaaaatccccggaatgttccaaaccagaccagctcgactttgggcaccaagtgtattctggagccacccgtttctagtcccggataccccccaaaaatagaaacctatgtgctatgggctttgataggaaagccagtaatagtggcccttgtctttccaaaatcatgggatgtagagactgccaccagaattgcttctgagtaactgaggccatagagagctgctgatatagtccagccttgcctctttttgaggagcacccacatctgttatttttaggattctgcatagattttttttaaactggcatttttgcctaatgatgttatttaggcacccttggagactgaaaaaaaaaaatccctgctctgtaaataaagctaattaaacgtctgtgtaaattta

SEQ ID NO: 486286 - DNA, 276 bp, Homo sapiens
gcgtcgacaaatatttaaattaaaagtatgtactacccagtgcaccatctatctctggagtaaggtatattatttacctactgttgcataacaaattactctaaatttcagcagcttaaaacaagacacagtttctacagatcaggagttggggcacaatttggctgggtccccactagccagccccacctgactgagtctctcaccaggctgcaatcaagatgacagcaacagttatggtctcatctcaaagcttaactggagaaggagtcgacg

SEQ ID NO: 486287 - DNA, 1287 bp, Homo sapiens
acgacgctttctcagacacattctgttctggctgctgcgggcccacgtcggtaatgtgacacatggtcactagcttgtttcctagtgagatccttggtccattgactcagtgctgtggattctgcacgcaatcacaaaaactgccctgtggtggccaacccggagctgttcttgaaaccaagatcccaagattggaggttccttgcagtgtcatataaccttggggaatctaattccaaaccagggacgtaccaaaggcagaagcactcggaattattacaacactttaacgcccccctgacgcgctgtgggaacacagcgaagagagcaagagacggaccggagagcggacgtagcacccacgcagagcgacagggcggacagcagagagagagccgcgagcgcagagggccgagagagagggcagcgcgcagcgaagggggactaggccacgcacgaggcgcaagcgaccgagtccacagcgggagaggcgcagcgcaacgccgcgaggccacaagcagaagagagcggagagagaggcaggacgcaagcacacaacacacagggggaacgcagcgcgacgaagcgaatgcagaaacaaacaaacgagagagcgaacagaagagcaagaggacaacaagagaagacaagcacgagcagaacacaagacggaagaagagcagagagacaaagcgcgacgagcaggacagcaagcacgaaagcaggcgcgacgcaccaggacgcgaagacgagacgaaagcgacagaccagatcgagaccagagagagaacgcacgagcggagcataggaaaatcagagaagcgcaaggagacgaggaggagcaagagatgagaggaaacagaaagagaaacagcgcaggacaaagacagcgagcgcgagagaaagcaggacaacacagaggaagagaagagcggaagagcgagacgagacaacgcaagcggaacagggagaagaaagagacgacgggcaaccgcaaggagcgggagtgaaggacggacgagagaaggaacgcacgaacacgcgagagaggcagagaggcgagaagagaaggcgcgaacagcggaagaacgacaacgaagagagcaacagcgacgcagagcgagcggagagaacagaagccagaagaagacggaacgaagaggacgggagacagaagaggaaaaagggcagaaggaaaagacaaacagaggcgcagacacgaagcaagagagagagaggggagaggaggccagagagcgagatgcgaaggaaaagcgacagaggcgc

SEQ ID NO: 486288 - DNA, 717 bp, Homo sapiens
agtttcgccccaacagctaagtagggacatctgggcgtgtcctttgataatgtttcaatggtactgtagaagatgtgggatacctctgttgcagatcacgagcatcgttatgtaaacaagtctgcgcagctgaggtaagatacgtctaggatattgctgcatatctagctagagtcagcctttatgcagcattataggcagttgtctaggctgaaataagcaagactcagaaggaacaggaggcacataaggtagatgaagaggatgacaatcagcagttagatgtagaagatggccatgaatacgtgtatgatgatgatgaattagttggttctagcgcagctttttttttcttgtctataaagcatttcacccccctgcacacaactcactccttttcaagagtaagactgacatgtatgtttgcgccagattcgttttttcactgcacagtgtctttttttgtatagttcacacacggccgaatgtgtctttagatagccgtgtcctgcgtggtattttcaatagcctctaaccctgtctggtacagtatcggggttgtaaattggcatgggtatttagagcaggttcttgttggtgctcagcacgaattagttatatatgcggatggtagttttttcatcttcatgttgtctatgatgcagtcttatccgaaataattgttgttgtgttacctgaataccattcggttcttgc

SEQ ID NO: 486289 - DNA, 232 bp, Homo sapiens
agaaagatcccagaaataaaactctagccagtcagtaaattccccaggagacatggtacctcgttgttgtttttgttgttgtttgagacagtctcactgtcacccaggctgcagtgcagtagcgccatctcggctcactgcaacctccacctcccgaattcaagcgattctcctgcctcagcctcccaggttgctgggactacaggcatgtgccaccacacccagccaattt

SEQ ID NO: 486290 - DNA, 326 bp, Homo sapiens
  misc_feature (238)..(238): n is a, c, g, or t
caggcaacagctatgacgagggggaatgctggagattgtaatgggtatggagacatatcatataagtaacgctagggtgagtggtaggaagttttttcattaggaggtgtatgagtatggtcgtagacggaatcggggcgtatgcgtgttcagaattcataatgaacaggggaggttagacagtagggtcttgtgtggacaaaatatgtatgtgtagaagttcagagggagagtgcgnttatatagttggttcctagagaagattgtagtgtgtgagggtgtttattataataagtgtttggtgtgtcatagactgtttcctgggt

SEQ ID NO: 486291 - DNA, 1404 bp, Homo sapiens
tatttacgattaatcgttaatttattatcaaaatcatgaccaggggtgtagaacatcactggttgaacaaatatacagcacactgggggcttatcaacacatgagcaaagaatgcacattaacgacgtgccacggtcacacatctgggggtcatagaaggctcaagaaacaaagaactcacagaacaagaagcgtatacataaagcggaaccccgggcagagaggctcccgaaagtggcagaaactcactccaattctccagacagtggctcagccgcggagaatatctcacagaaagagaaacacccgagccaaagagtctcttcttcggagaggcgcgctctcagaagatccagacagagtcttatcctataacaacccttatatgggagaagctcccagcgcccccaaatataaacctctgtggagaaaccacgagttcccagtgttcttgggggtataaacacgcgggcttcttcacgcggggtggcacttcaaaacacccgctgtgggcccagtgcttcccctcgtggcttcttcacattccccaccaacacagcgaagaaaggggtagtgacccgaccgcgttaacttatttatcaggtacaagaaaagaacctctggaggagccagcgagggcaacagggggcccgcagaacaagcaaaagcatccatcgtgggggataagagtgccatataacgtggagtcacaaccaaaccgtggagccccgtggtttcccaagggtgcaccggggaggctttcccaaaaattccctaggaagaaaggcacgtgggtactcttaaagaaaaaggtcttgagccatagggtgtcacacgacgacaacatgtgggtttttcacgtgtggaattttcatttgttccctctcaatgcggcagatattattgttcacaatcttccccttctacaacgggagaggacaaatgccccatggtggggtggccccggaggacattccctccgaagggaaatgaaaacagcaggccaatttcccaaacccatcttcatcacagggggatcacacacggtgcgcgctgtgggcacactgagagatcccgggattggtgtccaccaagagtctccctggagaccagggccggaagaccgtacattgtgaaaaacgcgtggccgctgttcaaggggacgaacatgaggaaggggcacacgccagcagagatggctatacaagaaacgaggccacaaacaacccgaaaacgagacacgtgatgagcagcctgagtaaggacaacccggcaattgagcatgagagcacatgagatgagtcgtgcgtcacaaccagcgataataaatgaacagtgacaagccaggaacgtgtgtcctgcgctgacttcctctctcgcctgcttgcctagcaggaatagaga

SEQ ID NO: 486292 - DNA, 401 bp, Homo sapiens
  misc_feature (46)..(46): n is a, c, g, or t
  misc_feature (131)..(131): n is a, c, g, or t
ccccaataaattaaccggtggatcctgggcccaaggacttaaaaantggccctcccacattattcctgataccacacctgacccccatgactgtatctctctgatccacctgacattcaccccatttcccnaaatttccttattttctgttcctcaccctgatcacgcttgatttattgatggcggttccaccaggcctaatcgccacacaccaggaaaggcaggttatgctatagtacaagccactagcctgcctcatagaacctctcatttcctttccgtcgtggaaatctatcctcaaggaaataacttctcagtgttccatctgctattctactactcctcagggattattcaggccccctcccttccccaaaaagctcgaaatagggcaaggttcc

SEQ ID NO: 486293 - DNA, 710 bp, Homo sapiens
ggccaagaactcctggccaggactgcaaggctctgcgagccgatgcagctagcaaacccatctacgatagacatgtcatcaggactgtcctttagatagtcttcctcctctctgcagctgcgggaagagaggactggccaacgaagtttcaggtggggtcatgtgtgactgcagggtcaccgcaacaggtgtggctgtggcgttgaggacggaggtgggaagccggagcatgcagtggatgcattggcgagggactgtctcctggggtacccttcttggacatggcgcgggcatcgtcgggagcccatccgagatgtgtccaaggcatccccgtctaccactgtggtggtaggcaacacatgcagatagagcaggaagagcatgtgtagggcaggcagggtggcacagaggagcagccgctgtgctggggcgcccacggtccgagcagaccaagcactgtataccatgcgcagagtggacagtccacccatcaacaggcagaagaggtagaagagggcgtggaggtggctattataggtcgatgaacaggacaatgcaatgcccagagaggccatagcccagcagtgccaacatctgcagcatggtgatctgggcgttgcacaggtaggcaaggaagtaacatgcaggatgagactcccagccagtagtcgaagcaggtgccaatggctgtgccatcagcgtgccctcca

SEQ ID NO: 486294 - DNA, 942 bp, Homo sapiens
gcagtcgtgtctccgagttccggtggtctctgccaaggcgcgtccggatggtgatcccaaaaccgggacgcgacccggcaggtagcgtcgccggcgccgtacaggagctgatgcgagggggtgcgccgaactggggtgcgctgcggtgatgggctacagctaggagctgatgacccatcatgaggctctggatacttgaaggagatagcatcggcttctcctgtacactctacgacaagcttctgttgaaatggtgtagaggtagcattccactgataggcatgatgtgtatacagtcctatgaagtaccgtgagcgtgtaagctctcgcgtgatagttcccactgcggactagtccttacatactgaagcccaccagtggaaagttggctcacgtcgtctgctgtaaagcccaatggggcagacaccagggtaacatatgatcgtggacctcctgatggaatagagtggtctgccgctgtatgatgtcagggactgattctgatgctctatccagagcatttctagagagagaccaacgattgatacgttcctatgaacacatatgctgctgatgctcggggaaaaacccccaaagctgttcacggaagtacctgcagaagaagagctaactgcagaagccaggtcaccaggtcacgagtagacccgtgagtccatggctggtcgcaaggtctaggggctctgtggtacgtctcatttcgaacttctattggcttatgactggtcgtgtcctccttccgggactgtactgtaataggagctcgttgatgctctgagcgtggagaattggagacgaagaacggggctctgaaaatgacctgcctcgggttgggagccttgtttcttaaagtaaggtgcctttttgtcctgtttagacggaagaactgaagaaaagttgaggtccctattcaaattagctgtg

SEQ ID NO: 486295 - DNA, 227 bp, Homo sapiens
gcttaaaggctggtctttctatctctagtacttacactagaattcacccccactgaaaaagatagagtatagcctagcagtgtgaaccatgtgactttgtacacagcccaagatagttaagtgggatcgagacatgtaagcagcatcatggaggtttgaagatgccgcattgggctaggatgaattccaaatactgctggctggcttttataatatggatatgctta

SEQ ID NO: 486296 - DNA, 382 bp, Homo sapiens
ccagccactggccttagtttttaacttctgggcgactaaaaagtttggtcagtcatttcttacaagtcatttcaatcatttaattaatcctttcatactattaagataaattgctatctctgtccttacagccttaattaagcaaagactccagcaaaatctgggagacttccaattcctcccaaaacaaaaacttatcttgcaagctgtcaactgagttaaccagttacaaatgcttctgttatgtttatacattcttgcatgctctacatttataaagaatacatttgcagaaaattcattttcagtaaagtggttttaaagagggaaagttgatgctgtctttatagaaaataaaataaaataaaataaacttgtgtat

SEQ ID NO: 486297 - DNA, 172 bp, Homo sapiens
tctcattatggacttaatttccatttccctagtggctagagatatggaacatctttcctcacgtttatctatgtcagaggattgagggatttgggactgttcaaggaaaaagatgtgaccatgagaggtagtaactcaaaacactcggttgggctgtgtttggtcagggatt

SEQ ID NO: 486298 - DNA, 629 bp, Homo sapiens
tcttaaaataacatgatatttcattgttaggtctttattttattttaagctgaagtacccatgtggcttctttagtggatccccttgaacgtttggtggctttgattttctcttatttccacaaagaggggattcagaaatttcgtgacagcaaaaacaattatcccacataagggtggcatcaggtactcgtgtctcctcagaggccacttgtggggcagggggatggagtgaaactcctccattcagggcctggagtggtcacccacaaggcttgtggctttacagggctcaagtcccccttgagccattagttaccctcgtcagtaactacattgggatttggcctctatgacttctccagctcctcctcaggttcgtgtaccctcttgcaggtctcccactctgtgaattgtagcgagagctcatatgtgagtgggcagtgcgtgggattgtgacgcagtttataaaaacgctcacgtgctcagtgtctctaacgtgtggtcccgtggtttgggacaggactcccagaatttgtgttaaatccctttaaaggagattaaccagtaatttccagaaatatctccagggaaggccctgcattctacccaattttccaattgcagcta

SEQ ID NO: 486299 - DNA, 148 bp, Homo sapiens
tcggtacctcatcctatgttgtattaaaaattgctctaattatgccgggcgtggtggtgggcacgtataattccagctactcaggaggctgagacaggagaatcacttgaacctgggagacagaggctgcagcgagccgagatcctgc

SEQ ID NO: 486300 - DNA, 123 bp, Homo sapiens
agggccctgggcagcccctgggggaaaaattaaaaaacccaaaaggaagcagcccagggagaccccctttgtgatttgcatgggtgcccctgattttttggaaaaaaaaagtggaagccgcca

SEQ ID NO: 486301 - DNA, 552 bp, Homo sapiens
  misc_feature (204)..(204): n is a, c, g, or t
  misc_feature (210)..(210): n is a, c, g, or t
  misc_feature (245)..(245): n is a, c, g, or t
  misc_feature (259)..(259): n is a, c, g, or t
  misc_feature (321)..(321): n is a, c, g, or t
  misc_feature (354)..(354): n is a, c, g, or t
  misc_feature (385)..(385): n is a, c, g, or t
  misc_feature (398)..(398): n is a, c, g, or t
  misc_feature (400)..(400): n is a, c, g, or t
  misc_feature (434)..(434): n is a, c, g, or t
  misc_feature (436)..(436): n is a, c, g, or t
tcgacctcaatagggatcaaggactcgaacggccggtatgtcgcggcactgtgcatgaacctggacttgagtctgttccagagcatgcaaagcgcgatggggcaattcaccaacgtggtcaagaatggtgttacggaaaacctgacaccagcaatgtgacgccattcgccagcgtatcgacgagttcgccgcgcgtcaggctangacacnacgcgcactgaaggccgaagacaaacgtttgttcntcgcgagctgaagngcaccggttatctggaagtacgcaagtcaatggaggtcatcgcccagcatttgggcgtgtcncgcgcggctgcctatagctacgtgaaataaccntggccggtctcgtaccgacagtaggccaganagtttttgcccangngaggggctggttctcctcgaccggaataaaggtntngccatgcttaatcccgctatcctatgcaccaatagcagctccatccgccttctgcggggcactattctcatgtttgtatcgccggtggatttgtgattatttctggccaattacgt

SEQ ID NO: 486302 - DNA, 248 bp, Homo sapiens
aacattttgaaaaaggtttgttttcctaccgggggcccgggggggaaaaaacatccccacccaagggggtttacagccaaggccttagggggggggtcctgatatatccgaacaggggggatgaggccttccctttcacgctcctggggtggggaaccgagccccaattgggaagccctgctttaattcattcctgggggggggggttatcccccaaccttaggaccggggggttaaaaaatcttttg

SEQ ID NO: 486303 - DNA, 872 bp, Homo sapiens
attctagaggccgaaggcggccgagatgtgttttgttatgttatttgtcttctgggggtttacccaccgcacgagaggtggagatcgggtgtttgccaacgctcaccaagaagctactgtctggtagcgatcgagaggctcagagagcgttctacgggagacacgaagaaacttctggcagatgtgctcaaggtgaacgtcttcagacaagacagtggcgaccaggtgctaagtagagaagctactgtgtcttcagcaaatcagggagggctggtgcatcccaagacttcaattgaacgacccacggatgagctggtcctctcttctttcaagtcccccttggttggggggactgtgaacggaggcagtgaaggtgattgctgctgggatggtggtgaatgactggtgtgccttcttgtggcctggacaaaaagcagcaccagagctgtccagtggtggagagtgtcttcaagctgaatgaagcccagctagcaccattgccaccagatgcgggattccctcattgagagcctcatcgtgagtcgacttccaaagtgtccagtgggctccgtgctctggactgtgggccaacttttccaaagttctgaccagttgtgtccggatgtctggaggaaggtggcagaaagcctcactggaactgtgggtggtggcaccaagtcttttgtcacactgttgttttgcatggagtttatattactggcaaaactggttgtgtggtgagagagccttgtgttatggaggggtatgtgtattgagaccattaagagattcgggaagaaaaaagaaatatatgggtggaaatataaattgggcacgggaagaagttaatgaaagggagtgtaaacggggga

SEQ ID NO: 486304 - DNA, 474 bp, Homo sapiens
gtatcgggacgcatggcgtgccttccacgtctgcccctgagcatttgtttgtacagccctgtgctctgtgtgggcctgcaacagcttcttgaggttggctgctagggttccccattggagcctctccattccagtgttcctgggggcagatgagctcctatcctccactggcctgtcttgttggagaacacggtcgtggcttccactttgcgaggtcacctttcaggattcatgtgtatccactttgctgtgtcagaaactccctactgctgacctccctctcctctttgctgtcattaatggattctcattgtgggagataaacgtgtgctcagcctagaataccacatgatttttttttcttgactcattgcttttgcctgttagccttgttgttctaaagtagttcatttttctactctacttttcctttcccctcaatgacccccgtcccgaaactgagacagggtaccg

SEQ ID NO: 486305 - DNA, 280 bp, Homo sapiens
tgcaaaagttagaagatatggtgcacagataacccacattccactcacagcaacaactgactaggaacaaatagctcacacctacagtaggtaggcatctgagtttagcaattcctggacatactcaaagttatgatccatatcaggagctgaataacaggaatgaggaaggggcaagcacagacaaactaagaaaaacactagacattacagtctgcagacatcatccaagacattctgtaaaacagcttccttctcactcaggattagggcgtacggg

SEQ ID NO: 486306 - DNA, 862 bp, Homo sapiens
ctagttctagatcgcgacggccgccctttttgtcattaatagggggtaaagatttatctatttatgtttaacaaatatactggaaaatcatgcaaggctgccagaattggatgcaactccggggccaaaagtctgcacaccccttatgctactggtccggaaagtggcagaaaccttacatctcgccatgaatgggacacataggactaccggaataactctcaaagatcaacgaaacacgaccatcataagcatagcgggaatgaccacgagggagcaagcaagggacccggtggaggaacgcacctagagcacgaggaagcaccggagacggcacgaacaatctgaactagcgcggcccaatcaacccagtgtgcgacacagacgaacaccacacgagggggcgacagtccatgagcaccacgagccggaacccctagtaagatcccccctacaacggaagaaaggactagttacagcgggaaccagcgggagtccacggatgagtagccacaggaaccaaacgtgacatcaaaccggcctacattacccggaaaaagaaccccaaggtgaaaaataccgaggaaaatctagccgacgaccagcgaaagggcgaccccaacgccaaggactcattcacgcacagacaaaaattctggagaaacgaggtccggggagaaacgacaatagcacaaaaagtggcccgggccacgacgccagaagaggagcaaatcgcccaccagaaggaggggaccccaaaaggcgataacggctgggtgcaaccaccagccgaacaacatacaagacaaacgaagaaggtggagtccacaccaaactaagaacagaacgggcacgaataaac

SEQ ID NO: 486307 - DNA, 134 bp, Homo sapiens
ctctagcaggatctcgtatctctaacattatgtctggcggctagatttgaataccaggtaatgaatacattcagttatactagaccctacttatcgttgttttcctgttttagatcatgttaacttaaatattt

SEQ ID NO: 486308 - DNA, 335 bp, Homo sapiens
agagactctccatattttattaaatgcagcccccagagaagaggcgctatgattaaagaaagttatgttttttagacagggtggtggctttacaccaacggaaaagaaaaaccgatgaattagcttttgagcctcaatttctttttcttattcgcacgggaggccgcgatgcccttaaatgtgtaggtattagcccaaagctggttgagttgcggccaccaggtttttaccctcctcgtgaaaacaggtatccttatcggcaggcctggagcacttttctatagcttgtgtgttacgagctcagcaagtgcccattgtttcttgagtctggtctt

SEQ ID NO: 486309 - DNA, 990 bp, Homo sapiens
ggctgcggcaggccggtggggtcccgcaggtggctgggagcgcctggaggacgagtcaagccgccgccatcgaccaggacccgcgggcccaggagagcgctcggcagggcattcatggcgggctgaagagatgcaattggacatgtccctatgaaggccattggatgaccataaacctgcataaccatgcctgggggatgtggaacaaaagatggatacactgcacaaagaagggcgcgtaaccacccacgcttgacaaggctagagtagaaaaatcggaccaacttgacagcttatattgtcaatcaattcacaacaaaacaggctatgacgtcataaatacattacaaaggaggtaagacacacacactacatagcactcccccagacaagaggcagggacatatacatacacacattgaagtcgggctaattaacccaggggtagaatcgacgagcgtccggactttgaaagtagacagaaaacccaaccgattaccaccaaaacacaaaacgaatttagttaagtcaccaccatttacaaacagagaaattcaattccccacttaattaccaggccaaaggacaaggcacaacaggaaaacaggagtgaagtatcacataacagatcggaggaacataagttcccacgaaagaggaaagaggacacgaccagcacacgacacagaacatcggacagtgcggacctagtggaagagcgggcagggggtacagacctctgtgagcccacgattaaccaaacggaacaacaaggacaaacgaaccccatggcgccagttggggtagaacccacagacagaaatctctccaaggcaattcgagaagcacccaggcacacgggcgatacaataacagggaaagccagattggaagactgaaaccatagaattggaataaatccaagcaacatatataccgcccggataaacacacaaatggggaaaaaagtgaaaaagaaacataataaaa

SEQ ID NO: 486310 - DNA, 413 bp, Homo sapiens
caggacgctggaaaacagcaggcctcatcgatggtgtgttcagcgcggcatcccggtgatacaagtcttccatgttgaagaccaagggcatttctccatgcaatcgggcaacgtcaggacattgagcgagctgttgatcaagccgcaactggtgatccataagcgctaccacagtgctttggccggtacgccactggccgctcggttggtggaaatgggcgtcaccacgctgatcatcagcggcatccgcaccgagcaatgctgcgagaccacaacgcggcaggctgcggacagcggcttcaaggtggattttgtcagcgaggcgacgttgaccttcccgatgacccacgtgcgtagcggccgggtctatacgccggctgagattcgcgaacgcacggaggcgtccgtagcgg

SEQ ID NO: 486311 - DNA, 789 bp, Homo sapiens
tggggccgtaggggaatcggggggtatagctggtgccgaatccataaaaacggggaggttaaaagtagggtctgggggacaaaattattgtttgggtaaaagttcacggggggagaaagtggggtcctatctgttggtgtccccaaggagaaagattgtgtaggggagaagagggggggtggtctatatactaaaataagtggtggggtgtgatattcggcgctaatagaaagaaataggggcgagaaggggtgccttgcggggtgtattccgatggtatagaagcgccgtggagaacatagtgtcagcgggagctttcccccacaattcgagccagagtgtgtccgccagagggggcggtatctgcggggtggggggactaccctcgtgggacatcagagtgtgtggggaagacatataacgactcccaattattattcagtggggggaccccagaggggggtttcacggtgaaagtgcggacgaagagaggagtagttaatacttcccaggagaggggggtggtgtcctccagctgtggtgtcgcgtgtgtcgtgacaccaagaggggcggtgtgtggagaagaaaaagggtcgttatcaaaaagaggggccgaccgcaccaacacatataatctttacatgaggagatcaagaagtcgtcgttcgtgaggaacatgaaggtcgattcgagaaaaaaaggtggaagaggagggcggccaatagaagggagggggttggaggcaacaattctcaacaaaatgtaagatgagaagaaaaatgtgggttt

SEQ ID NO: 486312 - DNA, 144 bp, Homo sapiens
tgctgggattacaggtgcgagccaccaggcccaacccagaactcttttaatttagcaaaattgaaagtctacaccgctaaatagcaactcttcttttcccttctcccacatgccctaggaaactgcttatcaatttctatgaca

SEQ ID NO: 486313 - DNA, 1357 bp, Homo sapiens
  misc_feature (254)..(254): n is a, c, g, or t
  misc_feature (263)..(263): n is a, c, g, or t
  misc_feature (347)..(347): n is a, c, g, or t
  misc_feature (418)..(418): n is a, c, g, or t
  misc_feature (423)..(423): n is a, c, g, or t
ggcaatggagggagtgcggacccgtactacacatagtccttgcacataacatgtgacgcgcgccgcatttaccggcgtcctcgatcccgtgcgtccagctcacgaggctcgcggctcgacgggtcccgcctctgctcttgccgggacgcagcccccagcgttgcgcagtgtctggagagcagaacagcccacatcgggcacgcaccgtgagagacttgtgcgtacacgacgacagaatgtctgccatggccggngcagaaggnatgcgcccatccaaattgtgcagggcgctgtatttgcagtgcgaactgtcctgttgttgcctttgacgcaatcgcacagcgcgncattgtggccatatcttatctgtctgcatgtctaacctgtatgtgaatgtcttgtctgtggggcacaccgntacgntcgcgagggagggtggcgaggcacatgtgcccaggggcttgaggtcgacaaagatgctgggctggacgccttctaaggacattggagtcttcgcagtagtgactaaagctgacgcgcactccatggccgaggtccatgcatcggagctgttgtcccttgcgagcccctatgcgcgtatctgcagttagcactaatggaaaagtacacaattgaggagccattgggcacgtaaacctgccgaacattggaaggcgacaaggtggaggcgcagcagattatgcctcggtgcgaactcgccatcgggagtcggcctctacccatttggtatacggatccgttagggggagccctgtgtctttcatcgagactggaaggtcagaataccaggaaggttcgaagcaagtgaagtgctcatttgtatgggaatcctatcttatgaatttcgttgtcctcgtcaagacaagcataaggtaaagcttgagtggcgccattatcttacacgacacgagttgtgtcagtaaaccatggggcccacaaggcaattggcgccacccggccccaaggggttccccatttatccctcggaaaaattaggctcgaaaattcggctggcccgttgtcggctttttcctttacattcgctttaagcgagaataaaagaacctcccggaatggtcgctccgccaaggttggtttcgctaagaggagaccatgggggtcctttgggtggaggggtggccacagggcgtgtgcaaaaagacgactagggtgattggaagcgaaaaagtgaacatgtggggacaggcaagagaatttatatgacaattggtcataaagaattaacgtattctaggtgccagtgaaggaattctcaaaaggcgttaaataacaagcggacacacaagactgcaatagaacaaaattggacggcaac

SEQ ID NO: 486314 - DNA, 671 bp, Homo sapiens
  misc_feature (231)..(231): n is a, c, g, or t
ggttttactggatgataggacggcatgagttggattcttcaccaccattttccttgtactcttctctccatcccttcttagggcgttggcaggagtggactattatatctgcatagatgtaactgttcccagaggcacgatgccactacttgctctgcctttactaggtgcggacaaggagacgagggatagcctcactcagctcttctatcacgcattagagatgttcanactgtattccattccccatccatcttcagaatctgtgcctctggtagctctgactggcggggtggggatgcgtgaagctccagtggatgtgtgtgagaggacccaggagcatcgcgttgcatcggacggggcaaggccgtgatcgtcctctccactcgtatcgatctcgtcatgtgtcaggttccttattagatggctggagtcgaagagccagtgcgtgtcccggagtccctgtatcgcgtgtcctcttacccgggctgtccacacacgacgcagccctttattaggaatccttagagcggggtcagggaagtgtgggctcgatcgttgttccttgtgcggtccagccagtctcctcggagctctgtgctgctcccttgagtggccctggacccgatgggctagacatggtgtatccttgaatcgagagggctgggacc

SEQ ID NO: 486315 - DNA, 208 bp, Homo sapiens
ggctttgtcacacttgagcccaggagtttgaacagcctggcaacatggcgaaatcctgtctgtacaaaagtacaaaaattaactgggtatggtggcttgcttgtgtgatcccaggtactggggaggctgaagtgggaggatcacctgaacctgggaggtcatggttgcagcgagctgtgattgtgccactgcactctagccttttaca

SEQ ID NO: 486316 - DNA, 124 bp, Homo sapiens
ctcggtccttatgacggctgggacctggaccacctgtacgagaagatgctgctattataaatatagactctacttagtggttacggttgttattactatcatcaggtaaggctcttcataactg

SEQ ID NO: 486317 - DNA, 711 bp, Homo sapiens
ctgcatattgccccgctgtggagactgcgatcaactcggctcattgggctcatgaacactggctctgtgtcttagacactagagcactgcacagtatctaaccgacgaaaggcaagggaatcgggtgtgccgccaggttgcggctgggcattgcatcgtccggcatggtgcctcgggtgatctccgcggaccgagggccgcaatggtcaccttgacactctgtacaacatccatgagcagcgagcccggtctgagccgtcacgggaggctgatcggaggagactcagtggaatacagactcattaccgcaaacccttactgcgcaaggcacagagcctttgctgcgttgcaccggatcctcgactcccttgacatggaactgatccctgtcaaccctcggcattcgtagagcgacacgctttcactagtcaaaacgcaatcctgttgtatacccatcgggttgcatcgttccacgggaagatggtgaatcacctgttatcaacctatgtagagaaggaggaacttgggaagtgttacactaagggagttgaaagcaaaatttttaaagagcgtatatatgaatgagtaaaggtccagagacgtagatatgaatacggggtggagaaataaggaggcatgacaattacagagaagggtgtgaagagcaaaaggtaggaatacgtgaaatacgatatcaagaaatccaaatag

SEQ ID NO: 486318 - DNA, 160 bp, Homo sapiens
tagaccatgtaggttatttattccaatgaatgggatcatgaaggatggaaagagagtaggaattgattgtgtccaaaatggtgtgcagtggacaggtggaagcggacaccggaaggaggtttcggagaaccggacccaagggttgtgtgtgtgcgtgtgc

SEQ ID NO: 486319 - DNA, 360 bp, Homo sapiens
cacgaggccgtggtggcgccgggttccccaccggcatgaagtggtccttcgtgcctaaggacaatcccaagccgacctacctcgttgtcaacggcgacgagtctgagccgggcacgtgcaaggacatgccgctcatgatggtctccccgcacaccctcgtcgagggcgtcatcattgcctcctacgccatcatggccaagatggccttcatctacatccgcggtgaggtgctgcacgtcgtccgacgcgtgcagcaagccgtgcgggaggtctactcggctgggtacattggcaaaaacatcctcggttccgggtacgaccttgacgttgtcgtccatgccggagcaggcgcctacatct

SEQ ID NO: 486320 - DNA, 769 bp, Homo sapiens
tgtgggcttaagcacttgttgataatcagcagaacgtgtaaggatagggctcaagcctactccccaaacccgtcttaactcctaacatctggctcttcctctacagatgacctaacgtgctttcttttcagcctcctgtggctgtggccccttcttttgaaatctcccttgtttccgcaagcctcggaagttagaaagttctgactctccccttcagagaacagaagtgtgagagtagggctgtgatttatgtagatagcgttgggtggcatacgcgtggtctcaagagtgaccccagcggtgttggggcgcgtagcacttgtgaacagcgcgcgcgagggaaaaacactgtgatgtagggtgagtggtgagataggacagatctgcgggttttctcctttggaagcttcctttacatagtggcgtgtgacacgttgaaacttccacagcaccactccgtgggtgtctacggtgttgtagaagggtggttgacaagcgcgagcgccaatgtgcagcatggtgtgaagggaagagccgaggccatgtgttatagaagggcgccacgccattatatttcccaaacatgtgtggtgtcctccgagttcttctggtgaccccattgtctgacatgctcgtcttggacagacctggtgcgaatcacttctatggtggggcccaccatccccgaggagacctggacggactttgaggaaacatgagaaaggcgctcagttttgagcccaacgaggcggggttccatgtgatgtac

SEQ ID NO: 486321 - DNA, 653 bp, Homo sapiens
  misc_feature (407)..(407): n is a, c, g, or t
ttggaacaatgtaggtcagggaactctctcatttcactaacaaaggggtatgtgctgcttctttctgtgttcttcaagcagtctcagggccaccagaagtcccctctagatctcttcatgtggtattgaatgtcacaaaaaaggaaggagtagaagtaaatgggaaagcaagtcttagagcaaccatttggaaagattttaaaccttccaaaaaccaattaagttttacatttttttttctcagcaaaaattataccaacaagaaagaaagtgaacaaagggatggaacatataacttttttacaacagatttcattcaacggaaaaacttctagggagaaacaagatccaaaagaaaaaaagcagatggaccattaaatatatatatatagcctgaatatcagctntttattaagctgacttttgcctacagagctcttaaaaaatcttttcaaatctcttactatcagatttttaaaccaaaggtattttccaagtgactcagagccccaataagccttttatgacttaaccaaagactcatgaggcatcttctaagaggcacgcggtccttgcaacctcttaacaatctgcatttctggccagcaatattctctagcatgtcagctcttaagttgccatcagccacttgg

SEQ ID NO: 486322 - DNA, 204 bp, Homo sapiens
agcaaccggcactcaagtggaatcccgaaaaagtgatttaaaaatgatcttacctgtaccagaaaagcaaaattaaaggaaacaaaataagaaccatagtcccaaatgacatttaaccgtacatacagcgataacatgttcaaaatccaacaaataacgcaacttccagacgtaaatatccgccactcgattccctccccccct

SEQ ID NO: 486323 - DNA, 179 bp, Homo sapiens
tgcgggtgattctacgaggatcccctcctacgatgcgcagatgacggaaattaggccacacgagagttaagtgacttgctccaggttcaccaagattagtagagagtggaactgggattccatctcaagacgagtcaggttccagagcccatggtttttaaccagataagctctcatac

SEQ ID NO: 486324 - DNA, 673 bp, Homo sapiens
agagcatccccttttacgtctaccatcactggacttacagtgaatgcgaacacagacatcatttagtattttttttgatcatctctccattatcttcctattacaatgccaacagacaaatactggaatggggacatctatcccttcatttcctcctattcttgacccatactcattccgaacttctctgaaaccgccttgatcacgaattaactctaacaccatttccttggcttgttgaactttatatgggtctcctgtaatcctaagaggttagtcagcaccagtgttctgcggcccgtcttgaatcataaccattttaactccagcccgttcctgaagctgtttaatagtttctcccccttttccaatgactaatcctgccttgctagctggaatcatgatttcttgaactgcatttcccggtccatcgccatgatggaagccaggagctggtcttcctttttcaacaatctggtccagtaaccgttttgctgactggacagattcaggtgttccagttaacatacaggacctttctggaaggccaccactgtcaggagctatctgtattttgcatccagattcctgtcgtatgcgtgagatctgttcacctcctctgccaattttgaatcccaccattccatctggcactttgtattcttctgtcatt

SEQ ID NO: 486325 - DNA, 172 bp, Homo sapiens
caagactgggagtgtgttatacgggtcgaccacacgctgagagcttgcgttaatcgttcacagagcttgagagcgtgtcagtcggcggaggtcctcctccacggtcggactcctccatctcatcatccgctgagatcaggatctcagactcagactcctcgtgggatgcgga

SEQ ID NO: 486326 - DNA, 177 bp, Homo sapiens
gtgtactaatcaaataataatcaatcaatcagcatatacatttcagccaaagccatagaagaaaaagcaatagttgcttgaattatgatcatctaccaccaactcttgtcaagccctgtaaccaggtaagggaagagggtttaaccaggagggctttgactcttcctcggctataac

SEQ ID NO: 486327 - DNA, 279 bp, Homo sapiens
  misc_feature (132)..(132): n is a, c, g, or t
ggccccccgggccccaggtgttttgggttttggtccctttccccgcccccccgtttttttttccccccttgggggtccaaggggtttttccccggttttcccccctttccctcccccccccccggccttaantttttggccccgggccccaccaaaattgggggggggttcccccccccaaaaaatgggggggcatgttgggcctgcccccctgcccccccccccctttcccgggcaaaaagggccccgggttttaataagtaaataacttttttttta

SEQ ID NO: 486328 - DNA, 297 bp, Homo sapiens
atgcaaaaaacttagggggcctgctgggagtggctgtttttatgccccagccccccaagtttgggagtgtttgtgggggtccaaagccctcccccaacccggaaagaacccccccgaggggtttttttgttgggccctgtgtcccctgctcgggagtaaggctggttctggggtcctccctgcccggacccccctgggccttccgagtgctgtgtttttcctcagtctggctgtgggcaggaacggcctgcccagtgtcccccagggtgagtgccaaataaaaacggcgagtgtgga

SEQ ID NO: 486329 - DNA, 260 bp, Homo sapiens
  misc_feature (247)..(247): n is a, c, g, or t
  misc_feature (249)..(249): n is a, c, g, or t
  misc_feature (254)..(254): n is a, c, g, or t
  misc_feature (258)..(258): n is a, c, g, or t
tcccggctcaagtgattctctcacctcagcctcccaagtagctgggaatacaggcgtgtgctacccatgcccagctcatttttgtattttttgtagagatagggtttcactatgttacccaggctgttctcaaactcctgagctcaaagcgatctgcctgcctcagcctcccaaagtgctgggactataggcatgagccaccatgcctggcccataatatagtattctgacttgacaacttagcttntntttantaanaa

SEQ ID NO: 486330 - DNA, 739 bp, Homo sapiens
  misc_feature (157)..(157): n is a, c, g, or t
  misc_feature (217)..(217): n is a, c, g, or t
  misc_feature (222)..(222): n is a, c, g, or t
  misc_feature (239)..(239): n is a, c, g, or t
  misc_feature (249)..(249): n is a, c, g, or t
  misc_feature (251)..(251): n is a, c, g, or t
  misc_feature (254)..(254): n is a, c, g, or t
  misc_feature (268)..(268): n is a, c, g, or t
  misc_feature (275)..(275): n is a, c, g, or t
  misc_feature (298)..(298): n is a, c, g, or t
  misc_feature (309)..(310): n is a, c, g, or t
  misc_feature (312)..(312): n is a, c, g, or t
  misc_feature (325)..(325): n is a, c, g, or t
  misc_feature (344)..(344): n is a, c, g, or t
  misc_feature (358)..(358): n is a, c, g, or t
cggagcgggagcctggcgagctaaccctgagccagccggcgggcgtcccggaggcggtggctgcagtggatgtgggccctgacgctcgcactgtggccccggcggccgccatggcggacagcggcaccgcggggggcgcggcgttggcggccccggnccccgggccgggcagtggcggcccaggaccacgcgtctactttcagagcccccccggggncgcangagatggcccgggtggngcggacgatnanggnccagtgaggcgccnagggaangtcaccgtcaagtatgaccgcanggagctacggnngngcctcaacctaanggagtggatcctggagcanctcacgcgcctctncgactgccagggaagatggagatcccaaaactggagattgacgttggatgagctcctggacatggaggatgtgacgatgcccggggttgccagggttcaagggagctgctggatttgactgtaacaaaacccacagaggccttcatttctggcctgctggacaagatccggggcatgcagaagctgagcacaccccaagaagaagtgagggtccccgacccagggagaacggtggctcccacaggacaattcgctgcccccaaccttcgtagcaacagcataaccggggaccttcggccaggccttgtgcatgagcaggctctcgtgccttgccagggtctcttcctgccctaggttccactttgggtttatgtatcactg

SEQ ID NO: 486331 - DNA, 112 bp, Homo sapiens
  misc_feature (5)..(5): n is a, c, g, or t
  misc_feature (87)..(87): n is a, c, g, or t
tgtanttggctcatttatcattttttagaaaaaaaagaaaacaacagaaatgtgctgaatccttgtaactgttggccatggcactantttcatggaaggtggaagggcaggt

SEQ ID NO: 486332 - DNA, 1356 bp, Homo sapiens
gcgccctccccagccctgtccagcctctcgatctttgtcctaacctcagacggcgatgggcggggcaagacgctggtccttcaggcccgagttgatgggcacctcgggctcatcaccatgaagtcccctgcggccgaagggcggtggatttttagggtctctcccgcccacccctaatgccagtccccaccactgcgtactctgttgcggatcacaccatccaatacaaactttattggtaatggaagccagcttcaatctggtttcctgttagaaacttgaaagagtttaatttaccgatttatttttaacaaccctagaaacctattaaacccaatcacacagatttagcttttggttataacatggcctggcacagctttctgatattgtcggagtgtaaacataggtcttctttctccaaccagtgagaaagggattttttttttcttttctctttttttttttgagacgcagctttgctcttgttgcccaggctggagtgcaatggcgcgatctcggctcaccgcaacctccccctcccggttcaagcgattctcctacctcagcctcctgagtagctggaattacaggcatgcgccaccacgcccagctaattttgctatattttagtaaaaacggggtttctccatgttgtcaagctgatctccaatcccgacctcaggacaatctatgcaggaagaatgaatgggtgatgctggcatcttgaaaagttgaagctgatagactgaagaatgcggattacataccctgaggctgcagaggattttttctcaggcagccaagaagatggtggattgagactgagcatgcctaccacaagcagctgaccatcattcaaagcaagaagagggtactgctaaaggaaactggcaagaagcagctcctatggtacttacaagaacatcggtctaggcttcaagaggtccaaagagactattgagggcacctacattgacaaggaatgcctgttcactggtaacgtctccatctgagggcagatcctgtatggcatggtgaccaagatggagatgcagaggaccactgtcatccagagaaactatctccactacatccgcaagtacaattgcttcgagaagtaccacaagaacttgtccatgcacctgttcccctgcttcaggatgtccagatcagcgacattgtcacgttggataagtgccagtccctgaacaagacggtgtacttcaatgtgctcaaggtcaccaaggtcgcagacatcaagaagcaattccagaagttctgaggctgaatgtctgcctgctccccaaaatgaaataaagttattttctcattcatacacacaaaaaaaaaaaa

SEQ ID NO: 486333 - DNA, 1137 bp, Homo sapiens
cttctacaggaaccctgagacaggcctctgagggagatctgactgccattttcccaaaacagcgccccctgtcagctggaagcaactcgttcaaaacaagccatgactcctcagcaaaacagctccatcaagcgtctcgccaacctctcccttggggctcagtcaagggaatgaaaaaacgaggctagacacctgtccccaacggaaaaaccaagaacacacctggagagcagctcagacaaagggagccaggcggggaaaacagtaattggagaggagaccgtgcttccagtctgttgctggtttacaaggtaaatctattcctggacgaaaggggtacaggaacagcacccgaaaaccggcgacaggctgtggcaggcccgacgtctttcaagcccagctcctagcgtcgacgcccctccttccaagacgtttcccagcaggccctgcgcccagtttggatcaggacaatctatgcaggaagaatgaatgggtgatgctggcatcttgaaaagttgaagctgatagactgaagaatgcggattacataccctgaggctgcagaggattttttctcaggcagccaagaagatggtggattgagactgagcatgcctaccacaagcagctgaccatcattcaaagcaagaagagggtactgctaaaggaaactggcaagaagcagctcctatggtacttacaagaacatcggtctaggcttcaagaggtccaaagagactattgagggcacctacattgacaaggaatgcctgttcactggtaacgtctccatctgagggcagatcctgtatggcatggtgaccaagatggagatgcagaggaccactgtcatccagagaaactatctccactacatccgcaagtacaattgcttcgagaagtaccacaagaacttgtccatgcacctgttcccctgcttcaggatgtccagatcagcgacattgtcacgttggataagtgccagtccctgaacaagacggtgtacttcaatgtgctcaaggtcaccaaggtcgcagacatcaagaagcaattccagaagttctgaggctgaatgtctgcctgctccccaaaatgaaataaagttattttctcattcatacacacaaaaaaaaaaaa

SEQ ID NO: 486334 - DNA, 479 bp, Homo sapiens
ccaccccctagtcctgccattggctgctggacccccatgatggccggcggcatggccgtgcgcttcacagccctggacttgggctttggacgatgcagtgcatgtgtatgacgagccctgggccccctgagagctcccgactactgcgtagtctcaccacacttcagcaatggcaacggctgtcactgtggagacatctgtctaggaccaggcgtgtctgtgtccattaccacacacgttgcttgcgagcatatggtcgctggcttcaatgcgcacctaccatgtgcggggctattgcttgcctttgggaccagaccctgtgtgcttacggctctggtcctgcgtgagctggtggcgacagggcctaggtagagcgcttgctacagtgaggcacagcgcttgtgacggctcactgggacttttgctgagccggctaccagactgcaggatggactgctccaggctaggccaacttggac

SEQ ID NO: 486335 - DNA, 133 bp, Homo sapiens
cagagtgtacccattgagaatagagggaaatcagtagaatgaagcctacctatgatggcacatagaggctcctattgataggacatagtgaaaagagagctacaacgtagtaacagtgtcgtgtacgtacgat

SEQ ID NO: 486336 - DNA, 1783 bp, Homo sapiens
gtgtgtgggggggtgtgggtgtttggctgccgcgggcctgctagtgtgtgtgtgttgcagcctgtctcctgctgactagcttggtgtttctgcgttgtgtgtgtagaacttgttgtgttggcgtgtaggtgttaagttgatatgtatgatgggtgtgcgtgtgaggagtgtgtgctcggccattcgttgcgctcgccgtctggtacgtgggctgtcgttgggtgtggtgtgtgttcgccgctcgctgagtttgcctcgtctgtcgttgtgtgtgtgccagtcgtctgctctcttgcgtggctggggttggtgctccttcgccgtccgtgcatctgtgtttggtggggggtgcgtgtccgtgtgtttgtctcgtttgtttgtagtgctctccttcggtgcgcagtctgtgggtttgtgtggttgtacgttgcgagttgatcagttctaccgtcctctgtgtggtggtgattggttgttgtgtgtgttggtgtggactcgtcttttattctttgtctgctctgccgctggtgtgtgggtgtggtgttttcttctgttcttgcgtgtgttgcacagcgcgacacgactctagcgtgtttggagtggaggtgttcgtggccttcgtcgtgctgtgcgtcggtcgcagcagttgtgggcttcgttgtggggagggctcggcgcttcgtccgacgagcgttgtgctgttgtgagggtaggatcgcgcctagtgggttttggagtgcgacctctcgtgtgtgttggtggggtgtttcggtctgggggtcgtttggttggtttagtcctccctctcgtctgcgtggtgaggtgtgagtggtgtttgtcggcgtttctgtgtttgctcgcttcttggcgagggggatgtgggtctcctctcttctcacgtcgcccctcagcgctcgtctcggctctctcgcgtcgctgtgtggtgtgtcttcgctctcttagtcgactcggctagcgagtagggggggtggtgtgttagtggaggttgtggtagtgtttgtttgattatgattggtgattatgttagctgcctcacgacgcccttcgggggttatcctccctcttttgcgtgtcgcttcgctttgtgctttgcgctttgagttgtgtgtgatggcctctctcgccgctgctctgtcgatgtggggcgcgtggctgagagaggagtgcctgtctgtgtctctctctctgtcatatagtatggtgttgtgtagtgtgtgttggtgagagagggagtgggtattgttttggtgtgtgtattgctagtgttggggcctcctcgtgagtattagttgttgctctcctctcgtgggctgcgtctcctcgcggagcgcccgccgctcggtgatgatgctcccgtggtctcctcaccgtcggggggcggccgccgctgtgggttgggtggttgtgggttggtgtgtgttttgcgctcctcgctcgcgtctgttccgctctctgtggtgttggagagccacacgatatagaagatagaggtgtggatcatatctctcccctcggtttcctctctttctgttttctgatgcccctccggaggtggtagttgttgtgtggttttgtgtgttgttttagttgtttatgttgtgtgtgtgtgttgtgtgtgttgttgtgaatataataagagagagagcgcgcgacagagagagaaaaagaagaagaataaatataataaatataaagataaaaaataaaaaatatacttcgagcatccatatcgatcggggtctggagaagatatgaggcaccc

SEQ ID NO: 486337 - DNA, 119 bp, Homo sapiens
gcggccgcctactactactactgctcgattcaagcttctaacgatgtacggggacatgcaggtctacaaacatacggacttttggccaggggaccaagctggagatcaaacgaactgtg

SEQ ID NO: 486338 - DNA, 922 bp, Homo sapiens
  misc_feature (347)..(347): n is a, c, g, or t
gctcttgttgtcctctggtctggccccagtatggacagtaaggggaatctcgaatgtctctctgaacttaacagacaggagtctgggatttatgtacagacaaagagagaaaaccacagagtgtcctgtgtgttctctgtagacactcgttctgtgagctttcagtttccatgttctattgacatgacacgagtaatcgtgcgtatatccttgccgatggagggcaaaaacgtagaatgatgacgacagtgtctgatacagaccgacgtccgagtctagcgtcacttccgtggcgagctgtagcgagagaatgggctgagttaccaaggactcgagtccgtttcacnccggatggtcctttgcctcgaatgctaacgagtgcgctaggattgcgaatgcacatgtggcgacaagagagtctttgggttcgttgatgctgcgcagaggtacttccacacgattccctaatcaattcgacgtcataagctccccttgggacgcaacgactcttcagtgaacgggcttgcgattcgaccgccgagatcctagacaggaaggggagatcgatacgggagctacttgagtttacactcctttggggctcgcagcccaattgcttgtcgataaagacgtaaggcgtacatagagttgacgccatgtggccttggcagtttgacaatctcttgggaagagggaacatgtgggggactatttgcacgaggcaaaggaagagagcgtgatcactgcctccgatgggttggctttggccacttccccaaccatagctaactcattaggggagggcgtaaagcaagatctctggttttcgggtttccatgggtcaagataaatacccctggggtatggggggatgccactaataccttggcatttggctgaggttcaccttagagaagctggg

SEQ ID NO: 486339 - DNA, 749 bp, Homo sapiens
ttccaaaaaaagtaaaaaattttatgctaaaaaaaattcgcaatgaaacaatcagtagccctttgcttttgttaattgtcccagttcccttggtaagggtttaattttcccaagggtggtttttttccaaaataatggtgtaggtgtttaccccccaattctttctgtggctccacatttctgcaggtttcctttgttctcattcagttgtgctcataaccgtggtctcgtggagttttcgtgacgactctcctttgtttcaccaaatgtggcaccattttccgtgagcatttggcgtggcctcttcgcgtgtgagtctccactgtgtggctttcgtgctccctccaagagtctccatgtgtggccacgtgttgtgcatctccctatagggcttttttttcttgtctgtgcccccacgactcttttcttttccgacttgtgttgtgcacgttgcaatggtgccaaaaccttgcagagcagattcaataggccaataggcccaatgagggattgccaaagatgtgcattcacgccattttcgtggaattttggggggttgcttccctttatttgcgacacacgaaggttttgggtgtttgtggctctcccacccttttctttgaacttccccatgtgtgtggagttgtctcccattctggatgttccagaagctcctctgacagtgtggctttgtggtgaacccccccccagtgtggggggtgtgcggtatcgtggtgcttcatggggtc

SEQ ID NO: 486340 - DNA, 1047 bp, Homo sapiens
aaccttagccaacacatatacccaaataaagtataaggcgatagcacaattgcaaaccatggacgcacatcagatatcagtaccgcaagggaacagatgaaacaattatagccaagcataactatagcaaggcactaacccctataccttctgcatactgcaattaactagacaataactttgcaaggagagccaaagctaagacccccgaaaccagacgagctacctaagaacagctaaaagagcacacccgtactatgtagcaaaatagtgggaagataataggtagaggcgacaacactaccgagcctggtgcatagctggttgtccaagatagaatcttagtacaactttacaatttgcccacagaaccctctacatccccttgtaaatttaactgttagtccaaagaggaacagctctataggacactaggacacaaacctagtagagagagtaacaaaataaacacccatagtaggcctaaaagcagccaccaagataagaaagcgtcaagctcaaaacccactacctaacaaaatcccaaacaatataactgaactcctcaacacccaacaggaccaatctatcaaccgtatacggacagaactaaagtgagcaatcacagtacacatgaacacactacaccacagcactacagccatgacagaaaagagacaaacaaccgaacatgaccaatcacacaagaccaagtaacaacaatcacacaaacaaccaaaaatacacaacaaagacaacaccaacaccaggccatcaccataccgacacagcgcacccaaccgacaaccgcaaccagcaaaacataacaagacgaaaccacacaaaatacacatccaacaatacccaacaactcaacggaccgcactgaacaagacacactacaaacacaccacaaaagcgcaccacacaacagctcacaacgcacacaaagcaccaacattgtaaaaaagccacaaaacaaacaaacgcaaccgtacaacaaacccaaacgcaataaagcccaaacaaacacagaaaaacccccaa

SEQ ID NO: 486341 - DNA, 208 bp, Homo sapiens
ctccttcacacgtatccgccacaccacggaaatcggtgatactcccctagagttttccatcctggccacgctccctcccccgcattcacctgatcccgcgaaccaagccatgatttaccactcccccaagctccatccctcctgggcggatacacccagcagtctatactacgcacgcgtcctccaccttcgtgaaaatcccccgccc

SEQ ID NO: 486342 - DNA, 324 bp, Homo sapiens
atccccgggtatgtgtggtgttatggtcattggctcctagaacgacaacaccgctattttgcgttttcaaacccgcatcgtgcctttctgtgttgaacttatacccgttaattctacacgacataaacgttttggcgtatgtagttgggccactttctaagatttttagttatttatttctttcactttcatccgttaataggccaacctaagaatacaaatatattcatcattattgcattcttgaaatatcttacataaatttttgaatatcaatgaaaacttactttattcttgaaatatcttacataacaccacacaatt

SEQ ID NO: 486343 - DNA, 257 bp, Homo sapiens
  misc_feature (123)..(123): n is a, c, g, or t
  misc_feature (218)..(218): n is a, c, g, or t
gtgagatcaatgtccatgctctcctgatatgtctcctgtgtgcaagatgatacatcacaattcttcagacgaggtccaaagtcagagaagagtcttgcctcagatagagttcaagagtcaacntggctgtccatccataacacccaatggagtgtctcagtgggaagagccgtgtagggccctgttcatggtgctgatctcaacagcaataggctctngcacagacaccacgtaaaagcaagaggtgggggctgcct

SEQ ID NO: 486344 - DNA, 1598 bp, Homo sapiens
  misc_feature (260)..(260): n is a, c, g, or t
  misc_feature (295)..(295): n is a, c, g, or t
  misc_feature (477)..(477): n is a, c, g, or t
  misc_feature (923)..(923): n is a, c, g, or t
  misc_feature (1328)..(1328): n is a, c, g, or t
  misc_feature (1339)..(1339): n is a, c, g, or t
ccatgggaatttggtcgagtgcgcgtgagcgatacacagggatcggggccgcgagagggagagtggaggctacatggtacgcaaggcaaggtagtcagacagctacgttaccggtgggcgactcgtgagtaagagtagtgacgcgtagtgagttgacagcggagtaatgcctcggcttctaggcacactagatggcgacacaagaaacgctagctctgatggagacgcgcacacaaacaagcgacacttgtaccgaagcnccactttcctaggtgagaagtcccagaattagtgncacataggtgctgcacgctggcagcatgtgcatacaccacggataacgtgagctattaatgattgctggtgtgttcaagctatgctaggctagccggagtgtcatttacttcaagctacagtctggcaatggtatgagtgccgaatctgtcctctacgagtgcatcgggtactcgcatatcntttcttaggataatcaacattctgtcatacacgatcggcggggaacctggcatgcgcacgcggctcgaacctttgaggcatgcaagtggggaccgctccaagcgatactttgccacacatggtcaacaagggcccgagttgtggcatttacatcccagtagaggctctaatggagtgacgaggctggccccaattgcgtcacatggtagccgggtccacggaggaaatggcgcaccaatatcagcggacgaggaatcgttgccctggtcctggggtagagccccctgggcttcccaagacttttacctaaaacctttgtattggaacaccaaaatgggcgctttttagtagaatcgtgcttgcaggcggaaactttcgtcagcacgaggaggtgaagcatactagagtggcttgcttcacaccgcgtacccacgggaaccacgaantgtgtgccttccttcacttatgcgggggaaccacaaacgttgcgtttgggtggggggtccttccgttcacaaacttcggacttgttcaccgtcggcggggtggacggccaggctgcccccccctggggctttgtgtgggctccttggaattcttgtgtttggctctcagggccaacctgtctcgttggattgccttagggggtggttggttacccccacgtgcgggcttctgtttctcacggacgttattttgtccccccgccagtatccccattggatcccctttttgggggcgaacggttctcggggcggccgccaagagggagaggcgcacctccccacgtggggggtgtggggggcccccccaaaacgaatatgatgaggggctgtttcatgcctggggangacgctttttnttcttgccgtgttacaacacaaacagggtggggagtgcaaacgccgcttataataacgagaagcacactgtggttgataaccatgtcataggggcaacaccaccagacgattgttgtcacactaccctgtcctatacaccaaacaaaaccacgtgttgcagagctgctcgacaaacaaccagtccgtgtgctgggcgcccaacagagaacaacatgtgtgtggtaagaagcggcgaacggcccatacgtgcaaatgatc

SEQ ID NO: 486345 - DNA, 143 bp, Homo sapiens
caccccctttccgtgctctttctctcggtccagctcggccacgatgctgtccctccgactctcgtgggcttaggtagtcagcacacatgcgcacggcctggagctcaggggccgaggagggcttgccatgcgtggattgccag

SEQ ID NO: 486346 - DNA, 614 bp, Homo sapiens
tgcggtggctcacgcctgtaatcccagcacttgggaggccgaggcaggcggatcacgaggtcaggagatcgaggccatcctagctaacacagtgaaactccgtctctactaaaaatacaaaaaactagccgggcatggtggtgggctcctgtagttccagctactcgggaggctgaggcaggagaatcacttgaaccggggaggtggaggttgcagtgagccaagattgggctgttccgtctctccacccttcgctgtgtcccgttaatctcaatacaagaggaaattctgctcttccttcccaaaaacaaaaaaaaaaaaaacacaacaagaaacaacagtgtgtgggcggcgcgccggggcccccgggaggaggctttttaagaaagaccatttggtgtgggagggcgcgggggaccccgagaggatggagtagaaaaaggggcaaaaggggtgtgccaaagggaaagacagggggccagagaaaagggcgaggggaacctgcgcaaaataaaaacgcccgggggcaaacagggggtcatgaccaaattccaaggggcgccgagagcaaaaggggtccataaaagggagccaaaggagactaggaaagtcac

SEQ ID NO: 486347 - DNA, 158 bp, Homo sapiens
tgtatgggcccaatggtagagttctcaaatgttgagatagtgaccacaatccactcccttgagaaaagaatggcatgaacccgggaggtggagctctgcagtgagccgagatagcaccactgcactccagtctgggcgacagagtgagactctgccac

SEQ ID NO: 486348 - DNA, 765 bp, Homo sapiens
ccccaaaaagaaaaaaagttgacccccgcggggggcggccataaaaaaataaggcccccggggggaaagaattcggaaaaaaaaaaggcgggttaattatttttcttggagggccccctctttccaaaaaaaatttaagtttctttccggaaaaaccctattccaaataaccctttaggtcccatggaagaggggagaccaaaatttttttttaaatattggccacaagagagagtcttgtctaaaacaaaacccccaaccaacaaaaaagccccaaaataaaagggttggggggtgtttcacggagcagcaagagagagagttcactaaataatactggtgaaaagaaagagttgaaccctagagataagggtgagcaataccagctttaaccaaaacaggaaatgacctggggtgaagattgtttctttggccagacacagtggctcgcgcctgtgattccagcattttgggaggctgaagcatgaggactgcttgagcccaggagttcaagaccagcctgggcaacacagggagacctggtctctacaaaaaacgttttaaaaattagccggacatggtggcacacagctatggtctcagctattcagggctgagatgggaggatcatctgagctcaggagattgaggctacagtgaaccatgattgcccaattatactccagcctggacaacagagtgagaccctgtctaaaaaaaaaagattgtatctttacatctgtatattaaaacagagcacggcat

SEQ ID NO: 486349 - DNA, 295 bp, Homo sapiens
tgagactctgtctttaaaaaataaaagagtttgtagaacttataagtataatcattgaaattaaaaattcaaaataaacgggtgcaaaaagtcatgcctgtaatcctagcaatttgggaggccaaggcaggcaatcacttgaggtcaggagttcatgaccagcctggccaacatagtgaaaccccatctctactaaaaatacaaaaattagctggaaatcacttgaacccaggaggcggaggttgcagtgagccaagattgtgccactgcacaccagcctgggtgacagagtgag

SEQ ID NO: 486350 - DNA, 163 bp, Homo sapiens
  misc_feature (14)..(14): n is a, c, g, or t
ggtttttttttttncccccccccttttttttaggggggggggggggggtttccttttgggggggttgggccaaaaaaaatccctttcggggggggcgccagccattcccccccctttcctgcaaaggccctttcaagccaaaaaaggtttttggccctttcca

SEQ ID NO: 486351 - DNA, 869 bp, Homo sapiens
gcgcggtctctggcggagtcggggaatcggatcaagggcgagaggatccggcagggaaggagctttggggccggaggttggtccgcacatttacgtgcgcgaacgcgtgattggaccgggagctggtgacgatgtgcggtgccgcaggcccctgggtgctgcaacctggaacagttgttgaacccgagaccaatgcgaggcggaccctgaagtcggaccccgagtgaagaccactgctgccaggtgtgattgtacagcgtttgatgaaggcggacacggatggtgcgaaggtgcaatttcctagtagtgggtagccattatacatgactggtcgtctgcctccctcttggaccacagtggacggagaagggtgttttgccgcgcaaaaaacgacctctagaaaacagccatgggtaactgactgcacgccatttgtgggaagctcgtactcatgccagggcaatctgtcctgaatggcatgcgataagtcatcgtggcattgaacccggagaggagggtccttggccaggcaattgcccagaatttcgaagaagggggacttgaggttgcttgcgcaggtgtacaccttattcgaaaattgtaaggggcaccctgaaccccttggcgaggattggctttgtccttgatgcgcaccacagggggaggattgctggagctggacattactagcgaaggggttacagaaaccccaaggggacatggaagccaaggcaataggcccttagattcctggaagcgcattacgatgtgcatccgggggggcttattctagaggtggttcccaaaccaaggttgattctgacgcttgaacccttttttgaaccgcaaacgcagtttgaaccccgaag

SEQ ID NO: 486352 - DNA, 824 bp, Homo sapiens
caggcggggggacaggcggggggacagccgggtggtgagttgcacacagctgcagccccgactagctgtccccagactattaggctcacaagagccgccagccctcctcatgaacgtcacgtctcgcgcacttgtctccggaaatgcagactgatgacgaacatgtgttggaactgacgtgtccctacagtggcgcttagccgccgggagcgctttcactactatactcaaacgcactgccggtgagcgcgaatcgctcccagtgaccgcgacgaatctcgtcaccattgctcccctgtgcggcactctgacagtagcgcttatctctaagagaaagtagtcctcagttactatagccaagatgaggccagatcacgtaaatgatacagtgtcgagcaggaaagatacgacggacacagtcagcagtttcgccctccagcctctgaaagcgagttagaacaccatttactacttctggcggttcgttcggacctaggaatagacggactgctcacttccatctcgattcaccatggccgcccatatactacgacactgaggcaagtgtctccgaagctgcgccacctaggcgaacgcgtcacacctttctacaatttccttcatctattgtacgacaccacataccactggtgccactggcccactaaattcgagcacgcagataaaaaggaactacagcaataggttgggaccgcccagaactgcgacagcgacaaagtatcaccaccactcgcgacttaagaccaccccaggcatacacgatagcaacgtgcacaccttctctcacgtacaagggcacccta

SEQ ID NO: 486353 - DNA, 330 bp, Homo sapiens
  misc_feature (30)..(30): n is a, c, g, or t
  misc_feature (119)..(119): n is a, c, g, or t
  misc_feature (137)..(137): n is a, c, g, or t
  misc_feature (170)..(170): n is a, c, g, or t
  misc_feature (275)..(275): n is a, c, g, or t
  misc_feature (304)..(304): n is a, c, g, or t
  misc_feature (306)..(306): n is a, c, g, or t
ggcacgagctttagatggtgcaagccccangctttgtggtgttgagcttccatgtggtgttgagcctgcaggtgcacagaagtcaagatttgaggttttggaacctccacctagatttnagaagatgtatggaaatncctggttgcccaggcagaaatttgctgcaaggntggggctctcatggagaacctctgctagggcagtgcagaagggaaatttggggtcggttcccccacacagagtccctactggggcactgtcctccagacccagantggtagatccactgacagcttgcactgtntncctggaaaaagccacagacaatca

SEQ ID NO: 486354 - DNA, 116 bp, Homo sapiens
agatctagagcatcccctctgagtgttcaggcactcagaatggtccagcgttagacataccgacgtaggctatcctacaatagagcctctaacaaaactaggctagtcccgaaccc

SEQ ID NO: 486355 - DNA, 275 bp, Homo sapiens
cctggctatgtcgccgaagcgggcctggagctccagctacttagtcaggctgaggctcctcagactgctggagtgcaggagttctgggctgtagcgcgctatgccgatcggctgtccgcactaagttcggcatcaatatgatgacctactgtgagcgcgggaccaccaggttgcctaaggaggggagaaccggtccagcttgagcacggaacagggcaaaactcacgtgctgatcagtagatgcatcgcgcctgtgaatagccactgcactccag

SEQ ID NO: 486356 - DNA, 166 bp, Homo sapiens
cgatctagaggatcaccgtatgtctgacccaccgtgcttagtttgtactccctgaaatactctagctgctccacctgggcagtgagtttctgcctctcttcctggaaccgtgcctctcctccaggaccttgagcttggcactattcaaggtgggtcagaacataag

SEQ ID NO: 486357 - DNA, 119 bp, Homo sapiens
tttggggatggtagacagaggtgtaatcgagctttatgcccatgttgccgcacaaagttttcacttcatcggctgtgaagtttgagccattatcagtgatgatgatgtgggggacgccg

SEQ ID NO: 486358 - DNA, 206 bp, Homo sapiens
  misc_feature (7)..(7): n is a, c, g, or t
aacatgncaccaaacagcaccgcatgcgacagggaactattctgcgaaaagaagagtcatgtatgcaggaaacttctttcttgttttatttaagaaattgccacagcaccctagccttcagcaaccaacactctgaccgtgcagcacccacccacactaaggacccccacgagccaaagggttacaactccccgaaggctcagatg

SEQ ID NO: 486359 - DNA, 226 bp, Homo sapiens
ctagccgctgctggctgtagcatggatccactatgtaccaccgccgggacaaggaccagaaggagccagccaatgatatcaaggaggatgccattgctccccggaacctgccctggcccaagagctcagacacaatctccaagaattgggacccctttacctctgtacacctccggaagagccctcgcggccaccccattggccccttccaggccctgggtgcatt

SEQ ID NO: 486360 - DNA, 163 bp, Homo sapiens
ctgtccactaacaagcttcacacgcaacacagggtagtcggtttgacttttgtcatgaggagaacttgcccagccctcatcattccccttaaacccaggacagcgtgtgtgtgcgtatctgagtctcacatcctgttgactcacacggcttttgctgatgaca

SEQ ID NO: 486361 - DNA, 242 bp, Homo sapiens
gaggtgaggagaagaatctctgggcccggaaggcggaggtcgcagtgagctgggatcgtgccactgcactccagcctgaggtgacaggagttaagcccgtgtctcatgaaaaaaataaaaacaaaaacccaaatagtacttaacgtttcatttacttagggtagtgagaaatgactgggtactcaaaataatacattgcaagattaatgggggtacaatgagagtcccacctgtattcatgg

SEQ ID NO: 486362 - DNA, 121 bp, Homo sapiens
ggtagaaactaaaccaatgaaaaccttaaaccagtgaaaagtcaaaaaaaacaaaaaaaggttttccggtattatttataaatatttccagaacattaagttccagggtcctgggttcaac

SEQ ID NO: 486363 - DNA, 127 bp, Homo sapiens
taactgcttcagtgtgatggctacatcaagatctatgatgtacaacatgccattttggctggcacgctgagcggccatgcctcctgggtgctgaacgttgcattctgtcctgatttccaccttgcca

SEQ ID NO: 486364 - DNA, 152 bp, Homo sapiens
ctaccttcatccagatctagctgggagctgaagctcactctggcttcgtgcttacttccaggcctgctcttctctctgggatgcgggacaggcagcaccaacacagacacaggcccagacttggaaagatgtaacacccaccatccccatca

SEQ ID NO: 486365 - DNA, 493 bp, Homo sapiens
  misc_feature (14)..(14): n is a, c, g, or t
  misc_feature (63)..(63): n is a, c, g, or t
  misc_feature (80)..(80): n is a, c, g, or t
  misc_feature (124)..(124): n is a, c, g, or t
  misc_feature (144)..(144): n is a, c, g, or t
  misc_feature (190)..(190): n is a, c, g, or t
  misc_feature (446)..(446): n is a, c, g, or t
  misc_feature (472)..(472): n is a, c, g, or t
  misc_feature (487)..(487): n is a, c, g, or t
gcgactctgctgcncctgtcctccgtcggctctgcgggctcccgggcctacagcggcctgcgnagacaatgccctccggntaggagcgacggcgccggcccgctatactcgcaccaacttcccnacctccccgctgcagaaagngcctgttggccgccggtccgccgaatggcgctcctataaccctacngccacgattcctggatccacctaaacgcactgaatctgaatctgaatctgcagtggagggagaaatgggcgtgaaaccgaaagtctgtctttaaactacttgggagaatctgtcatgcagccatattgagaacatctagactaaatagatgattcataagtaccgatcagtttataatatcctactagaaagtcaactccgaggtcgaggaccatgtctgcctcgttccactgcatctgagccttctggatagtgnctggcaatagtaaatgctcaataatngtttgctggatgtgnactgga

SEQ ID NO: 486366 - DNA, 110 bp, Homo sapiens
gaatgtacagtttgaagatatttggcagaagctccacaatgcagccaacgcgaaccagaaagaaaagtatgaggctgacctaaagaaggagattaagaagctacaacggc

SEQ ID NO: 486367 - DNA, 258 bp, Homo sapiens
  misc_feature (132)..(132): n is a, c, g, or t
gtaggtaacactatcagctgatttttctatatagatggaaaaaaaaaatcagccaagtaagggcacatctacagttcattatagaagtaagcatacaaggtacaaagaattctctgtttggacttgacatcnaatcccatacctctgtatactacgcctaaatctacttctcacaagagagtatagttctttcctatccagtagaaaatattactaccattaaagtccaacttagggtacactaatactgaaaaacct

SEQ ID NO: 486368 - DNA, 254 bp, Homo sapiens
tgtggagcgggggtctcagcaataaaagagtgaagtctgggagccgggcgcggtggctcacacctgtaattccagcacttggggaggccgaggcgggcagatcatgaggtcaggagatcgagaccatccgggctaacacggtgagaccccatctctactaaaaatacaaaaacttagtcgggcgtgggggggggcgcttgtagtcccagctactcgggaggctgaggcaggacaagggcatgaaccggggagga

SEQ ID NO: 486369 - DNA, 161 bp, Homo sapiens
ggagatcgaggcgggcagcgtgctggagccactgtggcacacggcccgggttcggcgtgcaccggggagagctcagcgggactcactgaccttcccagtgaagcagcctgtgagggtttcatgcgggctgagaagaagaaccatgcagaactgcgcctaat

SEQ ID NO: 486370 - DNA, 1302 bp, Homo sapiens
ggcaagttataggagcaaagctactaaagaaagagataaactttgaaacaagaagaaatgaagtcactggcttttgacaaacggctaaattaaacaacgacgacacaaacgcagatagccctacgacagcgacagacacacacacacgacaacaagaacgactaacagacgacacaacacgacgggaacgaacttgacacaacaacactggttgacagacacgacgacgacctaaacgaaaacaaccgacacgacaccaaacgacgacggcttaacacgctacgacaacgacgacacacaccggacacacgacgacgacacgttaaccgtgacacgacacacacgcgacaaaggtaactgtgggacactaccttaaacaaccacgttggacgtaacacccttagcgaacgatcatggaactgtgactgacgcttaaaggacacttaccagaaaccaagcacccagtgacaaacgtagaactaccatccgtgaacatcttttgggtagatgctcttgcatggtattacggacgttcccttaatagcattatggaggaaactttttagatacttcacagatgcagtattcctgcatggacagaaacccgtagcaagatattagcaggcaagctacttgtaaggcaaagtgacaagtgaagggcccactagtgtgaattgcttaaaatcattccttgactagcaatctatccagtgcaatcgctgcacgaagaagcaggaagtagacccaaagagcaagtaacgtgatgctgacaccaaaagatttaacagaggctttggcctgacgatgccagatcccaaaaaaattcttggacagattgcaagcatggaatcattggacagctgaatggacacaggtacaaccaggtctgcagttggcaacacgatggatctggaatgctggcacccttcagaaaatcttcagaaatggacattttaaagctccagatgcgcagataacaacgagcaagtcccacgccgaacactcacaacacagaagacatgaagcacaaccgaatgagagtcggacaatgggggccatagcagaggacaaacccagcgtaggcagagaaactgggactaaacccaacgggatagactaaaacagggagagcaaaagagacaccgacaaccgtatggaacacagcgacctgtaccacggagaatgacacaaaacgtagaacaaaacgacacgcgcaagtaaactaacaactcacaggcacagaacctacacagacagacagcaacacaaaaacacgtcgcagagaaataccatacagagtgc

SEQ ID NO: 486371 - DNA, 150 bp, Homo sapiens
agcacctgttctcaccggcgcctatcagcaaagccattcccaaggctatggctacatgaccccagcccagtgcgagatccatgagatcaatcacagcattcaaccaatcatacggtgcgtaccgaggcatcgtgcgacttacaggtgacg

SEQ ID NO: 486372 - DNA, 239 bp, Homo sapiens
tttttttttttaaaggaaacaagctctcaaatcataaagtgaaataaaaacggcatatgccctcaaagctgtgaattcaggtcccaggtgttgtcgcaaaggagtgagtgaaactccccccctccccccttttttatataataaaagtgccctagcatgtgttgcagccgtcccccatacagtaaggtggttttcaaatgttttcccctgagcctcccaataaaaagacccatgtgcta

SEQ ID NO: 486373 - DNA, 112 bp, Homo sapiens
cgatcccttaaatcgacggtttctcctcacccttcaatttttttaaaagtatttctgagaaagaaagtacatttcctgccaggtacggtggctcacacctgtaatcccagca

SEQ ID NO: 486374 - DNA, 586 bp, Homo sapiens
actcatgtaaagctcattgtaatagatgtagtttttctaatctacatttttattgactgtcatctatcaaaatattgacttaaatcctgtaactatttgatttcaagctttaaattgatctggtattccttgcggggctccagttgcatctaaatagatgtgagagttgaaagacctataaggagcttctctcgctttatgatgtcttattttttttttttcctctggttgatgaaatgccagggtaaaagggatagccaaatggactaaagcacaagtgccactctagttattcagcagagtgcccagtaaaggtccaccacaataccaccatacatccactcggggatgaacagaggctgactgattgataagctcttgaaaattcttaagctcactgcatcccttcaggtctccaaggaatgctaaatctcctccctgccatgagagacaagaagtgaacttagtgttgggagacataagttggatggcccttcggggctgacccccaagggacttaggattttgccagaaagaagcttgccatgactttttcacttcaggctgtagaaacctggaaaaaaac

SEQ ID NO: 486375 - DNA, 195 bp, Homo sapiens
acgcatctcgcgcagagcgtgatggaccggcggccggacggtggcgcccggcgagtcggtgccaggttcggtcagggtgccgcggttggcgcggatctcgtcggggctctgcgcgtcgacgtaggcgtggccggcctcgaccagcgcctcggcgaactcatacatatagccgaagtagtcgctggcgaaatacag

SEQ ID NO: 486376 - DNA, 178 bp, Homo sapiens
acgtctgacagagcgagactccatctcaaaaacaaaaaaaatagttaccattagaataattctaaattagattcaatcaccatataatttatatattataccaaatataatgttatatttagttcaaaataattgggtttaaattaacatttttactttataaacaataaccttttta

SEQ ID NO: 486377 - DNA, 977 bp, Homo sapiens
gccggttgggcgtgtgagaggttactcgctctagggagattcttcaagcaatcactatgtcaacagacacaggtgtttcccttccttcatatgagcgcaagactcagggcatcaacaactcattcgaaaagctaaagaggcaccattcgtacccgtgggcaatagcgggctttggcagcaatggtggcatatggcactcatataacactgaacgagcaggggaacatactacccatgtccattcatctgatccacatgcgtgtgcgcagcccaaggcttcgcccgctaggagcaattgacctgtcgggtatggcgctattccagtgtactcggcgacattctggggcaaacacctaatgcccttagacagcacgagcatgctgtcctggggcctctgctcgggacggagcctgggctatcaagctctcacaatgctcctaactcacttcaccgctttaccgtacttcactgggcagggcgccacctcaccccctacactacggcactgccgcgcctcaacagacctgcggctcacccattgggcccattcccggacataattggggcccttcccttttcccttgggcagggcctccgaccccaggcctatgggctgaacccggaacttacctaacgctggacctaagctctaactaaaccctaagggtcatttccagggcaacgctcaaacggttaagcctttagaaccatgtgtcacccctacaatggccccctctgaatcggctggttggcaaactggtcccaaccctttcttttcaacactttcttaaggaatgacacctttaagttccctaacagggaaaggcacctacccaggggcccaaatttcctgacaacgggttcttccccgcggattgggctgacagagacatgtgttccgcaatccattctcgggactgcgttcggcatatacgaaacccctatattgggcccccacattataatccacagctatt

SEQ ID NO: 486378 - DNA, 148 bp, Homo sapiens
accatctggattccttgggatggctctggggctgagcgtctgagtgcttgctctgaattctctcctggggactctggcgcctgtgtctcctggacaggcatgctgtcacttggctccttctctctgcagctgttgtaggggatgctgt

SEQ ID NO: 486379 - DNA, 426 bp, Homo sapiens
gtctacagtatctgtttccttagtgccttcatctcctttacttctctatgatgatggtatataaagtccaattcttacagccttatctctcactagtctgtctttatgacttaacttgccccactacttaacgtacggcagagaaaaagctgttcttccctgacatcatcaactactaaattttctactttaagaaatgcgcacgtaggctgcgtgcagtggcttacgcctgtaatcccagcacttagggaggccgaggcaggcagatcacaaggtcaggagatcgagaccatcctggctaacacggtgaaagcccatctctactacaaatacaaaaaaattagctgagagtggaggtaagtgactgttaatcccagctacctgggtggcagaggcacaagaacccgggcaaagggcaccgcacaa

SEQ ID NO: 486380 - DNA, 244 bp, Homo sapiens
gttttctaactatattgtttactgtttctataaataaaaggacttatgacattgaattccagtgatagctaccaggatttccctttgaaatgctaaaatgtgcattataaagggagtaatttttaatctcttattttaaaactcgcggaaataaatttgatatattaatgaaaagtaaatgggtttgacacactctctgttcctgggcacagctcccaccatctctgtgtacctatgaataggg

SEQ ID NO: 486381 - DNA, 778 bp, Homo sapiens
  misc_feature (626)..(626): n is a, c, g, or t
  misc_feature (629)..(629): n is a, c, g, or t
  misc_feature (639)..(639): n is a, c, g, or t
  misc_feature (642)..(642): n is a, c, g, or t
  misc_feature (654)..(655): n is a, c, g, or t
tccggggaattcctgtggggttcacaagtttctatagccacgccgtggccccgtggggtggagtaggccccgcggcttgttggcccagcgatgtgccggcaagtgtgtgcgcgcgccactcggttggtggggcacccacgtgtgtccctcttttacttccggggggctctactgcatgcgaggaatcttctgtgtgaccccacggagggggtgggggacttccacgtgggtcccaggagtttcacggcgcgcttgcacactgtcacggcgctcccgcgggaaaggcggggaaaccccgtgttccgagaagaagaaagaaagagcgagtagacccaaaatatagaggaccaaggaaaaggcccggcggcaagtggcgtcaactcttgtaaatccccgcactttgggagggccgaaggcacggaggagtcaatgaggtcagggaagttcgagaccaagcctggcccaaacagtgggcagagatgtgtttaagtgctgtggccagaagcggggggaggggggggtttggtggaaattttttgttatgatgtctgtgtggaaagcggctgtgcagacattcaattgttattattatgtcctacaagcattaattaattaacacactttantangtatgttcgnctntaatattggacnnaggggcgattaattataggatgaggcaggaatccaagacagattctgcgacatagggtgtccgggtccagcgtttcgcaatggtattgcgtgcataccccccagacgtaaatacccaatgcca

SEQ ID NO: 486382 - DNA, 406 bp, Homo sapiens
  misc_feature (254)..(254): n is a, c, g, or t
  misc_feature (257)..(257): n is a, c, g, or t
  misc_feature (267)..(267): n is a, c, g, or t
  misc_feature (270)..(270): n is a, c, g, or t
  misc_feature (282)..(283): n is a, c, g, or t
tttgatttaaattgtaaaaaaaaaaaaaaaaagggcggccgctcgcgatctaaaactacggacgcgtgggtggtgttagggttctttgtttttggggtttggcagagatgtgtttaagtgctgtggccagaagcggggggaggggggggtttggtggaaattttttgttatgatgtctgtgtggaaagcggctgtgcagacattcaattgttattattatgtcctacaagcattaattaattaacacactttantangtatgttcgnctntaatattggacnnaggggcgattaattataggatgaggcaggaatccaagacagattctgcgacatagggtgtccgggtccagcgtttcgcaatggtattgcgtgcataccccccagacgtaaatacccaatgcca

SEQ ID NO: 486383 - DNA, 521 bp, Homo sapiens
tttgatttaaattgtaaaaaaaaaaaaaaaaagggcggccgctcgcgatctaaaactacggacgcgtgggtggtgttagggttctttgtttttggggtttggcagagatgtgtttaagtgctgtggccagaagcggggggaggggggggtttggtggaaattttttgttatgatgtctgtgtggaaagcggctgtgcagacattcaattgttattattatgtcctacaagcataaaaaaaaaaaaaaaaaaaaaaaaaaaaaaaaaaaaaaaaaaaaaaaaaaaaaaaaagggggggggggggaaaaaactacccgcgaggcgcgcgcaagttaagcgctacaccaccgtcttgtgggaaaacgggggggccccaaaaggggagggccgactaaaataaacaacgaagcagcgcggcgcgcgcggtataacacaacggcgccggtcggagaacaactgacaagagcgggatccctggaggagagagaccccacacgtggcggggccggggccaacacctat

SEQ ID NO: 486384 - DNA, 501 bp, Homo sapiens
tttgatttaaattgtaaaaaaaaaaaaaaaaagggcggccgctcgcgatctaaaactacggacgcgtgggtggtgttagggttctttgtttttggggtttggcagagatgtgtttaagtgctgtggccagaagcggggggaggggggggtttggtggaaattttttgttatgatgtctgtgtggaaagcggctgtgcagacattcaattgttaaaaaaaaaaaaaaaaaaaaaaaaaaaaaaaaaaaaaaaaaaaaaaaaaaaaaaaaaagggggggggggggaaaaaactacccgcgaggcgcgcgcaagttaagcgctacaccaccgtcttgtgggaaaacgggggggccccaaaaggggagggccgactaaaataaacaacgaagcagcgcggcgcgcgcggtataacacaacggcgccggtcggagaacaactgacaagagcgggatccctggaggagagagaccccacacgtggcggggccggggccaacacctat

SEQ ID NO: 486385 - DNA, 691 bp, Homo sapiens
  misc_feature (423)..(423): n is a, c, g, or t
cgccatccgatgattgtcccgctggggccccgggagttcctcttggtgcgcgaggggaagtgtgccccgccgccaaaaaactgttcggtggtaggcacgaccacctttaataacgacagttttcctccacttcgctcgcggttcccgcgagacactattttcccccgcggatttctgcgcccctcttttccgtccgcgggtgtatattcttctgccctgcgctcacctcccacaatatgtcgttgacaaagtacaacgtgcacacaccttggaaggcttatatgtcccgaatatattatcgttgtgcataataatggatattaagagcaaaatatgtggagcctacgtctcccggctatattttaaagctctctcctggtgaagatttggctacccgctcccttgagtatatctattgggggngagcggggagctcccccgctcgtttttatagccgcgcggagataacatgaacaggctgtcagaaaccctctcccagtgttgggacaaccacaccacacaagtcttttgttccaaaaatagtcctcactccacacgtgtccgttccaaagcttctcttaatagtgctttatgacaccaatcttgttggcacatctgcctccgggtcactcctgtgcaccaacaattacaccccgatttattctccaagaaaacaacaaataacaaacaa

SEQ ID NO: 486386 - DNA, 434 bp, Homo sapiens
acggctcgtttttcctttacttaagaaggacgtggctgttgaggttagcatacgaatcaaggacaggacctaccatgcctcccgaagttatgccaaaacctagcatgcgtggccttctgtccaggcgtgtgcgaaatcatatggttggagcattcgagctatccttggcgtgtgcagctctgtataagatacgtgtggctgatcaaagaaagaaggcatacgctgatttctacagaacctacgatgccatgaaagattttaaggagatgagaaaggctggtatctttcatagcgtagagtaatgttggaatataaagaatttattcaggttgaattacctaaaagataggcactgacttgagttgctgaactatgacacatgactatgtggtctaagatatagttcctcttgttttgttaactattcacttatc

SEQ ID NO: 486387 - DNA, 384 bp, Homo sapiens
ctgtaattacttaggaagaccaaatggcaccagagataagactcccttagatccccacttagatcaccaccctttctcagggggtaataaagtcatcttccttggaatgtagcaatctataaccaatcaaagcactgtaacatatgcactggtcttgtatggaaaatgttgtaatcctgctaaaattcctctctctttgcctgtggaagtgaacccttaacttctccagtttggaatgctcaccccattcctttggagtcaatgcttactgggtggctattctcaaactttgcactcaaagaaactctatacttagtcttattttttgaatctcattatttaaggttgacataataaccaactaatagtaagtaaaaaaaaaaa

SEQ ID NO: 486388 - DNA, 540 bp, Homo sapiens
  misc_feature (411)..(411): n is a, c, g, or t
tggtgtaattcttacttctctgaaaaggaaacctaaatttactgctgaaattgggaatcagagtccggtgaattacttctgctcttgtaaatgatgcaggtccttttcccactccctttgaggggaataatgccattccacctccactgctgcgatgtagtatgccctctctgccaggtcgaaggtggaatcctcacactgccgcctgccttggttcacagtatataattgcttcatgccgcctgtgtaatgatcagctgcaaggcattcaacattaaatgtcctctctgtgtgaggccacatgtggagctgcagactcgtttgaggcaagaggctcgttgtgtctcttcggtctactctccacagatatgtgttctctgaaaagaatattccatggacatcggactcacnagctgcgctgagtaagtaccacacgaccgaatcttctttgcacatagcgagacccggctgattaccatacatgaatgccctcatggagcgcatttcaatagaatcccgaaagtcacagtattcttatca

SEQ ID NO: 486389 - DNA, 101 bp, Homo sapiens
cctggtgtgactccctgctctctgccagcccctttctcacccctaggtcccacggcccctggtctctcccccctgctagaatctcgctgagggatagtgtg

SEQ ID NO: 486390 - DNA, 344 bp, Homo sapiens
  misc_feature (122)..(122): n is a, c, g, or t
  misc_feature (143)..(143): n is a, c, g, or t
  misc_feature (317)..(317): n is a, c, g, or t
  misc_feature (338)..(338): n is a, c, g, or t
atctgggctggtcactgctgggggggcactgcagctcctctgtccagtcctgtgcctagaggccactagctctagcattttctcacaggggcccaggggacatccaagggcttggggcaggntccctgctggtccaggctggntccccccatgccccgtcccatcctgttcctggggaggtattgttcctgtctggcctggccggtggccacacacactaatacacagtcacaaatacacacatacacactcacacagtcacacacatacacatggatgcacacgtcatacacattcacacacacacattcacactnacacacagagtcacacacagncaccgc

SEQ ID NO: 486391 - DNA, 346 bp, Homo sapiens
  misc_feature (99)..(99): n is a, c, g, or t
  misc_feature (264)..(264): n is a, c, g, or t
  misc_feature (324)..(324): n is a, c, g, or t
ctctttagaaagcctgccttggctgggcctggtggctcacctctaatcccagcactttgggaggccaaggtgggaggattgcttgagcccaggaatttnagactagctggggcagtgtagtgagactttgtctctaccagaaaaaccgggcgtggtggcgcatgcctgtagtcccagctacttgggaagctgaggcaggagggtttgcttgagcccgggacgtggaggtggcagtaagctgtaattgtgccactgtactccagnctgggtgatagagtgagaccctgtatcaaaacaaaacaaaaaacaaaaacctgccttctngggattgggcttctgggttttt

SEQ ID NO: 486392 - DNA, 829 bp, Homo sapiens
agcggaaagatggaccgcagcgcgagaccagaggcggaagctgcagccctagaggtcctggctgaggtggcgaggcatcttggaacctgctagtgcctgtccgaagcaggagcgcgagaactgcacaggcgcaagatcctggcttgaggttctcgtgtgatggagctctcgagaagaacagacaagctgctctgcatgccagcttcaggtagcggatttcctgcagaacatcctggctcaggagagaccctggtgtgtccttcaaggctgttggtctacaaactgctggagatgtcaatttgccatgacttccttggtaggacagacagcatggacgaatagatcctataataaggtgctcctgacattcgccgtcagcctcccaaccatcattacaggaaagactgtgaactcctgagttcagcgttgattgctgactacatcccagctaagctctggcatctgtggattaaaatccctggatctctctcagatgtgtattggtccatctgcatatgctggcaggaacaagctattaataccacgatactcagaagccaataagctatgacaggagctgggactggtttagaacacagaggtgtgccagatggggagggggatactggccttgggcctcctatgatgcagacatggtgaatttaattcaaggaggaaggagaatgtttcaggcacggtggttatatgtgggaagataagtgttatggcatggataccaaatgatcgtagagtccttttcttgtgtgcgtaatgttctggcggtgaaccagaatgataacagttgacgtcatcttgactgttaaggatg

SEQ ID NO: 486393 - DNA, 199 bp, Homo sapiens
atagtggcatttgcgggaacatttgatagttggtgatgtgctctatatccactgagttctcactcactactaagccattcatgtatacctatctaataaagggaggtgatattcttagcccgccatgctagtttgcaaaaactaatgtgatatttctggtaatcaatgtgttgcccagttttacgtcaaaatgggtacc

SEQ ID NO: 486394 - DNA, 461 bp, Homo sapiens
  misc_feature (90)..(90): n is a, c, g, or t
  misc_feature (177)..(178): n is a, c, g, or t
cccccccaccccaccgggggggggtgggccctccccccccctcctttcctttttggttttaaaaaaggcagaaaacccctctctccggcnccccccggcgggtggggtggggaggaaaccctattttttccccccctcccggcccccggggggggtaagggccccccctttggtttnnaaccccccccccccttttgggttttccgttttgggggttgggacccccccccgggggggaagccccccccccttggggggaaccaaacctccctgaattaaaccttttacctttttgggggggggggggggggggcccttaaacccccccctcctggggaaaaacccccggggggggtttttttggccccttttttttttttaaaaaaggaccccccggaaggccggaaaaaaaccctttttttttgggttttttcccaaaaaaagggggttttttttgggga

SEQ ID NO: 486395 - DNA, 170 bp, Homo sapiens
  misc_feature (160)..(161): n is a, c, g, or t
gaagaatataagatgtatctgtgaactaattctattttaaaatatttatttagaaaaaaaattcataaaaatgttaacagtgattagcatatctgtattaatgaacagtggttacttgagctttcttttaaagaaaattttccaggtagttctcttatgnnccagcagag

SEQ ID NO: 486396 - DNA, 683 bp, Homo sapiens
  misc_feature (26)..(26): n is a, c, g, or t
  misc_feature (108)..(108): n is a, c, g, or t
  misc_feature (195)..(195): n is a, c, g, or t
  misc_feature (206)..(206): n is a, c, g, or t
  misc_feature (219)..(220): n is a, c, g, or t
  misc_feature (223)..(223): n is a, c, g, or t
  misc_feature (228)..(228): n is a, c, g, or t
  misc_feature (244)..(244): n is a, c, g, or t
  misc_feature (246)..(247): n is a, c, g, or t
  misc_feature (252)..(252): n is a, c, g, or t
  misc_feature (255)..(256): n is a, c, g, or t
  misc_feature (274)..(274): n is a, c, g, or t
  misc_feature (284)..(284): n is a, c, g, or t
  misc_feature (294)..(294): n is a, c, g, or t
  misc_feature (356)..(356): n is a, c, g, or t
  misc_feature (362)..(363): n is a, c, g, or t
  misc_feature (371)..(371): n is a, c, g, or t
  misc_feature (471)..(471): n is a, c, g, or t
  misc_feature (521)..(522): n is a, c, g, or t
  misc_feature (612)..(612): n is a, c, g, or t
  misc_feature (646)..(646): n is a, c, g, or t
  misc_feature (673)..(673): n is a, c, g, or t
ggattcatctgtaatggccttcccanaaaccatcttcatgatgcaagcatggaactgcttattcatgaagcagttgatgatgggattgtagatgcaagcactcttggngaagaatgaaggaatggtgacaagccgtaagtccagcccatggttacggttgttgaccatgttcatggcgaaggccgcgtagggcangtagcagaaanagaaggatcctannatnaaaancaccatgcggctaaantnncgtanagnnttctgggtggtagctgantcctgcggcngaactgcaanagcttttagggccctaagcagctgagtgtaggagaagcagatgagggagagagggacaatgnagcggnngatgaagngggaccacgtataggactcgcggcgggatttggtgcccacggtgtaccagttagggccacaggaacactgcagggcctcaggggtgaaccggctccagcnaaagaagggtgggatggagaggccaattccaatggtccaggtagccaggnncaccgtcagttcatgcttggagctgaagcggaagttgccgaaggcttacagatgaaaatgtagcgctcaaaggccagggaggccagttancatcctgttaccagacctgctacagttcccaggnagccctccaaagcacaaaaatgggggncggagacgaa

SEQ ID NO: 486397 - DNA, 247 bp, Homo sapiens
cagcaccccaaaagcctgtgggttcagtcctgggtttgccccccccaatcaaaagggtcgttttgttttgtttttaaaaaaaggtgagattggcttggttcttcatgagcccatttgaaatagctctttttttgtttttccctgcccctttcgttttggggaaaaaatttggtctgtattgggattgtaaagaacatctttgcccccagccagtttacaaaaataaatgttttttttgtttttcaga

SEQ ID NO: 486398 - DNA, 1012 bp, Homo sapiens
gggatggaacgtcacccgtaaggatgggcatgccagtggaaccgacgctgacttgagagctctggactgcgatcctaccaccaactcgtccaactgacaagtcccttggcgcgcgtgcctactccgaggatgtctacaacgattgcgtggtatcggtactgtatcctgtttggccgagtggagactggtgttctcaaacccggtatggtggtcagccttagcgtccagtcgaaggttacacacggcatgtaaaatctgtctgacaatgcaccatgaagcttggcagtgaagctctacctggggacaactgtgggcttcaaatgtcgaagaatgtgtctgtcaaggatgtatcgtgcgtggcaaactgttgcatggtagacagcagaataatgaaccgagcaatggaacgcgagtctggattctacatgctcaggtgatgtatccgtaaaatgcttgaagtgctggctgatgctggccagtaggtgcgagtactggttcccagggcaaggcaccatgagtgtcggtaggagaagcattcttcaggacttatcagcatcctatgaggagtacaggtaaaggcagtaggacaggtgaattagtggcagaacagaacacgttgggccgtgcaggcgaatgtccatcacatcacggccagaatggcaacaacgacacgggcgtgacttgggaggacaaggagagaaggggtcggcaaatggtactgggcacagaaaagggctcagacaaagggcttagacgggaccatcgtgtactcccgtacataccgcctgggacagccccaaaactccttgaacgcccacgatactggggaacgaaaccggggccatcaagaaaccaggtaagagaacgatacaactggagaccaagtcgcccagcgtctcaaggatacgtacacaaggacactaggtcgcacacggcctgcaccggcgtagcgcgcggtgaaaaaaaccgatgcacgcaaagggaaaaccgacagcaacggcgatggagggac

SEQ ID NO: 486399 - DNA, 959 bp, Homo sapiens
ctatctaatgcgtgtgcccgctgtcgggatagggtgtgcaatgggtgcactacgtggctggaggatcacgagtgggtgtagtgcttatctggatgatctatgatcgaagtgagggatgaatcgaggatgtggagccacggacctgttctgatgaccaaataaataagtagatccactggatgtaatgggacctggaagtgcgaatttatatccagtagagaggaatgtctagttcgtaatgtctcataaatgaaaaaagtactggtagcatcttatggtgacctgagtttcaccttaagtggtgggttgcttggcttaaaagctaaagattgtctggttcgtaaaagaaggatggatgtgtactgatatgactgatctgtggataactttctatggttaggcaaggcttgtggatgcactgggaaaaattctcttcgctaaaaagcagaggggtgcaggatcctcttgactgcaaggagtttcggactctcaattagttggcggatggcccctggttccatactttggaaaggacgacccctcagtggttcccaggcagacatggtaacgggtttcaggggaggatcctggatgccacggatggcaaagccagaatcgacgggaagcattaaggacggcgcgttttacctgtttttggctgtgccctactcgagccactaacggagctgccccgtaccacagcgcaccaaagcaaaaccaactgtgtcgcgccccgccctaaacgctcataccagaatggagcggggccaagtagagagactcgaatacggcccgacgaccggctcccagccaggccccaccaaacccgggcgcgcgcgccaccagggcgggaaggcatcaagcaacgccgatccggcgggaccaaacgcgacgacgccgccgcgagcgcagacgtccacgacacactgcacatcaccaagagcacgccccgccggcgc

SEQ ID NO: 486400 - DNA, 274 bp, Homo sapiens
  misc_feature (154)..(154): n is a, c, g, or t
agcaatgactatttatacagtagtgtgtgtatatatttcccgtccttccaatcccccccaccaccacgacagtgtcccctatggtaagcataagatgggttttgaaatctgagttcgtttctaattttataaactaacgttcttgtagtatcantttttattaagattccgcatataaggagatatcatatgactatttatctctcttctacctagactttcttcggcttagtaggataatctctaggtccatccattgcaacacggtctctca

SEQ ID NO: 486401 - DNA, 447 bp, Homo sapiens
tggagctggaagaatattatgttaaacaaagataagccaggtacagaaagacaaatattgcatgttattactcatatttgagagctaaaaaaaaaacattgaactcatgaagatagagagtagaatgatggttaccagaggctgggaagagtagtgggaagagaggataaaaagtgatggttaatggtagaaatacagttagatacaaggaataagatctaatgttcactagcatgatagggcaactatagttatctctaatttattgtatattttgaaataactgaaagagtggaatttggaatgttcaaaggcttgagctgatggatacctcaattaccctgatatgattatcatacattgtacacatatcaaaatatcacatgtatccaataaataagtacaactattatgtatcaataacaaaattaaaaatgttaaaatcta

SEQ ID NO: 486402 - DNA, 799 bp, Homo sapiens
caacacaaacacacctataattacacatatttctatgacgagccctgtgttaattggcctgagggcccgcgtaccaacatggcgacatctcggccgcgctgccctgaatactcggtgctgggtgccctgggccccgtctgctgctggttgggctttctctggtgaagtgctgaccccccgtgcctgctcgtgcctgagcctgcagtgactgcattgtgaagctgctgactgtgccacttattggtcctgctgatgtctgtgagtgacagcacctgatttcaactgacaatgatttttgaatgagcccctcaagcactctgacttcttcaattgtcaatggaactgttttcctgtgagaatgcctcttcgatgcccgagtccatctgggacacaaatgctgtgctgtctgtgcacatggtttattgtgagccgtacattctttggtgatgcctgcctggaccacgacatcatcgacctggaacagacagccactgcacctccagctggccttgaacttcaccgcccacatggcctaccgcaagggcatcatcttgtttataagcctgcaaccggcagttctctgtacctgatttgagaacatggcccgtgactgtggctgagtactgcccacacatctgctacttcaggggggcgtgcattgctgaccaacgctgcgcctcctctttggccccacggtcctgacttgccggacctcatcatcttcctgcacacgctcaacaacatctttgagccacacgtggcgtgagagacgcaaccaagatgatcatcccacagtggc

SEQ ID NO: 486403 - DNA, 81 bp, Homo sapiens
actgaagacagtgccacttactactgtgccttcgccccccttcctaccttatactggggacccttcaccgataaactcact

SEQ ID NO: 486404 - DNA, 1163 bp, Homo sapiens
ggactgcctaggactaccagtagaagggccaagcgtaggttggagcagatgataccggagtagcctggaagccagacatcgctccgtctacaacggtagggaattacgccgtaccatgaatctcgagaggcccaggccagtcaagggcagacactgtggcaggctgatcgagagcagaacagtagagagcgcggagctactgctcttctgaaggagctctgtctgcgtggaactgtagacacggattgtggcacaagacatactacatgtgaagattgtgtcgagacacagacctagattgtccaacctatatggcatgggggacgttgtcactcattgtcaagcatgcagttcgattggccggacgcagtggttcactttgtgatccatgcgaggattgcggtcacagaagcattggtttcacatacacatgggtcgccaatcagccttaccagcatagggccaagcagtcgcaagttcgctgtacaagactaattggcgcagtggaccgcgaagtaccatttccagatgcttgatgatgcggtcttcggctggtcagggccaggctccttggcctgctgagtgacctttgacacagaaaagtgccatcatgcgtgaaagcgattcaataggtataccgctgatcattgagccctctggacagggcacagaattcattatgaatgaatataaggatcgtaagatcacacggaccaggttcctggatgacgccttcagaaagaacttagagagtgcactgagattcggtaaaccccttctggtacaggatgtggaaagctacgatccaagtttgaacccggtgctgaaacgtgaagtgcgggaacagggggggaaagatgtgaatcaatctcgggggaccagagatagaccgtggggccaacggaggacactcctggcacccggggatcaaggagagatcccacagaatacaggacccggggaaccaaacgtacacatcacagcaccacgaagaaaaggtaacaaagacagagaccagagtcagcagcaaagagaaaaagatgaaagcaagaaaaaagagagaccaaacacacgcgggaacagcaccgataacagcgggaaaacacaacagagcgaaacagaaggcactcgtcacacaaccatcactgcgaacaaaagagaac

SEQ ID NO: 486405 - DNA, 245 bp, Homo sapiens
gaaaagaagaaccagaatatcgagctacatagctggtgcctaccggtcgcgccctgattcgcaataagcgcaagcggcgtctagcgactacgtcgctcatcttacggtcctgtgcggcatcgctggtcatggtcattcgagaccggagctgtcgtggggcgcctactacaatgcgtcgcgtggtcttccttgagcgtctgacaagtgcctgtagtcacgtcgtcgtccgacgcattgcatcctgg

SEQ ID NO: 486406 - DNA, 128 bp, Homo sapiens
ctagaggatccccccgcatcaatccctaccggctggggctggctttgttgaacgacatcgagcgccgctgggatcgtggccagttcggcaaggaatgggaagaatgtgaggactggaaccgcaagaaa

SEQ ID NO: 486407 - DNA, 293 bp, Homo sapiens
gcgcacaaaaccagccgacggaagaatgatggaatgaagacgctttttatatttgaaaatatgcataaaagatggacatacagcagtctcttgatgtcagtatctctcacggtgtttccttgagtggctatctaatgaaaaacaaattaagaaaagagcataggcaataatgacttttaccattgccctaaatgttccaatgtctaaaaataagccatgaaccaaagtcaattttctgtgggcaataatgtcttgtgttagaatataggaagatgcacatgtgtaaacgcacg

SEQ ID NO: 486408 - DNA, 419 bp, Homo sapiens
  misc_feature (25)..(25): n is a, c, g, or t
tgcgaaccccggaaagcacaccctnaagcgcgccgccgccctggcagcggaaattaccggtgtgcgcaagaatgtgttgtatcaggtcgcgctcgataagcagaaggccgaatagttccaggggcaaatctgtatttcgtctgaacgtgatggcaatgccgcacttttaatacttgtcctcaagccgccgtgccgttaacctgcgcggcggagagtcgattggacagtcgctgccctctatgaaaattaggggggggaggaaagtccgggctccatagggcgaagtgccaggtaatgcctgggaggcgtgagcctacggaaagtgccacagaaaataaccgcctaagcacttcggtgccggtaagggtgaaaaggtgtggtaatgagcgcaccgcacgactggcaacagttcgtggcta

SEQ ID NO: 486409 - DNA, 391 bp, Homo sapiens
ggaggctgacccagaggatcctccacactagtcaaagtcagaaacttttccttacattttctttagtagctttataatataaggtctaacgtgtaagtcttaatccagttgagtagattttgtatatggtgtgagataagggtctaatatcattcttctttatgtggatatccagtttttcagacatcatttattgaagagactgttctttctccattgtgtgtaataggcatctttgtcaaatatcaattgaccataaatgcatggtttatttctgggctctctgttgttccactggtctgtctgtttacgtgtcagtaccatgctgtatttattactatagatttgtagtatattttgaagtcaggtagagtgtgacgctaccaggaaa

SEQ ID NO: 486410 - DNA, 396 bp, Homo sapiens
gggcatcatttttaccgccgcgatgtagagggtatacgcacccacaaggtgcatgtctgtgtcggcggccatgagcaggtggggcgcatgctgcgctttcgcgatacgttgcgtcaggacagcgacatccgccagcagtatcaggatctgaagtttcggctcgaggccagcaatcgcgaggggattggcgagtaccttgcgcagaaagccccctttatagatgccctgatgggggctcagtcctagtaactgcaaatgcttggtgttgcctgataggttgctgcgaggctatcaggcccccagttgctcctgcagcaactgggcaaaggcgtccctggcgccgtggtgttgtacatccttgtgccagacaaagcggttatccactggctgcaggtc

SEQ ID NO: 486411 - DNA, 892 bp, Homo sapiens
  misc_feature (25)..(25): n is a, c, g, or t
  misc_feature (67)..(67): n is a, c, g, or t
  misc_feature (164)..(164): n is a, c, g, or t
  misc_feature (179)..(180): n is a, c, g, or t
  misc_feature (214)..(214): n is a, c, g, or t
  misc_feature (224)..(224): n is a, c, g, or t
  misc_feature (265)..(265): n is a, c, g, or t
  misc_feature (297)..(297): n is a, c, g, or t
  misc_feature (300)..(300): n is a, c, g, or t
  misc_feature (352)..(352): n is a, c, g, or t
  misc_feature (354)..(356): n is a, c, g, or t
  misc_feature (541)..(541): n is a, c, g, or t
  misc_feature (595)..(595): n is a, c, g, or t
  misc_feature (733)..(733): n is a, c, g, or t
  misc_feature (757)..(757): n is a, c, g, or t
  misc_feature (846)..(846): n is a, c, g, or t
gcaacaaaacagctatgtgggattncagatattcatcacgccttatcatactatacgactcactgcntcccatcgatcaatagtttagtgtagagcatcaaacagtgtacacagagcacaatagcaacatacagaaaacattgtccctgcacttgaggagcttncattttaaaagatannatacaccttttttaaaatggcattgttgtttggngttttctgcnaagtactgaggaaatattttgtaaaagtgagcatagggtanaaataagccgccatcatctcatttagagaatngcngaggacagacagcaggaaggatgtgtgaaacgagcagacaatgacagaccantnnngaaaggtagggttttaaagggagaaaaacacagtctcatcaactaaggagagaattgctgcagtaaataggatgagggaaatagtctgtgggatgcaagcaaaggaagcagggtgccttagacactgagtggagccagaaagatcatgcggcgctttttccaagtacatggccaccaagtaagantggttggtgacaagacagagggctaaaacaggaaggtaatcttgtgcacctganaaatagaaagaataaaggatcaaaattgaaggcaggctataagagtatcaagaaattcttaaaaaccaaaaagtgatttggaagcacaaaacttacagttaatgctacccaatgtcatgatgggccaagaacattgtngcttcctaagttagaaaatgccanatgccaaaattttaaatggaacacactacatttttttctaatcaatcccccctctcccagaaaaaataggaactcatttttttcagggnggggaggaagaaaggggatcatgggacatggaaacagtagtaatat

SEQ ID NO: 486412 - DNA, 673 bp, Homo sapiens
gactgattacgactgtcggacttctacctatgctctttattcctgtccattgtggtttgtattgatgtcaattctggtgccttagaagttagtagtgtgggaacctatctgtaaaatcagatgttgtttcttggtagagaaggatttcgtggtgcttagcttactaggagaccgatattcttaagttgtattcttgtttaattagccttgagaaatgtttggtttaggcagacagaattctggtctacttttttcttatcccaaaaagtgttcttttaatttctctaccaacagaaatgaatgagcaggtgtagagtaatttacagtgcaccttatatagcactgtagataaaaggaggctgtataatgtgtggcaggaagggactatgggagaatactttagctgtggagtggaaacatgttgagctacagtttgacctggtttgccctgtgtatatccacgtgcatcctttacattggacatcatgaaaactaacacattcctggtatggtagcgcgtcattcagcttgacatagtctaggtcgtctcgcatttgatatttgtacatatatggtatacattggcagaacaactgtggttcagttccattaacgtacattcttgcgtgcaggttatatgacctgattggtaatatttcctttgggttttgag

SEQ ID NO: 486413 - DNA, 151 bp, Homo sapiens
  misc_feature (10)..(10): n is a, c, g, or t
  misc_feature (18)..(18): n is a, c, g, or t
  misc_feature (60)..(60): n is a, c, g, or t
  misc_feature (131)..(131): n is a, c, g, or t
agcccaaggntccaggtntaggtggagcttgtgctggaatcccaggagttggaccctttnggggaccgcaacctggagtcccactggggtatcccatcaaggcccccaagctgcctggtggctatggactnccctacaccacagggaaact

SEQ ID NO: 486414 - DNA, 422 bp, Homo sapiens
  misc_feature (18)..(18): n is a, c, g, or t
  misc_feature (22)..(22): n is a, c, g, or t
  misc_feature (56)..(56): n is a, c, g, or t
  misc_feature (59)..(59): n is a, c, g, or t
  misc_feature (105)..(105): n is a, c, g, or t
  misc_feature (107)..(107): n is a, c, g, or t
  misc_feature (110)..(110): n is a, c, g, or t
  misc_feature (141)..(141): n is a, c, g, or t
  misc_feature (198)..(198): n is a, c, g, or t
  misc_feature (229)..(229): n is a, c, g, or t
agggaaaaataaatttcntaanaaaaggccttaaaatgttaaacaggccccaggcnagngatgatgcaaatcacctaaagcttttgcatatgataagttgcaggnanaancctggtttgctgcaagactcgacccctcccnctctatgcataacttaaggtataaaaactactttgaaaaataaagtgcgggccttgntcaccgaaacttggtctcaccatgtcgttcnttctcttaccttctggctgaattattcagcctcttttctccactgaatttcctcactgagctatcctcattctattactctttatatccttaattaacatttaattaagcagtggtttcctgatcttcgcctacgccgtctctccttcgaataccctggatcagccggggctggtccccggcaccctaccatg

SEQ ID NO: 486415 - DNA, 404 bp, Homo sapiens
  misc_feature (24)..(24): n is a, c, g, or t
  misc_feature (38)..(38): n is a, c, g, or t
  misc_feature (61)..(61): n is a, c, g, or t
  misc_feature (337)..(337): n is a, c, g, or t
aattaataagttccaaataacatnagtttaccaaaagntaaatccaaaaagccatgaaagnactattgatgtggttttggatctgtgtccttcaccgagtctcatgttgaaatgtaagccccctggtgggaggcgatgggattatggggcagagtcctcacaaacggtttagcaccacccgctcagtgctgttctcctgatattgagtcctcatcacatctggttgcttcaaagtgtgtggtgcctcccctctgtctccctcctgctctggccatataagatgtgcctgcttctccttcgccttctaacatgattgtaagtttcctgaggcctcccnagaagcaaaagctgctgtgcttcctgtaccatctactggaccgtgagccaattaaacctcttttctt

SEQ ID NO: 486416 - DNA, 329 bp, Homo sapiens
gctcgacaaaaaataagttctgttaaccttgggtgaaagtttagagttttataatttattagaatctgtaagtcaccagaacattattgccagacctgacttagtgtgccaatagatcaggttaatgggagctgtcgggtcatcagtgttccatagtgacagttgtagttcatgcagaagggaaagtggacatccttttaatattttgagtgattggcagtgttggggagtatggtagacattttctgtcctgaatactgctttggtaccagtgtatgttagtgcccattggtgtcaccaagcagggctatatgtaagcttttattctt

SEQ ID NO: 486417 - DNA, 755 bp, Homo sapiens
tgggttgaccacagggtacttatatggatggtacatgacaaggtgcggttcccctaggcccctcccctcttacaaggggtctactgtggcaaccgtggtcaggaggggcagaattcaggtgttgggtgggggactgagctgctggcacgggattccccagcaaggtgagggttctctcctcttcctctgggtgcctcttgcgtggggcctggtggctccagggggtctctatacctccttgtgtggagcgccatgtgttggcgcccattgaggttcacaccaaccccctgtgttgtgcctgttacgcacaaaaattcggtgtgatcaatacacagggaacatgtgacgctttgaccacaacgctggggttcgtgtagaaggggggcccacagtgtcccacaagtcccccactagagagcttccaaacaagagtgttcagcacgcgaaactctgggcgtcatggattccggcgtgttgttgaaagtctccagagaggcaagacaaccccaccctgtgggtgtgcctcacagtgtgtaatagaccccaaagagaaatgtgccccctcattgatagagggggcgccgcccctccacgacaaacgacctcgtgtccatttacaacccacaacgacttttttgtgagtaaactagctcaacctacaattactttggaggccaagaacggaataatccaacataagaaaggggcgacaaggaggcaaataaatatagtatacgtgagaaaacaaggccccc

SEQ ID NO: 486418 - DNA, 120 bp, Homo sapiens
atcaatgacaaggcaccgctgagctactcccctcccctctcccaatggcccctactgtggtgcttatctgctaagccggggtaggcccaaactacaaactgaaagcatgcaaatgccctc

SEQ ID NO: 486419 - DNA, 941 bp, Homo sapiens
  misc_feature (21)..(21): n is a, c, g, or t
  misc_feature (472)..(472): n is a, c, g, or t
cgcgatggcgctttctcttcnctccgtcgtgccacctctgtatctgtctttacactgcagctctcgggaggcttctttctctcttgtatacgtccctggccggtcgtccacacaacccccttgggggcacatctattcccccggggcccccttctttatgccccaggtctctccggttcttctggaacggttgacgccaaatatttctgttaggcgggttcctactccctgtgtgtaaatgcgccccccgcccttctggatactcccctggtgcccgaacccatgcaaatccgttcttgcgcctctccacatccctccttcctaagaggagcccccccttcgtgatgattgtaattgcccccccccccaaagttccccctcgtgaaaatttgccccaaacgcgtacaatctctttatctttcctcccataggcaatcctccccgaacaatacttccaccgtcgtacatggtntcgacgaccctctcctcgcttctttgcacacgcagtgaggccccccctccatggggggataccaaaaatctccaaggagccaatgttattaacaatatgagagcaacccggtctagcgcggaacaccaagtgtagcaatttcttcttgtccttatgggtcgtcactacttcgaggtggatttgaggacataccccggaagctcacctattaaataggccacagttgtcccctggtaatagtgctcgcacatacacaccacttctgggatagggcggtcattgcccccatgctgttgaaatgtgcaggataacgcccccctgcgcacccaataagtctacagatatcaggaaattcatatgggcctattttccccccacagggcgagtccttctcagatggccaaacatttcttttccaaaaaaatttttgttcaaaaaaacaatcttaaaaaaaaggcgcaacataaca

SEQ ID NO: 486420 - DNA, 457 bp, Homo sapiens
aaaaaaaaaaaaaacttttttaaaacaaccccccagaaaaaaaggggggccccaaagcccaaaaaaagtttttttccccctcaaaaaaaaaaaaaaaaaaggggcccccgggggggtaaaacccccgggggtaaaaaaaaaaagggggctcaaaaattaaaaatgggggggaaaaaaaaaaaaaaaaaaattttttttttaaaaaattccccccggaaaaaaaaccccccggggaaaaaaaaaaaaaaaacggggggggggaaaaaaaaaaattttttgggccccaaagggggggggggggaaaaatttcccggaaaattttttttttggccccgggggggatttaaaggggaaaaaaaaagggggtttttttaaaaacccccaaaaagggggcccttttaaaaaaaaaatttttttttttttctcccgggggggggggaaaaacccttgggggggg

SEQ ID NO: 486421 - DNA, 459 bp, Homo sapiens
  misc_feature (113)..(113): n is a, c, g, or t
cggctcgatggggtctttcccccacccttccagcctccccgtccgggagggaggttgaggggtcagccccccgccctgcctttcttcctgtccgggtgggggttttgtttttntttttcttttttttttcttctttttttctcttttttttcttttttttttctctcttttttttttttttttttttcttttttttttttttttttttttctttttttttttctctctttttttttctttttttctcttttcttctttttttccttttctcttttttttttttttttctttttttttttctttccttttttttttcctttctttttttttttttttttcttttttttctttttttttttgtttcttttttttttttttttttctctttcttttttcttttcttctttttctttctttctctttttcttttttttttctttttttcttttttttttcttt

SEQ ID NO: 486422 - DNA, 90 bp, Homo sapiens
actgacgacactgccgtatattactgtgtgagagaaggggagggcttgaccacggtgactaccaggggcattgaccactggggccaggga

SEQ ID NO: 486423 - DNA, 233 bp, Homo sapiens
cccctccatacatgtgtgatatgctacagaagcacagaaaactaacacacaagtcacatggctcatacatctaaaccatgatctcaaattcaagtttggttgctaaaacggtggcacttgtgtgtgtgtgtgtgttttttttttttttttttttgaaaacgggttcccgcccggcccccaagggggaaccaaaaggggaaaatctagaccaccagaaacccataagatacgat

SEQ ID NO: 486424 - DNA, 393 bp, Homo sapiens
taagttggttctagcgcagtttttttttttcttgtctataaagcatttacccccccggccccaactccctccttttaaagaaaaaaattgaaatgtaaggctgtgtaagatttgtttttaaactggccagggtctttttttgtatagttaacccccccccgaatgtgtctttaaaaagccccgtcctggtggtattttcaatagcccctacccctgcctggtccagtatgggggttgtaaattggcatggaaattttaaaccaggttcttgttggggcccaccccaaattagttaaaaatggggatgggagttttttcatcttcagttgtctctgaaccagcttaaacaaaaaaattgttgttttgttaactgaaaccccctctgtaattcca

SEQ ID NO: 486425 - DNA, 136 bp, Homo sapiens
atgtatccgcgtattacaccttatcacgggatacactcaacgtacattcttggctgacacaccagcactagtgcaacgtattcaaagttcttagtttggaaagccctgcggggactgcgcagccagagcccccacc

SEQ ID NO: 486426 - DNA, 754 bp, Homo sapiens
gcggaatcgactgcatcgtgtttcgggggctgcccggcaggcccggcaggacgcctcgtgaatgccggtccactcctcagccccgcagtgcggcggtggcctggcagcgcggtgcgggctccgagaagaaagagtgtggcccggggcgggcggagtgggaggtgtcgatggcctgtgtgccctggaatgttggtctggggcctgcttgctgtgactgtgaatggggctgcctcgtgcttctgtcctgctctggctggtgtgcccatgccatgtgccccgctgggacctcaggaccccctgtgtggatgctgctgtgctcctgccctttgtggtgccctccctgccgtgtgccgggagacccaatgcccccaactgccagtgccctgcccttggaagctgctctgctggcccgtggcggcctgtgacgggggcgagtttgttgagtgaaacgcggcacgtggtagccggctgatgggtcgggccgtgttcgggcctggtgtcggccgggctgctggagtttcttttgttggggatgccgcggtggacaggtcgcgccgaatccccccttcggaagtcaattaacttcaaacgtgtactccgcagaacgtttccacgtgactcccgtgtgcaattatcggcgctaggccggtggggataacggccactatggaccgaagcacaggtggacgacgctcagttttgatgggttaacccaaaggggctggattacggggaaaggttacaggttttgtgg

SEQ ID NO: 486427 - DNA, 122 bp, Homo sapiens
gttgcatgagaaactctcatgcaactgtcactgatctctacagctagcagtggtcccatgccccagcacgctggacaatccaggatgtctccaggcattccaaatgtcccagtggcagatca

SEQ ID NO: 486428 - DNA, 143 bp, Homo sapiens
  misc_feature (37)..(37): n is a, c, g, or t
  misc_feature (57)..(57): n is a, c, g, or t
  misc_feature (134)..(134): n is a, c, g, or t
ggaatatatctacttttctcaaagtcaacttgttganatgttaattaatcccatctnaaaaaaataccttcacagtacccatctatacgtgatgttttggcccaaacttgcttgggtgtcatattcctagccanagttgacac

SEQ ID NO: 486429 - DNA, 268 bp, Homo sapiens
  misc_feature (2)..(2): n is a, c, g, or t
  misc_feature (6)..(6): n is a, c, g, or t
cngtgnaaattagccgacgcctatctaagcatttctcaccagatcaacgctcgcttccaaaggctaacttcagaatgtgacccgaaaacacatacggactatggactaaaagaccggatgacacacgttcacagtacacgtgtaaagcttcatgtcaccgtatgttaaaaacacgaacctaaaagcagctcatagcaactcggacggtccgcccaaactcctcaggctgcaaagtgcttctcgaccgcgacccccgtcggataatttt

SEQ ID NO: 486430 - DNA, 178 bp, Homo sapiens
atttatcagctgggacttgatagatataatctaaactctctggctgggtgcggtggctcacacctgtaatcctggcacttagagaggctgaggtgggcagatcacacaaggccaggagttcgagaccagcctgaccaacatggaagaaaccctctctctactaaaaacaaaaaaatag

SEQ ID NO: 486431 - DNA, 320 bp, Homo sapiens
  misc_feature (25)..(25): n is a, c, g, or t
  misc_feature (173)..(173): n is a, c, g, or t
tggcctaaacgttagatttgacctncagaattcctagagtttgaaaataaataggcccatataatatgcactctttttgtgtcctgactttttttttgccttaacatgatgtcttttgaaacccatcccatgttgagattcatcccatgttatcatgtgtatcaataataagntcctttttattgctgaatagtattctagtatatagatataccacaatttgtttagctgttcacctattgatggacatttaggttgtttcaagttttgatctattatgaataaagctgtctatatatataaatcacaaaaaaaaaaaa

SEQ ID NO: 486432 - DNA, 366 bp, Homo sapiens
ccagaggcacgaaggagggagttgacaagaagccaagataggcggggcacagtggctcacgcctgtaattccagcacttggggaggctgaggtgggtggaccacctgaggtcaggagttcaagaccagcctggccaacatggcaaaaccccgtctctactaaaaaatacaaaaattagctggggatggtcatgtgctcctgtaatcccagttactcaggaggctgaagcagggagaatggcttgaacccaggagacggaggttgcagtgagccgagactgggccactgcacaccagcctgggcaacagagcaagactccatctcaagaaaaaaagaagccaagagtagagatccttgcactgctgg

SEQ ID NO: 486433 - DNA, 155 bp, Homo sapiens
tcgctttcgtcgtaatgctttccccaaagtgtatcactattataatatctagtttgtatgcttataataagagcgaccgtttctgtcatcaacatctgcgggtcgttttcttagtcctcttccttgtcgacagctaggcactcaatagtaaccca

SEQ ID NO: 486434 - DNA, 203 bp, Homo sapiens
tagttcttcagaatcaccaccaagccgggtaaccatttgtgtccattgtagaccctcgcccgcatgtcgtacatgattcatgattttgtccattttcaaaacacgctctacattagccccggaattgggggttgtgtagaacgagacattgttcactttattttcaataatttgatgcataacacttgtaagttctctaagtc

SEQ ID NO: 486435 - DNA, 347 bp, Homo sapiens
cagcatttttgatagtttatattggctgagtctagtttgtttacatatgaaaataataggccgggtgtggtggctcatgcctgtaatcccagcactctgggaggccagggtgggtggattacctgaggtcaggagttcaagaccagcctgaccaacatggtgaaacatcgtctcaactaaaaatgcaaaaataagccaggcgtggtggcgcatgcctgtaatcccagctactggggaggctgagtcaggagaattgcctgaatcctggaggtggaggttgcattgagccaaagtcgcaccgttgtactccagcctgggcaacaagagcgaaaactctgtctcgagga

SEQ ID NO: 486436 - DNA, 490 bp, Homo sapiens
  misc_feature (119)..(119): n is a, c, g, or t
tccggcgtccgttgctatcattatggttgaataacaatttattatgctttgcagcaaacatgattatcaggggaatccgcccccaatatttcaacgatgttctttctattttccataangtgtggccttctaacgaaataaagagaaagaatacaaagggaggaattttacagctgggctgccgggggtgacatcacatatcggtaggaccatgatgtctgcctgagtctcagaccagcaagtttttattaagggtttcaaaaggggatggggtgtaaagcagggagtaggtacaaagatcacatgcttcaaagggcaaaaagcagaacaaagatcacatgcttctgagggaacaggacgaaaggcaaaacagaactactgataagagtctatgttcagctgtgcacgtattatcttgataaacatcttaaacaacagaaaacaggttcgagagcagagaacttgtctgaccacaaatttaccagggtgg

SEQ ID NO: 486437 - DNA, 546 bp, Homo sapiens
gggtttcaccatgtggccgggctggtctgggactcctggcctcaggcagtccacttgcctcagcctcccaaagtgctgggattataggcctaagccaccgtaaccagccagaattttttttttttttaaagcaccagaacatgggggaaagatggtgtctttaacaaagtgggtgctgagaaaacgtgtataaccacatacaaaagaagtgaagttgggacccttacccttacaccaataatacaaaaacacaaaacttattaaagattaaacataaggaccgtgaaaaaaaacaaaaaaaaaaaccttcgacaacttgagttctctcctccctcttcctcctcaagaattgccggaaggggaagagaggcgccagggggaaagaaggggggctcccgggccccaagcttggctcgtggaagaaacccgagggaggcttaagaaaggggggggattccccgtgcttggaagaacaagggcctaagaaattggggccatgggcacaggaacatccagcccaaaagaagaacccacccgcttggtgaa

SEQ ID NO: 486438 - DNA, 162 bp, Homo sapiens
agcaagaatggcatatcagccaaaatgatacctggatggcttatctgaggccaaatccgccactccagaaatccaggagattgttgattaggttaaaccatcagtcttgcaagaataatacacaatatgagcacttacggacaaattggaacgctgtgcatg

SEQ ID NO: 486439 - DNA, 150 bp, Homo sapiens
agtgaacactcacgtttattcctgcctgctccggccaggactgaaccccttttccacacctgaacagttgggtcaagggccaccagaagcatttttttattattattattttttaacctggacatgcattaaagggtctattagctttca

SEQ ID NO: 486440 - DNA, 150 bp, Homo sapiens
ctttgccggtcttcgactttgaacccaagcccacatcattgctcccctcgtggatactgaccccactataaacttcactggggctacaaccttcctaccctttgtgcctcatgaccaccccctcccttgccccgccatgccctatagtga

SEQ ID NO: 486441 - DNA, 490 bp, Homo sapiens
cgatcgttgacgaacatgacacgatagaccagtgatgactgtccacgccataaagattactgaatgctgtacctagatcgtctagattcaattctgtaagcaatgggacttttacagttttgattcgtgttttgggcatagttgttataggagataatattatagatgtataaagagatggaagaccagtaaaactgaaatatctgttgtaggaatagagaacataatgagtggaaaaggagatgcactggatggaagaagagatcataggagggtggcagtatataaagaggtagtagaatattgcggaggccttattgaatcgttgctgtgctttatgggatcgcagcgcatatcctcttctcaataagtatatcgtaactcccaaaacatagtttgcaatgtattccgaccagttcaactggcgcacgtccagtgctgagcagcgtacaaggggggactccgtctaggagtcgagctgcaaggcatg

SEQ ID NO: 486442 - DNA, 698 bp, Homo sapiens
  misc_feature (2)..(2): n is a, c, g, or t
  misc_feature (72)..(72): n is a, c, g, or t
  misc_feature (113)..(113): n is a, c, g, or t
  misc_feature (162)..(162): n is a, c, g, or t
  misc_feature (173)..(173): n is a, c, g, or t
  misc_feature (189)..(189): n is a, c, g, or t
  misc_feature (192)..(192): n is a, c, g, or t
  misc_feature (218)..(218): n is a, c, g, or t
  misc_feature (220)..(220): n is a, c, g, or t
  misc_feature (242)..(242): n is a, c, g, or t
  misc_feature (247)..(247): n is a, c, g, or t
  misc_feature (254)..(254): n is a, c, g, or t
  misc_feature (273)..(273): n is a, c, g, or t
  misc_feature (279)..(279): n is a, c, g, or t
  misc_feature (296)..(296): n is a, c, g, or t
  misc_feature (308)..(308): n is a, c, g, or t
  misc_feature (314)..(314): n is a, c, g, or t
  misc_feature (418)..(418): n is a, c, g, or t
  misc_feature (635)..(635): n is a, c, g, or t
  misc_feature (691)..(691): n is a, c, g, or t
anggagctgactggggaagacagtggtgtgctgtcaggtccccctgctccccttagagtggggctacctctnggggtagctgaggatgggtgggggtgggctgagcaggtctnacttatcgaagtgatccagtgggtagtgctccccgtaggtttgcaggtngcgggccaganattcctgctgcttgcngantgggcgggcatcttctgatacacgtntnagaagagtaggttggggttggnttttntttttcnctcggtctgctcaaaggtntccatnaccttcctgcgggactncttcctccaggncttctnctgctcctcatcccaccagccttggctcagcagatagtgccgcagccgggagatggggtggtcctgtttattccagtaatttatctcatccaccgagcggtacntgaaactgtcgtcactggtgctgtggtgcccgatcctgtaggtcatggcctcgatgaggaagggctggttctctgccacagcccgccgtcgggcctcctttgtggcgttgtatacggcaaacacatcattaccatccacgcggattgacatgatgccatacccggggcctcgtgctgcaatgccatcgccgcgatactgctcacaggtgggcgtggngatggcgtcctcttgtttccggcagaagaagatgatggggcactcaagtgtggcancgagttg

SEQ ID NO: 486443 - DNA, 1011 bp, Homo sapiens
  misc_feature (940)..(940): n is a, c, g, or t
aataaggctaggtagaggctgggtgtgaatcggccgaggcgtcgtccgcaaagcctgagtcctgtcctttctctctccccggacagcatgagcttcaccactcgctccaccttctccaccaactaccggtccctgggctctgtccaggcgcccagctacggcgcccggccggtcagcagcgcggccagcgtctatgcaggcgctgggggctctggttcccggatctccgtgtcccgctccaccagcttcaggggcggcatggggtccgggggcctggccaccgggatagccgggggtctggcaggaatgggaggcatccagaacgagaaggagaccatgcaaagcctgaacgaccgcctggcctcttacctggacagagtgaggagcctggagaccgagaaccggaggctggagagcaaaatccgggagcacttggagaagaagggaccccaggtcagagactggagccattacttcaagatcatcgaggacctgagggctcagatcttcgcaaatactgtggacaatgcccgcatcgttctgcagattgacaatgcccgtcttgctgctgatgactttagagtcaagtatgagacagagctggccatgcgccagtctgtggagaacgacatccatgggctccgcaaggtcattgatgacaccaatatcacacgactgcagctggagacagagatcgaggctctcaaggaggagctgctcttcatgaagaagaaccacgaagaggaagtaaaaggcctacaagcccagattgccagctctgggttgaccgtggaggtagatgcccccaatctcaggacctcgccaagatcatggcagacatccgggcccatatgacgagctggtcggaagaaccgagaggagctagaccagtactggtctcgcgattgggggagccccggggtccccacggtgtggggtnggctggaaaacccaagggagacccggggaaccggccaaataggcgggaacggggggccgccccaagggcag

SEQ ID NO: 486444 - DNA, 151 bp, Homo sapiens
aaagacattgctagctgcacagaacaactcctgtatctttacctaatatgttaccccaaaataaacatatactcaaagatatacgaaaagtaaaaccctaagactactagacacagagaaagcagagaaagattacaacttcatcacattc

SEQ ID NO: 486445 - DNA, 1031 bp, Homo sapiens
  misc_feature (866)..(866): n is a, c, g, or t
  misc_feature (886)..(886): n is a, c, g, or t
aatttggctaggtacgaggctgggtgttaatcggccgaagctgagtcctgtcctttctctctccccggacagcatgagcttcaccactcgctccaccttctccaccaactaccggtccctgggctctgtccaggcgcccagctacggcgcccggccggtcagcagcgcggccagcgtctatgcaggcgctgggggctctggttcccggatctccgtgtcccgctccaccagcttcaggggcggcatggggtccgggggcctggccaccgggatagccgggggtctggcaggaatgggaggcatccagaacgagaaggagaccatgcaaagcctgaacgaccgcctggcctcttacctggacagagtgaggagcctggagaccgagaaccggaggctggagagcaaaatccgggagcacttggagaagaagggaccccaggtcagagactggagccattacttcaagatcatcgaggacctgagggctcagatcttcgcaaatactgtggacaatgcccgcatcgttctgcagattgacaatgcccgtcttgctgctgatgactttagagtcaagtatgagacagagctggccatgcgccagtctgtggagaacgacatccatgggctccgcaaggtcattgatgacaccaatatcacacgactgcagctggagacagagatcgaggctctcaaggaggagctgctcttcatgaagaagaaccacgaagaggaagtaaaaggcctacaagcccagattgccagctctgggttgaccgtggaggtagatgcccccaatctcaggacctcgccaagatcatggcagacatccgggccaatatgacgagtggtcggaaaacgagagggtnacaagtggtctccgatgggngcccacggtccccccactcgggagggtcgggaaagcacaggagaacacatggaacggaccaaataggctgaaccagggggggccaagaaagagacaacgaccgagaccaaacagaaaaacaccaggaagacacacagaagtagac

SEQ ID NO: 486446 - DNA, 708 bp, Homo sapiens
aatttggctaggtacgaggctgggtgttaatcggccgaaggccagctctgggttgaccgtggaggtagatgcccccaaatctcaggacctcgccaagatcatggcagacatccgggcccaatatgacgagctggctcggaagaaccgagaggagctagacaagtactggtctcagcagattgaggagagcaccacagtggtcaccacacagtctgctgaggttggagctgctgagacgacgctcacagagctgagacgtacagtccagtccttggagatcgacctggactccatgagaaatctgaaggccagcttggagaacagcctgagggaggtggaggcccgctacgccctacagatggagcagctcaacgggatcctgctgcaccttgagtcagagctggcacagacccgggcagagggacagcgccaggcccaggagtatgaggccctgctgaacatcaaggtcaagctggaggctgagatcgccacctaccgccgcctgctggaagatggcgaggactttaatcttggtgatgccttggacagcagcaactccatgcaaaccatccaaaagaccaccacccgccggatagtggatggcaaagtggtgtctgagaccaatgacaccaaagttctgaggcattaagccagcagaagcagggtaccctttggggagcaggaggccaataaaaagttcagagttca

SEQ ID NO: 486447 - DNA, 101 bp, Homo sapiens
tgcttgtagtagtgtgatgtctggggtgtgcatatgcacatggtgtgtgtgcatagtgtgtgtgccgtgtgtgtggcttctgcatgtggggtgtgcatgtg

SEQ ID NO: 486448 - DNA, 267 bp, Homo sapiens
  misc_feature (71)..(71): n is a, c, g, or t
gaggatcctcggcctttgataggtagtgaagataaacacttccaaaaggaagtggtcacactatcatatgntcagagagagcactggatatggcatgtggaagtcattggtggaaatggtgcaatagttttagagtattggaggaaaagattttgcctgagttcctttatctccttgtaattcatgtcagtcctctatgaacattaatatattcacaggttacccctattcaaaagaacgaggggtacccgaggctcgaaattcgta

SEQ ID NO: 486449 - DNA, 109 bp, Homo sapiens
tgactgggcgctctctgacaactctgcttctcaattagctgaacaatttgcttaatgtcttggtctttttcgggtgatctgcatcccagcaagtcttcattatgtcata

SEQ ID NO: 486450 - DNA, 917 bp, Homo sapiens
  misc_feature (800)..(800): n is a, c, g, or t
  misc_feature (826)..(826): n is a, c, g, or t
  misc_feature (837)..(837): n is a, c, g, or t
aataaggctaggtagaggctgggtgtgaatcggccgaggcgtcgtccgcaaagcctgagtcctgtcctttctctctccccggacagcatgagcttcaccactcgctccaccttctccaccaactaccggtccctgggctctgtccaggcgcccagctacggcgcccggccggtcagcagcgcggccagcgtctatgcaggcgctgggggctctggttcccggatctccgtgtcccgctccaccagcttcaggggcggcatggggtccgggggcctggccaccgggatagccgggggtctggcaggaatgggaggcatccagaacgagaaggagaccatgcaaagcctgaacgaccgcctggcctcttacctggacagagtgaggagcctggagaccgagaaccggaggctggagagcaaaatccgggagcacttggagaagaagggaccccaggtcagagactggagccattacttcaagatcatcgaggacctgagggctcagatcttcgcaaatactgtggacaatgcccgcatcgttctgcagattgacaatgcccgtcttgctgctgatgactttagagtcaagtatgagacagagctggccatgcgccagtctgtggagaacgacatccatgggctccgcaaggtcattgatgacaccaatatcacacgactgcagctggagacagagatcgaggctctcaaggaggagctgctcttcatgaagaagaaccacgaagaggagtaaaggctacaagcccaaatgcagtctggttgacgggggtaatgcccaattcngactgcagactgcggatccggcatanaagggtgaaancgagaggtagaagtatggttaggtggggagcccatgtccacggtgtgggtggggtggaaggcaaggtaagagccttggac

SEQ ID NO: 486451 - DNA, 1439 bp, Homo sapiens
aataaggctaggtagaggctgggtgtgaatcggccgaggcgtcgtccgcaaagcctgagtcctgtcctttctctctccccggacagcatgagcttcaccactcgctccaccttctccaccaactaccggtccctgggctctgtccaggcgcccagctacggcgcccggccggtcagcagcgcggccagcgtctatgcaggcgctgggggctctggttcccggatctccgtgtcccgctccaccagcttcaggggcggcatggggtccgggggcctggccaccgggatagccgggggtctggcaggaatgggaggcatccagaacgagaaggagaccatgcaaagcctgaacgaccgcctggcctcttacctggacagagtgaggagcctggagaccgagaaccggaggctggagagcaaaatccgggagcacttggagaagaagggaccccaggtcagagactggagccattacttcaagatcatcgaggacctgagggctcagatcttcgcaaatactgtggacaatgcccgcatcgttctgcagattgacaatgcccgtcttgctgctgatgactttagagtcaagtatgagacagagctggccatgcgccagtctgtggagaacgacatccatgggctccgcaaggtcattgatgacaccaatatcacacgactgcagctggagacagagatcgaggctctcaaggaggagctgctcttcatgaagaagaaccacgaagaggaagtaaaaggcctacaagcccagattgccagctctgggttgaccgtggaggtagatgcccccaaatctcaggacctcgccaagatcatggcagacatccgggcccaatatgacgagctggctcggaagaaccgagaggagctagacaagtactggtctcagcagattgaggagagcaccacagtggtcaccacacagtctgctgaggttggagctgctgagacgacgctcacagagctgagacgtacagtccagtccttggagatcgacctggactccatgagaaatctgaaggccagcttggagaacagcctgagggaggtggaggcccgctacgccctacagatggagcagctcaacgggatcctgctgcaccttgagtcagagctggcacagacccgggcagagggacagcgccaggcccaggagtatgaggccctgctgaacatcaaggtcaagctggaggctgagatcgccacctaccgccgcctgctggaagatggcgaggactttaatcttggtgatgccttggacagcagcaactccatgcaaaccatccaaaagaccaccacccgccggatagtggatggcaaagtggtgtctgagaccaatgacaccaaagttctgaggcattaagccagcagaagcagggtaccctttggggagcaggaggccaataaaaagttcagagttca

SEQ ID NO: 486452 - DNA, 143 bp, Homo sapiens
gctccttgtggggtgacgctctctctgtggggtgaccgctctctctgtggggtgacgctctctctgtggggtgacgctctctctgtggggtgacgctctctctgtggggggaagggggaagacacagacaggagagagagcgt

SEQ ID NO: 486453 - DNA, 990 bp, Homo sapiens
ctgtgtaatgggatggaagctccgcacgcctggacggatggcccaagcatgtgagtgccatttctcgttttgaggattctgtggactagtgtcacgtacctacagaacctcggttgcaatgttgagaaagaactatgcttcctcgcctctcataaggtagttgtctggttcacatgggcgaggtatagttattcgatgcactcgatgtgtgcctcagttggcgcatagctgcttgttcgttcaacccagggatgtggtggtatatcttatgggtccagtcagttgtcaaatgggagagttcaaatcatgtagaacttcgatcgatgtaagcttgtgaagtgatgttgctggccttgggtactatgtgttggtgactaatgtctatgtgttggtgttcttgatcaagaagatttgttcgtctgttgagtgacgttaggttgaatgacatttcaacagattggttgccaccttgttgagaggttgggccgctaggtttcaagtgggataagcgtagattaatgctagtattctgtctagggtcaatataagcagccgggataattggctcgtgttttggcttagtcgaacacattggtcactactttgtctgactttatttgatagggcgaggatgggaaagagttagagtgggccgttggtggtaaggtcgtggtcatagggcactgaagggttcttgtacattatggtgaccgcaggcagcgcaactcgttcagggtaacgcatgcttcgctgggaccctactcgtggaacgaacaccttgggttgcttaggcggtcccgatttgcagacagccgtgggcagtctggccgcaactgggccgaattgctgactgcacaggcccggcccctgtccacgtaagtccgcaggtatgattctcctcattttcgccctctccaatagagcaccggtaccagttacatgagcgctgacacagcactcgcacccacctgagcggttgcacccattcgt

SEQ ID NO: 486454 - DNA, 1425 bp, Homo sapiens
aatttggctaggtacgaggctgggtgttaatcggccgaagctgagtcctgtcctttctctctccccggacagcatgagcttcaccactcgctccaccttctccaccaactaccggtccctgggctctgtccaggcgcccagctacggcgcccggccggtcagcagcgcggccagcgtctatgcaggcgctgggggctctggttcccggatctccgtgtcccgctccaccagcttcaggggcggcatggggtccgggggcctggccaccgggatagccgggggtctggcaggaatgggaggcatccagaacgagaaggagaccatgcaaagcctgaacgaccgcctggcctcttacctggacagagtgaggagcctggagaccgagaaccggaggctggagagcaaaatccgggagcacttggagaagaagggaccccaggtcagagactggagccattacttcaagatcatcgaggacctgagggctcagatcttcgcaaatactgtggacaatgcccgcatcgttctgcagattgacaatgcccgtcttgctgctgatgactttagagtcaagtatgagacagagctggccatgcgccagtctgtggagaacgacatccatgggctccgcaaggtcattgatgacaccaatatcacacgactgcagctggagacagagatcgaggctctcaaggaggagctgctcttcatgaagaagaaccacgaagaggaagtaaaaggcctacaagcccagattgccagctctgggttgaccgtggaggtagatgcccccaaatctcaggacctcgccaagatcatggcagacatccgggcccaatatgacgagctggctcggaagaaccgagaggagctagacaagtactggtctcagcagattgaggagagcaccacagtggtcaccacacagtctgctgaggttggagctgctgagacgacgctcacagagctgagacgtacagtccagtccttggagatcgacctggactccatgagaaatctgaaggccagcttggagaacagcctgagggaggtggaggcccgctacgccctacagatggagcagctcaacgggatcctgctgcaccttgagtcagagctggcacagacccgggcagagggacagcgccaggcccaggagtatgaggccctgctgaacatcaaggtcaagctggaggctgagatcgccacctaccgccgcctgctggaagatggcgaggactttaatcttggtgatgccttggacagcagcaactccatgcaaaccatccaaaagaccaccacccgccggatagtggatggcaaagtggtgtctgagaccaatgacaccaaagttctgaggcattaagccagcagaagcagggtaccctttggggagcaggaggccaataaaaagttcagagttca

SEQ ID NO: 486455 - DNA, 126 bp, Homo sapiens
  misc_feature (95)..(95): n is a, c, g, or t
cggacgagaaaagcatacgaggagaggatatgagtgacatctacggtcaaaggctggattcctggcaatgaagaaaacaaacagaaaacagatgntcattacagatctttggatggtccgagcgga

SEQ ID NO: 486456 - DNA, 1434 bp, Homo sapiens
cgcgtacaactaggctagtacgaggctggtgttaatcggccgaggggacctgagtcctgtcctttctctctccccggacagcatgagcttcaccactcgctccaccttctccaccaactaccggtccctgggctctgtccaggcgcccagctacggcgcccggccggtcagcagcgcggccagcgtctatgcaggcgctgggggctctggttcccggatctccgtgtcccgctccaccagcttcaggggcggcatggggtccgggggcctggccaccgggatagccgggggtctggcaggaatgggaggcatccagaacgagaaggagaccatgcaaagcctgaacgaccgcctggcctcttacctggacagagtgaggagcctggagaccgagaaccggaggctggagagcaaaatccgggagcacttggagaagaagggaccccaggtcagagactggagccattacttcaagatcatcgaggacctgagggctcagatcttcgcaaatactgtggacaatgcccgcatcgttctgcagattgacaatgcccgtcttgctgctgatgactttagagtcaagtatgagacagagctggccatgcgccagtctgtggagaacgacatccatgggctccgcaaggtcattgatgacaccaatatcacacgactgcagctggagacagagatcgaggctctcaaggaggagctgctcttcatgaagaagaaccacgaagaggaagtaaaaggcctacaagcccagattgccagctctgggttgaccgtggaggtagatgcccccaaatctcaggacctcgccaagatcatggcagacatccgggcccaatatgacgagctggctcggaagaaccgagaggagctagacaagtactggtctcagcagattgaggagagcaccacagtggtcaccacacagtctgctgaggttggagctgctgagacgacgctcacagagctgagacgtacagtccagtccttggagatcgacctggactccatgagaaatctgaaggccagcttggagaacagcctgagggaggtggaggcccgctacgccctacagatggagcagctcaacgggatcctgctgcaccttgagtcagagctggcacagacccgggcagagggacagcgccaggcccaggagtatgaggccctgctgaacatcaaggtcaagctggaggctgagatcgccacctaccgccgcctgctggaagatggcgaggactttaatcttggtgatgccttggacagcagcaactccatgcaaaccatccaaaagaccaccacccgccggatagtggatggcaaagtggtgtctgagaccaatgacaccaaagttctgaggcattaagccagcagaagcagggtaccctttggggagcaggaggccaataaaaagttcagagttca

SEQ ID NO: 486457 - DNA, 403 bp, Homo sapiens
  misc_feature (156)..(156): n is a, c, g, or t
  misc_feature (165)..(165): n is a, c, g, or t
  misc_feature (173)..(173): n is a, c, g, or t
  misc_feature (180)..(180): n is a, c, g, or t
  misc_feature (182)..(182): n is a, c, g, or t
  misc_feature (239)..(239): n is a, c, g, or t
  misc_feature (255)..(255): n is a, c, g, or t
  misc_feature (292)..(292): n is a, c, g, or t
  misc_feature (297)..(297): n is a, c, g, or t
  misc_feature (305)..(305): n is a, c, g, or t
  misc_feature (329)..(329): n is a, c, g, or t
  misc_feature (332)..(332): n is a, c, g, or t
ggtcagggtcctgctttgtccctggcaggctgtcagtccagctggagggggtcagtaggctccagggagtgggccctcccctccgattttggagtttttgggggttccttcagcctcagcctcaatgggaccttttgccctttaggggaggctatnagtttgggncaggaggncaaattnanagcccaaagggggaaatggaaaaacctgggctgctgaggaaaaccccgggggttggngtgaactgatgatgtntcatcccacgccccctatggccccattacctaacctntccanatttgggntattcaaggttttggaggccagcncanacccagctagttgttgaagccagtttttttttgttttggtcatgagggaattaaacgttttttttggcaga

SEQ ID NO: 486458 - DNA, 1451 bp, Homo sapiens
agcggctgtacggtcggaatctttaggatcgcggctcgcgcaggccgccaccgtcgtccgcaaagcctgagtcctgtcctttctctctccccggacagcatgagcttcaccactcgctccaccttctccaccaactaccggtccctgggctctgtccaggcgcccagctacggcgcccggccggtcagcagcgcggccagcgtctatgcaggcgctgggggctctggttcccggatctccgtgtcccgctccaccagcttcaggggcggcatggggtccgggggcctggccaccgggatagccgggggtctggcaggaatgggaggcatccagaacgagaaggagaccatgcaaagcctgaacgaccgcctggcctcttacctggacagagtgaggagcctggagaccgagaaccggaggctggagagcaaaatccgggagcacttggagaagaagggaccccaggtcagagactggagccattacttcaagatcatcgaggacctgagggctcagatcttcgcaaatactgtggacaatgcccgcatcgttctgcagattgacaatgcccgtcttgctgctgatgactttagagtcaagtatgagacagagctggccatgcgccagtctgtggagaacgacatccatgggctccgcaaggtcattgatgacaccaatatcacacgactgcagctggagacagagatcgaggctctcaaggaggagctgctcttcatgaagaagaaccacgaagaggaagtaaaaggcctacaagcccagattgccagctctgggttgaccgtggaggtagatgcccccaaatctcaggacctcgccaagatcatggcagacatccgggcccaatatgacgagctggctcggaagaaccgagaggagctagacaagtactggtctcagcagattgaggagagcaccacagtggtcaccacacagtctgctgaggttggagctgctgagacgacgctcacagagctgagacgtacagtccagtccttggagatcgacctggactccatgagaaatctgaaggccagcttggagaacagcctgagggaggtggaggcccgctacgccctacagatggagcagctcaacgggatcctgctgcaccttgagtcagagctggcacagacccgggcagagggacagcgccaggcccaggagtatgaggccctgctgaacatcaaggtcaagctggaggctgagatcgccacctaccgccgcctgctggaagatggcgaggactttaatcttggtgatgccttggacagcagcaactccatgcaaaccatccaaaagaccaccacccgccggatagtggatggcaaagtggtgtctgagaccaatgacaccaaagttctgaggcattaagccagcagaagcagggtaccctttggggagcaggaggccaataaaaagttcagagttca

SEQ ID NO: 486459 - DNA, 218 bp, Homo sapiens
acaaataagcgtggatcttgccaattgtaatactgggtatccatgatgattaacaggtgggcaagacaagatcatgccccagcaaagactccgagaagccaccaccacctggatagccccatgagctgaagagctgctccaccaggcgtcgctccatggggctgagcccctcatgcaggtagcccaccccatttagcagcgtttccttgagcgtgctg

SEQ ID NO: 486460 - DNA, 179 bp, Homo sapiens
gcaaacgtagaggaaaactgagctccaggtctcctccatacccattatagccatccccaaatccacgtgcagtgccatatccatcagatcctcctctaaagttacttcctggtcctggtccgaaatgtccacccactttatgaatctgtatgccatatgccggctgactcgtggaattg

SEQ ID NO: 486461 - DNA, 1424 bp, Homo sapiens
tgagccaagcgactatgtctaggtcgggcctgggtggtgctgagtcctgtcctttctctctccccggacagcatgagcttcaccactcgctccaccttctccaccaactaccggtccctgggctctgtccaggcgcccagctacggcgcccggccggtcagcagcgcggccagcgtctatgcaggcgctgggggctctggttcccggatctccgtgtcccgctccaccagcttcaggggcggcatggggtccgggggcctggccaccgggatagccgggggtctggcaggaatgggaggcatccagaacgagaaggagaccatgcaaagcctgaacgaccgcctggcctcttacctggacagagtgaggagcctggagaccgagaaccggaggctggagagcaaaatccgggagcacttggagaagaagggaccccaggtcagagactggagccattacttcaagatcatcgaggacctgagggctcagatcttcgcaaatactgtggacaatgcccgcatcgttctgcagattgacaatgcccgtcttgctgctgatgactttagagtcaagtatgagacagagctggccatgcgccagtctgtggagaacgacatccatgggctccgcaaggtcattgatgacaccaatatcacacgactgcagctggagacagagatcgaggctctcaaggaggagctgctcttcatgaagaagaaccacgaagaggaagtaaaaggcctacaagcccagattgccagctctgggttgaccgtggaggtagatgcccccaaatctcaggacctcgccaagatcatggcagacatccgggcccaatatgacgagctggctcggaagaaccgagaggagctagacaagtactggtctcagcagattgaggagagcaccacagtggtcaccacacagtctgctgaggttggagctgctgagacgacgctcacagagctgagacgtacagtccagtccttggagatcgacctggactccatgagaaatctgaaggccagcttggagaacagcctgagggaggtggaggcccgctacgccctacagatggagcagctcaacgggatcctgctgcaccttgagtcagagctggcacagacccgggcagagggacagcgccaggcccaggagtatgaggccctgctgaacatcaaggtcaagctggaggctgagatcgccacctaccgccgcctgctggaagatggcgaggactttaatcttggtgatgccttggacagcagcaactccatgcaaaccatccaaaagaccaccacccgccggatagtggatggcaaagtggtgtctgagaccaatgacaccaaagttctgaggcattaagccagcagaagcagggtaccctttggggagcaggaggccaataaaaagttcagagttca

SEQ ID NO: 486462 - DNA, 364 bp, Homo sapiens
aggctaaataaaaattataccaagcatatatatcaaggactaacccctataccttctgcatatgaattaactagaaatatctctgcaacgagagccatagctatgaccccctaaaccatatctagctaccttagaacagctaataagagcacacccgtctatgtcgcagaatagtgggaagatttataggtagaggcgaccaacctaccgagcctgttgatagctggtttgtccatgatagaatcttagttcaactttaaatttgcccacagaaccctttaaatccccttgttaatttgactgttcgtccacaagaggaacagctctttggacactaggaaaaaaccttgtagagagagtaaaa

SEQ ID NO: 486463 - DNA, 321 bp, Homo sapiens
  misc_feature (93)..(93): n is a, c, g, or t
  misc_feature (165)..(165): n is a, c, g, or t
cttccattgcgctccggccagggcaacaagagcaaaactccgtctcaaaaagaaagaataaagctaaagataactgataatacagcttatagnatcgtcctctcttagaggacgattgtttgtgtagaatgtggtttgctacactgcctccaaaagctgattttntttttttgagacagggtctcactctgtcacacaggctggagtgcaatggcacaatcacggttcactgcagcacctcctggcctcaagcgatcctcctgcctctatctcttgagtggctgggactgcaggcacgtgccaccatacccggctaattta

SEQ ID NO: 486464 - DNA, 1417 bp, Homo sapiens
accttttgctagtcgaggctgggtgtagcaagctgagtcctgtcctttctctctccccggacagcatgagcttcaccactcgctccaccttctccaccaactaccggtccctgggctctgtccaggcgcccagctacggcgcccggccggtcagcagcgcggccagcgtctatgcaggcgctgggggctctggttcccggatctccgtgtcccgctccaccagcttcaggggcggcatggggtccgggggcctggccaccgggatagccgggggtctggcaggaatgggaggcatccagaacgagaaggagaccatgcaaagcctgaacgaccgcctggcctcttacctggacagagtgaggagcctggagaccgagaaccggaggctggagagcaaaatccgggagcacttggagaagaagggaccccaggtcagagactggagccattacttcaagatcatcgaggacctgagggctcagatcttcgcaaatactgtggacaatgcccgcatcgttctgcagattgacaatgcccgtcttgctgctgatgactttagagtcaagtatgagacagagctggccatgcgccagtctgtggagaacgacatccatgggctccgcaaggtcattgatgacaccaatatcacacgactgcagctggagacagagatcgaggctctcaaggaggagctgctcttcatgaagaagaaccacgaagaggaagtaaaaggcctacaagcccagattgccagctctgggttgaccgtggaggtagatgcccccaaatctcaggacctcgccaagatcatggcagacatccgggcccaatatgacgagctggctcggaagaaccgagaggagctagacaagtactggtctcagcagattgaggagagcaccacagtggtcaccacacagtctgctgaggttggagctgctgagacgacgctcacagagctgagacgtacagtccagtccttggagatcgacctggactccatgagaaatctgaaggccagcttggagaacagcctgagggaggtggaggcccgctacgccctacagatggagcagctcaacgggatcctgctgcaccttgagtcagagctggcacagacccgggcagagggacagcgccaggcccaggagtatgaggccctgctgaacatcaaggtcaagctggaggctgagatcgccacctaccgccgcctgctggaagatggcgaggactttaatcttggtgatgccttggacagcagcaactccatgcaaaccatccaaaagaccaccacccgccggatagtggatggcaaagtggtgtctgagaccaatgacaccaaagttctgaggcattaagccagcagaagcagggtaccctttggggagcaggaggccaataaaaagttcagagttca

SEQ ID NO: 486465 - DNA, 155 bp, Homo sapiens
ggaggcgttcagaggagtccccggcggagaaggtcaaagatgatagtatgtgatgaaagaaaacggttctgggcatatagtgcataagtacatcaaagcatgactataatccttttttttttttttttttttttttttttttttttttttttttt

SEQ ID NO: 486466 - DNA, 295 bp, Homo sapiens
ggacaatgtggggagatggaatatgtagaagatagtattaattggttaagaatatctatatgatttaatattttaaaaatctaagcagcctatccatatgttatgtggtgggaagttggacgttaataatttatttccaatccctagattggactctgtcatgtgggacaaagagtaagagatacataacccactataaaaataatgtcttgatgacaggagactaggtctagatagcagggtcttcagcaatcccaaaaggtgaacacatgtaggtgggtcacagctcagttgg

SEQ ID NO: 486467 - DNA, 606 bp, Homo sapiens
  misc_feature (240)..(240): n is a, c, g, or t
  misc_feature (273)..(273): n is a, c, g, or t
  misc_feature (299)..(299): n is a, c, g, or t
aaagcttatagtgtagtgtattcaagagaggatttctacaggaaagcagtccctgcccaagcagcacctacaataaacatgtttatgagcaaacagttcagaaaaacatattgtgagtcttagaaacagcatatgcctcatttcatagaggttgctatgttgctaggcattcttttttttttttactgcattttagagaaataactgtaaaacgagggtctataaccagcatataacacnataaacaacagcatcaacttctgtccccttgtngtaaacagtttccctatgctttaatnggaaatgtaaatgttaatgccttgtgtgctttctcaaaatagttttggacaaattatattccaagaaagatctctgtatttgtcacctctatcaaaggtccaaagattatagaattttcttatcgtaaatcaaggactgctcccctcagcccatagaaaaggatgagctacttcctatttttcaagagctttggaatccctttgcagtaagagaggaactatgacaacaaagtccctaaatgcggcaagatagcacagagagggaggtgtggcatgcagcggcagcaagggtggtcacttaagcttt

SEQ ID NO: 486468 - DNA, 398 bp, Homo sapiens
caagcgctctctatcattacccactgacctggggggctagcatccccctaccttctctccgcgactctaccctctctttgctctggacttgcctccttcactataggcaaacttccaccctccattcctccttcttctcctttagcctgtgttctcaagaactcaaaacctcttcaactcacacctgacctaaaacctaaatgccttattttcttctgcaatgctgcttgaccccaatgcaaacttgacaatggttccaaatagccagaaaacggcactttcgatttctccatcctacaaggtctaggtaattcttgtcatgaaatgggcaaatggtctgaggtgctctgacgccaggcattcttttacacatcagtccctccctagtctctggtccc

SEQ ID NO: 486469 - DNA, 490 bp, Homo sapiens
ctgcagtagtaaggttgagcactgccagggcgtagcttagaagcatggcttgagtgtaaggttgtggtaggggatagtgctcgttgattggaatgagaattttcatcaaagtgctgctgtcagcaaaattgagaaactgtttgagcatggacttaagatgcatcttgccatagccgcctacttgtccgtgcagcaccgtcgttctgagaacagcgaaaacacctagcgtggcaatgtatggtgcaactagccttagggcggcagtaagtttttttggtatgctcagaggctctgtgtttgactcgtcaacgcttggtccggtcagtgaaagcacctcagcggcaaatagcaccgctggtagtgttatggctgtctctttagagcctagagctagccaaaaagagattagcgaagctgtaagtagtgaacgggcaccggccttgcgaaagagtagatatagatagaatgaagctaggtaaaaagccgtagg

SEQ ID NO: 486470 - DNA, 331 bp, Homo sapiens
ggggttccccccagggatttcccgggcccctttttttattggggggcccccttttttcttctttttttttggccccccccccccctgggggccccccgggcccggggggggggttttaccccccccccccccccttggtttttttttttagggggcctcccagggggttttttgggggggggccccccccccccccggggggttccccccggtttttttttttcccggggtccccccccccccccccccggggggggcccgggggtttttttccggtgttttcccccccccccccccgggggggggccccttttcccttttttttttttta

SEQ ID NO: 486471 - DNA, 722 bp, Homo sapiens
gcggacctgagagctggaggggcgtgcgcgcgcctcgctctgttgcgcgcgcggtgtcacctatgggcgcgagcggggccgagcgcgcacgggacccggagccgagggccattgatgtggctgattgtgctggcgacagtgcgatgtgccgtgtggcctgtgcgtggatagacgtggaagccccgtacctcccctaagtccgtcaagttcctgttatgggggcctggccgggatgggagctacagtttttgtccagaccctggacctggctgaagaaccggatgcagtcgagcggggacaggggccaagactcgagagtacacaaccagcttccatgccctcaccagtatcctgcaggcagaaggcctgaggggcaatttacaccgggctgtcggcctggcctgctgcgtcaggccagctacaccactacccgacttggacatctataccgtgctgtttagagcgcctgactggggctgatggtactccccactggcctttctgctgaaaggctgtgattggccatgaccgcaggtgccactgggtgccttatgtgggaacaccagccgaagtggcctcttcatccgcatgactgccgatggccggattacagcatgaccagacgccgtggactacccacaatgtgtctaacgccctgattcgaatacacccggggaagagggtgtcctcacactgtgagcggggctgccatccctaccatg

SEQ ID NO: 486472 - DNA, 82 bp, Homo sapiens
ggttgcccttggtctcggggtcgctgtcggcgctgaggctgcagagactcgctgtatcccccaggctggagtgtagtggcgt

SEQ ID NO: 486473 - DNA, 945 bp, Homo sapiens
gggcctggtggtgggccttcttcatcatcaataggaagtgcatctaaatcggatgaaagcagtactgaggagactgataaatcaagggagagatctcagtgtggtgtgaaagctgttaataaagcttctagtaccagtacctaaagggaattcaagcaatggaagatagtggctctaactagtcaacaaagcgtgttaaagaaaatgagaaagaaaatagggaaagagaaagaaaaagagaaacaaagagaagaatccagctacttactccagaggccaggtacttggtaaaagatggtaaagaaaaaccgaaagtgaagagtggcaagtaatgatgataaagcaagagagaccagggaaagaacgccgaagtctgacaaagagacagaaagcgttcaatgaaggaagaaaaagctaaggatgagagaattggagaccagtgtccccaaagcatgaatcaaaatcaattcaagaaagggatagagagaaggagccatccgagaggaacagagatatagcacaggagatgaaaatcgaggaagacctgtccaagaggaggagaaaggcaccccagtgctgcgttccttgaaatcaactgttcgcagatcagattattccagagctgagaggaccaaaacgcggaaagtggtattcaccgtttccatgacattctccccagtgaggaggctcttcgacctaggacttcgcaaggtgaataatgttttctcctacctgtccgagatgggaggaatggccgaaattgggcgtctgggagaaccagaacagaaacaatgatgcggagaaggcaggtgtcccacacagggtagccggttccaactagcgagaaggggtcgaaacagagggtgcttcatgagagaaaaacatcacagcattgagtctgcacatagacacaataactctcatcctcttaactaccgaggagag

SEQ ID NO: 486474 - DNA, 440 bp, Homo sapiens
tatatatgtatttatatatggcgtgctggttggtctgtccaaccagtacagacctgacatcagccctacagagcgcacacataatgtcattgcagacgtcaataagatgctgagcatgagggaggttgtcatccaggaagtagatcaggttgacagaaagagaatgatatggcaggtgcactgcgtacgggatggattgcatctgaactctcacttcgaaaacggaccgatacttagtcggatcgaatgggctgcacgagatgttccatcaggttcggttcatagtggcattactggtactgggtgcattgtctccaaccagaacttaatcattccgtgccagccgttctagatgaccctgaagagactggtctgcaacgaccaatattaggtgatgtgctgcacaggctcactggagtcatgtctacatgacatgccat

SEQ ID NO: 486475 - DNA, 401 bp, Homo sapiens
ccaacagtcgcgcaatgatcgcgcagcgcatctggcttgaataaaaacaccgtcaatgccgtcgaactggccggcagcttcatgatgagttccatccagcgcctacctcacatgcctggctctacaccccgtacggcggactggaaaatttcgacagccctaccaacgtgctcgcagcgttgacccagcgtttgaaaatcccgaccgacgccacgcgactgctgtgcttcctgcccttgcaacaacaggcatcgcaagtgctggacaaccacctggtgctaacaccggaggcgatgctcgatgacgtgtttggtgaacaggagaaaaccctcaagcgctatcaggcggtcaatcgccaggcgctgctggcggagttgaaacagttgccgtcattgggcgcc

SEQ ID NO: 486476 - DNA, 928 bp, Homo sapiens
gttctttctgtcgcttttcaccatcgggcttctgctgggctcagtattccccaaatacacaacaaggacggacatctattgttcactcctgcttctgaactggcgatgggcttgactacttgctcttgaactgtgagcgactactttagctccgaagggactctggacggggttcaggtctctccaccaaatgaaaactgttgcaactttacaacccctttcagacctgtggcgggaacagataccaaccagcttagcctactacaacttatgcacaagatctggcaaactgaagactgaactttacgaaacactgggtgactagatgtaacaactgtcggcggttcgctattctatgtggcctgctgtaacttaactcatatgctgtggtaacgctgtgagctgcaggaacaacgcagtacctgtggaagttacttcaaccctggcaagtagggactttccagcagctcccatattctggatgggatttcaatgatggtaaactgtaaaactggaagtggagatatcgagaaactacaatgatgctactcaggtcagcagaatcgtcgtctggactggtcttcttgatcttgcactgcagaaggatacgtgcgtctaagattgccgactattgaccatctcattgacctgcgtgcaggctcagacttgatgctccagcacatgtggcctgcggacctacgggacctcggacaacggcaaaatctaaccgaactggttcccggaggaacgtaaccttcatcaccagccgcaacgcccgcgcgcgccccccccacagcccgacactggcagggcctgcacccccgctccgcacccgcccctcccagacgccacccgcccccaccggcaagcggcgacacaaccccccaccaccccgaaggacccccaccgccgccccacacacccccac

SEQ ID NO: 486477 - DNA, 155 bp, Homo sapiens
aattgagacagggtttcgctgtgttgcccaggctggcctcgagctcctgggttcaagtgatcctctgcctcaacttcctgagtagctgggattacaggtgcttgcacatccccagcacagtcttggaggattttaaggagctacctccattgaaa

SEQ ID NO: 486478 - DNA, 283 bp, Homo sapiens
ccgtcacctgggcgtactggtagggatgcgggcaggttggtgacctgggtgaaccacctgacttgagcagggcttacgacgtctctctgcaaacgaaacccagagacatgaacagtgctgagacttctcagttggtttcccactgtaggctagctttccaacgggcagcacagcatggtttcatcacatcacccatgtgcttctgacttcacgcacctgtgactgctcggttaacgttttacactgacggtttcacaactttttctcgtactgtaacgacgtc

SEQ ID NO: 486479 - DNA, 278 bp, Homo sapiens
  misc_feature (167)..(167): n is a, c, g, or t
  misc_feature (225)..(225): n is a, c, g, or t
  misc_feature (247)..(247): n is a, c, g, or t
cgggctcatgcaggtggcggtccagagccctgagcgcccgctgaatgagacgccggtcctgtggcgtcatctcgccgggtaaaaaggaaagctgtttcatctgttgctcttcggtcagtcgataatacgcagaatggcgtgagcctctggatgttgcatggcatacntcccaggcggtaatagtgtgcggtcatcgcgtcacattctgtacggcaggcatggtgntatacgcaatcaggcagacagnaatacctgctgcttctgcactcatttgggca

SEQ ID NO: 486480 - DNA, 615 bp, Homo sapiens
  misc_feature (16)..(16): n is a, c, g, or t
  misc_feature (38)..(38): n is a, c, g, or t
  misc_feature (46)..(47): n is a, c, g, or t
  misc_feature (51)..(52): n is a, c, g, or t
  misc_feature (70)..(70): n is a, c, g, or t
  misc_feature (77)..(77): n is a, c, g, or t
  misc_feature (94)..(95): n is a, c, g, or t
  misc_feature (104)..(104): n is a, c, g, or t
  misc_feature (106)..(106): n is a, c, g, or t
  misc_feature (108)..(108): n is a, c, g, or t
  misc_feature (110)..(110): n is a, c, g, or t
  misc_feature (113)..(114): n is a, c, g, or t
  misc_feature (117)..(117): n is a, c, g, or t
  misc_feature (121)..(121): n is a, c, g, or t
  misc_feature (129)..(129): n is a, c, g, or t
  misc_feature (181)..(181): n is a, c, g, or t
  misc_feature (232)..(232): n is a, c, g, or t
  misc_feature (250)..(250): n is a, c, g, or t
  misc_feature (280)..(280): n is a, c, g, or t
  misc_feature (287)..(290): n is a, c, g, or t
  misc_feature (292)..(292): n is a, c, g, or t
  misc_feature (298)..(299): n is a, c, g, or t
  misc_feature (302)..(302): n is a, c, g, or t
  misc_feature (413)..(413): n is a, c, g, or t
  misc_feature (447)..(447): n is a, c, g, or t
  misc_feature (572)..(572): n is a, c, g, or t
  misc_feature (576)..(576): n is a, c, g, or t
  misc_feature (593)..(593): n is a, c, g, or t
  misc_feature (606)..(606): n is a, c, g, or t
tattggtgctgctagnctgtgggtcaaatgtttgccanttccaggnngttnngccctcttatgagtttanaatttgnaaatttctaaacccaannatgtaaaangngncncgnngcnccantggggtantcccccacctaaatatcaagatggctactatgctaaaaagagaaaatatggncaagtcgtaaaatggctaattggcctatgacgctattatcatagactaatnacatttatcttcaaaacnccaaattgtctttagaaaaattaatgtgancacaggnnnngncccccnnggncaaacacttttaaggtacactgcattttgcaaaaaaaaaaaaaaaaagtaatcttttagcaaccccagtattccttcactatttcgcttcctgcattagcaaatttaactnacagtcaaaagtgcagatttatactcctgacgtntctcattcacagctaaataataggccataggacttttggtaggtttaaacttttaattctgtatttcatgattataagtcttgctagaattttttctaatctttagtagatttgattaaataatnattnacagaatttagtaacanaatcacaactaanccatgtata

SEQ ID NO: 486481 - DNA, 237 bp, Homo sapiens
aggtcttttattgcatcatttacatatcacaagtaggtcttacgtgtcatctggcatcttcttttctgtagccaggtaactcttagattcttattccatcagcctggctgaaccagttcccttttcagaagaacattagaatacccatcccaaaaaatttccctgattattccttggtttttaaactggtgtgcgggcttggtttgaaatcaacagcccgcgtggaaattttgtaaa

SEQ ID NO: 486482 - DNA, 341 bp, Homo sapiens
  misc_feature (15)..(15): n is a, c, g, or t
  misc_feature (19)..(19): n is a, c, g, or t
  misc_feature (52)..(52): n is a, c, g, or t
  misc_feature (139)..(139): n is a, c, g, or t
  misc_feature (173)..(173): n is a, c, g, or t
  misc_feature (298)..(298): n is a, c, g, or t
  misc_feature (302)..(302): n is a, c, g, or t
  misc_feature (319)..(319): n is a, c, g, or t
  misc_feature (332)..(332): n is a, c, g, or t
aaggtacaatttganactnatgcttcacctttcctttaataaactattcaanatcaaaaaaaaaaaaaaaaaaaagtaatcttttagcaaccccagtattccttcactatttcgcttcctgcattagcaaatttaactnacagtcaaaagtgcagatttatactcctgacgtntctcattcacagctaaataataggccataggacttttggtaggtttaaacttttaattctgtatttcatgattataagtcttgctagaattttttctaatctttagtagatttgattaaataatnattnacagaatttagtaacanaatcacaactaanccatgtata

SEQ ID NO: 486483 - DNA, 332 bp, Homo sapiens
caaagtgaattggaaaaaacgcccaaaagaccccaaccccatgatgatggtaatgttagaattatctggtaagcattttaaagcagccatcataaatatgctttaggagcagtcataagcatgcttgaaacaaaggaaaaaaatgggtttaaacatagaaagtgctggaaaagaaataaaatcccttttaaaagaccaaaatggaaattgtaaaggtaccaaatcccgtaatccagttaaaaaatcccccccccaatagatgagctcaccagcataatggagaggaaatgaaaatcagtgaaattaaagataaaacaccagaaattgtccca

SEQ ID NO: 486484 - DNA, 290 bp, Homo sapiens
ggacggcgtggaatgaggccggttcattcctggaggcctcctgtccgtatggaccccagcacctcatcatcagcattgctggagccaagggcctctgagcccaagctcatgtcctctgtaacctgcacgtacacatccagatggccggttcctgccttaactgatgacattccaccacaaaagaagtgaaaatggcctgttcctgccttaactgatgacactatcttgtgaaattccttctcctggctcatcctggctcaaaagctcccctactgagcaccttgtgacct

SEQ ID NO: 486485 - DNA, 203 bp, Homo sapiens
ccaaggaaaatggtcaataaacacgtgtaaagatgctcaacatcattagccatcaaagaaatacaaatcaaaatcccaattagatgtgacttcacaccctcaaggatgtctatcatcaaaaagacataatgacaagtggtgctaagaatgtaaaaaattcaaacactcatatattactggtcacagtgtaaattggtatagcc

SEQ ID NO: 486486 - DNA, 254 bp, Homo sapiens
  misc_feature (193)..(193): n is a, c, g, or t
  misc_feature (213)..(213): n is a, c, g, or t
  misc_feature (239)..(239): n is a, c, g, or t
  misc_feature (241)..(241): n is a, c, g, or t
  misc_feature (246)..(246): n is a, c, g, or t
gcccaagcaaggaaatccccaaggcttatgttgtgttaaaagacatccccctgaaaaacttcgaaaagctcaaaaagcccaggggagaaacaaagggaatgttttattgagagccctttttcccattttgtgaagagaacaacaaaacccttcctgttttttattggggactccaaattttccccaaacttgnttttgttgaaatttttcccnccccttgcctttcaggcccaataaananagttntcccccta

SEQ ID NO: 486487 - DNA, 326 bp, Homo sapiens
gggatatcattagggacagtttctacggatccattctttttccgggtatggggccattcgtcctatttcttggcatgtcttacaattcttggggggaaaatgggacatattagataatatggcatctctgaaaattagatacttctcccccatattctcttcagttttttttttttcttttttgggtctggtagtggctggctggctggtggcgggtctggtatccttggtcatatgtgtccactaggtctcttctcagttagtttaggggccagttaaggatggattgggacagagttttccttaaaagcctggaaggtatgtct

SEQ ID NO: 486488 - DNA, 206 bp, Homo sapiens
tccccggggtttaagggttaaggggccccccatcccagtgccaagggggatgtcaagtggtgatgttgttgtgctcccctcccccagaggggggggggggggggtgaatatggttggcctgcatcggggggccttcccttttaggggctttttttggggttgagggccctggtgtgttgggaattaaagagaaagccggcccccta

SEQ ID NO: 486489 - DNA, 525 bp, Homo sapiens
  misc_feature (305)..(305): n is a, c, g, or t
  misc_feature (408)..(408): n is a, c, g, or t
  misc_feature (432)..(432): n is a, c, g, or t
  misc_feature (439)..(439): n is a, c, g, or t
  misc_feature (465)..(465): n is a, c, g, or t
  misc_feature (502)..(502): n is a, c, g, or t
tttatggtcccagatgagcagatcggtgtcatctcaagcacctcgcacatcactaaggccaccttgatcacctagaacctcaagaaggtccagcacagcagcgcccatctcgagcggatgaagatagaacctggtacagacgctgaagcgacctccagcatcgtctggatgacggctgagcagctggccctgaaagggtgggaagaagcagatcccagaaactggaggccagggtacgggagcctggaaggagaggttgagagtgagcaaaaagccgtatgctgaggctgtccaaggtctgcgcnaacatgagaggcgagtgaaggaactcacttaccagacggaagaagatagaaagaatattctcaggcttcaagatttggtagataaacttcaggcaaagtgaantcttataagagacagctgaggagnctgaggnacatccaacaccaatctagctaaatntccgcaagctccagcatgagctggaggaggccgaggnacgggctgcattgctgaatcccg

SEQ ID NO: 486490 - DNA, 528 bp, Homo sapiens
  misc_feature (305)..(305): n is a, c, g, or t
  misc_feature (468)..(468): n is a, c, g, or t
  misc_feature (505)..(505): n is a, c, g, or t
tttatggtcccagatgagcagatcggtgtcatctcaagcacctcgcacatcactaaggccaccttgatcacctagaacctcaagaaggtccagcacagcagcgcccatctcgagcggatgaagatagaacctggtacagacgctgaagcgacctccagcatcgtctggatgacggctgagcagctggccctgaaagggtgggaagaagcagatcccagaaactggaggccagggtacgggagcctggaaggagaggttgagagtgagcaaaaagccgtatgctgaggctgtccaaggtctgcgcnaacatgagaggcgagtgaaggaactcacttaccagacggaagaagatagaaagaatattctcaggcttcaagatttggtacgtgaatgtgtgtcagggggagacttgctggtgggttaatctgccttaggatgtgatcgatccaacaccaatctagctaaatntccgcaagctccagcatgagctggaggaggccgaggnacgggctgcattgctgaatcccg

SEQ ID NO: 486491 - DNA, 152 bp, Homo sapiens
tctgactagccagctatagagtatagttagagcaggctactgtgataaatagttcataatagtactaacccattgcctaccaggaaaacaaatcagtatcttaccctgggctacaagggccctcataatctaggcccctaacatacctactg

SEQ ID NO: 486492 - DNA, 227 bp, Homo sapiens
tccagcgggggtcggagaagacacaggctgggctcacacgaggggcaacattcacacgtgttctctctacaggtcaggtcatttttcttcatgttcgggcgggaaaaggaattcctttctccttttctaaggcaagctgctggtggtgtattcaatctgcttatcatgtaagaacttacatctgcacactggttcactcccccgctgcatgcattcgggggaaatgg

SEQ ID NO: 486493 - DNA, 334 bp, Homo sapiens
ccgacttagaggacccctacgcctggcgcaagccaacatttccgatccccaggtcagtagagcccgagtgtgcagaatctgcagaggggctgctctcgccctgctctggccgggaaacaggcctccaagtacccaaggtagcatttttggtggccctccccaagctcctctttctcctccagcccagctgtgtggtaccaagtgccctggaagtctactgagtggtgtccagggtcccctcagacagcatcccagagacttgaccttcctctgtgtgtccagtctgtcaggcccagcttttaggtactctttgaccatagacgtctttgaagcc

SEQ ID NO: 486494 - DNA, 210 bp, Homo sapiens
actccactcctgagtacagagtgagaaatccagtttcaatataatatatataacaagagaacaaatttgcttgctttaagaagtggtctcctgaggttttaagacttgcctgacagtttcgtgattggttgggagagaggctgctgtctttgcgctgtgcattttcacagatgagaaccacgcctagccaaaatcacttttcctgtttgc

SEQ ID NO: 486495 - DNA, 933 bp, Homo sapiens
gaatactttctgcctttgctcagtgatagttattctacaatctccactaagaaaaatataccttttatccggaaaagtattggtttaaggcaaataacataaaactgtgacttgctctaaagactctgtcactactatagcaaagtttgtccagttcctttattccactcataaccacatgctgttccccaccaggtctaaagatgcttctgtaatcttaaatagggtttttcaactttcattaaggtacacctatatgatcttatggttcctagaggtgcaggtccatatagtcgtacatacttaaatactacttgcgtacactgatgctttagtggctcatgggtttccttggttctttgatttaacacctggcattcctggtatcgtatggctggttaaatatcgtaaacctgcattattagtgcttgacaataataattcccttggactgaagtccagaaatactaaagcacttctttttgattgctgtgaatgcgcttagagcgttatcttcgcgaaataggatacatgcgtttgctatttgcatagtataactgaaatatttgataaactcactgtaatcaaatcttgataaaatctgaatcgaacatgaagaagttgtcaatgcttgaatgaatactaataatcggtaccacaaggatactagataacgtaaatggaccatgaagtgtcccactgtgtcaaagggtaacaaactttaagaacagatagccatggaagtggtggtgtggaacctcaagattctttggggactagggaatttaaaggttggggaggcaggaattcaatgatttgacaagaaatacttaatagaactttgtccaatggtatggctaaggaagacttcctcaaaatttggcaggtcgaaactggatccttatgtttacgaatattaatcatttaataaac

SEQ ID NO: 486496 - DNA, 459 bp, Homo sapiens
  misc_feature (47)..(47): n is a, c, g, or t
  misc_feature (69)..(69): n is a, c, g, or t
  misc_feature (71)..(71): n is a, c, g, or t
  misc_feature (108)..(108): n is a, c, g, or t
  misc_feature (113)..(113): n is a, c, g, or t
  misc_feature (127)..(127): n is a, c, g, or t
  misc_feature (144)..(144): n is a, c, g, or t
  misc_feature (151)..(151): n is a, c, g, or t
  misc_feature (154)..(154): n is a, c, g, or t
  misc_feature (162)..(162): n is a, c, g, or t
  misc_feature (209)..(209): n is a, c, g, or t
  misc_feature (238)..(238): n is a, c, g, or t
  misc_feature (255)..(255): n is a, c, g, or t
  misc_feature (266)..(266): n is a, c, g, or t
  misc_feature (280)..(280): n is a, c, g, or t
  misc_feature (434)..(434): n is a, c, g, or t
ttttattttatttattcatttaaagacaaatttttaaaagtaaagtnaatgaaaccatttgtaattaananacatagacagaacttcaatgtagaaaaaaaaaaaaanttgangggaaaaaaatgangagaaaaaatgtaaaanatttcanagncgcccaanaagctcccattgtaaacaggattaagctgctcttgatttagcccgtnacatcaaggtttcattttgctcagcctgngatctcgctcaatttcnaactgcctgtnatccactcggtcgnggaaggctttccgttcaatgttcccctctttccctcgattatggatggccagttcttcaccaatcccctcttcctccttgaagctctcccagtccagtttggccttctcaggggtgctcattttctgcttcttggcaccaattttccccaaagngctgctcatgccacttgatcttttt

SEQ ID NO: 486497 - DNA, 368 bp, Homo sapiens
  misc_feature (43)..(43): n is a, c, g, or t
aatactgcatgatctcatatatatgtggaatcttagaaattanagtcaaactcatagaaaaaaatcttctcttcggctgggtgcggtggctcacgcctgtaatcccagcactttgggaggttgaggcgggtgtatcacaaggtcaggagatcgagaccatactggctaacacagtgaaaccccgtctctactaaaaatacaaaaaaattaatgggtgtggtggcgggcgcctgtagttcccttagtcccagctactcagaaggctgaggcaggagaatggcatgaataaaaacactagctccacacaagctcccgggaggcggagcttgcagtgagccgagatcgtgccactgcactccagcctgggc

SEQ ID NO: 486498 - DNA, 511 bp, Homo sapiens
tccgtcagaacaaatcgacaatcagaaatgctcgaaaatcgcaaacatttctaataccggaagtaactaattccaccgttgacctcatgtgacagaccacagtcacaatgcaggcacagaacacagtttattccgcgtctccaaggggaacacagacctcccagacccctgcatctgctgctgtttaatagcggttacaggtattccagtaatacaactatgctgcttagttaccctccacgcattattttttaattgtattaatggtacgccatatcccttactgttaaggtacttacatgtgaatcatcgtcagcctctgattgcttattgctagcctataaattcatgtccaggaacaatcagtgatgtctagcaaccgcaagatgtcaacctggatggctgagatggtgacacctttgctttctgatggttcaatgtatacgcacttctttcatatcttcaactattgtataaaattacgttcagactggacgcgccatcgtgcgct

SEQ ID NO: 486499 - DNA, 400 bp, Homo sapiens
tctatcaggcggagagtcacaaccgcctccccaattcatcagctgggctgaaagtccaacttgccagaatatcgtatctgatctctactacctcttccactgccttcccttccagcacttcctccccttctacatctgtgaaatggctcacccttccacattcaagacataactcccaggctctgctccatatcccattccgcacaccttccacagcaacttagctattaattatctcctttcatccttacaacattataccataacactttctccatctctactgacttgccatccttaggatacaaacataattaacttctccaatcttataagatgataagttctttcaaccacagataattcctaccattctttcaccccttatctggggagagaa

SEQ ID NO: 486500 - DNA, 203 bp, Homo sapiens
gggctctgaagtaccatgaagcctgtagaactgagaaggagaagcttacaaaaaaaaaaaaatcctctttctatattgcagtctctctaaaggagggcaaatttggttttacaccctccatgttaattctccttttacttttaggggtttgttaaaagctacctttattagatatagaatggccagatttctctgatttcaaa

SEQ ID NO: 486501 - DNA, 580 bp, Homo sapiens
  misc_feature (99)..(99): n is a, c, g, or t
ttgtcccaaaacgcttaactgtggccgcttagaacgatgcgaaaccatccccctgtgtaaggccgtgccgtgtgacttgaaacctagggccctcccttngaagcatcaaaccccacccagccctggggggagggccaccccttttggaccaacccgggttttggggggcccagcgccaggttaacccttaaacctgccccccttagcccaggaaccgggaggcctgcggggtgacccaaaaaccgatcatgcccctgtcctcaagccaacggctttgggtgggggtggttttaaacccgcccccggcagttttttgttaaaaattttaggggccccccaagtccgggggggtcgccgcccgcagccttttccaaaccctggggccaacgagggtcccagcccaacccgcaaaaacggaggtggggtgcaactggggggggcaagggctttcctttcaaaaattcgggttttaaaaaaaagcaagcccaaaggggttttttttttttcccaagatttggaaaaaaccttttaaggctgggaacttttttgggcaacccccccaaaaacattttgtttttta

SEQ ID NO: 486502 - DNA, 115 bp, Homo sapiens
cagtgagtctcgcgcggacaggcgggcggaagaggagcggcgatggatctacagctacgggataggaaggccttcgtgagcggatcgtcgcaagggatcggctacgcgaccgcgt

SEQ ID NO: 486503 - DNA, 367 bp, Homo sapiens
ttcccatattttttaaaacataaaattgaaatctcgagaatataatacatagaatagagaatatagaaaattaaatcttctaatattgttctgcagatttgatcttttttctctaataataaatcaaggcctccgggtatatttgtttgtatatgtacaggaaaaggtctgtaaggatttactttcagctgttaattgcagtgactctggggaatttccacttctgctttgtacagttccttgtgtgaatttttacatcatgtattacttttgtagttggggaaaaagcaattaaaagtttggaaaaaaagaacctctagccattgttataataagaagttggaatcaataaaaatatccacaaacg

SEQ ID NO: 486504 - DNA, 372 bp, Homo sapiens
ggaacacactgtggggtttcaggggacatatgtgctcaccacacattgcgccccaaccaggcccagacatgagacacggtcccgggagctctctctagccttctcgtatattccagacctgtgctcatgtcacaatttgtaatgaggtgtttggctgggtgacattttatggccatctgtctccctatcccctataatgggggttgcgcggcgaagcccaagactgtgtcgggcatctgtgtcttcaggatcaccccttactgtgcatggagtatgtgtgcaggtaacgcttgctgagtgaatgaatgaatactccatactctgtctggagaattacgcactttagcatattcaagggtctgcgtgctgcgt

SEQ ID NO: 486505 - DNA, 740 bp, Homo sapiens
tctccctctcccggggacgtggtctggcgggcacgcagaaagggcccagcgttggacataccgacgtaggcttccctacaatacagcctctaacaaaatctaggctgccccgaaccccgggtaataagaattggtgtcacctttataccaaagaagggtggggaacacgcaccaaaatctggcttgtggtgttggtggtggcccagggcagactctcagaaggggtctcggtggctgggtaacgaccctaaatgtatctatatagaagattggtccaacaacaagagaaacttggtcacgccgagggccctagtgggtggtcccagtggtggttgctaaagtggtgtctcggttgacgaaggatcaaggcggtgcttcaccattatcggaggagccagaacaatcgtgtgtcgaagggtgtgtgagggcacagagcacagagtcagaaggcctaaataaaaaattgaaccttttgggaagttaattaaaaaaagaaaaaaaaagaagaaagaaaacaaaaataaaagaaaaaaaaaacgaacacaaaaaacccggggggacaacaacgacgggggggcgggggaacaaagaggacgtacgaacgcggccactagccacgcgagagtagcccacgaacaaacagcgaagtacgcacaagagggagaaaaaccacgagcccacaaaagagggcggaaaaactacagaccacgggcacgcgcatatacgccggaagaaacccg

SEQ ID NO: 486506 - DNA, 348 bp, Homo sapiens
  misc_feature (192)..(192): n is a, c, g, or t
  misc_feature (227)..(227): n is a, c, g, or t
  misc_feature (265)..(265): n is a, c, g, or t
  misc_feature (269)..(269): n is a, c, g, or t
  misc_feature (272)..(272): n is a, c, g, or t
  misc_feature (282)..(282): n is a, c, g, or t
  misc_feature (288)..(288): n is a, c, g, or t
  misc_feature (292)..(292): n is a, c, g, or t
  misc_feature (306)..(306): n is a, c, g, or t
  misc_feature (312)..(312): n is a, c, g, or t
  misc_feature (318)..(318): n is a, c, g, or t
tgcagtactggatgtgatgctgtgtgcctcccaagagacagccagacaacaaatctgtcccccactggcccactgatgttcccacatggatcctgcccatcagtctgacacccaaacttgtgtgtagcagcgctccatgtggtgcaaggcaagacgcgggttgatgggtgttgcccacaggaaacacagaanatctgcaggtctgtgtcatcactgtcaccctcgtngctctcctcatcctcgcgcacagactgctgcttggacngtanaangatggcctcnagctcntggnatcggcgtaccatntcctgnaggcgngtgcgggcactctgctgctctcggcgaatg

SEQ ID NO: 486507 - DNA, 286 bp, Homo sapiens
  misc_feature (8)..(8): n is a, c, g, or t
  misc_feature (24)..(24): n is a, c, g, or t
  misc_feature (33)..(33): n is a, c, g, or t
  misc_feature (63)..(63): n is a, c, g, or t
  misc_feature (108)..(108): n is a, c, g, or t
  misc_feature (217)..(217): n is a, c, g, or t
  misc_feature (221)..(221): n is a, c, g, or t
  misc_feature (227)..(227): n is a, c, g, or t
  misc_feature (261)..(261): n is a, c, g, or t
cctcaggntcccgagtagctaggnttaaaagcntgtgccaccacgccctgctaaattttgtanttttagtagagatggggtttcacatgttgctcaggctggtcttgnacttctgacctaaagtgatccgcctgccttggcctcccaaagtgctaggattacaagcatgagccactgtgcccggccagattgttctctcttaatgggctgataagtnaccnagtganacatattgtacttttaccccatgctagaggcagnaagcccaagctgcagaatgcccaat

SEQ ID NO: 486508 - DNA, 616 bp, Homo sapiens
  misc_feature (327)..(327): n is a, c, g, or t
cagctgtgctcctgactttaaataaaatacacatgtataatctgcatgtcattgaaagattattcttagactgggtgcagtgggtcacgcctgtaatctcagcactttgggaggctcaggtgggtggatcacctgaggtcaggagttcaagaccagcctgaccaacatggtgaacacccatctctactaaaaatacaaaattagccgggcatggtgacacatgcctgtaatcccagctacttgggaggctgaggcaggagagttgctcaaacccgggaggccagaggttgtggtgagccaagatcgtaccattgcactccagcctgngcgacagagggagactccgtctcaaaaaagaaaaaaaaagaaaaggattctgagttgagttgggttttataccttaaatagcaagcaacatcccaggagtatcacataccaaggaatagatctgagaataaaaatagccaccatttattgagtgtctgttttgtgctagggctagatactttatatgtcattttattgtgaatcacaatatccccacaaaataatggggaattcttgcatttatacataaagtgaggcaagattgagtcgggatctctagagtgacctg

SEQ ID NO: 486509 - DNA, 1145 bp, Homo sapiens
  misc_feature (1020)..(1020): n is a, c, g, or t
  misc_feature (1117)..(1117): n is a, c, g, or t
  misc_feature (1145)..(1145): n is a, c, g, or t
gacactacttggcccgttcctgggctatggagggcatgagttcgttgcgcgcagggtatcgagataacagaatgtggatagtgtgcgttggtacttgtgcgcgaacacgcgttggaactactgtctctgatgaggggtcctccactcgcctcgatgcgtttccagaggggacgtgatgctcctgtatcgagacagtggtgaacggtgctataagagtatgatgacatcgtgaggtctccttggattatactgaaaaggacgtctgtcaagtaagtatacttgaggattctaatcttgtgggatgagagatagggattgataggtagtctatggagatatactctggtgtactgtctttgtaaggtacaaagcgatactttgtcaggaatttccgagagaagggtatgatccgggaaacattgggagattatttttcagcatccgcatactaatgatgtgatgctccggtcattgctattgattagtcctgaaacggatattgttgctcgagaccatggccgtgcgttccaatcgtttgccttgaggtctgctgacatcacggggtcaggagtcgtgggatggtcgcgacaagattggttgccgtgtgggcagggccatggtttcctggtatttacctgggctgctcggttgacctgcgcatgttccggtccttgctccggaaaggagatcttcgcctttgtgcctttgttttccctcgtctaccccgttttttcctcctctttttgcgccaccgggtacaggcgcacacttctgcggacggggcggcggggcgcacacacacagcctcgggcgaggtctgcgcccaagtagagctcacacatgagagcgctgtgcaattacaaaatgggcgcgcggggcccctaccggttgataggacatacaacaagcactagagcaggcttgcgcgtgctcatatacagtagttgcgtcgtttcgtacctcttatctctcttgttgctttgctattctaccatactattctagtctatctactcgacntcaacattaaatggtatacagacatactatagacaaatactactaacgcatactgctatactagcacacacacactacaacatgagactgacagcancaacagaacagaccacaacgaagcgacn

SEQ ID NO: 486510 - DNA, 103 bp, Homo sapiens
tgtcgccagccaacaggatgtggtagtacatcgggacaacaatagaggcaatcctaaagaggtatcccaaattagggaaaaccagtgacccaaattatacatt

SEQ ID NO: 486511 - DNA, 711 bp, Homo sapiens
  misc_feature (34)..(34): n is a, c, g, or t
  misc_feature (90)..(90): n is a, c, g, or t
  misc_feature (101)..(101): n is a, c, g, or t
  misc_feature (119)..(119): n is a, c, g, or t
  misc_feature (130)..(131): n is a, c, g, or t
  misc_feature (135)..(136): n is a, c, g, or t
  misc_feature (158)..(158): n is a, c, g, or t
  misc_feature (169)..(169): n is a, c, g, or t
  misc_feature (188)..(188): n is a, c, g, or t
  misc_feature (206)..(206): n is a, c, g, or t
  misc_feature (221)..(221): n is a, c, g, or t
  misc_feature (225)..(225): n is a, c, g, or t
  misc_feature (242)..(242): n is a, c, g, or t
  misc_feature (260)..(260): n is a, c, g, or t
  misc_feature (288)..(288): n is a, c, g, or t
  misc_feature (297)..(297): n is a, c, g, or t
  misc_feature (353)..(353): n is a, c, g, or t
  misc_feature (508)..(508): n is a, c, g, or t
  misc_feature (637)..(637): n is a, c, g, or t
  misc_feature (701)..(701): n is a, c, g, or t
ccatggtctggccctgggtggcgatggcgtccangtggggtcccctcattggcctggctccgtgctgcctctggctcctgggggcagtcnttctgatggangcgtctgcacggcctgcnaaaaaatagtnnaatnnaaaaaaaatagaaaaaaaggangaaaataaaanaatgcacccaaaaaaaatnaacggggtgaagctgganatggatgggcacctnaatngcggcttccaccaggangtcttcctaggcaagganctgggtggctttgatgaggaagcggagngcggcggangaaggaagctgatggtcatcttttccaaggtgagatgtgaacactgaccggaagancagtgccaaggagatgcagcgctggatcatggagaagacggccgagcacttccaggaggccatggaggagagcaagacacacttccgcgccgtggaccctgacggggacggtcacgtgtcttgggacgagtataaggtgaagtttttggcgagtnaaggccatagcgagaaggaggttgccgacgccatcaggctcaacgaggaactcaaagtggacgaggaaacacaggaagtcctggagaactgaaggaccgctggtaccaggcggacagccccctgcaganctgctgctgacggaggaggagttctgtcgttctccacccgagcacagcggggaatgctcaggtnatggtgaaga

SEQ ID NO: 486512 - DNA, 345 bp, Homo sapiens
ttttgggggcccagggggaaggggaaaaaacccccccctgggcccggcccccccggtccgggggggggccccccctttttatgggggtttttgtttcccccccccggggttttattccgcccctggggggtttttggggaaggttttcccccccccgttcccgggggggccgggggtcccccccccatttccggggggcccccccctttgggggatttttagccccccttttccaagggggggggccccggttttgaatacccccccggttttcaggggcccccccccccccccttgggtttgggggtttggggggttttggccccctttatttttttttttgga

SEQ ID NO: 486513 - DNA, 603 bp, Homo sapiens
tgtcccgatgttcaagttattggatcatttagtattagtagttcgcttgcctgggtgaagtcttagcatgtactcctcgaaggttagatcctgctcgaggtcgccacaccgaatcttaatgcagattgggtagtttagtacctgtgggtctgttaggtactgtatgcattattacattaaagctccatcactggttaaaagtaatagccagctgatccctcgtggatccattcgtacaggtccctaattaaggaacaagtgattatgcgacctttgctcggttagggtaccctggccgttaaacatgtgtcactgggcagtcggtgcctctattactggtgatgctagaggtaatgtttttggtaagcagacgcggtaagatatcccgagttcctttcacttcatttatcctttccttatgagcatgcctgtgctgggttgccagtcagggtaataatgtcttgttggttcattgtagatattggcctgttaagtgtcagtccagtgttctgatctgacgcaggctcacgcggaggagaatgtatgcacgttacttatactagcatgagttcttctatagggtgatagtctggtccaattgag

SEQ ID NO: 486514 - DNA, 536 bp, Homo sapiens
  misc_feature (47)..(47): n is a, c, g, or t
  misc_feature (85)..(85): n is a, c, g, or t
  misc_feature (299)..(299): n is a, c, g, or t
agcgggtaaacacacacgctcggggaacacacaccggtgtgtccggngacccacaagaaaggagtgggtaacactatacacaacnttggagacaaaaaagtattcccgcaccccttcttggcaagagagcactggtaagtggtacaaacacgagctgccctttttaatgggagattattttaactttcgcccattatcaggagttttccaaagatgccctcccaccccgatcgccaatgcacacacggcgcataatcatagcggattatttaatcatttggtaaaaaaccagacaattnaaattccttcttgggacccaacgtgggatacaatatcatactcgagacccccacatatgggggatttcacccatatccaccgggccaaattggctggagattggggacctgaatgataaataatttttgacgcacccgagccctcgttggcgcaagagaaaacctgtttgccatttttttaaccctttttaaaaactggggcgggtttttccgggtaaaaatttttaagccacccaa

SEQ ID NO: 486515 - DNA, 333 bp, Homo sapiens
  misc_feature (2)..(2): n is a, c, g, or t
  misc_feature (10)..(10): n is a, c, g, or t
  misc_feature (116)..(116): n is a, c, g, or t
  misc_feature (169)..(169): n is a, c, g, or t
  misc_feature (174)..(174): n is a, c, g, or t
tncatttttngagatggagtttcactcttgtcacccaggatggagtgcaatggcacgattctcggctcactgcaacctccacctcctggattcaagcgattctcctgcctcagccncccgagcagctgggattacaggcacgcaccaccacacctggctaattctttanatttncagtagagacagggcttcatcatgctggccaggctggtcccggaactcccgacctcaagtgatccacccgcctcagcctcccaaagtgctgggattacaggcgttgagtcatcatgcccatccctactcaggggtcttttagaaggaaaatgccaccat

SEQ ID NO: 486516 - DNA, 299 bp, Homo sapiens
gagctatagatattcctacagcagtattgaatgatatctacccaaatatatgtacccattatataaatacataaatctgaaaaaaattatgaagtgtttcatgcctgtcctttgaagatctttccttttcactccctaatttacaatatacttgaaacaaaaatgctcaaggattacactgcatgaacatctgtagtaattgtgcatagtagaacatagaccaatattaattcttctagtattgagttgtggtacattgtcagaggaatgtcttatccatgtcaactttcatatgggta

SEQ ID NO: 486517 - DNA, 165 bp, Homo sapiens
aagtgagcactgctattcctcaactgctgcctgcaggaggccatctcttctgggagcttatctgacttaacttcacctacaagttcgctcttacgagacgggggtaagcgtgatctccatgctatccctgcagcgcctgcacggcaggcttgccctatcttatag

SEQ ID NO: 486518 - DNA, 1072 bp, Homo sapiens
  misc_feature (768)..(768): n is a, c, g, or t
gccgggcactgatcccgcctggggccggtgagtggcacttaagcgggccatgccatgcaaccttgggcgctgccaaccgtgggcgagctctgggtgtgcgggcggctggcgcggcgctccgtgtgtcagcgtgttatgatgccgtcccgtaccaacctggctactggaatccccagtagtaacacgtgaaatattcaaggctctccagcacagacgatgggctacatttgaccgctccctcctgctgtgttcaggctacatcagcaaagggggggcagaccgggccgttccagtgctgatcattggcattctggtgttcctacccggattttaccacctgcgcatcgcttactaatgcatccaaaggctaccgtggttactcctatgatgacattccagactttgatgactagcacccaccccatagctgaggaggagtcacagtggaactgtcccagctttaagatatctagcagaaactatagctgaggactaaggaattctgcagcttgcagatgtttaagaaaataatggccagattttttgggtccttcccaaagatgttaagtgaacctacagttagctaattaggacaagctctatttttcatccctgggccctgacaagtttttccacagggaatatgtatcatggaaggaatagagggttatcttgtaatggaaaaagtgttgcctgcaccaccctctgtagagctgagcatttcttttaaatagtcttcattgccaatttgttcttgtagcaaatggnaccaatgggggtattggtaatttcttatttattaagtaggtcattttaccaaatttctgagtatattatcctggtacattaatcccctaccttcatgttccagtggaagaccttaggtaaaatcaaagaccagggagttccaactgtaaatcatttgcacagtgcttcttacggaacagcaacacggaatataatcctggcgagaccagttcacaatggtaactccctcggttaaagactggaccatctgtcacgtacacgagtggcagaaaatggacatattgccagaacaaagtgcggattc

SEQ ID NO: 486519 - DNA, 483 bp, Homo sapiens
  misc_feature (106)..(106): n is a, c, g, or t
  misc_feature (347)..(348): n is a, c, g, or t
  misc_feature (350)..(352): n is a, c, g, or t
  misc_feature (393)..(393): n is a, c, g, or t
  misc_feature (477)..(477): n is a, c, g, or t
caaaaggcccaaaggcctcaggtgctagaattcctcaaataaatgctgcacaaaaattacagacaacccttgactggccacagtctgttttcattaaagctagccnctgcttactaccataaaacagagagagtaaggacaaaggtgttaaacactaccctagctcaaacaagtttctctctgtaggatgccaagaacctgggaaccagtgcatctgctgctttcccttctcggattctagcccagacaaaagaggcaaggggcatttctccagaggccttgagcgtcactacacaatgccccaggctctgcatgcacccgcgttatatatttctaccttggaaaanngnnntatataatattaataatatatggttttatattagaaacacncgtttattttatagatagatatagatatacatagatgaagatctctagtcagccttttttaaggctgggctgattcgcggtgcnttgaaa

SEQ ID NO: 486520 - DNA, 149 bp, Homo sapiens
gccccgggtaactgcctgacttgtagatcaacgtgatcataaagaaatactgcattactaggcttgaaagatagtagtagttgttttcctgctctaactgtactttggaaggagcagaggatagaatctagtttcatacgctcgggggg

SEQ ID NO: 486521 - DNA, 476 bp, Homo sapiens
aggatcccggtggggcatcacggcacctgcgccttcactggggtgacacattagtggacttctgaatagcaaaccaaggtggcactgagggaaaaatccaacttcatgttatatggtactatttagatttggctatattggggttactaatatttggcttaaaatttttcatctaagttggagaaattggcctgtaatttcccattctggtaaagctctggtcaggtttgggaaacatgtttatgtggaccttattaactagttggatggtgttttcttatgttcccaagatgatgtggcaaaagttttctgttatttcttccttatattgggtccattttataagtaaaacttggagttcatagagatttgaaaaaaaatagcttaaataggctgcgtgtggaggctcatgcctgtaatctcagcacttggggaggccgaggcaggtggatcacctaaggccaggagttcgagac

SEQ ID NO: 486522 - DNA, 1195 bp, Homo sapiens
  misc_feature (891)..(891): n is a, c, g, or t
gccgggcactgatcccgcctggggccggtgagtggcacttaagcgggccatgccatgcaaccttgggcgctgccaaccgtgggcgagctctgggtgtgcgggcggctggcgcggcgctccgtgtgtcagcgtgttatgatgccgtcccgtaccaacctggctactggaatccccagtagtaacacgtgaaatattcaaggctctccagcacagacgatgggctacatttgacccttcagtttacgaaaaaccccttcttaagatcccttataaaggccaatcgcactttgccactgtgctgtttatggattgggcgcctttctcaattattataggctccctcctgctgtgttcaggctacatcagcaaagggggggcagaccgggccgttccagtgctgatcattggcattctggtgttcctacccggattttaccacctgcgcatcgcttactaatgcatccaaaggctaccgtggttactcctatgatgacattccagactttgatgactagcacccaccccatagctgaggaggagtcacagtggaactgtcccagctttaagatatctagcagaaactatagctgaggactaaggaattctgcagcttgcagatgtttaagaaaataatggccagattttttgggtccttcccaaagatgttaagtgaacctacagttagctaattaggacaagctctatttttcatccctgggccctgacaagtttttccatgatacatattcctgtggaaaaacttgtcagggcccaggatgaaaaatagaggttatcttgtaatggaaaaagtgttgcctgcaccaccctctgtagagctgagcatttcttttaaatagtcttcattgccaatttgttcttgtagcaaatggnaccaatgggggtattggtaatttcttatttattaagtaggtcattttaccaaatttctgagtatattatcctggtacattaatcccctaccttcatgttccagtggaagaccttaggtaaaatcaaagaccagggagttccaactgtaaatcatttgcacagtgcttcttacggaacagcaacacggaatataatcctggcgagaccagttcacaatggtaactccctcggttaaagactggaccatctgtcacgtacacgagtggcagaaaatggacatattgccagaacaaagtgcggattc

SEQ ID NO: 486523 - DNA, 1174 bp, Homo sapiens
  misc_feature (870)..(870): n is a, c, g, or t
gccgggcactgatcccgcctggggccggtgagtggcacttaagcgggccatgccatgcaaccttgggcgctgccaaccgtgggcgagctctgggtgtgcgggcggctggcgcggcgctccgtgtgtcagcgtgttatgatgccgtcccgtaccaacctggctactggaatccccagtagtaacacgtgaaatattcaaggctctccagcacagacgatgggctacatttgacccttcagtttacgaaaaaccccttcttaagatcccttataaaggccaatcgcactttgccactgtgctgtttatggattgggcgcctttctcaattattataggctccctcctgctgtgttcaggctacatcagcaaagggggggcagaccgggccgttccagtgctgatcattggcattctggtgttcctacccggattttaccacctgcgcatcgcttactaatgcatccaaaggctaccgtggttactcctatgatgacattccagactttgatgactagcacccaccccatagctgaggaggagtcacagtggaactgtcccagctttaagatatctagcagaaactatagctgaggactaaggaattctgcagcttgcagatgtttaagaaaataatggccagattttttgggtccttcccaaagatgttaagtgaacctacagttagctaattaggacaagctctatttttcatccctgggccctgacaagtttttccacagggaatatgtatcatggaaggaatagagggttatcttgtaatggaaaaagtgttgcctgcaccaccctctgtagagctgagcatttcttttaaatagtcttcattgccaatttgttcttgtagcaaatggnaccaatgggggtattggtaatttcttatttattaagtaggtcattttaccaaatttctgagtatattatcctggtacattaatcccctaccttcatgttccagtggaagaccttaggtaaaatcaaagaccagggagttccaactgtaaatcatttgcacagtgcttcttacggaacagcaacacggaatataatcctggcgagaccagttcacaatggtaactccctcggttaaagactggaccatctgtcacgtacacgagtggcagaaaatggacatattgccagaacaaagtgcggattc

SEQ ID NO: 486524 - DNA, 788 bp, Homo sapiens
gtcatgcacccagtgcggcctacacgggctgagccccggcccttcaatgtgttctggtctgcgagaagacctacaatggacccagtccacgctgtggcagcacgatgaagacgcactggctgacacggacttcccctgcaacatctgtggcaaaatagttcacgcagcgcggcaccatgacggcgtcacatgcggagccaacctgggcctgaacgcccttcgcctgcggatgagtgtggcatgcgcttacacccgtcagtaccgcctcatggagcacatgcgtgtgcactcgggcgagaaacccttacgagtgccagactgtgcggggggcaatgtccacccgagcagcgcaaacctcatcagccacctgctgcagtgcacatctcccactccttagaagccaaaagcaccgcgggcggcccatcatgccaacctttgcatccccgggaacccatggaagggagaagcgaggtgatagcagcaggcagggggcaagcaccctgggtccaagttggaaggctcctgggtggcccctcttggccccaagttgcacaacacacaagagcttaacgtggaacagttcccggtatcaatgcaagagccgagaggagggacagccggagtccaagccatgtctagctacgcaaatccacccagggccgcatgctcgacgaggggagccaacatgagagactgtaggcatggtcacgtggattcgcatgggacagggacatattgtagcaaggtgattgcaaaaggttggtactctgtcactggcatggtgagtt

SEQ ID NO: 486525 - DNA, 115 bp, Homo sapiens
tgacatcacctctagcatctaccccgtattagaggcaccgcctgccctgtgacacatgtttaacgggcgcggttaccctaaccgttgcaaaggtagcgaaagtccaacttgtccg

SEQ ID NO: 486526 - DNA, 111 bp, Homo sapiens
ggctcggtaccctaatctgttcgatatgatgatattgaaggggctattacttccagcaagcaaatgagctctcaaagctagtgaaccagcagcttcttgctgacccacttg

SEQ ID NO: 486527 - DNA, 119 bp, Homo sapiens
gggatttgcaaatcataaatctgacaagggacttgtagctagaatatataaagaactcttacaactcaataataaaagacaagccaatttaaaaaataggtaaaggatctaaagacaca

SEQ ID NO: 486528 - DNA, 637 bp, Homo sapiens
gggagaacttgcgttggctgaggctggggcgatcgatacacagacctgcaggccccggggcatcctccatcccccaagccgtagggggagtacgctggaaggtcatgcagacttcctggactcccgcaccggctacaggcgcactgcactgtaagtattacagaacatggtggcgggcagaattttgggaatggagggagaggtgtcgcttgtgcacgctaggcttgtaacatcttgcatctggtccctcgcaggtagggttgcaacttgcacagctcatccagcacgaaggtccagcagtgcgtccctggatgagctgaatagaatgcatagcgttctccgtccaccttgtgcgcaatagcactgtctgactggccatgcaaggcgtgaccgcaactgtgtgacttgggcgtagctgtggaggatggggaagcccaacttgaggaaacagttgtgtagggggacgaagtccggaggttcagatagttcggtccaagaaatccctatggccacaaacttctgtacctcccgacaacatggaacctctatatagagattgccccgggaatcagcgggtccatcagtaaataaccgttgccgcccactcgcactggcggttgtttggcaaccgcgggag

SEQ ID NO: 486529 - DNA, 504 bp, Homo sapiens
tagagaagatggggattttctatggataagggctttctcattctgccatgaagtggtaagggccctagctggggttagggcgtccaagaaatttgcgaggtgaagataagagcactgtactagactgtttggtttctttgcaggccagagatacttttttttttctttgaagaaaaagataaaggcaaaaacagcatttgagcaaataaaaattatccttgaactcacctttacttgatgggctactatgtctgtttttgataacacctaaatctttcttctaggaaatggcacgtgccacctttactcatatttaattcgtcaaagaagtcacatggtcaagcagtgaaggggcagcaaatgatagagacaatgatgtcatctccaatgactacatggagccctagtcgtttgtttctgaagataaaagaccaagaagaggtcaaaaaaaaggaggctcgtaaatgtaactttaagcaggtgaaataaaagattaatcagttg

SEQ ID NO: 486530 - DNA, 261 bp, Homo sapiens
tccctttggcatagtgatgggagggagatgagggggacaggaagacagtcggagcttttgccctaggtgatcattgaaccccatgggatcaagcgatccaacaccttggctcccaaagtactgggattacaagcatgagccattgtttctggccctgacttactttcttactttattacatttttagagaaagggtctcgctcatgtcacccaggttggagtgcactagtgcgatcatagctcactgaagcctcaaatacc

SEQ ID NO: 486531 - DNA, 212 bp, Homo sapiens
cctctacctgcacagcctcaagcttgtgttaccagcagtgcctcctagggtctgccttcagcgaggatgacggtgacttccagggcaagccttccataggccagctgcgcttaacctgctttgcttttagagccaacctgttgaggtttgtcaggggccacaaagagggacaaggcatggtttaacaagctcaaattaggtccttggggggt

SEQ ID NO: 486532 - DNA, 374 bp, Homo sapiens
  misc_feature (45)..(45): n is a, c, g, or t
tgccccaagtcaggtactgcaagtgagagagagtcccgttagaanacaccactagtcagagtgtgggcgcggtggctcacgccctgtaatcccagcaatttgggaggccgaggcgggcggatcaccctgaggtcaggaggttgagactagcccggccaacatggtgaaactcccacctctactaaaactacaaaaattatccgggcgtggtggcgggcacctgtaatctcagctactcaggaggctgaggcaggagaatcacttgaacccaggaggcagaggttgcagtgagccgagatcgtgccactgcccttcagcctgggtgacagagattccatctccaaaacaaaaaacaaacaaacaacaaacaacag

SEQ ID NO: 486533 - DNA, 916 bp, Homo sapiens
  misc_feature (2)..(2): n is a, c, g, or t
  misc_feature (100)..(100): n is a, c, g, or t
  misc_feature (109)..(109): n is a, c, g, or t
  misc_feature (120)..(120): n is a, c, g, or t
  misc_feature (123)..(123): n is a, c, g, or t
  misc_feature (125)..(125): n is a, c, g, or t
  misc_feature (129)..(129): n is a, c, g, or t
  misc_feature (131)..(132): n is a, c, g, or t
  misc_feature (135)..(135): n is a, c, g, or t
  misc_feature (140)..(140): n is a, c, g, or t
  misc_feature (144)..(144): n is a, c, g, or t
  misc_feature (147)..(147): n is a, c, g, or t
  misc_feature (158)..(158): n is a, c, g, or t
  misc_feature (163)..(163): n is a, c, g, or t
  misc_feature (170)..(170): n is a, c, g, or t
  misc_feature (184)..(184): n is a, c, g, or t
  misc_feature (197)..(197): n is a, c, g, or t
  misc_feature (200)..(200): n is a, c, g, or t
  misc_feature (207)..(207): n is a, c, g, or t
  misc_feature (221)..(221): n is a, c, g, or t
  misc_feature (234)..(234): n is a, c, g, or t
  misc_feature (247)..(247): n is a, c, g, or t
  misc_feature (266)..(266): n is a, c, g, or t
  misc_feature (269)..(269): n is a, c, g, or t
  misc_feature (281)..(281): n is a, c, g, or t
  misc_feature (283)..(283): n is a, c, g, or t
  misc_feature (287)..(288): n is a, c, g, or t
  misc_feature (291)..(291): n is a, c, g, or t
  misc_feature (293)..(293): n is a, c, g, or t
  misc_feature (322)..(322): n is a, c, g, or t
  misc_feature (332)..(332): n is a, c, g, or t
  misc_feature (554)..(554): n is a, c, g, or t
  misc_feature (582)..(582): n is a, c, g, or t
  misc_feature (711)..(711): n is a, c, g, or t
  misc_feature (744)..(744): n is a, c, g, or t
  misc_feature (758)..(758): n is a, c, g, or t
  misc_feature (773)..(773): n is a, c, g, or t
  misc_feature (782)..(782): n is a, c, g, or t
  misc_feature (786)..(786): n is a, c, g, or t
  misc_feature (788)..(788): n is a, c, g, or t
  misc_feature (790)..(790): n is a, c, g, or t
  misc_feature (801)..(802): n is a, c, g, or t
  misc_feature (818)..(818): n is a, c, g, or t
  misc_feature (827)..(827): n is a, c, g, or t
  misc_feature (829)..(829): n is a, c, g, or t
  misc_feature (840)..(840): n is a, c, g, or t
  misc_feature (847)..(847): n is a, c, g, or t
  misc_feature (853)..(853): n is a, c, g, or t
cntgtggctctggacaaagcccattgcacgggacttcctgcaccagccgccgtttggggagacgcgtttctccctgctgtccgattctgccttcgactcngggcgcctntggttgctggnggngntgtncnngcngcggntggngtnacccggccccncctgnaggcctncctgtgcctggccnaggcccgggtggngcngctgcgnagggaggctggccncatcgaagcccgngaaatccagcagngggtggtccgagtctactnctntgtgaccgtggngngctnncantncctgacgccgctcatcctcaccctcaacngcacacttcngctcaagaacgctgggaaggctattcctggggcctgggccccgctcctctactatcccccgacccatcctcagccacgcgctgcccccatcggctctggggaggacgaagtccagcagtactgcagcgcggattgccggggccctgggtggcctgcttactcccctcttcctccgtggcgtcctggcctacctcatctggtggacggctgcctgccagctgntcgccagccttttcggcctctacttccnccagaacttggcaggctcctagctgcctgcagaccctcctggggccctgaggtctgttcctggggcagcgggacactagcctgccccctctgtttgcgcccccgtgtcccccactgcaaggtggggccngactccccggcgttcccttcaccacagtgcctnaccccggccccccntggacgccgagtttntgcctcagnactntntntcctgggcccnncagcatgagggtcccnaggccattntntccgaagcgtntgtgccnggtttnagtggcgaagggtgatgctggctgtttttttgaaccaaataaaggagcaccccccgattttta

SEQ ID NO: 486534 - DNA, 987 bp, Homo sapiens
ggctactacggctcgctgactcaggcgggcaccgtgagcctgggcctggacgccgagggccaggaggtgttcgtagcccttcagcgcggtgctgcccatggtggtgcccaacgagctcgtgttcgatggctgggacatctcgtcgctgaacggtggtccgaggtgatgacggccgcgccgagagggtgctggaagctgggggctgcctatggagcaactgtgagcctgcatcgatggaaggccctgtcgggccccggccttctgtttacatccccgaattcatcgcggtcaaccagaggcgcgcgcgcggagtaagctcatccccaggctcgcgtgcgcagcagctggagcagatccgcaggggacatccgagacttccggtctagcgcggggctggaccaaagtcatacgtgctgtggaccggcgaacatcggacgctgcttgctgttgagagtagatctccatgggcctcatggaccacatggccgagaagcttggtgcgtacacattggagactcgcgtgcgggaggtgtccgccctccacgctcttcgccggtggccacgacactccctggatggggctgtggcttcctcaagtggggtctccgcagaacaccctggtgcccggagctcttgagcctcgcgtgacagcacccgggtttttgttgggcggagatgacttcaacgtcagggcaagaacaagagtccacgatcgtgctagtggactgcctcatggctccggacgtacagaaccatgtccatcggtgagtatacaaccaccgggacaccagcgctggggaagaacctgctggaccacaatgcaggtccgctcaaggagggtcccacaaccaccgcgggctggcgcaacatgtttgcagagcaccccaagcctaataagcacgggaaaagctgtacccctggtggccacagtttggcccgacgtgtggtaaaaacccccgagagaacctccagaatcaggggacacac

SEQ ID NO: 486535 - DNA, 230 bp, Homo sapiens
  misc_feature (224)..(224): n is a, c, g, or t
aaccgagggagcgagtcacagtcctaacctcatttgacaggtgcagtctaaacaatcaaaatttgtttcatatactaaattatttaaaatattgtataaaattgggccaggcgcagtggctcatgcctgtaaacccagcattttgggaaggtgaggtagatggattgcctgagcccagaagttcgaaaccagcctgggcaatgtagcaagacttcatccctatnaaaaat

SEQ ID NO: 486536 - DNA, 814 bp, Homo sapiens
agtcagggacggttgttatgttacatttatttcaccagaactattttactatatcaaaggggtttactatgccaaacaaaattctagggaaaaatactgctaaaaatggatgcctcatcagaacatgctgttgagtccaatgtgccataacgacattttagcatgttaaatagcacttataatagcaaaaaaaggcacatcaactgcgaagttctccttagttgcaaatgctttttctagattcattgatttttcaatcattagggtacctagactccatcagcctaaagtggcatctggaactggacatggctctactgataatgatcagtctttagtcttcccattgtgttatatgactttataggttatgattgatcacatttagtttactacatggtacgggtgagggtcatagggcaggtttggatttctagtactgttgaaaaattgcaagtatggctatgtgtatacttaagccataattggttaaaaaaaaacctgagcatgtctatgtatcaatgcgtgggacaagaaagcttggtgtgtggtaggttgtgggcacatgggctcaaggatattcattattaaaaataaagcatgtttgtaagaggacacagaagggcaaatctgtagcttaagtctatacacaaggtgtggaacctcaaaggggggtttctggataccttaaacttggggaacagtagggcgcaggagggtaagggacttacagggaattataattggaaacggatggataatgacttggcaaacagttttactaatgaatgctttacataacactcgaatgcat

SEQ ID NO: 486537 - DNA, 175 bp, Homo sapiens
ttaaagtgctaacatctgggggaggaggagagtgcgtcagtgtttgatggccccgcgcccccttgggtgcctcttttgcctctgccgcacctgtaagccctgcgactgcccacagtcactgttttgtgacaggacatgtggtaaaacagcaggtgaggaaaaggccaggagggca

SEQ ID NO: 486538 - DNA, 958 bp, Homo sapiens
  misc_feature (205)..(205): n is a, c, g, or t
  misc_feature (251)..(251): n is a, c, g, or t
  misc_feature (735)..(735): n is a, c, g, or t
gagtgtgtcgggcgagctaccgagagctcaactatgcctcgagtatgcgcatctggtcatgtgtgtcccgtcgggcagctgagaaaagcatctactgatgccaccatggatccaggcattgctgaatgaccctcaaaccggttcttgtcccaaggtcgtcgaaccctgagcatccgagccggttttcaactacttccaacttcantcctgcggcatgtgtttttttcgtccgggagaaaaaaagatggganacctagcagcgcaggcatgcggatcatgcttcgcgatcgctaggtccctctgtgcgcagactaactatgttcgaactaggtctgggaggacatctggtgctggtggggccagggatacgaaggaaccgacgtaatagtacctatgtgatgactatagtccctatcgtccacgacttggacgtctctgtggcatcttcacctctaggccgtgatgattagagacgcagggcttgagtaccacggcagggcttcggagggcacagtgggagaggatatcccggaagcgtcatgatggggagcgtggttgtcatgtgatgcgaactgcgggcgaggtctcagtggggtggtacgatcactgtcaacggttatactttccgtggaccgtgcttgcggcaggcccgatgcagatgcgcaagtagtcctcctcgtaagaaactttccgcgaagttcccacagtccctggacgacaaaatggcctcttgcntgctgatcgtccaacgcccgatccaagcagatcgcataaactctacaagggtccacgaccaaggtgctcctcaaaggcacacagcgatctaacccaacggaccaaacgaccgcgccagcacttttcagaaaccaggcccggcacatggtggacagtgcgtgacactggacaccagggcacagcggtacacctgcaaccgctcaacaagacctcacctatagcc

SEQ ID NO: 486539 - DNA, 1749 bp, Homo sapiens
tggttcttcgagtttgccgattgtctagctatgtctctgtttgtgtaggtgtgtctttgggtttcgtagaattggatcgccgtcatgagacggcgtattgcgcctgttggtgtggtagtggatgagttgtgccgcccatcgtggacctccctaagggttgtatgtaaatgaaagtgtgtcgttgctctgtaggaagaatggttttgtatataatgcacggcgaggaacggggttgtatatatgtgaagtcggtgagcgtttgtcgtatgaaggggttggaagttagaataagtggttgtccgtgcaagagattgtgtgtactgttgtggagagctgattgtgctcctgcttgccttgctcgctttgtgtgctgtgcacggcgagcatgtttgttatgcgtgatgggatccaccggtcgttagtttctgtgtgttggagacaccacaacgttggtgggttggtagaaaaataaagtaggtggtgtgtgcaaacacaggcactttgtgtttggataacacctccgtctacgtgtggggagatacatagaaggggctcttttgtatcgaaatgataccatcgttgtttcttgaatggttgtacctgaagtgtgtgatcgtgtttgatgaaaaggggggtggaagcccccccccctttgtcctccgcagattcctctgtggtgagaccgttctgtcaagtacttggtgtgtttgtgttaagtcgccacaatagatgttgcgccctccggtaggagggccacctccgtcgtgtgtgattgagacacccctttttatgatgtgttgaccaccgcttgttctctaaaattgtggtcttgtgaacacaacaacactcgtgtttgttaaaatgctgccacctctttgggagatgctctggtaatatataaaggttgtgttatagacgcctcgtgtagaaaacacaacacgtgggagaaatatttgctccacctcgggagttcttcacacgttggatatgcccacataatggttgtttatatctcccacgcggggggaggagataaaagttttaaaaaggggatgatgccccacatattggagaatttgtccttttctcggggttcacacaaataccactcatgggccacacacctccacatatacgcccctttttactccttggagaggtgatatttttataggggagaaatatgttgcgcccttaaaagatcgtggcgtctttatatatattttgggtgtgtgttttgtgtgttgtttgcatcttctttgttgtgggcgctttttttggagagtaaattatgtgtgtatattttatatgacacccaatatatgcctctggccccacaggtagaacactcgcgtgtgttttatatgtgccactcttggcttttttgagaaagccactattgggggggggtataaaatatttccactctggatataaaatataatgagtattgagttaatatgtggaagtggtgtttttgtttgtgttaatcccccttacgcccaatttgtccctcggccacgcccttgcttgaggtggtgaattttgggaaacactttggctttcacggaattaataccgaggttctaactggggagtaaacacatgtctcacacttgggaaagctatgtacttttaaaatgggtggcccaaaggtcacaactgtaaatgagagagtaaatatccctcgcctgtgtccaagtcagactttgagctgatcctgaataatataagaccttttacccttta

SEQ ID NO: 486540 - DNA, 250 bp, Homo sapiens
  misc_feature (5)..(5): n is a, c, g, or t
tcgantcggtacctcataggtcgcaggaataaaatatgaagagtttgctttcacgacatcacacaattggcccaggcatggcggctcatgcctataatccctgcactctggaggctgaggcaggaggatcacttgaagccaggagttcaagaccagactgggtaacatagggagattcccagattcccgtctctacaaaaaatttataaaaatgagctggacatagtggcacatgcctgcgaacctatga

SEQ ID NO: 486541 - DNA, 790 bp, Homo sapiens
ggctgacgcaggagtatcacttacatctgggagtcggaggttgcagtgagctgggatcgcgccaccgtacttcagcgtgggtaacaaagcgagactgtctcaaaaaaaaaaaatacacgtgtagatgactctttgatggcaccttggctggggagagatagagctgggtggggctggacgtgggccttacaagggactttaaaatatatatatattttttctcttgagtcagggtctcactgttgcccaggttggagtgcagtggcgcaatcatagctcattgcagcctcaaactcctgggctcaagctatcctctcgcttctggcccccaagtagctgggattacaagtgcctaacaccattgccgtggcttaaatttaggtactattggggtaagagaactaggggttaacacacatgcttagaccacaggatagaactcaacaacactcatgactcaccaggaacgcctagcaactgatacacgaacacaccaaagcagctgcagactcacaaggtgatacgccaggaaacaggagcgcgaagagaaccagagaaaacacgggaacagagaaaagaaagcagaacccgagagagcaagaacagaaacaagaaaccagcaacccaaacacaaaacgaacaaagcacgaggaaaaagggagagacaaccaaaggacgacaaagaagaacgaaacaccccaagcaaacacaaggaaaaagaccgacaagcaccaaaaagaaagaaccaaagaaccgcggaagacaacagaccaaaaaaaacaagaggaaa

SEQ ID NO: 486542 - DNA, 1001 bp, Homo sapiens
gcgtgccggggcctgggtgcccccctgactgaggaccagcataagcggcttagtgaggagatcgagaagaatgtggcagggagctggagaagctgaccctgcgtggtagaataagcgggtgctccctcactgccctgctcaaccaaagccggcggagagcgccgagggcccccaagtgacggcacgaggcattggagaaaggaggttcaggctcttcgggcccagctggaggcgtggcgtctccaaggggaggctcctcattagttgcatctgatgatcccagtgaggatggctcatcatccccccgtggctaccatctcacaggtaggcatgtgaagctgcagcctggcagagatggagtcctcgcaccagcaggtgatggaggagctgcagcggcaaccacgagcgggagctgcagtgcactgcaagcaggaggaaggaggtggctcctggctgaaggagacggcaagcctacgtgcctctatgctcattgataggtccagtgatctaaggcctaccagggacagagcgtgagccagaggagcgtgatcaacacacaccggttgtcgtccagcagggtcccggatgggccctccgagaacgcaagcaccagttcacgattgtggaggcacctgaagcggagagcttggagagtgggtattgggagccgtcctcgcatgaaagtgctggagattggggcactcatgcggcaaagcttgaggagcgtgagcacaccgctgcgccgtgccagcagggaagggccaggagctgtgtgcacaccaggagttgatggccgctgtcggagaggataaccagcttgcacgggtcattgcttcgaggcttgccattggtgcggcgccgcacgagcggggtctgcaactaagtttgtttcggtaaaaaagacccgcctaaagaggggggccgggaggccatatgaaggaggccccgaaacagttttagcgcccaagtgaggacaagaacgctatgcgcaagagaaagtg

SEQ ID NO: 486543 - DNA, 245 bp, Homo sapiens
cccggcttaggtgggtgggatggaggcgaccttgggaatagcacttggaagacacaatgaagaatccctccattgttggagtcctgtgcacagattcacaacgagccacgccaagtgccccaccatgagcacgccacgagccaccccactgggcgccttgctgagcccgacgagctccgcggttccccccgggtcttcctaccctccatgctgcgatccccttgcatcttgggcagatgcaggat

SEQ ID NO: 486544 - DNA, 149 bp, Homo sapiens
gaatcacctcccattccgataaaatcaccttccaccgttactacacaattcaaagacgccctcgcttacttctcttcctgctctcctgaatgacattaacactgttctcaccatacctcctaggcgcccagacattattaccgtagcca

SEQ ID NO: 486545 - DNA, 101 bp, Homo sapiens
ttcacatagtcaaaatttcaccactaaaacccagcacttagctaaaacctcatttttaaacattaacaacaaaaaataaattgtaaaaaaatatttctata

SEQ ID NO: 486546 - DNA, 314 bp, Homo sapiens
cagaggattacaaacgcagagaggagcatagccctctgtatctccaggactgttggttctttctcctgactcctgtggttttgctacatggtactttacagactccatggagatgtcaggtggaccatcttctagggcccagcaggagtagggaatgtgccaaaagactgcccaggttgccgtggccttccccaccccccagatctcctgagtcatcatgctgtgctaatgaaagggatcatatcatcctctctgcgtttgcaaacgcagagagggaccataatctaatagtaacaacgaccctgcacctaaat

SEQ ID NO: 486547 - DNA, 321 bp, Homo sapiens
aaaaacccccaattccctttttttttttggtccggggccccggggcccaggttttttttttttaaaatgggtttaaaccccccaaatttaagggggtttttttaaggttgggggcccccccccccccccccccccaagggggggggttccggggttgaagggttacctttttttttttttaaattttggaccaaaaaattttttggggttttaacccgccccctttgggacccaacccgcccttttatttttgcccggccccattttgtttttggggggcctggtttttaaaaaaaaaaagggtttccccctcccctttta

SEQ ID NO: 486548 - DNA, 1070 bp, Homo sapiens
gccagaggcttggcctcgctgtgacccttgtaggcggtacacagcgcgcagatgcctgccgatgcagctcgccgcgcaggccaggccgtacagcgtatcggtggggactggccaccatcggcgccggctgcgcagcatcggccactggctggcccgaagcgccctcgtgtcacagccgtgcagctgctccgtggctcgcaggcctgcacggacccgtgtccccgggagccgcaacatgccgtggcgccgggggccgccggagcgggactcggctgaggcggaaagaggcagacctgatccgggagccagcaggcccctcgactcaaccccacgctggctagccaccgtcggccctcatcccacctgtcaccgacagcgccggagacatccgcccaggcccgccttccgggcaggcaagtgacgctcccagccagctatccgggtaccagcgcagactcggccccgcctcttccgccggggccagcttcacaagggaccaagacccccaggaggatctgaagggagcaccgagcagggcatggccgcgccgctgcgacccgccgggcaccggcgccggcctgcggagcaatcggcaggcgcaggcccaccccccacagccgccccctgggaaggacgcgccgacccaagcagcctgcctggaccgcagagtggatgcaacagcgacgccgggcaccatccactggaccaccaattcgcgagcccctgcgaagggcagactcgctcacgcgcaccctgaggccgcccggaacacatgagaggccccgcctaggacgcccggcgaccgccctcagcccaaaacctgacagacgcccccccaacccggcgggctccgaccacaaagaccggcatcacccaacagggaatccctgccccagtcgatgcttccggcgtcccctgtccactatcccgcaagcagaaattacccgtaggttgttttccctcaccactgaccgttgcttctactctcaaccactccctacctaaatgggcaccacctacatggactgatcgacagtctatcccagccgatgggccacttcctcacgagg

SEQ ID NO: 486549 - DNA, 230 bp, Homo sapiens
gctgtcacatgtgccatttgcactgattcgccttcctctaattgattcgaatgggattcccaatctcattccttccactggccgttctcattgatatacactttcatatcggaacggagccgatgataatataatacgctccgcgggcgtcgatctcggccagtgcggcaacggagaaaaagcccaaatcccgaatacataggtcattcgggaaaatcgtgtgctgggca

SEQ ID NO: 486550 - DNA, 112 bp, Homo sapiens
cgtggctggacacgtttgcccagaagtgacgcatgccctctatgcccgaatcttcttcagtcgctccaggtcttcacggagcttacgtgtccggccactacgtgtccggcca

SEQ ID NO: 486551 - DNA, 819 bp, Homo sapiens
tgcctttgatcctcacacatcctgtattatggacacagtagccatgcttcacgggaggtcagagctgctaccagaggtcttgcccttaatgagcttagtgtcatcttgggatgctgtcatatgctgcttgtgagtgaaccagagaaacagccattgtgcagcatgagaaagccccaaaagctctgggatttacctccactttagtaataatgaatattcttagcatagaatgtgttatgtcattggaattaatttgtgactacacttgggctgtgggagaggaattattttaaatagacattgatggtacttttggaactgtgatagctaaagattctaaaatgcatgttttatactaagttttaaccagtcaggaaaattttatgtacctagtgatagttcattttggtatgactttggtttaggctgcaagtgtttagcttgtgtaaactcctcactctgtgctgtcttaagttcattactatgtttaatggctacttgcaagatatttaagcattgttacaacagcccagggtttctgtttaccaccacaacacaccgggtccatattgacggtgagacttaccatacccccgttgtgtgccaagccggaatggggggtctagatggcagatccttcgtacttggtcctgtctcccccaacacaccacaccaacacacacactgttgggggcggcccgaaaatttcaaaacccttttgggggcggcccatgatcaaactgcacggtgccaagagcctgggtcaggggggtgtccccaaaaacgcggagcggtgcacccagcggtggttggtacagc

SEQ ID NO: 486552 - DNA, 333 bp, Homo sapiens
  misc_feature (27)..(27): n is a, c, g, or t
  misc_feature (232)..(232): n is a, c, g, or t
cctgtatatatatattcattctgcagngttgctgaattaaaattctgctggactttataacatagcaaatccgatgtttataaactggtaatcaaaaaggttttttcttttaggtgagtgggaaagtattacccttgttttaaatatctaagcaatgcctatcaacccttttttgtgttatgattacgtgggccatatttatgaaaaaaggcttgtgttctactcttgctgnggagaaaaggggacaaaatttacttttgaaaaaaaatgctttattgcacctaattatttatttttttaaaaagccttaaatgcatctattttggaaaacct

SEQ ID NO: 486553 - DNA, 539 bp, Homo sapiens
  misc_feature (11)..(11): n is a, c, g, or t
  misc_feature (135)..(135): n is a, c, g, or t
  misc_feature (144)..(144): n is a, c, g, or t
  misc_feature (271)..(271): n is a, c, g, or t
  misc_feature (326)..(326): n is a, c, g, or t
  misc_feature (337)..(337): n is a, c, g, or t
  misc_feature (366)..(366): n is a, c, g, or t
  misc_feature (383)..(383): n is a, c, g, or t
  misc_feature (388)..(388): n is a, c, g, or t
  misc_feature (392)..(392): n is a, c, g, or t
  misc_feature (419)..(419): n is a, c, g, or t
  misc_feature (458)..(458): n is a, c, g, or t
  misc_feature (475)..(475): n is a, c, g, or t
  misc_feature (489)..(489): n is a, c, g, or t
cgccggcgcgntcgcagtctccacggcgcaggcccacggtagcgcacgcgctctgagtagaacttcatggaggaacacggaggaccccaaaccgaacatatggctaccatagacgcacatgccgtgcgcccagcnagtgcagcnggtccatgtggctacttacaccgagcatagtatgctgagtgctgatgaagactcgccttcttctcccgaggacacctcttacgatgactcagatatactcaactccccagccgctgatgaggtgacngctcatctggccgctgccggtcctgtggggatggccgctgctgctgctgtggcancaggacagacncggaaccggcctcctgtctttgcgtctcntccctctctccggccgnggccncacncccgtttgcttcggccccttcgggccncgttcggtgcctctcctcctcgtgtggggcggcccgctnttgtcctctgtctctcnccctcccctcctcnccctgtctttcacgtgtttggtgccgcgcctttggcgactgtggtgcgtc

SEQ ID NO: 486554 - DNA, 108 bp, Homo sapiens
tgcgcgcagccattagagcagaggatgagaaagaaggagcttattgtttgtttttggtttaatcacaagattagttaagagaaggcaaaggcatgcacatttcacttt

SEQ ID NO: 486555 - DNA, 179 bp, Homo sapiens
atgaaagtcaaaaatgggggtcatttatgtcagtggcagtttgtgtagttccagtagtgactgatacacactcttttcgccaaatgtaatgcacactccattgcattcagcccgctctcccagtcatcacagtctggtttcttgtgcatgataggaggggggtgcatgataggaggggg

SEQ ID NO: 486556 - DNA, 117 bp, Homo sapiens
accgtgtcgtggctcatggccctaataggggtgtgtctgcaggaactgcactgcatggggcccacagccctgccccacaagcagctttggtctcgtttgctgagaccgcttgctgtg

SEQ ID NO: 486557 - DNA, 151 bp, Homo sapiens
tggggggggggcccccccccccccccctccagggggtggggggggggggggggggccccctttttttttttaaagggggccccggggttttcctttttttccccctcccccccccccctttttttgggggggccttttttttttgggggga

SEQ ID NO: 486558 - DNA, 332 bp, Homo sapiens
ctcatcgcttggtgttaggagctcctcctttgtcttatagcaatctgcgctaccccatcatcatcacagttactgtattagaactgattttataacggttactttcttgaggaaaaagggattttctttttcagttttacctcttgtgcctagtccagtaaccggtacctggtaagtcctcaatgtttattgaggtaataaactcaaatacttgcctttctggtcatctcttggagtaagagatcagaagatggtggagatgttgataatgacacaaagtaccttgctatattccaaagaggcatagccacaaacatgtacttttaaaaatt

SEQ ID NO: 486559 - DNA, 413 bp, Homo sapiens
aaagtactagaaaatacatacttgccaaaaagcttccatctggaatgacacatcactttcactcactctccctctctctccacactggaagtctgaactgggtgcctgttacctgtcgaggttactggcagatcaccgtggacagcatcatcatgaacggagaggccatcgcttgcctagagggctgccagcgcatttgttaacacacggcacctactctgcttgacctggcccaatccagcccctattgccaacaatccatgagcgacaatcggagcccagcggagaactcatgatggcgacattggtggtcagcttgctcagaccatcaagcagcctgccccgaccatcgtcattcacccatcaaatgggagtcccagtacccctgtgccacccaagtgccctacatccct

SEQ ID NO: 486560 - DNA, 192 bp, Homo sapiens
acgattgggggcatcaattgaagttacagattcgttcatttggtctcagggtttgtcaataatatttatattaatgggctttggtgagggaggtaggtgttagtttgtgttaaatattttaagctgagtgatgaggaatagtgttaaggagtatgggggtaattatggtgggccatgccgaccagcgatcga

SEQ ID NO: 486561 - DNA, 262 bp, Homo sapiens
acaggatctcatacatgtggtctagctaacggttattagcctgacaaaaacaaaggctcgtacatcattatacttgcaaagttttctccagtattaattaatggtatgtcttacaaggctttaatgctaactgaacactctgccacattaattacatgtgtaagatttctttccggcatgaaatctctgatgacgtacaagatatgaattgtcgcggaagagtttgccacattcattacatttgaaatgtttctctccagtg

SEQ ID NO: 486562 - DNA, 266 bp, Homo sapiens
  misc_feature (251)..(251): n is a, c, g, or t
accgcatactcggcttcaagacttaaactttagattcatgctattttaaataatatttaaaactgttaactctggagttcccatcgtggctcagtggttaacgattctgactaggaaccatgaggtagcaggtttgatccttggccttgctcagtggattaaggatccggccttgccgtgagctgtggtgtaggttgcagacgcagctcggatcccgcatggctacaactccaatgggacccccgagtatngcggtcgggtaccga

SEQ ID NO: 486563 - DNA, 304 bp, Homo sapiens
cccttaaaatccctgcattctttcggagaaatacgacagcaggcaaggtgaattgtgggaccttacaggtcttcatctataggtaaatagggcatgttggagggaggtaaccaggtaagacttcactgtcagcaccgacttgtagaatatcagataaccatttatttcggagcaagagcttcctatagccccgggaacacgcacttgctcaaagtcttgaggtgggttctttttgagacctttcagctccatatatccaaatggtttgtgcggcttgagtaccatgatttctagggtggaacag

SEQ ID NO: 486564 - DNA, 747 bp, Homo sapiens
agcggtaagcgggaagcgagggcgaggggtaggggctggggaagggcgagcgggaggcgcgggctctctctagcagggggctgcagccatgaagaggctcttagctgccgctggcaagggcgtgcggggcccggagcccccgaaccccttcagcgaacgggtctacactgagaaggactacgggaccatctacttcggggatctagggaagatccatacagctgcctcccggggccaagtccagaagctggagaagatgacagtagggaagaagcccgtcaacctgaacaaaagagatatgaagaagaggactgctctacactgggcctgtgtcaatggccatgcagaagtagtaacatttctggtagacagaaagtgccagcttaatgtccttgatggcgaagggaggacacctctgatgaaggctctacaatgcgagagggaggcttgtgcaaatattctcatagatgctggtgctgatctaaattatgtagatgtgtatggcaacacggctctccattatgccgtttatagtgagaattcgttaatggtggcaacactgctgtcctatggtgcagtcatcgaggtgcaaaacaaggctagcctcagaccccttttactggccatacagaaaagaagcaagcaaactgtggaatttttactaacaaaaaatgcaaatggaaacgcattaatgagtctaaatgcacagccctcatgcttgcatatgtgaaggctcatcagagatag

SEQ ID NO: 486565 - DNA, 81 bp, Homo sapiens
agcggggggttggcggcccgagcggctgcagttgcaggggcgggggaggcggcggcggggcccgggagaggggtggcgtgg

SEQ ID NO: 486566 - DNA, 129 bp, Homo sapiens
agcacgaatgtggtatggaagcgtagatgaggggcgatacacaagcgaacccaatcccgtactaacgacgctgacgggctgcgttattcagacttacatgccatggtgtgccgataaaaaaattactcg

SEQ ID NO: 486567 - DNA, 103 bp, Homo sapiens
tatagttataaatttctctgtgtgatgatcagtttatttaggtctatgtagcgataatgttcttgcacttagcatctaaagagacatattttcatattaaaag

SEQ ID NO: 486568 - DNA, 147 bp, Homo sapiens
atttgggagccggtggcagtacattctgtcaccgtctggctgagctggaaaactggagacagagcttctaccacctgatttacagcttggcgtggtttgagacacaaatcacccgagagagcggctcagttgtagtctgcagatgcg

SEQ ID NO: 486569 - DNA, 630 bp, Homo sapiens
agggactgtgttgccatatttacatgtgtaccccacagcaaacaatgtgattagatattatggttgctgttcgagtaagtgtctggtgagtgagggctatgtggcttctactgtgatcatcagattaagcctcccgtctatggtacgcactatttttgcttcccaattccctacgatcttgtctcctaaagatgcactggccgccgtttacaatgaggtggatgacttctgatgacatcaacgcacagcacatttcactgtgctgagactgcttcccctggctgctggcagaggcagaggtgaaagacactttaggacttgaaaacacacggtccatagtaaagaagagaaaaacaagaaaacagccacaaggaagcctgaaaacaaaaaatgtaccgaagcgtaaagctgttcatgtttccagccagttcatgggacagttactcagggtaacaggccacctccacggcttcccccacataccacctagtttcactagagaagacaactaaatcattatgggctggttgggttccctctgccattaggagaaaacacttttgtttcattcattcttggcaaaatacttcctctgagtaatctttcacttgctgatgggagcaagacttg

SEQ ID NO: 486570 - DNA, 275 bp, Homo sapiens
tacatctggcgagaatacgtgataaagtctcctctctgcttggttcggtggggatctcggggcggcgggaatccagcaaagccttaggaagggaaagattggctccagaaggtagtccattcagcaggtgtcggctggtgatgcccggttctgtgatggtggcctccagggcactgatggaggaggggaagatataggacggctgggaggacctgggggcagctgggggcgtgccagggagctgaaggcggtggcgttgtatggctcagcgctgg

SEQ ID NO: 486571 - DNA, 608 bp, Homo sapiens
  misc_feature (3)..(3): n is a, c, g, or t
  misc_feature (91)..(91): n is a, c, g, or t
  misc_feature (100)..(100): n is a, c, g, or t
  misc_feature (112)..(112): n is a, c, g, or t
  misc_feature (161)..(161): n is a, c, g, or t
  misc_feature (163)..(163): n is a, c, g, or t
  misc_feature (170)..(170): n is a, c, g, or t
  misc_feature (183)..(183): n is a, c, g, or t
  misc_feature (200)..(200): n is a, c, g, or t
  misc_feature (202)..(202): n is a, c, g, or t
  misc_feature (208)..(209): n is a, c, g, or t
  misc_feature (219)..(219): n is a, c, g, or t
  misc_feature (232)..(232): n is a, c, g, or t
  misc_feature (242)..(242): n is a, c, g, or t
  misc_feature (315)..(315): n is a, c, g, or t
  misc_feature (378)..(378): n is a, c, g, or t
  misc_feature (524)..(524): n is a, c, g, or t
  misc_feature (565)..(565): n is a, c, g, or t
acnttgtaaaattgatttaactggtttttacagaaccatagcagccaattatttagaaacaccacctgtcctttatattagagtacctgcnccagttgtntttgttatagtntgaagcaacacactgttcatggtaaacactctattttagtagataaatntntgaggtntattcgaaaagtntcttcaagaagaaaatntnttagtnntttgtttatnaaatcagattctnataggtatanttatatacattattttcaaatatacaaattatgtgctaaagtaaaagggataaaatgtcctttagttcaagcnaatcttctgttggtgttattcagtgtgcacgtgtgctaggagatgggtcctccatgccgagantcaatcctgccggcttctagcaatgccgtattttctcctgcatctcctttaaagctgggatcacactgtggctcagattcagcaggggaggctgatggtggactgctctcatcacttccgtcatcatctggtaaagctagactcanaatttgcagctggatcccttccaggaggagattctggagcnggcatctcctgtacatccccaggctctccccaatatcctaggg

SEQ ID NO: 486572 - DNA, 106 bp, Homo sapiens
gcggccgactactactactactgctcgaattcaagcttctaacgatgtacggggacatgccactgcactccaccccaggtgacagagtgagaccctgtctcaaaaa

SEQ ID NO: 486573 - DNA, 195 bp, Homo sapiens
gcgcacgccaagtgcagaatgagcccttcgctggtggagaggacggcaccactctgtctcatgcgggccagagcctacagcccggtccacctggctgcgtgaggcgcaggcgtacaccaccacatggacctgcagcccccggtctaggaggcccagggtcgctgctcacagatgcaggccatgtgcctcaatgcc

SEQ ID NO: 486574 - DNA, 914 bp, Homo sapiens
ggagagaactagtctgagtttttttttttgggattaaggttcgaggggaaatgctggaaatggtaaggggtttggagccttttcatataaggtaatgctagggtgagtggtaggaagtttcttccataggaggtgtatgagtgggccgtagcggaatcgggggtatgcggtccgaattcataaaaacagggaggttagaagtagggtctgggtgacaaaactatgttgtggacaaagtccagggggcaaagctcgcgcacaaagagtgtggtgccctaaggacagcatcggtcagcgggcacgagggtcgtcacatccatcacacaaatggtcgggggtaatcccgagactcatcagccacagaacacagcggcacacaggggggaccacaagcgaagacgaacatacccagcaagagtgtgaaaaaacaccacgtgcaacaacaccactaaactctcgacgggaagcacacctcaccacgcactcatgcaggacaagagaggctcacacaacgagggagcatataccacgaagaaagacggagacacaaccagagaaaacaacagtacggtgcagaacgcattaccaaactccacataataaaaagtgagcgcaaaaagggggctcaacgagaactatgcgcgacaaagcagcaacgaactacaactccccacgagaagggcgcgcaaacaccactatcggagaagcatacaaggagcgaaaaacacaaagaggagtattgaagacaaacaacgaacgcattatcacatcgagatacacagcacgccacaccaactcaactcatccccgacccaacacggctggccacagacagaacacaccaagagaacacacagcagacagctcgaggcacgccagagggaagcgcagcacacccccaccacgacacaata

SEQ ID NO: 486575 - DNA, 485 bp, Homo sapiens
gaagttatcttgctgtattctctgagcttattggatctctggtttagtgaatggaaattctcagtcattattgtttcaaatatttcttctgttcctttctctatttcttctacttctgggattctaattatgtgtatgttataccttttacaattataccacagtaattggatattctatttcatgtttttcagtattttttctcttcacttttcagttttggaggtttctattgaaatgccctcaagctcagaaattctttcctcagccatgaccagcctactaatgagccctttaaacgcattcttcatttctgtttcagtgattttgatttctagcattgcttttggttctttcttagaatttccatctctctgcttacaatcccttctgttcttgcattctgtctactttatccattagggcccttatcctattaattgttttaaatcatagtatgataattccaacatccctgccttatc

SEQ ID NO: 486576 - DNA, 129 bp, Homo sapiens
tgggggggggggaaaaagggggggggaaaaattggggttggaaattaaaaaaaggggggggggcttttttaacacagcccgcggggggattacaatagggagtggaacttgaaaaaaatcgttttacaa

SEQ ID NO: 486577 - DNA, 122 bp, Homo sapiens
gtctgatagtcaaacagtaagtgtataagtttcgggttagatggcggtcctggtgcagtaggtctcatgcctgtcatcccagcatcttgggtaaggtgggaggatcgcttgaagccagagtt

SEQ ID NO: 486578 - DNA, 275 bp, Homo sapiens
  misc_feature (14)..(14): n is a, c, g, or t
  misc_feature (22)..(22): n is a, c, g, or t
  misc_feature (74)..(74): n is a, c, g, or t
gacggaccaacacngacaacgngctagtacaaacccaaaaggctctgcttagagctcagaggcagcacgagatngggagagctggatgacggttgctaagagaattcaagctgtcaggtcctcctgtgtatccttgggattctgttatgctgttgcttgtagagggaaaaagttcatgcgtcatttatatacaagtgcccatttgacattgagtgggtcacatttattttaccctatatgaacacaaaatctctgttttaaaatcagattctaga

SEQ ID NO: 486579 - DNA, 795 bp, Homo sapiens
tggggacggagtctcgctctgtcgcccaggcgggattgcggactgtgcaggtgggcgcagtctcggctcacttgcaagcctccgctttcccggggttcacgccattctccgtgccgtgtagttcccagcttgctcgggaggctgaagcaggagaattggcttaaaactcagaagggtggaggttgcagtgagctgagactcgtgtcatgtgcacctccagccgtgggcgaaagagcgaaacctccatctcaaataaacaaacaaattaattaaacaaaaaaacaaaaaattggtcggcttttaacaacaaaaaaaaaaaaaaaccctcggagggctttctatagtgctcggggggcggcgcagacaaaagaggtgtaatggcaatgggcgcccagtgggccaataggtgtggttctccgggaacccaggtttttctgggcccaagggggggaagactcgggcgcggcgtccccccaaatgggggaggccggcataaattccagaataaccgccagggtaagcccctggcttgatgacatcgcggggaaaaaacctcatcagcgccatggccaacgccgaccccaccaccacacaccaccaccccgagccgccacccacgctcgtcctcccaacccccatcgcgtatccgaccaaccgaacgacccatcacacacacgactcacccaccactgccccccacacgctaccacaaccccgcctctctagcaccctcactccccccagccgccgccgccatcgccagagacatcaaacccgaccgctgcctgacacaca

SEQ ID NO: 486580 - DNA, 106 bp, Homo sapiens
  misc_feature (102)..(102): n is a, c, g, or t
ccaatatcacttgtgccaactgtatatccgcaaatatatccacttttccacttcaattttgcactttccggaggaaatgatcacctcaccaccgaacaagcntttt

SEQ ID NO: 486581 - DNA, 853 bp, Homo sapiens
gcgcccgggccatggcggcggcggtggcgggagctgctgtctgagtcagtctgtgttgcggaccgacgcgacacttggcccagtgagcccgggcctagtggatgatggcgctggcgtgcgtgcgggacgcgcgacacggctggagctggccttcttcgccttctcctcgtgctgtggagccctgggtggggggtctgcgcccggtacaccatgtactgactgccgtgcagaatgcccagtaatgccagcgaaacgtgggtaactgagtctgtatgagctgcaccggtaccccgtcgagtgaaagaccataatggtatggtcacatgcagcattgctgtttccccgtcgtggtcacatgccattcagaagctcagtgtgccctatctgcctggacatgctgaagaatacgatgaccactcaaggagttgcctccacagagtgctggtctgactgcatttgtcacagccctacggagcggggcccagcgtgtgaggcgggcgaataccaagggtcagattcagaccacaaacgatgagggggacggggaaggacgagcccggggagggaagaaggggatggacgaacgatgtgagctcagactccgaccctgactctgcccaggccctgcacccaagcgaacccgtggacggggcgcagcggggaggcagtgtagggacagggggagcgcgggactggtgagggcgggtgcggcatgccggatcggaaaaactctggtgacccgggccgggactcctgggagcgggacggctgagcacaccaaaggcctcctcgggagcacgcagacccctggatccagaagctgaagttgacgcacaggaacgggcccacccct

SEQ ID NO: 486582 - DNA, 528 bp, Homo sapiens
cagtctatccaccttgtgtgccttttagtggagtatatttaacaatagtattctgaagaccgaagaacgggaataatgattctgtaactaaagaaagggagagatttaatcaatttcagtaagaggaggaaagtagctgaaatgacggaagaaattcagcagtatcagaatcagccttactgtttacggatagaaccagatatgaggagattctttgaaaaccttaaccccatgggaagtgcatctgaaaaagagtttacagattatttgttcaacaagtcactagaaattgaacctcgaaactgcaaacagccacctcgatttcctaggaaatcaactttttccttaaaatctcctggaataaggcctaacacaggccgacatggctctacctcaggtactttacgaggtcacccaacaccattagaaagagaaccatgtaaaataagctttagtcggattgctgaaactgagctggaatcaacagtgtcagcaccaacctctccaaatacaccatctactccacca

SEQ ID NO: 486583 - DNA, 650 bp, Homo sapiens
atattttcttattatctaaactttaacaagaaattattaaaattactttaaagcaagaatagtaagaatgtacgcgtggcaacccgctacacaaactgctacgcacgctaccaacctatcaacactcacgctaccacgctaccacaccctacctcgccactctgtcccaccacatactcacaacactactaccactgcctgcactaactcgactactcacacgacacttgctactcccacactcctaccactactgcactaacctctctaactatcgtcactatcctcactgccctctacctacacatccatgtatcaccaatatcaactccatatatcaacttatcaccacaccaccatatctattctataccagaaatacaatcactcatcaatctttctactactcttacactattcaaaatcacatacatctcttactaacaacagcctacccatactcgtcatcactttcattctcaaaacagcacatgactactaacaaacaagcatccgacaacagaacacaccttgcagaactcaaaaacaaaaattaacttaccttctgtccaactctataaccttcagtccatcatacaacatcacgacatcaaaattagcaaacaaacacatactccccaccaccaagt

SEQ ID NO: 486584 - DNA, 1125 bp, Homo sapiens
gctgcatccagacttcctcaggctgtggctgttacgctgcgcatctggtggctttaaacatacaaagggattgccaggacctgctggcggcgggcggcggcggcggagggctgggtctgcaggcggccaggaccatgagcctgctgagccggggcaaaacccctaggccacctgatgccagcggaccctcgcgagactgcagccctgcgccgcggagcaggctccaaccgagtgcggccgaggcggccacacgcaccgagctcagctgactccccgggcgaccgcgcgtgggcccacgtggacgcgctactggattggatttgcgctatttggcccttgttgggcgcttcagcgggttccccttggagtgtgctgctctgttctccccttgggggctggtcttgcttgagtggccatctgccgcctgtcttgcgcttgtatcgttcgcattcaatttctaaggttttctcccgcgagtcgcacttgatcggcgcacccgcaaaaaagcggtgacgcaaaacgtaagattgggggcaaggctggaacattaactcttgaacccaacgcattattcgtaattgcgtgcttgccacccataaaggtgacgaaggccttgcgaagacccttgctcactgtggcttttgagcggttggaaccggcgacagctacgtcataggaaggggcattggcgctgacaaaggttaccttcaattggcgagactttgaccccccatcatgctaccaaatcgggtttgaactcccttttggacgctccgctaaaagtttacccacattcggtgacgcgaccccaattgctgtggagcagtggcctaagcgtgccgtatgaatcgggatagacaaacccgcagtgcagcttcgttgggtcctcaaatttaacaccaacaggtttctttattcccccgttcgggtcgagagtccccccgacgtgcttggggcaccccacggtgagctccaaggaatatcgtaagatcatccaggcggatttccaatctgtggcgctaagcagccatccgatggagattctggcggaacccccgagacacgaaccagggcgtggtccttttacatggcccctataggcctccgtctgcgccgtttccagac

SEQ ID NO: 486585 - DNA, 169 bp, Homo sapiens
ggaggggtgactcatgtggaaagagagtcagctgccaactcaaaacaaacgtgggaagaagagggcgcagccaggcccaaggcttagggcaagacactgctttttacaatagagggacatagtggacactctctgagttgcctgctgcgtcagaaccggtgtgggatgc

SEQ ID NO: 486586 - DNA, 814 bp, Homo sapiens
gggaaatggctgcgagatcctagaggcctgcggcctgcggagcttactccacgggaacagcctctaataatctgagttgttcgaaaatacgaagcctgttactcgtgaacagtggctgacaacagtgttgttgtgagcctggctgtctgcttggacccagaggtttcgtctgccaggtttttggttgtatttacggatttcagggcaaaagtgtccaagctttcagtgttggagcaggtatggacgacaaaggcgaccctaggcaatgaggaggcacctaaggacatcaaatccacccagctaagagttcaggaaaacatggggttgcgaaggacactatcgcaagcgagagggcgcatggggacgcggaggtctgaccactggagccgcaccccacaaggagtagctgggcctgttccctgcgggcattgggaggcagcccaagcgcaactgagcgcgtggagcagttcctgtacccattgcgcggcgccgccggctaggagggatgcactgcctgtctccctggagagattctggtgagcccacgtcctggccctgccacagactcgccgaagtacagcctcctgattgggcaggttgcgaaagtcgctttctgaccaccagaagcggccccagtcttgttccccacagcctgtgaatgaaaacgacccagctcttctgaaccaggtgaaaaggggccgggatgaaccacgcatgaaacctccggatagttgacattacgcatgcgccttgaaccttggaaggagcctatcagaaatcgccttcgccgtgaagctgggaacagggatcccag

SEQ ID NO: 486587 - DNA, 646 bp, Homo sapiens
taaggtttgagggggaatgctggaaatgtgtaatggggtatggagacatgtcatataagtaatgctaagggtgaggggtaggaagttttttcataggaggtgtatgagtgggccgtagcggaactcgggggtatgctgtctcgaattcataaaaacagggaggttaaaagctagggtctgggtgacaaaatatgtggtgtaagagtctcaggggagagtgcgtcatatgtggtccctaggaagatggtaggggtgagggtgtttattataataaggttggtgtatccggctatagaagaatatgggcgaatggggcctgcggagtattcgatgttgaacgcctgaaactagttcggacatccccttcggcaaggtcgaagggggtcacggtagggcactcggcaaggggggagataaatcatattagggcccagggtcatgaatggcacggagttaatcagagggtgttacaggagtcagagaacaaagcgggcggaaaaggtataacagggagccccactcaatagagttaccgggtgcaacgcacacaggcgtggcctcggggtggcctccatattgaaaatggacggggcaacctgccacaatggccgaaacaggcgaactgaacttgtgcccccggaaagag

SEQ ID NO: 486588 - DNA, 240 bp, Homo sapiens
tactacatttcatcgttccacaaatttggcagagtttgtgctgacatctcggatgttttcaccaacatcgtcgacattaatatggcaatcctcatcaaccttgatgaaatcgaccgcgggcttggcttctactttatgaaatgaccatgccagatccttttcgaaccatcttcttaggcatattccacttatttgcctaccaggctgtccacaacttctaaggattaaagagggagaatc

SEQ ID NO: 486589 - DNA, 121 bp, Homo sapiens
tatttgtggctagcgaactgaatccaggagtctgagaggcatctgacttgattcatatgaagccagatacattctccagatcagagtcacagggggtccattgggaggttgcatacacagt

SEQ ID NO: 486590 - DNA, 463 bp, Homo sapiens
gccctggtgtgattccgtcctgcgcggttgttctcgtggagcagcgtttcttttatctcctgtccgccttctcatcctaccctaagctgcgtgcctgcaacccgaatggaaagattcggatggaccattggacatgagccccctgtaggccccagaactatcttttacggttgtgaactaaaggccgacgaagattatccactttaaggtggactcaatgatgaacatgagcaccagttatctcttcaagaacccggtcacacggtttcacgggcgcttggtgttgcccacaacgcgacttgaagtttagccaccaatttgcttggaaaccgccaatgaagggccacaattgcaacatttaaccgacaggtgacaagtttccccaaacttccaaaacggttacaccacttggtgcccaaacctttctgaccacaccactcgttctttggtaaacaatggccca

SEQ ID NO: 486591 - DNA, 367 bp, Homo sapiens
gaggaaacttgcaaacactgaggaattgcaattctacttaacaggaatcattccatgactggacaataattaacccccctcccattgtcctgcctcgactgatctcaagaccggaccagtgggtaaatccccagtactgggtagtatctgcgctcactcgaagaaaagtcgggcaccctccaaacaagaaggccacacggaggttgtgccggagcacacaaagggcagccgccaacaagagcgggccaccgacaaacaacagggggacagaccgcccgccagaaacaataggcgaccgaaggagaagccagccaagcgaggcccacgccaacaaggccgcagtcgcgcccacccaacaaagctcaaa

SEQ ID NO: 486592 - DNA, 195 bp, Homo sapiens
gatctataggatcctgatgttcgccgaccgtttgactattctctacaaaccacaaagaacacttggaacactatacctattattcgtgtgcattagctgtgagttcctagtgcacagctctaaacctccttattcgagccgagctgggccagccaggcaaccttctaggtaacgaccacatctacaatcgttatc

SEQ ID NO: 486593 - DNA, 300 bp, Homo sapiens
  misc_feature (14)..(14): n is a, c, g, or t
  misc_feature (51)..(51): n is a, c, g, or t
  misc_feature (61)..(61): n is a, c, g, or t
  misc_feature (95)..(95): n is a, c, g, or t
  misc_feature (220)..(220): n is a, c, g, or t
  misc_feature (270)..(270): n is a, c, g, or t
gcgaagaggatttnatctgtgccttcaagaattccagaaagcacgcatgtntccatttaanttaggactgggtccccacagactgcctgcccctntttcagcagcaggggcaagctgggcagtgggatccacttgcattgctgtgcatccagagatgaaatgccatcagttagtgtagtcagtcacggcatgtttgtcctgcagtgcttctgtgaataantgcctatcctagcttagtagacattgagtagagcaccagcaatacaaatnttaatggtaccatctaagcaattcccttat

SEQ ID NO: 486594 - DNA, 358 bp, Homo sapiens
  misc_feature (318)..(318): n is a, c, g, or t
aaaataacaaaaaagaaaatcaaaattcaccttcgtcatgctgcgtccagtgccccaaccctgtggtcactctccccattttgtaacactgtaccaggtggtgactgtttaactctttggtgtctgtgctcaaaaaaatgccttataccagtgtccagtgtataagtgtgtaccctgaacccttgaccctcactccccacatgttgtatgtagccctattcctagcaccctagggagggacccatccatatccctagctatcatgggaaaccctaaaccacaatactgttaatgtacaaaatgcagtcaaaaatattnacgaaaaataaaacgttaaactaatcctcaaaatacaaaa

SEQ ID NO: 486595 - DNA, 718 bp, Homo sapiens
  misc_feature (29)..(31): n is a, c, g, or t
  misc_feature (42)..(42): n is a, c, g, or t
  misc_feature (45)..(45): n is a, c, g, or t
aaacttacggctaggtacgaggctgggtnnncgagttctggncgnataaaaaactcttccttctttaatccggtgtcgaggagttttgtgtgcgactcgtcctgctacatttcttggttacaaaaacctcttccttctttaatccggtgtccgaggagttttgtctgcgactcgtcctgctacatttcttggttacaaaaacctcttccttctttaatccggtgtctgaggagttttgtttgcgactcgtcctgctacatttcttggttccgtgaccgggaagcgaggtgattgaaggacggtcgaggcagccccttaggctgcttaggcctgccctgtggagcgtccctgcaagggactctggccagcttgagcgacgggcatcctgagagcgctcccgggtaggcaattgccctggtggaacacctcgtcagagcagtgtgtggcaggcccccgcggaggatcaacgtggtggctgaacaccgggaaggaactggcactagaagtctggacgtctgaaacttgccaacaaaaataacagcaatggggcttaaacagagcatacgcccacaaggacaaagaacacatgatggaggagacaagaacaacacagtcctggaaagctggagggaggaaggacacaattcagctgactttgcagatccaaaatgcggacctctctcagctggtacagtgggacgtgacaagcaactttttc

SEQ ID NO: 486596 - DNA, 545 bp, Homo sapiens
ccacatcctgggggaaagttcaaccaccctccatgcgcggggaaccccctgtgcccgcacaacccccgcggagaagtcgtttcttgccccaaacctcccccttggcagcccctccacagttgaacctgctgcgataccccggtgaacacacctttagtgagccccgccccgttgcccccacgaacccctctgggggcaccaccacaaccccgcggtgcggcaggaaccccgcagtgggaaaaaatcatctgcggaaggacggtcaatacccgccagggcttcgggcaccaggtgtgcacatcccccacggcgcgcctcccgagaactcgtgcgacacaaccaggggcgcgccgaacatcttgccccccacatactgtgttgggcacacccatgggacaccccaccgcgtggtccgtaagacaaggacccgagcaccccacagaggctgcgcggtgctgtcccccacccctgggaaggagaaacgcccgatctgttttttttccctgggagaaaaaattaaaattggggcccaccccccacaaaac

SEQ ID NO: 486597 - DNA, 246 bp, Homo sapiens
gactcgtgaccgctgaccttcctgaccgtgtctagcctcacacgactccccaccctcctaccctcgtactcctgcccgcctacgcctccccaactgtgcttgtgtgtgttaccactgtgcactgactgccaccctgttgcctgtgctgcaacacaccctcactttccacgcaccacacacaacacacaacaaaacaaaacacacaaacacacacacacacacaaacacacacacaacacacacaca

SEQ ID NO: 486598 - DNA, 340 bp, Homo sapiens
  misc_feature (128)..(128): n is a, c, g, or t
  misc_feature (146)..(146): n is a, c, g, or t
tcgtgccgaattcggcacgaggtgaaacatagcaagaccccatctctacaaaaaatataaagatcagccaggcatggtgtgtgcatctgtggtcatagctccttggggggctggggtggaaggatcgnatgagccctggagggcanggctgcagcgagtcatcattgcagcactgcattctagtcagggtgaaagagcgagaccctgcttcatacacaaattctataccacacacaaaaactctcacagctatgaatagtttatcttaattctctttcagaagcgtcaaattttcataaaacttagcccatttatacctctcttcctattgtctctacgg

SEQ ID NO: 486599 - DNA, 882 bp, Homo sapiens
  misc_feature (9)..(9): n is a, c, g, or t
  misc_feature (76)..(76): n is a, c, g, or t
  misc_feature (275)..(275): n is a, c, g, or t
  misc_feature (281)..(281): n is a, c, g, or t
  misc_feature (323)..(323): n is a, c, g, or t
  misc_feature (332)..(332): n is a, c, g, or t
  misc_feature (350)..(350): n is a, c, g, or t
  misc_feature (358)..(358): n is a, c, g, or t
  misc_feature (362)..(362): n is a, c, g, or t
  misc_feature (387)..(387): n is a, c, g, or t
  misc_feature (406)..(406): n is a, c, g, or t
  misc_feature (451)..(451): n is a, c, g, or t
  misc_feature (463)..(463): n is a, c, g, or t
  misc_feature (507)..(507): n is a, c, g, or t
  misc_feature (534)..(534): n is a, c, g, or t
  misc_feature (541)..(541): n is a, c, g, or t
  misc_feature (546)..(546): n is a, c, g, or t
  misc_feature (551)..(551): n is a, c, g, or t
  misc_feature (571)..(571): n is a, c, g, or t
  misc_feature (603)..(603): n is a, c, g, or t
  misc_feature (643)..(643): n is a, c, g, or t
  misc_feature (681)..(681): n is a, c, g, or t
  misc_feature (702)..(703): n is a, c, g, or t
  misc_feature (717)..(717): n is a, c, g, or t
  misc_feature (755)..(755): n is a, c, g, or t
  misc_feature (804)..(804): n is a, c, g, or t
  misc_feature (829)..(829): n is a, c, g, or t
agcgggctnctcctgcacacctccctcgctctcccacaccactggcaccaggccccggacacccgctctgctgcanggagaatggctactcatcacacgctgtggatgggactggccctgctgggggtgctgggcgacctgacaggcagcaccggaggcccaggtctccgtgtcagcccaatcttccagtcaggacaagttcctggggcgctggttcagcgcgggtcctcgcctccaatctcgagctggctccgggagaagaaggcggcgttgtnccatgntgcaagtctgtggtggcccctgccacggatggtggcctcaancctgacctnccaccttcctcaggaaanagaccagntgtngagacccgaagccatgctgctgcangcccgcggggtccctcggnctcctacagctaccggagtccccactggggcagcacctactccgntgtcagtggtgngagaccgactacgaccagtacgcgctgctgtacagctcagggcnagcaagggccctgtgcgaggacttccngcatggncaccnctctnacagccgaacccagaccccncagggctgagttaaaggagaaattcaccgtcnttctgcaaggcccagggcttcacagaggataccattgtcnttcctggcccaaaccgataagtgcattgacggaacaantaggactccccaggggctganngctgggatcccggncagccaggtgacccccgacgctctgcgatgtcttcttncttcttgtttcctttccccctgatgcccccttgcccccgtgctcccccngcccaaaagcacccccttgcccacntctgggctttcattccttgcacaaataaaactcccggaatgcaaagttaagcc

SEQ ID NO: 486600 - DNA, 393 bp, Homo sapiens
gtcacttgtattaaactacgatattttggatgacacagctataaatcttcggggtatgctagaatatgacacagaacagaatgtcgcgaatcaggacttgatatcagaaaacaataaatctatagagaaggtgaaggatggcatttcaatgaatgcctcagaattttcagagggtcagattgcacttatagaagcttagcttagtgaatagaaagcgaagtctgaatgccatcgggttcatgaagaatatgctaagcttatgaagaaccatgatgaggtgcagctggaaatcgaagactggagtcaagtacctgctgaggtcagtgtggaaatcaaatcattttgagaaaaaacccctttcccaaagggggcgccaaaaaaggaggggggggc

SEQ ID NO: 486601 - DNA, 762 bp, Homo sapiens
agcggagaaagtccgttggaaccgtcggctgctctctggtctctggagatgaggcgggaggacttgtggtgacagctgtggggacactggcccagatgctctgtgtcccagcagaagtgactggcgtgggaccagtgatgctggactggtcatgctcgatggcctggggatgcccaatggatgggcacccacaccagaagaccctgtgccctgggatgctgggtgctgccgatggcagaagacaccctgcatgcagcctgagtgtccctcagggacggacgagcagatgcctggtggacgatgcctgtcagttacatgcacgcatgatcaccatgccgtccaccaagacgctcgcgtgagacatgcagtctgctgctgggctcgatattccacagaagaactccgagagtcatataggatgccttgcaggaacgcagacaccgggagctcgcgagaacgagctgcacaggcctgcagcaggcagcagtgcgcgaagccgggaagaaacccgcagcgtccccacacgcggggcgacgaatcacacactctggcattggaacctgctagtggaacacaatttcacctctgtcagctgatgaagagacaacacccaaatacgctggccgcaagagtcagagtgccactctcctgggacaaagatgctcatctaaccacttagctcctccacaggtgaccctccgtgcttatcgtctgtccaggagcagcagagcttctgtacccaaacacacacatcccatcaga

SEQ ID NO: 486602 - DNA, 372 bp, Homo sapiens
tgtgagctccttggtgaaggaaggtcagcatttaccacattacctagagtttatacataatgaccaaaacctaagtttccttgggaaggtgatatgtttttattaatgctttattcaatttatgaagtatgcacatattcatataagtgtttctaaagcatagtttctcagccgggcgcggtggctcacacctgttatcccagaactttgggaggccgaggtgggtggatcacgaggtcaggagatggagatcatcctgggtaacatggtaaaaccccgtctctactaaaaatacaaaaaattagccgggcgcagtggcgggcgcctcagtcccagctactgaggaggctgacgcaggagaatggcgtgaac

SEQ ID NO: 486603 - DNA, 453 bp, Homo sapiens
gcggcctgtgtacagagctgggacatcggattagtctgtgtgacttggttgcacaggtcgttcctctatcagggcgcacagatgttcactcgggtagaatgaagaacagagtccgatctagaaaaaaatccaacatcttctcttatgcgcccctccccccccccacgtatctcacaccaccaagcagtcgacggtttgggagggggtagtgcagagatccaacttcatgctggaccattatgtctagagacatgtgaatgtctgaaaaactgccctggaaaatgccactattccaatgtgtgagtgtatttcaagtttttattctgtctagccccgaaagtgagcttaatggctggctggggaaaggtatgcattgtcagcagctctttaaccccaaggacctcaagatgaggttaagtttagtttgttcattgttgtgttttcctttttaac

SEQ ID NO: 486604 - DNA, 338 bp, Homo sapiens
aggccgcgcatacatgttgatgacacaaaagattagaatattctaaaccacgctgataaagcagaggcagggttagagaggaccaacttcaatttagaaagaagtatactgggggttaactgctatcaaatggcatggcatgctatggagaactctttcatgaaaggaatattcagacatgaccctgcacgggcaaaaagactatgactcgttgaaggctcagatgatcattaggatttattttatttcttgggagacggagtcccgctccgtttcccaggctagagtgcagtgacacgatctgggctcactgcaaactccgcttcctgggttcgggc

SEQ ID NO: 486605 - DNA, 398 bp, Homo sapiens
  misc_feature (362)..(362): n is a, c, g, or t
cacgagggcacgtccacgtagaaggccttgttgtaggacgagcccttgaataccgacggcagcgcggccaccgtcgccttgatcgcagccatgccgttgccggccacgaagccaccgatcatcagaccgaagatggcgacgtactcggcgggcacccacagcgcggccagactgccgtgcagtgcgtaggtgccgaccgaagcggcaaggatgatcacgtagccgatgatcagaaacatggaatttccctgtgtatgacggatgttcggggcatcaatcactgcgtgcctgctggtctaacggcaccacctcaggaaacttgaccaagtctgctgcgcaggtgaacagcacccgacgcacanaaaaatgccgctgcgggttgccccgcagcggcgagc

SEQ ID NO: 486606 - DNA, 103 bp, Homo sapiens
cgcgtgcgctatggccggcaagtaggcggacaggcccattcacgaatggtcggcgttgtccgctgcagcttcaggtagcggccagcgaacgagggcgaaacag

SEQ ID NO: 486607 - DNA, 899 bp, Homo sapiens
  misc_feature (899)..(899): n is a, c, g, or t
tgattctgtttcctctgctggcctgtaatggcaggaactcggatcgttctggttcttcagaccaggaggactcccaggagagaacggagagccagtgtgctgtgtgtgacggtccctggatgaacgttgtggatctggattgaattaaacaagacgtgcaaagcaagtggttcaccgagggtcttgctccgtcgcccattctggagtgcagtggcaagatctctgctcagtgcagccttgaactctcaggctcaagaaatcttcccgcctcagtcctcccaaagtgctgggattacaggtgtgagccactgtgcccggctatagctaacatttgattttttacaaagccaagaaaaaggaaacacttaacaaagcgcgcaacagattaacacggcgcacatgagcaagagtaacgtttggccagtggtttaactggttttggggccttaaaggccccaggggaggggtttaaggcggtatggggaacagggacaactacccttgtttgaaaggtggccccaatccgaatgggggtttggcctatatctcgcacccgctaaggcggtacggcgggcggaatttttcggaacgcccggagggtgtcccctgggccaagggacaaattggaaggcgtggccacggcgtcatccaggggtgacaaatcgggtggcaagtgccgaccttgtgtaaccttgagtcattcccaggctccgacttggggggaaagggcccggatggttcaagtggacggcgcaattgttgttcccccagctggaaaacgcggcccgttacacttttggacggagaggtgggtgaccaacaattagccatatgagtaagtgggtcccaacaagaagaaccgacttccctttgttggcgagaccgctatggggagctan

SEQ ID NO: 486608 - DNA, 149 bp, Homo sapiens
ccatcacgcgggactggccccatggaaaaaacaaaattctaggaactaagacacgactggggcaggaggctgggaaacttactaggaaggatcaaggtttgactttgccaccatgaacctagccatgaacctgatgggagcaagactcg

SEQ ID NO: 486609 - DNA, 377 bp, Homo sapiens
acatttctctcactacttagtgcaccacagctgatcttatggatacatcatgggctctcgtgcctcagttggttctgggcaatgagagacccaagggcaagagagatgatccccttaacatcgctactgtacccaagctctggtcatctctctatgcccttaactccttcctcttgtagcttacttataccttattggtctcttccttgtccaccgttattaaatttttctcagcttctctgaaggagtgtggaacctgttacatgtgggactccagctaatacaccactgataagcctataggaaggtcaggggtaattcagtgagctctgacattgcacacagagtttcatagtacaatgtctactactaaatat

SEQ ID NO: 486610 - DNA, 421 bp, Homo sapiens
  misc_feature (113)..(113): n is a, c, g, or t
cagtcgtaaaaaacagtaaaacacactttttacgcagccattttcaggagtcatttgaaactgggtacaccagtcctttgcctgccctccttccctccctttgccaagccctngaggtccatcccagtatcatttccttggtggggccctccctttttgtatcccagcctgcagcctttttttttttgaacagcaaccaaagtgcacgcctcaggactgactggtgctgttgcatcagctccttattttcccctccctggctgggagttttgagggcaggaactgtgttttgtgcctggaaagcacgagttcaacagctgctcactggatgggcctgcacggggccttttttacaaatacaaaaacccttgcaaggctggccgggtagcacccaaatgctattaaccctgctggtgataca

SEQ ID NO: 486611 - DNA, 1348 bp, Homo sapiens
tacccctggagccaccccggggcttatatttaaagggatgccaaaagcccccttcccaaaaccgcccaaaaggcgggcgcccagaaggcagcaggaccatatacagctctccttatccttctgggggcaaaaaggagggttgccgtggaacagtccgaggagcgtgcagggggggacgcgaaagaggctcccagacaacaatggctcaatggagcgaggccagcggcaagaagagggccaaggcagtaggcgcaagctccagagagatccacgtagaaggcgggcggacagactctcacactgtgaagcgcggcgaaaacaagacaccccttttgcacgacgcgacaacagcagaagcggcatgggaactctacgacacggacacccagcaacaccatatgcacgccatgacacgacacccttatgggggacaatagaggcgggtcgccaccaggagagcataataaacatacgcaactagagcgacaaacgctcccctgtgcaaacagactgcgccctgggcacacacagaaccaccgtgaggaagccccaaagtgcgagacaagagcgagcagcatagaaaaccaggcatcaccagaaaagcgcggacacaacaaactacccccgaggatcccataccatgaaaagtggctagaaagacccccacacaccacctgtgaaagagaggaacacgcaaaaacaaagggaggaaaactcccaacacgatgaacacactctggcgacaacacgccagagaggaggaccacccacgccaaaattcgtgccctcagtgagaggccaaaaaggggactagagagacataaaacaccatagcgaaaaaggccccaacccaaaaaaatggacgacaacaaagggggccaccacccagacagcaccaacaccagagaaaaggcgagaaaagacagcaacacagcaggaccaacatagacgccaccacgaagcaagaagcgagccccaaaccggaaacaaatacatgataaacggaaccacaaagaataacctcatgacaccacacgaccagaaaagcgggggagacacaaaccaaacaatgggagaagaagggcacaagaaagactctactcaagagtggcccacaggacaaaacactccgccaccaccacaagagcaacggcgacaggtgaacaacaagcagacaccacgcaccacagacgcaaccacaccgcatgaggccagacagaaaaaaaccacctaccaccacaagacggcacacccgatgaagaacaacaaactgcaaggccaaccaaccacacaaaaggaacgccgacacaaccacagtgatccaccccccacaacgcaacaaccacag

SEQ ID NO: 486612 - DNA, 136 bp, Homo sapiens
  misc_feature (56)..(56): n is a, c, g, or t
tcagctcggtaccgcttcttcatgcagtgtcaccagaaacaagcaccacccacctnttctaaaatagctcgtggtgaaagagaagaaaatgagaaagctggctgacgtgactaacacactgggttaagtaagcagt

SEQ ID NO: 486613 - DNA, 352 bp, Homo sapiens
ccgctactgacccggctactcgaatcgctgaggtgggagtatggctcgcgcctgatacgccctctatgaagccagcgctgactgcaccacggcactctgtctaacgagccccacagagagacagcctagacgacagatacatggaaccatgatcaggatcacccaagcttggacaggatcagactcgaacgggatgagtgcgacatgagcctatacagacaggtggcacactagtccaacagaaccaatatcatgcactcaccaatgagcatcggtacaggcgttgcaacgctatccctgatgaccaaggctgatactcacgatgatgacggcttccaagcttctccgtccg

SEQ ID NO: 486614 - DNA, 326 bp, Homo sapiens
ttccatatgattgaattttagaaatataataaagttcttttatgggccgggcacaatggctcacgcctgcaatcccagaaccctaagaggccgaggtgtgcagataacctgaggtcaggagttcgagacccacctggccaacacggtgaaacttcgtccctaccgaaatacaaaaattagccgggcgtggcggcgggcacctgcaatcccagccactcgggaggctaaggcaggagaatcgcctgaacccaggaagcagaggttgcactgagccgagattgcaccattgcactccagcctaggtgacagagccagactctatctca

SEQ ID NO: 486615 - DNA, 239 bp, Homo sapiens
tagcgggtctaagcccagctcctgtggacaatatctacccactgctcacatatacagggactgatgctgaggtagctactgtgtataactcgcaacggtgattagcttttgtcacggaacaaaacgcacccaggtgacatagcctgctgtgtccctttgagttacacctaggacgggtcacaaagttaaaggacttctgacacacgggctctattatgcgtggaacaaattctctctaa

SEQ ID NO: 486616 - DNA, 152 bp, Homo sapiens
ttttcccccccccccccccctttgggggggttttttttaaaaaatttgtgggggcctaaggggttttttaaccggtcccccccccttttttaggggggggttttttggggttttagaaaaaaaaccttttaaaaccctgggggttttcccca

SEQ ID NO: 486617 - DNA, 91 bp, Homo sapiens
gaattctgtgaccgccgcggacacggctgtttattactgtgtaagtggttattatttctggggccaaggaaccctggtcaccgtctcctca

SEQ ID NO: 486618 - DNA, 388 bp, Homo sapiens
ccggatcctttctagcctgccagtggaagcggtgcgactctgcggaaagcctccttgtggtgtgagttcctggccgtctcatacacgtattcgatcttaacgtcgggtttgtagccgtcctttctccttgaagttctgtgtgaagcctcgggatttcctccctcgggctgtactttgtcatcggatggccatcttatcctctgatgcagtacacggcttgagggcagctgaactatgtttggggtgccttcaccccggggcccacctatctgcacgtgttggtcttccaagcaagccccttttgtatcttgaacaacagggagcaaggggcaggatagccatgcccccctatttcaacgaatcgggtttccctctgtccaaggattgg

SEQ ID NO: 486619 - DNA, 236 bp, Homo sapiens
ttttttcagggttttgccccaaggccttttttgtcctcagggtttggacttggtcagtggcctttcccccgtggagctgccttcccagggaaaaggaaccctgcccccgggcagggcccgtgccttttacttttcccccccccccaagcgctggttccccggttttggcccccccccgtgcttttgaaattttccgttaattttttttttttaacccaaaaatttccaggtttcca

SEQ ID NO: 486620 - DNA, 170 bp, Homo sapiens
acccaaggggggttttttttgggttggttttttttttggggccaaaccgggtcaaaaaagggaaggggggggggggggggggggggccggccctgggccaagggggcggggccccccctttttttctttttcccttcccgggggggggtttgttttttttttttgggtta

SEQ ID NO: 486621 - DNA, 165 bp, Homo sapiens
  misc_feature (165)..(165): n is a, c, g, or t
gacatcacctttacatcactgcccgaccttagctttcaccatcgctcttcactatgaccgccctccatacccaaccccgtgtgtcaacctcaacctcaggtcttctttttttttctagccacctctagtctagccgtttactctattctctttatcagggtgagn

SEQ ID NO: 486622 - DNA, 909 bp, Homo sapiens
ataggaccaatatcggtggaatataattatgaaagagaagaccttcatagctgacgctcataagcaattggagtgaatgaagtgccatgcccagcaacagagtgggagcctgcccacatggagcaaaaggaggcggacaccatattcacccacggtgcaatcccagtgacagaagcagtgtgagcatgcatgcagtggtcactctggggaagggagaaagaatgatggtaaaaggggcacatagggcctccagggagacggtgctatctggcctcttagttatgggtggatggacactgaatggaacgtgtgagaaaacttaactgaatatcatttttattacatgaatatttatgaacatattttgaatgcttatagtataaaaaaaacgttggtaagaataaatatttttgtgatattatacttggtggcttctttttataaaggttaatatgtgatcataaaacactgacatattagtcataagtggataatatggtgtcatctctgctatatttatttgcgttcggattttcggttcacaataagtataaagttgttaatacaacttaagattttatgttttaaataataattaccacgcttatttgtacttatatatgtatatcctaatttcagttcccagtaaattatattacatattatgtgactagcaatatatttttttatatatagtgactgtaagatgaactttgctaattaggaatagaaatttatagtaaccgattggttatagatggtgcagaactatattaactcactaccatatattattaaatgatggttatgtcccttgatgccaattttcagtcctgtgtcaatataatattatgaactctaataggattggtcggataaaaatttatatacgtatattttataagtttg

SEQ ID NO: 486623 - DNA, 471 bp, Homo sapiens
gatacagaaaatgatagcttaaccatcacctaaattttatttatttttatttattttatttttatttttttgagacggagtctcactcttttgcccaggctggagtgcagtggcgcgatctcagctcactgcaaactctgcctcccaggttcacgccattctcctgtctctacagaaaatttaaaaattaactggcactgtggcccgtgcctgtaggaggctgaagtgggaggatcacttgaacccaggagtttgaagctgcagtgagccaagatcacactactgcacaccagcctgggtgacaaagcaagaccttgtctcaaaaacaaaacaaaaaacaaaaaaggccaggcatggtggctcatgttgtaatcccagcactttgagaggctgaggcagtaggattgcttgagcccaggagttcaagaccagcatgggcaacatagcaagaccttgtatctacaaaaaaaa

SEQ ID NO: 486624 - DNA, 258 bp, Homo sapiens
ctgtgtaagtgtagcctaactccatctgtacaaaagggtgaatgttatgataggcgagggccgacattctaagcctaaggtatggagggcacagggaatgctgacaggccataatacctgggcaggggagctgccctgaatgatgtcatcagaaccatgaccacagggctacatgtccccccacaggcatggcgcagcaccagggaagcacagagggtccaggtcatcagggcataggtcggataaaaccaaagagtc

SEQ ID NO: 486625 - DNA, 353 bp, Homo sapiens
gcaagagaggggataggacatcgccatctacacaaatggacctacagaacagacttaagatggcttactattgccgccttcctcccagagtacctgaccagctgtgatggtatggatgccaaccagaaaagtgtgctggggcggaatttcaagatggatcgggacctgccctcattcacccagaatgtgcacaggctggtcaacgacctgcgctactacagactctgcaacgacagcctgccccctggcactgtgaagctctaggcctgctactgcctggggacacggacttctgctgctgccacctgcgccagccctaccttccaccacagatgtcccccagatgggccttg

SEQ ID NO: 486626 - DNA, 368 bp, Homo sapiens
  misc_feature (3)..(3): n is a, c, g, or t
ccnggacattccacgagtcacagagagataactcgagtaggtgatcggcggcacatgcgtgtatctgcatcgtggacctggtggatatagcgctggtggctatgggtatcgatggtgatctcggagactcggcgagatctcacaaaggtgtcttccgtgtttctctgactctccagccggtagctagtcatgtgcttcgtggtcatgttcacgtggtagcgagctcgagtggctagtcgatgggcatagtcatgtctccggttctgcctctgattagccgcacagccttgaacaaatcacatttcatctttgaacttacctctactgttagactaggtgactcgtggaaatgtccacgggtaccgagc

SEQ ID NO: 486627 - DNA, 868 bp, Homo sapiens
gaactcgggagccagaggttgcagtgagcggagatcttgccgctacactccagcctgggcgacagagactccaactcaaaaaaaaaaaaaaaaaaaattccccggttggttcccccaggtaggtttctcagaccgtgccaatcatccatactatacgggtgattcgaatacaggagaaaagtgggctctctgaattacagcttccctcattctgcttggcagcagaaactctctctctgcagggctacctcctaaagggggcagcgggggaagggaggagaggggaactggccaaaccctcgctaacatatcgaatgggggttgtcggtgtactgggccccaagctggttcgcttgggacaccttttctcctcgggatgggtaggtatgtgggcccatcatgaattttcacatgttggtgacctggcgaaagctctcctggggatccctcctaaccctgaagaagttcttccattctgtttgcctgaatgggtctctccccctttcaacccttttaggcattcacatctcctccttccagtggcccctttattgaccctttcacattccggctgggatttggacaagatccccatattccccggtcctccttctggtacccggggggttgccccgggagccgttgcggtcgcattgggtgaacacctttggcgccctcgcaccggacttttggtgggccccggaatatatttattaccgtcactgtatattctcaccgtgcagcgtttctcggcgggctcttcgcgtcccacccctccggttcttcacacgtatcttggcgtgccgtcttggtttccccgaggcttcggggggtgaacccctttgtagcttgtcggtggcacctccgc

SEQ ID NO: 486628 - DNA, 326 bp, Homo sapiens
  misc_feature (77)..(77): n is a, c, g, or t
  misc_feature (104)..(104): n is a, c, g, or t
  misc_feature (239)..(239): n is a, c, g, or t
  misc_feature (282)..(282): n is a, c, g, or t
ccagcaaaagttagttaaagcctagtttccttgaatattgataatatattcaacatggtacagtcctacatacaaanaggccgagatgggcagatcacttgagnccccaggagttctgagactagccctaggtaatgtggtgaaaccctgtctctctaaaacattaaaaaaaattagctgggtgtggtggcacatgcctgtggttccagctacttgacaggctgaagatgggaggatcncctgagcccagggaggttaaggttgcagtgagctttgattacnccactgcactccaccctggccaacagaagtgagactttgtctca

SEQ ID NO: 486629 - DNA, 332 bp, Homo sapiens
gggtctgggtacatccagtaagtcaaagggtaggtaaaagtatatttctaaatacaatcaccaaaataaacagaatatatcctacagggacgttactatggtccactaactaagtacaggagaatctctgagctttttacaatagacaaatgaattacgaagctgggtgcagtggcagtggctcatgcctgtaattccagtacttcgggaggcaaggcaggtggatcacctgaggtcgggagttcagagcagtcgaccaacatggagaaaccacatctcttctaaaaatacaaaattagccgggtgtggtggcgcatgcctgtaataccagc

SEQ ID NO: 486630 - DNA, 150 bp, Homo sapiens
tgctgttgatgttagttatgaccctgagcatcttcggctggctgttcctcatgcagcacagatggattgctccttttcaaatacttcaggcattgtgtgccttgtcaacttaaccaacactgtaactaaggatcctactgtgatgttgtt

SEQ ID NO: 486631 - DNA, 166 bp, Homo sapiens
  misc_feature (65)..(65): n is a, c, g, or t
  misc_feature (117)..(117): n is a, c, g, or t
  misc_feature (123)..(123): n is a, c, g, or t
gcttatgtgtcctgtcctgagcccgtttcctctcttgtaaaatggggcaatgctgcttgatgaanccagtcaagttgtggtagaaataattgttgattctttattgcacattgtgcncatatnccctaaaacttaaagtatgataaaaataaaaaaaattgttgca

SEQ ID NO: 486632 - DNA, 301 bp, Homo sapiens
acgactgtcgacagagtgggctatatgtatatatattttaaagtattggtaaggatgtggagaaatcggaaccctcctatgttgctgatgggaatggaaaatggcacactcattgtggaaaataatttgggagctcctcaaaaagttaaacatgaagcccccatatgacccagcaattccactcctaggtatttatccaagagaaagaaaaacgtgctcccacataaaaacgtgtatatgaatcttcacagcagcattatttgtaacagccaaaaggtgaacacaacctggtcgaccgtct

SEQ ID NO: 486633 - DNA, 625 bp, Homo sapiens
atgcggagctcggccggtgtcgccgcaatgagcgcgagaggcgcggcgggaggatccggcggcgcgcgcctccctgggcccggactcggccgcctccccgccggcctcccgcgctggacagtggactgagccgccgacggccaggtactgcggggatgtgggccgccgttcccgactgctgctgcttgctactgctgctgctgccgaccactgcgtcctgcctgccgacccttcgtacgtcccccgcggtctggcatgctccctggggcgtctggactggagtgttatggacacggtgccacaatggttcccggcaatggagctttaaagccgctacaaagtgtcgcccagtggaaccatgacagcgcactgcgcgatggcgcttgcaacaagcttagccgggacaggttttcacggtggcaggactgactaatactcacgctactgttgaatggacccacggaaacatttgaccgaaacatccccgaagaaccatagcctgagggaggtacttgaagcgatccagacacagcacaaggttgatgaccgcattcatacagagaagcatactggccctatgatggagcaaaagtttgcgatgactacccttcacgggacccggacc

SEQ ID NO: 486634 - DNA, 656 bp, Homo sapiens
  misc_feature (205)..(205): n is a, c, g, or t
tgggagacgccatgagagggacgcagagagggatcgtacttcgctttgcctccggtgcctgacgtggtgagctggggccctttcattctctctgcctcagcctcccgtagtagctgggagtatagagcgcgcaccggattgaggcccggttaatatggtgtattgagaggcctatgagcacgggtcttatcaccacggttatccnaggagtggtctcaggattctcctgaccgttgtgatccgtgccgcctcgggctcccaaagtgctgggattacaggcgttgaagcaaccggtgcccgggctacaaagtgttaacaaagcacattaccaatggccctttttacatattttttctttacatgaggaataatactgcatgtacgaaaagacctacttaaagtcttcatttatattctttcaaatcaaatctttatttaactaaccttactatatgtggctggaatggttaccattttgtgcagcccttgtgtatccgtgggtagtcgaaattgtatcacttctaaacagcaaacgtgttaggtcaagttaagcagatatctgaagtactatttctgcagggtttgcacaggccgtaactgtctactactttgatatactctgtatacatcctgtttgctgagtggtaaaatacatg

SEQ ID NO: 486635 - DNA, 746 bp, Homo sapiens
ccgtggtaacatcgtcacactccgccgttggggcccccccaccacaataaaaccgtaacagtggtcgtcgtatctgcacataaagttggttaaccccactcctttctttcttcaaagcagaagactgtgtcctcccccgcgaaaggtattgtcggtacccaacacgacggcgccccccccaccctcacttgtactctacacacagggtgtcgataggacgcgcacacatatttctgtgagacaagcaagcggtgacctctattgtctacacacactccacagactatagatctaccttccactgtgttacgacacacacgaccacactcgcaggtacatgagagtagacactgcgcgggcgagagaacactcttctcactcgcccttaagtgtatgtctctctccgcgcgcgcgtgacaagatgtactttgactccttctcctcggcgtgttcgagagagaggcgtgttgacacacttgactctattccgcacatctctgtctgatcagaagtgtctgactctctcactcggagatacctctactcgcagctactccagacgaggtcccgcacgcgctcctgtttactttatgttcagcacgacgtctcctaggcgctttgtgtcgcttcccagagagtacgggacgcacgaatctagactgcgacgactagtcaaggcccggccccctccattcatggtgtccccgcgtattttgtaccccgcgggcccatcattgatacaaaaa

SEQ ID NO: 486636 - DNA, 365 bp, Homo sapiens
atgcgccggtgaagagctgaagcaggacagcatggtccccggacgaccttcctggccgaggccaacctcatgaagcagctgcacatcagcgattgattcggctctacgctagtgtcacccaggagcccatctacatcatcactgaatacatggagaatgggagtctagtggattttctcaagaccccttcaggcatcaatgttgaccatcaacaaactcctggacatggcatgcccagagttgcagaagggcttggattcatttgaatgatgcggtaattatattcatcgtgaccttcggattgcctaacattcttggtggctgactacccctgtagctgctaaatagcagactttgtcctaacc

SEQ ID NO: 486637 - DNA, 225 bp, Homo sapiens
ttatcccccggctccacggcacagccgtgggcacaggaagacgaccttggtgtccttgtggaacacgtagtctgtacccaccaccatcatcgcgctgcagggattcagcctcccgcggcggctgcctatgactgcaggggctccgcgatgaccaccattgcccacctctgtcagggtaccgcacggctcgaacttcgctaatcttcgatcgtagcgtcttttcct

SEQ ID NO: 486638 - DNA, 166 bp, Homo sapiens
ctctgaggatccccacaaatgtggactcatgtatccacccgccttggcctcccagagtgttgggattataggcttgagccagtgcaccctgcctccaggaaagatttaggaagagagaagtgacacatacccagtgagatttctcaaagtaataaacatcactggg

SEQ ID NO: 486639 - DNA, 806 bp, Homo sapiens
taaacaaacagtacagcggttctacaaaaatttaaaaaggacccgggggcggggacccaccccggtattcccagcatttgggggggccaaaccgagggggatcaggaggccgggagaatcaagcaccatccgggcgcgggtcaaaagtggtgtgtcccccacgtgggaacaatcccagaagccccatccgataatcgtgtcccaaccaggtggaggggggtgagagtccacccctggctaagaacatagacccattacgttccccattatgagcgagcgtcggcgtgatccacaagcgggtgaatttttccccattagtgtggattcaaaagatactcaaacatccgtggagtgctcttctcagcattcccatataaattgtttactcatagcgggcagcccatgggctgggtggccaagaatagtagctcaataacgggtgggacgaccaggaagccggtctaaatatttcgttggtgggggaaccctgttgcaagtgtgagacaaggattccagaactttcacgtttcccagcgctcttcgtgtctgggggggtcccctcttatgttccccccgctgggttgcccacccccatgtccttggcgtgggcctcgtgcgcgcccctttttgatcgcctcatcacttggttcccttccccaattaactcacttcctagccgtctggcaaatggctttgggtctccccatactcccaaaagtttcacccaatcgcgctcggcttctcaccattccgtggtcacgcgcgtccccctgtgactctccccctgcttttgtacccccgaggca

SEQ ID NO: 486640 - DNA, 1083 bp, Homo sapiens
  misc_feature (31)..(31): n is a, c, g, or t
  misc_feature (69)..(70): n is a, c, g, or t
  misc_feature (78)..(78): n is a, c, g, or t
  misc_feature (85)..(85): n is a, c, g, or t
  misc_feature (92)..(92): n is a, c, g, or t
  misc_feature (110)..(110): n is a, c, g, or t
  misc_feature (112)..(113): n is a, c, g, or t
  misc_feature (130)..(130): n is a, c, g, or t
  misc_feature (153)..(153): n is a, c, g, or t
  misc_feature (1030)..(1031): n is a, c, g, or t
  misc_feature (1034)..(1034): n is a, c, g, or t
  misc_feature (1036)..(1037): n is a, c, g, or t
  misc_feature (1041)..(1041): n is a, c, g, or t
  misc_feature (1058)..(1058): n is a, c, g, or t
  misc_feature (1064)..(1064): n is a, c, g, or t
  misc_feature (1067)..(1067): n is a, c, g, or t
aagagctccacagcgtggccagctgcactcnaccccagcctgtgcccaccttccagctgacccttcgtnngcgcctgnactcacnactctgncccaagatcagggctgtntnnctccgcaactctccctncctccctggcttcagccagtccntgacgctgagcactggcttccgagtcatcaagaagaagctgtacagctcggaacagctgctcattgaggagtgttgaacttcaacctgagggggccgacagtgccctccaagacagagacgactgaacttttggggtggagactagaggcaggagctgagggactgattccagtggttggaaaactgaggcagccacctaaggtggaggtgggggaatagtgtttcccaggaagctcattgagttgtgtgcgggtggctgtgcattggggacacatacccctcagtactgtagcatgaaacaaaggcttaggggccaacaaggcttccagctggatgtgtgtgtagcatgtaccttattatttttgttactgacagttaacagtggtgtgacatccagagagcagctgggctgctcccgccccagccgggcccagggtgaaggaagaggcacgtgctcctcagagcagccggagggaggggggaggtcggaggtcgtggaggtggtttgtgtatcttactggtctgaagggaccaagtgtgtttgttgtttgttttgtatcttgtttttctgatcggagcatcactactgacctgttgtaggcagctatcttacagacgcatgaatgtaagagtaggaaggggtgggtgtcagggatcacttgggatctttgacacttgaaaaattacacctggcagctgcgtttaagccttcccccatcgtgtactgcagagttgagctggcaggggaggggctgagagggtgggggctggaacccctccccgggaggagtgccatctgggtcttccatctagaactgtttacatgaagataagatactcactgttcatgaaaacccttgaggttcaagtattaannccnanncaanattttttcctttttaanaaacangtntgtttaaacaaaaaaa

SEQ ID NO: 486641 - DNA, 685 bp, Homo sapiens
  misc_feature (485)..(485): n is a, c, g, or t
  misc_feature (511)..(511): n is a, c, g, or t
cggcacgagtgagattgcaccactgcagtctagcctgggtgacacagcaagactccatctcaaaaaaaaaaaaagagagatacttctttccattttctgtgaggtcatctgcagtttcacatggtagacagacttaggtgagattcttagcaacatagaatgaagagtaaagaggtttgtttatttcacaagggtttattgaaggcctacgatgtgttaaatgctgtaggaaatacccactgatttctcttttcatggaggtttcccgccttctcttaacgagtgatcaattaaactgtttactgggaacttgctaagttaatgaacacacgggatacattctttggatgagcagacattggttgggcagaggggcaagaggagagcagtttagacagagacctgcttatacactgtagtgtctaagagagcttgtgatgttcaggaaacagttgttcactgtgctgcaatataggggacggccngttgcggtggctcacacctgtaatcntagtgctttggaggccaaggcgggcggatcacctgaggtcaggagttggagacaggctgggcaacatggtgaggcccgtctctactaaaatctaaaattggctgggcgtgctggcgggctggtatctagctattgggaggtgaagcggtgtggaaccaagccgttcattgctgt

SEQ ID NO: 486642 - DNA, 987 bp, Homo sapiens
  misc_feature (476)..(476): n is a, c, g, or t
  misc_feature (502)..(502): n is a, c, g, or t
  misc_feature (531)..(531): n is a, c, g, or t
  misc_feature (968)..(968): n is a, c, g, or t
  misc_feature (977)..(977): n is a, c, g, or t
aaaaaaagaaaaaaaatcagaagtgaacctgtagcctgtagtgtgttgccaaataaacttatttttagagatacttctttccattttctgtgaggtcatctgcagtttcacatggtagacagacttaggtgagattcttagcaacatagaatgaagagtaaagaggtttgtttatttcacaagggtttattgaaggcctacgatgtgttaaatgctgtaggaaatacccactgatttctcttttcatggaggtttcccgccttctcttaacgagtgatcaattaaactgtttactgggaacttgctaagttaatgaacacacgggatacattctttggatgagcagacattggttgggcagaggggcaagaggagagcagtttagacagagacctgcttatacactgtagtgtctaagagagcttgtgatgttcaggaaacagttgttcactgtgctgcaatataggggacggccngttgcggtggctcacacctgtaatcntagtgctttggagggccaggctggtctcnaactcctgatctcaagtgatccgcctgcctctgtgtcccaaattgctgggattacaggcgtgagccaccgcaccggccatgctttcagttttcaagaaagaagacaccattattgccaaagattttggtaatttgagagatacaatgtatgttttctccatgtgaatactaggtagtaaggatctgttgaatttgaagtgtctatccagaagtattttgggtacttgtttaaggattgtaaaacaatgttttcatttctggatataataaatgtatttgttaatataataaatgaatagattagacccgtaaactatttgcagtgttgagtcatttcccacagttaaaatcaggatgaaaatatatagctgaatacttgctttgtttcttgtaactgatttctgtagtacagacctgctaaggccatcaaacctatngatcaggcnactccgccct

SEQ ID NO: 486643 - DNA, 918 bp, Homo sapiens
  misc_feature (407)..(407): n is a, c, g, or t
  misc_feature (433)..(433): n is a, c, g, or t
  misc_feature (462)..(462): n is a, c, g, or t
  misc_feature (899)..(899): n is a, c, g, or t
  misc_feature (908)..(908): n is a, c, g, or t
acacgtagttctaacattattattattattattattattattattattattattattattgacagagtctcaccctgtcacctgggctagagtgcaatggcatgatctcggctcactgcattgaaggcctacgatgtgttaaatgctgtaggaaatacccactgatttctcttttcatggaggtttcccgccttctcttaacgagtgatcaattaaactgtttactgggaacttgctaagttaatgaacacacgggatacattctttggatgagcagacattggttgggcagaggggcaagaggagagcagtttagacagagacctgcttatacactgtagtgtctaagagagcttgtgatgttcaggaaacagttgttcactgtgctgcaatataggggacggccngttgcggtggctcacacctgtaatcntagtgctttggagggccaggctggtctcnaactcctgatctcaagtgatccgcctgcctctgtgtcccaaattgctgggattacaggcgtgagccaccgcaccggccatgctttcagttttcaagaaagaagacaccattattgccaaagattttggtaatttgagagatacaatgtatgttttctccatgtgaatactaggtagtaaggatctgttgaatttgaagtgtctatccagaagtattttgggtacttgtttaaggattgtaaaacaatgttttcatttctggatataataaatgtatttgttaatataataaatgaatagattagacccgtaaactatttgcagtgttgagtcatttcccacagttaaaatcaggatgaaaatatatagctgaatacttgctttgtttcttgtaactgatttctgtagtacagacctgctaaggccatcaaacctatngatcaggcnactccgccct

SEQ ID NO: 486644 - DNA, 2571 bp, Homo sapiens
gtgcaatgagatctaaatagaaacagcaaaaagtttaaaagcaggggcatgatattaaggcatagagtttttcttagttttctttttccttgtttgttggtttatgtagagttaagttgttatcaggttaaaataatgggttataagatagtattcgcaagcctcatggtaacctcaagccaaaaacaaacaaacaaacaacaacaaaaaaacacatagtggatacacaaaaaataaaaagcaagaaactaaatcatatccccagagaaaatcaccttcactagtggaggataggaaagaaagaaggaagagaagatcacaaaacaaccagaaaacaaataacaaaatggcaggagtaagtccttacttatcaataataacattgaatgtaaatggactaaactctcccgtcaaaagacagagactggctggatgaaaaaacaagacccattgattgttgcctacaagaaacacacttcacctatatagacacacacaggctgaaaataaagggatggaaaaaaatattccatgccagtggaaaccaaaaaagagcgggagtagttatatttacattacatacaatagatttcaagacaaaatctgtaagaggagccaaagaaggtcactacataatgataaaggagtcagttcagcaaggtgatgtaacaatgtaaaatatatatgtacccaacactggagcacctagatatataaagggaatattattagacctaaagagagaggccttgatacaataatggctggagacttcaaaccccattttcagcattggacggatctcccagacagaaaatcaacaaagaagcatcagacttaatcttcactatagacaaaaaggatctaatatttacagaacatttcatccaagggctgcagaatgcacattctttttctcagacatgaattattctcaaggttagaccacattttagatcacaaaacaagtcttaaaaaattcaaaaaattgaaataatatcaagcctcttttctgaccactatggattaaaactagaaattaataagaattttagaaactttacaaatacatggaaagtaaacaatatgctcctgaatagtgggtcagtgaagaaattaagaaggaatttgggggccagaggtagtggctcatgcctgtaaccccagcactttgggatgccgaggtgggtggatcataaggtcaggagttcgagagcagcctgaccaacatggtgaaaccctgtttctactaaaaaaaaaaaaaaaaaaaaaaaattagccaggcatggtggcgtgcacctgtaatcctagctactggggaggccaaggcaggagaattgcttgaacctgggaggtggaggttgcagtgagctgagattgtgccactgcactccagcctgggtgaaagagtgagactctgtctaaaaaacaaacaaaacaaacaaaaaagaaggaatttgggaaatgaagcggtggggcagaggctggcagctcaggcagtgaccatgcatattatggcctcatggtgcctttcgctgtgatgagcatgttctggggcttcgttggcttcttggtgccttggtttatccctaagggtccttactgggaagttatcattaccatattggtgacctgtccaggtttctgctatctcttttggctgatttcaattctggcccaactcaaccctctctttggaccacagttgacaaatgaagccgtctggtatctgaagcatcattggccttgaggaggaagatgtgctctacagtgctcagtctttgaggtcacgaggagagaatgccttctagatgcaaaatcacctccaaaccagaccacctttcttgacttgcccattttggtcattagttgccttaaacatcagcaccacatttaaatgtcttattctacaatgaagtgttttttccttcacttttttacactttaacgaattatgtccctacttaaactgaactgtgctgactccagaaaatgattatgtactcttctgagatagaagattgtcttcttctgagagatatgttactgcctccttggaatctgtgcatttgaagatggctcctgccttctcacatgggaaccaatgaagtgtttagaaactgctgcaagacaagtaatactccagtggggcagtcagtaggagagcattttcagagggaagagctgtctcaacagaattacaccttactgtattttcaggatgaatttattatttctgccgtctttcggaataaattatttttctgctttctatgggggggaaaaaagaatttgggccaggaactgtggctcatgcctataatcccgacactttgggagactgaggtaggcagatcacctgaggccaggagttccagaccatcctgggcagcatggtgaaaccttgtctctacaaaaaaaaaaaaaaaatcacacaaaaattagccaagcatggtggcacgtgcctgtggttcctgttacttgggaggctgaggtgggaggattgcttgagtccaggaagtggaggttgcagtgagctgagatcatgccactgcactccagcctggtttc

SEQ ID NO: 486645 - DNA, 1290 bp, Homo sapiens
  misc_feature (476)..(476): n is a, c, g, or t
  misc_feature (502)..(502): n is a, c, g, or t
  misc_feature (531)..(531): n is a, c, g, or t
  misc_feature (841)..(841): n is a, c, g, or t
aaaaaaagaaaaaaaatcagaagtgaacctgtagcctgtagtgtgttgccaaataaacttatttttagagatacttctttccattttctgtgaggtcatctgcagtttcacatggtagacagacttaggtgagattcttagcaacatagaatgaagagtaaagaggtttgtttatttcacaagggtttattgaaggcctacgatgtgttaaatgctgtaggaaatacccactgatttctcttttcatggaggtttcccgccttctcttaacgagtgatcaattaaactgtttactgggaacttgctaagttaatgaacacacgggatacattctttggatgagcagacattggttgggcagaggggcaagaggagagcagtttagacagagacctgcttatacactgtagtgtctaagagagcttgtgatgttcaggaaacagttgttcactgtgctgcaatataggggacggccngttgcggtggctcacacctgtaatcntagtgctttggagggccaggctggtctcnaactcctgatctcaagtgatccgcctgcctctgtgtcccaaattgctgggattacaggcgtgagccaccgcaccggccatgctttcagttttcaagaaagaagacaccattattgccaaagattttggtaatttgagagatacaatgtatgttttctccatgtgaatactaggtagtaaggatctgttgaatttgaagtgtctatccagaagtattttgggtacttgtttaaggattgtaaaacaatgttttcatttctggatataataaatgtatttgttaatataataaatgaatagattagacccanaaaaaaaaaaaaaaaaaaaaaaaaaaaaaaaacaaaaaaaaaaaaaaaaaaaaaaaaaaaaacaaaacaacaaaaaaaaaaaaaaaaaaaaaaacacaaaaaaaaaacacacccacacacaaaaaaaaaaaaaaagggggggcgccaccacaaaaccccccggggggggccacaaaagacagcacacccgagtatcacaacaggggcgccccatggggggcccatatacacgagccggcagggagccggcataccacccaggcggagggaaaacacgccgcacgcagcaaaacagaagagagccccaaacggggggggccacaaagggcgacaccaccccccccgcgacacaaaccccgggggcataaaacaacacgagggagaaacggggaaaaccacggcaaaagccacggacgaaaaccgcgcacgagaacttggaggcactttcc

SEQ ID NO: 486646 - DNA, 748 bp, Homo sapiens
  misc_feature (238)..(238): n is a, c, g, or t
  misc_feature (344)..(344): n is a, c, g, or t
tggaaaatgaaatgttcccccatcatagtggattcttaagcccgttcgccacgatatgcggcgtgctagctggatgtctttgggcttaattgttacactttgggcatgaatagcacacaggttggtgtcttcaaaaaggccaaccaaataggccctcatgttgccctccgtggcaaagcaccgattagctgcgcctcgtggaagcgcaaactctgtgttttaaaagctccgtgagcanatttcctcgcaccagaacgctggaagggaagtttgtgcgaatctcagaagtttcaggtggactttcgtgataccgttctaattttcacggaagcgccacagtaccnaggcctgtaacagataagtgtttcttacacccctccagtaaagggcgcactcttgcagagcggtcttttgtacccagtgagctccctgggtgcttataccaccggtcaatttagcgggcagtctgctttgtacagagccatggtacagagacctccttatgttacccccctttactccttcggctggagcctcgggagcgaaagcgcggccgctgtgctgtatggaaagcacacggaggcgcctgagaggcaggcccacatgtgggatagaccccggtgccaccggggggccccgggggcccctggtggccctgggatggggacccgggtggtcacccggaagtttcggcatagcatccgggcaggtcacgcttaaagggccgggccaagacggaaccccgaaa

SEQ ID NO: 486647 - DNA, 425 bp, Homo sapiens
agcttttagacctttggcaaatgaatttaccatgaggaacagttcttttcatttataaaatgggggtaaaagctcatacgatgcttgtgaatgttaaacaaacttgtttatgcaaattacttaggcattgcctagtacaaaacagaacttaataagtagtaggaattctatcatttccattagtcattattaattttgttctaaagtacctgcctctccaggtagctaaattgcttgttatcttatgttgtagcgttttaattaatccaatctctgagtaaatttactatgtagggatctagggaaatattaatttcagttaaacatactttcctttttaaattgaaaaccaaatacggtaactttagaaaagtttaagtatatattcaattcaccagaattattttcttgtaaatattttcatc

SEQ ID NO: 486648 - DNA, 879 bp, Homo sapiens
atgccccaactaaatactaccgtatggcccaccataatgacccccatagtccttacatctatgcctcatcacccaataaaaatattaagagcagcaaactatcactagctccctcaccaaagcccagtaaaaagtaaaaaatgataagcaaaccctgagaaccagagattgaagcgaaaatctgttcgcttcattcattgcccctcatttgcataaagtatgatactagcatttaccatctcacttctaggaatactagtatatcgctcacacctcatatcctccctactatgcctagaaggaataatacaatcgctgtcagtatagctacgtcctcataaccctcaaaaccatccctcttagaccaatattgtgcctatggccatactagtctttgccggctgagaagaaggggtgggctagcccgtactagtcgcaatctccaacacatatggctagaatacgtaataacctaaacctactccaatgctaaaactaatcgtcccacaattatattactaccagtgaatgacttccaaaaaacacatatttgatttacaccaacacccaatatctataaactagcatggcattccctttagggggggcgaggatataggttcgtctaagattaaaatgcctagccatttcttaccaaggggaactacacccttatccatatagtatatcgaccgggattattaacaaaggctggcggagcgtaaggtaaatatggggactatatggattgggggggaaagaaaaaaagaggctaagtaatataaatttgaggacaaagggggcacaggtgttgagccgcagaaaaaaaaaaaggggggaaatggggggtttgttagtgttcccttcgctgtaggaggg

SEQ ID NO: 486649 - DNA, 328 bp, Homo sapiens
tacctgggcatagagctcctgagcatagtgatctcccacctcagcctcctaagtagctgggactacaggtacgcgtcacagcccccagctagttgcatactttttttttttttttaaaaaaagggggtctcactctgttgctgggaaggaaaagccgtggtgcagccacggttcactgcagtcttgacctctgtggcctcaagtgatcctcccacccaagcatccgtgagatagctgggactagcgggtgtgcgcgaccatgcctggctaattttttcatagagacagggtttggccatatggcccaggtgggtctcaaactcctgag

SEQ ID NO: 486650 - DNA, 154 bp, Homo sapiens
  misc_feature (113)..(113): n is a, c, g, or t
tgcggcagtgcgagctgaggcagtcgcccctgaagttgcagttcgcccctagagttgcagctatgcccctgagttagcatcgcctattaactcagggcgagctgctgggagtntattttccgcttggtgccaggtgcaccagttccaggtgtca

SEQ ID NO: 486651 - DNA, 675 bp, Homo sapiens
taaaaatgagaagattgataaagtctaagaaagatatttaatcgggaacgccagaaatctctatcattaacacccagcccgctcagactccggtgaaggattccttcagctccctcatcaagacagtcaagatagtacttcagtaggtacaaactcttaagaaagatggccagacgttggggacaagaaaagcagcaccatgaatgagctggtgcagtccatggtcctagcaggacggtggacaggtagtactgagaatgtggaggttcctgatgatatttcagcgggtaaaaggagaaaagaattgggagctatggcctcctctactacagccaacaattttacagctgtccaactcttctgcaggctacagatccaagcaggaggttaataataaagatactacatcctttgaagacataagtccacgaaggtgttagtgatgatgctagtgacgggatcaagagttcatgcttcaagaccagccaggcttgatggtgggagaacatccactagcaataacaataataatgcttactaaatgaagtcaagcggtgcgtaataaacaaggcggccaaaagcgcaggatggaaattagctgttctgaccagaggtggccaggggtagcgccagccttctgaaggacacatcggcgggccagaaatatgagcggga

SEQ ID NO: 486652 - DNA, 502 bp, Homo sapiens
ccgggtggggcgtagggagggatgtctatggggtcagaggattcaaagagaaaaatttgggttggaacttgagttcctttcctgaacttgctgtaacaaatttatacaaattgggtggtttacaacaatacaaatatgttctctcatagttctggaaggcagaagtctcagatcaaggtgttgggaagcatggttcgttatgagggttgcaagagaggaatctgtctcatggctatatcctggcttctagtggccccaggtattccttggtgatatggtttggctgtgtccccatccaaatctcatcttgaatttccacgtgttgtgggagggatttggtgagaggtaactgaaccatgggggcaggtcttttctatgctgttctcatgatagtgaataagtctcatgagatctgatagttttataaggtggtgtttccctgcacaagctctctctttgcctgttgccatccatgtaagatgtgacttgcttctccttgtct

SEQ ID NO: 486653 - DNA, 215 bp, Homo sapiens
  misc_feature (92)..(92): n is a, c, g, or t
  misc_feature (144)..(144): n is a, c, g, or t
  misc_feature (155)..(155): n is a, c, g, or t
  misc_feature (160)..(160): n is a, c, g, or t
  misc_feature (166)..(166): n is a, c, g, or t
  misc_feature (192)..(192): n is a, c, g, or t
  misc_feature (199)..(199): n is a, c, g, or t
  misc_feature (206)..(206): n is a, c, g, or t
ttagcttttgtgggtttgctctccccatcccatttcctgtactacacagttcatggcagggtggggaagggtggggttggttcgggtgggtnagggtctttttcctctgtgtgcgatgttgttatttgacagttttccgtcccnactggcctttntcctngttttnatatttgtacgggacaagcaataaanaccctcntttcagnccaggaaaa

SEQ ID NO: 486654 - DNA, 438 bp, Homo sapiens
actacatataaaaacacattgtaatgatatatcatgtggaaagatctcccccactgctctcatgtagatacctgactgttttttggattgtctgttcatgtggcaatctttttcctcttctctgttaaactttttacttcatataaataaatctaaaactctacaggctgctctacttctctcttcagaacttgcattgctcctgataataatgctcctggaccttacacctacatcaactgttaaaaaaggatgggagagggaattttgagtggtgattttaacacggggggtgtaggccctgtgggaaaccagattcttcattcccaaaaatttcctcccactagcagcgagtgtttgagaaaatatctactaagggatagatgctgagtgcccacctgccttaatccccctgttgtaaaacccccaatcaattgg

SEQ ID NO: 486655 - DNA, 927 bp, Homo sapiens
  misc_feature (95)..(95): n is a, c, g, or t
  misc_feature (195)..(195): n is a, c, g, or t
  misc_feature (217)..(217): n is a, c, g, or t
  misc_feature (291)..(291): n is a, c, g, or t
  misc_feature (325)..(326): n is a, c, g, or t
  misc_feature (338)..(338): n is a, c, g, or t
  misc_feature (342)..(342): n is a, c, g, or t
  misc_feature (355)..(355): n is a, c, g, or t
  misc_feature (358)..(358): n is a, c, g, or t
  misc_feature (369)..(369): n is a, c, g, or t
  misc_feature (372)..(372): n is a, c, g, or t
  misc_feature (378)..(379): n is a, c, g, or t
  misc_feature (383)..(383): n is a, c, g, or t
  misc_feature (401)..(401): n is a, c, g, or t
  misc_feature (458)..(458): n is a, c, g, or t
  misc_feature (471)..(471): n is a, c, g, or t
  misc_feature (562)..(562): n is a, c, g, or t
ggaggccacaggaggtgggctcctgtgctggcctgagtgctggcggaggggaaggggctagcaggtgtgtaaacagagggttccatcaggctggnggcagggtggccgccttccgcacacttgaggaaccctcccctctccctcggtgacatcttgcccgcccctcagcaccctgccttgtctccaggaggtccngaagctctgtgggacctcttgnggggcaaggtggggtgaggccggggagtagggaggtcaggcgggtctgagcccacagagcaggagagctgccanggtctgcccatcgaccaggttgcttgtggccccnnggagcccacggngtcntgtgtgattgccnatnagcatgcgcanacncaccgnngggngcctacggggctgcggcnagggactcggcctctgggaggtttacctcgcccccacttgtgcccccagctcagccnccctgcacgcagnccgactagcagtctagaggcctgaggcttctgggtcctggtgacggggctggcatgaccccgggggtcgtccatgccagtccgctcagtcngcagagggtccctcggctagtcgcccctgtgagtgggcattcggaaacattggacagaagccacacgagtcaaattgtcacaatttgtggaaccatatgggctgagatcagaacgcttgaggcaccctaaattacatgcacattcgtaaggacagccacctaccagtgtatatactgctctcccggacgtggatgttcccggggcattgtcaccaggcccttgcgttccagtgttgagtctcacctgggcataacatctggccggctgctgttggaatcggctagtcggccctcatctgtttctccggtccatgctcggggggcccttgggtctccttgttataaacctcgaactatgtctgctg

SEQ ID NO: 486656 - DNA, 375 bp, Homo sapiens
  misc_feature (44)..(44): n is a, c, g, or t
  misc_feature (153)..(153): n is a, c, g, or t
  misc_feature (203)..(203): n is a, c, g, or t
  misc_feature (316)..(316): n is a, c, g, or t
  misc_feature (368)..(368): n is a, c, g, or t
aagaaaagccatcatatcccctgtgacctgcatgtatacatccnagatggcctgaagcaagtgaagaatcacaaaagaagtgaaaagggccggttcctgccttaactgatgacattccaccattgtgatttgttcctgccccaccttaactgngcgattaacctgtgaacttccttctcctggctcagaagcttccccactgngcaccttgtgacccccgcccctgcctgccatagaacaaccccctttgattgtaattttcctttacctacccaaatcctataaaacggccccacccctatctcccttcgctganactctctttggactcagcctgcctgcacctaggtgattaaaaagctttaatntcacgca

SEQ ID NO: 486657 - DNA, 516 bp, Homo sapiens
tactttcacagggaagtatttgaaagtttcaaatattaggacaggtgccgtggctcacgcctgtaatcccaaagctttaggagactgaggcaggaggattactcgaggtcagaagtttgagatcagcctacgcaacatagtgagagctcatctctacaaaaaaataaaattttaattagccaggtatggtggtacttgccttagtcccagctacttgggaggctgaggtgggaggattgcttgagctgaggagttcaagtccagcctgggtaacatggggaaaccctgtctctacaaaacatacaaacaaattagctgggcatggtggtgcacccctataatcccagctactgtgggggctgaagcaggaggatcacttgaacctgggaggttgaggctgcagtgagccaagatggcgccactgcactccagcctgggcaacaaagtgagaccctgtctcaagtaagtaaataaataaatgagagagagagagagagattgtgtaccggggcaaaa

SEQ ID NO: 486658 - DNA, 325 bp, Homo sapiens
actcgttgacctcgtctgtatgtaacggctgcgtagggatgggagggcgctgaggactacgtatgatggcgggcaggatagtccagacggtttctctttcctgcgcgtctgagcatgttcagtcatcagtaagttttgtcgtgagtgtcaggaaaagggccatccaggataggacgccgataaggcacaaatgcattatcagggcgtcatcatcaaaggtgatcagctcttctcatcccaggggaagtcagcgtcttgtcgcactactatgcgctgcattgtcccatgtgggtcgcttttgaaagggtaccggagctccgaattc

SEQ ID NO: 486659 - DNA, 180 bp, Homo sapiens
  misc_feature (37)..(37): n is a, c, g, or t
  misc_feature (144)..(144): n is a, c, g, or t
  misc_feature (155)..(155): n is a, c, g, or t
gcgagtgatggtctcccgcgaatctgcagcttctgangacagggttgctccgtcgtgctccgcctcccatgacttcctacagctatctgcagtcgtcggccacgtcgtcccttcggaggcctgggcggcgcgctccgtgcgtanttgggcccggnggtctgcttttccgcgcgccccagc

SEQ ID NO: 486660 - DNA, 135 bp, Homo sapiens
aggccagtgtccggtgctgctcgagtccgcagcactcagactacgtgcacctctgcagcggtgtgcaggccctctttgtcaccccttctagcatgatctgcccatgttattctggcaggtattgagctctccaga

SEQ ID NO: 486661 - DNA, 297 bp, Homo sapiens
gttggcaccatataatgtatgctaaatgggatggcaatatcagataacttcttctggcacaccgtggtgtcaacaatctagatagcaaatatgataatctgtcccattggtgacatggtatgcctggatgaagcattccaaccagggatatgcataaatttttcatcccgggcaggcacaacacacatcatccatgatcatatcccacactttcctggaaggtcatcatccaatcagcaacttctgcatgctgggcaatctgggaagcaattggcccagcaatccatgcagcatagg

SEQ ID NO: 486662 - DNA, 806 bp, Homo sapiens
taaaaacccacagagtctttatcgggtctaatactcagcgggccggaaaaataaggccccccgggaggggggcaaaatctaggtccgggggcagccgggaggggtatccgcgaggagggggcccccccagccggcccaccctcaggaacatcataagcccatactcggtccaggccctcgccaaccggggtcacaggctggccagggggggagtggggaagcgcccagacaccacgcgggccccagcaggcagctcggtccgcagctggtcctccagcagggggagcacgctaggggccaggaacacagacacgtggcgggagtccctcaggctcaccggccgggaagagaatgtcgccccagccgggggagaggcctgggtggggcccggggtcatccgcagcttccggagtcccgggcccccaagccctcgcaggtgtcagccggcacctggggctggtcaggggggggccgggaatccccagtgttaccttccagaagatcctgggggcgatagcagacgctgccggggaagcgggccctccaaggggtgaagccggccaggccaccagccggggtgttcatggctcgtagccatggccgtggggggggctcgccttgtgggcggcacaaagaatcttgcccggtgcaaaacccagatccccggttccggggggtgcccgcgagggaaactgtgcccactggcgggggcgcccaataggcactgaccgtgggggatcggggttggaatggcaacagccaatccggaaaaagggtcgtgactgccatggggccaccgcaagagg

SEQ ID NO: 486663 - DNA, 363 bp, Homo sapiens
  misc_feature (8)..(8): n is a, c, g, or t
  misc_feature (253)..(253): n is a, c, g, or t
  misc_feature (282)..(282): n is a, c, g, or t
  misc_feature (340)..(340): n is a, c, g, or t
  misc_feature (346)..(346): n is a, c, g, or t
ccctgggntgcatgtaagacaaaagtggtttctggtgaatatacggtgagcagcacaatgactgctgacctgactgccgaaatcgctgaaggttacgtactggcctgctcctgccatccgcagggggatttggttctcgcataatcgccttatgcccgatgatattcctttcatcgggctatttaaccgttagtgcctcctttctctcccatccctttccccctccgtcagatgaactaaacttgttaccgtntatcacattcaggagatggagaaccatgnaacaaacggttgcagctttatatcgccaaaacactcggaatcggcagggggggcccgngtaccnaatttcggccctttagt

SEQ ID NO: 486664 - DNA, 186 bp, Homo sapiens
gatcctccatcataagtaacaggcatcatgtggttgaccactgaagggcctgctagtcgcgcgtgaccaccattagcgcaaggagcaacttccaccggagctcggacgggttccttgtgacaacgtgaaacagcgccgggttacagcgttagtattgaataatcaggcatagtattacatattgtg

SEQ ID NO: 486665 - DNA, 405 bp, Homo sapiens
aagactaaacatgaaattcatttatgcttcatatacaccttatatacatagcctaaaggtaatttgatacaatattttaaataattttgtgcatgaaacaaagtttcgactgcattttgactgtgatttctggcatgagatcagttatggaattttccacttctagcgtcatgttggcattcagaaattttgaaattttggagcattttggattttcagattagggatgctcaacctgtatatatattttttaatcgacgtgaaattcacgtaacatagaattaaccattttgaagtgaacaatttggttgcattcactgatgttgagcaaccaccacctttaactatttccaaaacattttcatcactccaaaataaatgcctgtacacacttggccggtcact

SEQ ID NO: 486666 - DNA, 472 bp, Homo sapiens
gtgactctccaggatcttacacactgggttcgagttccccactgggtcgagtcaagacagcctggccaacatggtgaaacccggtctccactaaaaatgcaaaaattagcctggcatggtggtgcaggcctgtgatgacagctacttggggggctgaggcaggagaatcgcttgaacccaggaggcggaggttgtggtgacccaagatcacgccattgcactccagcctgggcgacagagcgagacaccatctcaaaaaaaaggatcttgttaggaagtacatgaccccgagtgagtgcctctcctggccaggtgtccccttgtgtatgtcatccttgaatcttcctagcagccttccaaagtaggcttcgggattcagttttacagatagggaaacttaggcacagagagacttttggtggctctataggcagtaaagggcaaaatggaaagcaaacctggcctcttgtac

SEQ ID NO: 486667 - DNA, 665 bp, Homo sapiens
  misc_feature (248)..(248): n is a, c, g, or t
atcccagcatttgggaggctgaggcgagtggatcatgaggtcaggagatagagaccatcctggctaacacagtgaaaccccatctctactaaaaatacagaaaattagctgggcgtggtagcagatgcctgtagtcccagctactcgggaggctgaggcaggagaatggtgtgaacccgggaggcggggcttgcaatgagccgagatcacgccactgcactccagcctggggcgagcagaggcaaganctccggttctcaaagaaaaagaacaacaaaaagaaaacaaaaaaaacgtgtgtgtgcggcgcgcgccctggcggccccttcgaagaagagttttaaaaaaccccattgtggttgggggcgcgcgcgcgggcaccccagagtgggtttaggtggagaccgtgggcccaaaaggtggttcccccaagagggagacacccgggggacaagagacacaagtgcgggcgctgggagattctcttcaccccatattaaaaaaacaagcgcgcccggggggggtgcaaaccggagagggtgttttcttagaaaacaaacttcccaaatgggggagtatccaaggaggcgccaaataccgggggtcttaattctaaacaggggagtccaaaagggagcctccgagattttataaattatacgcgg

SEQ ID NO: 486668 - DNA, 92 bp, Homo sapiens
  misc_feature (34)..(34): n is a, c, g, or t
cgagacttaacctcctagaattcccatgacgagntaatgcatgtccgtggttgggtgcacctgtaggtctgtttattggtcagtggaaatga

SEQ ID NO: 486669 - DNA, 161 bp, Homo sapiens
cgaggcagtatagctgttcgtgagtgtaacacgacggcagtcatagctgattcctgattgtaacaggacggccagtcattagctgtttcctgattgtaacaggacggccagtcgatagctgttgcctgattgtaaccggagggcgacgtgttaccggttgc

SEQ ID NO: 486670 - DNA, 783 bp, Homo sapiens
gttagcaggtgagcctgcgatgcgcgggaagatgttccgctatgaaactgcagcgggatttggtgagttacccgcgtgtctccagtcggttgtgggtgaagctgagtgatctgcggggttccagactgctgaggaactcctagaggtgaaaccctccgagcttagcagaagaagttgggatatctaaagcagaagccttataaactctgcgagaattaatcacgaagcaggaatgtcgtcacaaatagaagccaagaatatgctggtctacactctgagctcacacaagagagtgtcacagtccacttggagaccttcttgcagacaggcagcgataccccaggggcttgcataactcgacccttgctgttccaggcactcagatgatattcttggggggtggcagtgcccttgaatgaaacacaagagaaattttgtggtgcaccaggtgtctggaaaaacacaattatgtatgcatgtgggcagtagatgtgcagataccaagaatgtttcggaggagtggcaggtgaatgcagttcctattgatacagaagggacagttgtatggttgatagagtggtagaccttgcgactgcctgcagttcagcggccttcagcttatacgcagtacaaagccaagggagaggaacaccgaaaagcttggggaggctgtcacctcttgattatattctttctcatattgcttatgttcgctgtcgtgactaccacagagctcactggtcccaagttatcctgcctccagaattcctttcagaacgctca

SEQ ID NO: 486671 - DNA, 432 bp, Homo sapiens
aacattcggtattacccggaccgtccatgaaataacgaggatagcgtctttccccatgcacctgattaactgcactaaccacaatatctcagctgatatgctaggatgtctctcccaacatatggaggcaacaggttttaagaatagtgtcaggggcattatttaatcagtgttagttctgacaggtgaacaaactgagtaggtctctgcagatagtacctatgaaacattaaggtcagattgattcagctacctggtgtgtaagataatgcccaatttatagtttcctttttattttttctggtacttctacaaatataaccctgagcatagaaataccctcattattttaatgggacatcctatttctaccatgcaatttgagcttgatctgagacatttctgtgaagtgtgaaagtacagttaatcatt

SEQ ID NO: 486672 - DNA, 397 bp, Homo sapiens
ctcgggcaataaaatggacaatcgaaggaagattcactcttgcagctatgccgatagtatggacaatatccatgacatctacacttaatctataaccatatagatctatgtacacccataaatcccggctggccgaatcagatggaccatatattcgagatatatagtaattgtaggtctgtatacctcctcgatctgagtgttatagtcctgcccatacatccagcagcaggtctgtgaagctacagggaacaggagacgtctggacgacgcatatgctcggtacgatagtctaccgccttgagaaagtccaagtaacttataccacctgtgactgtacgcgtgtaaaatcaaattccacctcctcctctgtgtgagggaaggcctgagtaactcc

SEQ ID NO: 486673 - DNA, 317 bp, Homo sapiens
agctccaaggcgcgggagctccagggcatttggtcaagtcacatccctggtcactgctctcactgcaaattttttgctctccaaaattgccctggccacagagccaccttgagctcctgcagggtcaagagaagaagaaacacaggaaggatcaggaagaatgttcactgaaagaaggtcagaaatctcataattcagagtagagctgctgcagtacctactgcagggggtgctacatggcccttcacatatccccatggctttcaaactaagttctttgtggcctcttcagaggcatttttgcagaggacatggga

SEQ ID NO: 486674 - DNA, 263 bp, Homo sapiens
tgggatcttttttatttttatacacattacaagattttacattatagaatagtcaggtaaatagtacaaatttacatttatgaggaatgttaaaaaaaattcaactataaaacccacttttttctgtgacccataatcccacattttacagtgcaagggataaggggattatggggcattcaaaacaagttttttccataaagaaatgatgtaaattttacattcccttttcacacaggatccaaatggtgaaagttttattt

SEQ ID NO: 486675 - DNA, 1380 bp, Homo sapiens
  misc_feature (289)..(289): n is a, c, g, or t
ggtgatgctgatgaatccatggctgattgatgatccacgtcttcccgcaatactgagcacatccgaaagttgacccagagcctacaaaagcgaaattcagaagacagaccctgggagaagagtgccattacgtaagcgacagcatgcgatggtgcaacttgttccgaagacgggcttccatctaagtactctactcattcatcagagtaacaagcagtcgatgaaaggctacaacatctgtggcacatagtctacgtcgcctcaagagcagatgcaccgaggacgcctngtatgcgcgccgagggagaacttcgtcgtgggtagagcagagcgacttctcagacggtacagaatgcgggtttcgtagtagacgtactcccaggagcacggtgcctcactctcgggtaggcaagatccaagcgaagtagagttgaccatgatgaatgagcatggccgggaaccattcgacgagagagcatctagccggggagcatgtcctggggacctgggcacgggaagcgccattgtcgttggccgttggctgaacataggtctccagacgaaatacgcccaagaaccttacattttgcgcgaagaagtgctcatactagagtggcccattgaagcggcggagggctatgggaaaaccaaaaagcgactcgtggactccctgaattcaggcgaatacaagtagagatagttcttctgcaaagtgaagaaccatgaaacatccgtgggtaccattcaggaatcaagaaagtatagaagcgagattgtacgtgcaaagtcagcatgttaccagagaatacatctcggggaagattacgttcagggggggaattaccggggaaggatttcatggtgaaagaatcttgtggttggcgcaatggacttgaacagttggaacgtggtagggggtacaaccttccttggccaaccagtggcacgggaaaagcaaccaagtggacaagagaaaaacggggcaaaaaagaacatggtacggagggccataaacagaaatcccagcgacagataagccccgaagaaattcacccagggtacctaaagaaagccgtgagggcccatggttcttagcaaagacgagcgtacttggaaaccggataataagattggtgtaccacaagggaaactaggggattagaggactatagaaaactcacacatcaagggaatggccgtatgtgtataagcaccagaaataccattcagaaaggaactaactaggtaagggattaaaaaaatacgaattggatagtcaagagatgatttgacaatacatgaaaaatacattaccccagtatggcctgtctgcataaagaatattgggaacaaataaagagaaggttaactgggataatg

SEQ ID NO: 486676 - DNA, 430 bp, Homo sapiens
aaagagaagacaacattacaatagcaccaaaaataataaaataattagaaacaaatgtaattaaaaggcacaaggccgggaagggtggctcacacctgttaatcccagaactttaggaggccaaggtgggtggattgcttgagctcaggaattcaagtccagccggggcaacatggcaaaacctagtctttacaaaaaaggcaaaaaattagccaggcatggtgtgcacctgtaccaggtatgcacctgtactcccagctactcggtaggctgaggtgggagaatcacctgagcccagtaagtcgaggccgcagtgaaccaagatcgcaccactgcactctagcattgaagacatagcgggaccctgtctcaacaacaacaaaaaaggcacaaacacaagacttgtatgctgaaaagtacaacctgccgg

SEQ ID NO: 486677 - DNA, 174 bp, Homo sapiens
cagaaggctggagatgtaagtagagctgcaacagtgccgtcagtgaatgtcattggttctgtagaagttctaaggaagcggtactgaactccacgtgtggtggggtgctaacatagacaggggagccgcactgagaagatgttggtcgggggactcgagctgactgagctgaca

SEQ ID NO: 486678 - DNA, 105 bp, Homo sapiens
cccgagaaggagtaagaccgaaaggcgatgtgaaataaacctgacaaagacgagatgcacaagcgccccgcgagaaggagagcccggaacctgcgacggcggaac

SEQ ID NO: 486679 - DNA, 102 bp, Homo sapiens
atgaaacatatttgggaccacagtatgtcgcaggcattactaatctgaaaaagtgctcaacctcccccctactggaaggctgtgaattcctcaggaagtaaa

SEQ ID NO: 486680 - DNA, 102 bp, Homo sapiens
tggaaataaaattttggctctgtcccccaaatggaattgcgggggcaaattctcggttcactcaaacctccaccttcctaggtctcaagttgattctatgcc

SEQ ID NO: 486681 - DNA, 610 bp, Homo sapiens
  misc_feature (142)..(142): n is a, c, g, or t
  misc_feature (388)..(388): n is a, c, g, or t
  misc_feature (519)..(519): n is a, c, g, or t
acataacgttagctggcctagggataggggtcagtctgggcacagagcccagagggagtgggaagcccagcagggggaggggagtgggatcctctggggattattctggaatggctctcccatttctggacctggaacccantcctactggctaagaaaatggcgacaaagaggggtagttttggcagctgtgtaacgtatctaaagctcagatcagctgggggtggcactccagcatctgggaggctccagtagtctcaagtgcaaggcagtagggggggcagtgccctaggttataacgccagctcagccatggactatctgagacctcagggcatgacactcccactccggcctcagttcccttctcggcagtctccggggcggnacaggatggtatgtaaggcctatggagctctcatacccgggtttaattcagactccagggaaaccagtattggtaagagctcagctgctcccacagcaggaccgagtagactaagatggatgaagctcggncctgggcccactggagaggggaacgggcctcaaagaaggacgggataaggctgactcacactccatagaacatacagttaacctttcccca

SEQ ID NO: 486682 - DNA, 394 bp, Homo sapiens
gccaattttggccctttttaattttgcaaaatgcgttgggtgacattgtttcacccaatccctggagcaaggatacaaagggttttcttttttgggtgcccccggaaattgaaaatggggcccgtggcagaggtgcactttcggtcctgtttccatcctgtttgtgtctttttgccgttttcggccattagaagttggaggtttgctgtccttctggccaattttggggcctcagcaggtttccaaatcaatcattaccccctaccccatttccaggcctttaataaagtttgctgcctgcttaggggctttgaaggggaaacccgtgggccgggtcaccataagttgttaacattggggaagcatttggcccataaagtttttggaactttta

SEQ ID NO: 486683 - DNA, 843 bp, Homo sapiens
  misc_feature (10)..(10): n is a, c, g, or t
  misc_feature (71)..(71): n is a, c, g, or t
  misc_feature (82)..(82): n is a, c, g, or t
  misc_feature (89)..(89): n is a, c, g, or t
  misc_feature (96)..(98): n is a, c, g, or t
  misc_feature (103)..(103): n is a, c, g, or t
  misc_feature (113)..(114): n is a, c, g, or t
  misc_feature (131)..(131): n is a, c, g, or t
  misc_feature (138)..(138): n is a, c, g, or t
  misc_feature (154)..(154): n is a, c, g, or t
  misc_feature (159)..(159): n is a, c, g, or t
  misc_feature (161)..(161): n is a, c, g, or t
  misc_feature (198)..(198): n is a, c, g, or t
  misc_feature (228)..(228): n is a, c, g, or t
  misc_feature (231)..(231): n is a, c, g, or t
  misc_feature (238)..(238): n is a, c, g, or t
  misc_feature (242)..(242): n is a, c, g, or t
  misc_feature (254)..(254): n is a, c, g, or t
  misc_feature (260)..(260): n is a, c, g, or t
  misc_feature (264)..(264): n is a, c, g, or t
  misc_feature (268)..(268): n is a, c, g, or t
  misc_feature (276)..(276): n is a, c, g, or t
  misc_feature (280)..(280): n is a, c, g, or t
  misc_feature (294)..(297): n is a, c, g, or t
  misc_feature (299)..(299): n is a, c, g, or t
  misc_feature (303)..(303): n is a, c, g, or t
  misc_feature (305)..(305): n is a, c, g, or t
  misc_feature (307)..(308): n is a, c, g, or t
  misc_feature (310)..(312): n is a, c, g, or t
  misc_feature (314)..(314): n is a, c, g, or t
  misc_feature (316)..(316): n is a, c, g, or t
  misc_feature (319)..(319): n is a, c, g, or t
  misc_feature (722)..(722): n is a, c, g, or t
  misc_feature (825)..(825): n is a, c, g, or t
tgggcggggnggctcacgcctgtaatcccagcactgttggggggccggggcaggcgggtcagttgagcccnggtgttcgggnccagccnggccggnnnggcgngatcctgttnntacaaaagatacgaaanacaaggnatttgccggggatggngttgngngcgcgtagggggcacaagctacttggggggctggggngggggggtcacttgggcccgggttggggcngcngtgggcngtgntgtcgtcactgnactccncctngggngacagggngggnccttgtctcaaaannnngnaaangngnngnnncncngcnccagacaacctactgtaatttcagactagcagaatattccagaaagttcatgcttgtatcagcacagggagacattactccaccattgctaaatctttcaggctatggcttttttgtctcttggccttatatcctggacgcaggaactctatctttctcttctttgcttcacttttatttttgtgtttcttcatttttttcttggcagcaatatcaggattagttacaaactccagggccttcctctttttccggagtgcccttttctcattagcctgtttctgtacagaggcaaaggctaatgagaagctctcaagcccaaccagctttttgagtaattctatgatttcctgggatagattcttcagcaaaggatcttgctctgaataggtgctgttgagtnccgaaacaaaggagctatgatcattgggagatacggctttaccttgtctatcccaagatccattgctacggcgccgaggaacttaaagatgcatgttctcttnaaggggtttctcggcgaa

SEQ ID NO: 486684 - DNA, 156 bp, Homo sapiens
gggggttttgggcccccttaaaaaaaaaaaaatttgtaccttggggcttttttattaattcccaacgggccccccaaaaggagaaatttttttttccgttttttttaaaaaggtctggtttaaaatttggagcccccctttttttttttttttgta

SEQ ID NO: 486685 - DNA, 387 bp, Homo sapiens
  misc_feature (12)..(12): n is a, c, g, or t
  misc_feature (206)..(206): n is a, c, g, or t
  misc_feature (357)..(357): n is a, c, g, or t
  misc_feature (369)..(369): n is a, c, g, or t
ctgaagcttcangccatactttctccgacaaccggcgccggggcttctaggagcagtgttacggtcctcggctgcgagagtaaggccccaccctggacatgccggtttcttccaccttcaacgacattggccaggactggtggccgcagcttttttcggccagatgtggtacgaacaggaagttaccctgccagagcgatggaccnaggacctgcacacaagagtggtgctgaggattggcagtgccactcctatgccatcatggtcaaatttgtattcaggcagaagtcttctgcaggggcagagcttcatggagaacctgcgctagggcaattgcagaagggaaatgtggggttnggagctctcatngcagagtccccactgaag

SEQ ID NO: 486686 - DNA, 845 bp, Homo sapiens
ccactctgagagtggggttaatcttcgcgtgtgtgtggtctctgctccttcgtcccctgtttatccattgttcccaacgggccgttttggtgaccgcaatttccacctcagttctccgccgaaattccggtgccctctccgggaagcccaccaatcaaatgcgccccaggtccttttaggcttaaaatcgcaattggggtgaacttcgttacacccgcgtgggtgaactattttttgcccctgccaagctttttggtcccgcccaccccccacattataagaggggcttctaatctgcatccactttccgcgggtcccctctacgccccgggagtctcctttttgccaaggtgttttcacccacatcgtcgaaagggcaggtgctttctcccagtatattgtgcgccgcaacctgggagcccccgccccgacccggccccagttatcccctcgcgtcatgagcaccggggaagtgacccccccggcctgggcgaacccctttgggctgtaccctaactgtcaaactacttcttaggcccgtcaaattttcttataagatgcttaagagttttccaaaaaaatattcgggaaaacccgaacctgtggacacttaaaagttccccccgattggttccccaccaatgtgacaccaagaaaccccctgccagttccattttacacaacccccgcaacgccacagactctgtgggaaattacaaccgtccctaccccccttggcggttctggcctttctgcgcccaactacataacactttttaaccattttttaaaccaaaaggtttaggtacccttaaaaaaagatttaaaaatttaaaagtttttta

SEQ ID NO: 486687 - DNA, 97 bp, Homo sapiens
ggggagccccccccccccccccccccccgggggctttggtttggttttttaccccggattgggggggtttttttttaaaaaattttttttaggggga

SEQ ID NO: 486688 - DNA, 208 bp, Homo sapiens
aacacaggacacatggcagcaacatactagttatgaagagaagcatggccagtctcccgaactgactcttagactcttaggccgactggcctctccacacctagtgtgcgtgcactagatttgaatttgtatgcaacattcaccattgcatcttaagttttcctaataccatttccattacgatcatgtaagtgaaaaaggtccatta

SEQ ID NO: 486689 - DNA, 614 bp, Homo sapiens
cgcagtctctgtgctgttgaagcctggagacctgcggcggcctcagctgaggaccctccgccccggagccgcctggcctggagcctgcagcctctgcctgcagctgccccaggcactgtcccctcccacctccgcttccgcctggatcgctcgtgcatctgggtatgtgcctgtcaattgtgtactccacatctgtgacacacgcgacaatcgtgagtcggcatgatatgcttgcgagtgggtcaaagagtccctgcacctcagactataccaagatagaacagcttagtccacgggcgcaggccatactgccagtgcagtggacagtgcttcgtacccacgtgctgctgtgcacgtagaggagaaaatgtgatccggtttcgcgaagtggcccaaagagcgtatggacgcgattgcaagattaacacaatcgcatgcgaagtatccgcgacggataggcatgcgaaggtcgaatgacggtaagcgaaggggaagaggaattgcgcgttggtagagacgcagaagttagggattacggtgacggcactcagtgacgggcgtgcgccccgtggaagggaagcagggctagtgagcgcgcatggggcgaaagtaac

SEQ ID NO: 486690 - DNA, 594 bp, Homo sapiens
caaacgcacccacacgggggaaaggcccttcagttgcgagttctgtgaacagcgcttcacttagaaggggcccctccttaggcacgtgccaaccgccatcaggagggccggccccccttctgccaaatattcggcaaaaccttcaaaaccgtggagcaactgcgtgtgcacgtcaaacggcccaaaggggttaggaagttttagtgcccccagtgtgggttcaagttttccccacaggccccccttcggaggcacatggagatccccggccgggtaaagaacttcaacccccggcagggcaagctccgcaaccttattattgaggacgaaaaaatggtggtggtggcccttcaacccccttcaaaactggaggtgggctcggcggaggtcattttggagtccctggcccagggcggcctggcctcccagctccccggccaaaaactgtgtgcaaaggaaagctttcccggcccaggtgttctggaggccgccctcatcattccaactgctgttccccagggctgtgacacatagccccttttggcccccaaaggccccttggccccccccctcaataaaccgggtgggtttgga

SEQ ID NO: 486691 - DNA, 365 bp, Homo sapiens
cgatctagaggatccgcgacgctctctctgtggggactgtcggatgagcccaaggaagagtgtgatgaacgcacctgtagccataccagttccgctgcaagaacaacctgttgcgtgcccgtccgctggcagtgcgactacgacaacgattgcggtgacaactccgatgaagagagctgcacccctcggccctctgtggggaggcctggcaggctctggttcgagggctgaggcagtggctctcggggggtagagaggggtcttctggctgctctggagggatctggagactctgtagcaggcaggctaggggactagaatcctctgagaggggtggatgagctccccccccaaagagatagcgt

SEQ ID NO: 486692 - DNA, 110 bp, Homo sapiens
tagatcacatcatagcctcaagtcacgtcccaagcccccgtccttgatctgtgcatcctgggggcatgctctggagggggtttgcgtggggaactggacgccatcgccgt

SEQ ID NO: 486693 - DNA, 387 bp, Homo sapiens
  misc_feature (8)..(8): n is a, c, g, or t
  misc_feature (12)..(12): n is a, c, g, or t
  misc_feature (20)..(22): n is a, c, g, or t
  misc_feature (76)..(79): n is a, c, g, or t
  misc_feature (89)..(89): n is a, c, g, or t
  misc_feature (118)..(118): n is a, c, g, or t
  misc_feature (130)..(130): n is a, c, g, or t
  misc_feature (158)..(158): n is a, c, g, or t
  misc_feature (169)..(169): n is a, c, g, or t
  misc_feature (185)..(185): n is a, c, g, or t
  misc_feature (221)..(221): n is a, c, g, or t
  misc_feature (246)..(246): n is a, c, g, or t
  misc_feature (248)..(248): n is a, c, g, or t
  misc_feature (280)..(280): n is a, c, g, or t
  misc_feature (300)..(300): n is a, c, g, or t
  misc_feature (317)..(318): n is a, c, g, or t
  misc_feature (352)..(352): n is a, c, g, or t
  misc_feature (369)..(370): n is a, c, g, or t
  misc_feature (374)..(375): n is a, c, g, or t
gggatacntcantatattannntggtcagaatatagcctacagatagccagaacactatgccatgataaagctcannnntctagcagtnccaaagaacaaatcatatcatggcctggntatcaggttganagagctcatacttatgacaaatggtccnttcacagcaantttcatagaaacaganttttattggatgtcacaagatgcttttatatgtgancactccttagcagagaagatataancntctttagaattgatgaaaagaaaatataaaantctgcatttatttcaatcgnagaagccagcatcctcnngaggtataagagtagtctattacataaacaccgntcacatctctcccatgnntatnntactgaagcaag

SEQ ID NO: 486694 - DNA, 859 bp, Homo sapiens
tgagtgaatgataaggtccgcacgctctgctcctgactcaccgctgttcgctctcgccgaaggaacaagtcggtcaggcagcccggcgcaacagccatggcttttcaaaggataccggacaaaccacccgtggagccggaggtggcaattcaccgcacattcgaatcaccctaacaagccgccaacgtaccacatccttggccaccaggtgtgtgcattgacttgctacagaggctgcacaacagaacaagaactgctcacacgtgaaacggacccacgtttcgaactgcctaccaagaccattggagaactcacctaccgacgacaaaagcgtccttgatggtgacaggtctctaagaccgtgggactcgtaatccacgactgacgaacttcacaaagcagactcactaagagcttgcaaccagatcccttctagagacatagtaaaggcagcattactttaccatcaggatatagacgccaagggagttagagggtggaagatcaaggcaatagacagatgcgtaaagatacaagtactaaaaataaaattgatgcaccaacgatcgtcaaaccacaaaaaacaaacaacaacaaacaaaacacacgcgaggggacaacacaacaccaaagagaacgaagacaaacaaaaacggacaacaacaacagagacacacaacagagaaaccaaaaaccaaagagaacaccacacacacaacgaacaaaaacagtaaaccaaagcaggaaaacaacacatgcacccggaaaccacaaaacaaaaagagaacaaactaagaaaaataaaaaaacagaaacagcacaacagaacaccacgacaaaaacacgaacgacgcccaat

SEQ ID NO: 486695 - DNA, 141 bp, Homo sapiens
tagcatgatgaaggtcagcctggcagtcagagaagtggtgcagatcactgctctgggtttcaggcgcctgtgtctcatcaccagtgaagctgggatccaccataaaccaatttctgctattgaaacttctaatgactaggg

SEQ ID NO: 486696 - DNA, 490 bp, Homo sapiens
agatccgttgagccagggcaaactatgtaccgcacctatatggcagacctgccgatggatgcaggactcttagctgcttggagttgtctcttgacataaggtgtaagactccaacacttccaacaatacattgtaaccaaactagtgcaagctgtggatcactttcaaagccaagcacacaacctacaacaacaacaccaccactaccactggctgcacctgtcccaccaaggattcagtgtcctggcacaaccctactttaaccaagtgcagcagctctctgatcacgacttagggcacggactatatatcctccacgttgccccgaaaccgctcacgcacctcttttgcagtgaagtcctcccagggatccgtgcacgttatcgattactaggactatgcagacaacctgcctctcccgtgttcttctttttcttttttctctttgctggcgctgcgcgcccgtcgcgctctgtggcgggcggcgcgg

SEQ ID NO: 486697 - DNA, 116 bp, Homo sapiens
ccagaaatgtctctctgcagctctgggtagtagtcggtgctgcagagagacatttctgaaatgtttttggcagacttataaacaagggggtttgctgggcctctccaatattaagt

SEQ ID NO: 486698 - DNA, 117 bp, Homo sapiens
ttttattcacactggtctcacagttagtgtacaggtaagccctggtgcctcacccactccgcaggagacaaaagccttcatacatctcaagttgggggacaaaaaaagggcggcgct

SEQ ID NO: 486699 - DNA, 136 bp, Homo sapiens
ctgatcctcgtgtctatgcggaactcatgcttagaatggttctaacgtactcggctatcaaaacttactgtctgcctcttcaaacttcacacctcacgaaaatgttaaacatgcccagcacggacacgaattttca

SEQ ID NO: 486700 - DNA, 1990 bp, Homo sapiens
actagatgagggacgtacttctgtgccatcatactgtcattgaaagtgagtagtgtacagtgcgtgtagctctatgagcgaaccatgacactatgtgtgtgctctactggtctagctcatgccgctcagcgcactagtgcaatgtgtgcagtgagaagcgtaccgactgccttcgcatcgcatcataggatgtgataaggtgctgagcctaggctatacatctagtactcacctgtgcccacgaacctccattgacacccgtgcacatggtccctatgggatgatgcttcatacacaactgggtgaagcacaggagaaggagttacccagctaacctccggaaacggggccaacgccacgggctgcgacgaccaactcagtagggggcacaccatacgagaacgccttggcagatcatagagacggtgaactgcaccaggacagggcggcccacaagagtagaaacagtgggccagcacaaatgagcacgcaacagagcgcatggcaaccacacgttgacacacgaaatagaacttggtggaacgcccaacatgagaaggcatgaacagtcatagtggccattgggtctgtgaaaagctggtccacttccaattttcccacagtgaggagcaggtactcctacaaagattcgcctggtaaaggcttaacactagggatatggtgtgccaaacaggcacacatctcgcccgtgtatagtttgggtcgacataggagtgtaaaagatgtccttggccagaacaccaagattatgaatgacacacacacgagagactccgccacatagtgggaacacgatcaacgagcggatcacaaagcgtaactatggtatgtgggcgcgccacctcaagaatatttcgtggtgcataagaacaacaccgcagtttgggagcattttatcaggcaatgtgacacatccaagaacgttatagatatcagaatgacacttccatatggaaaagacaccacattgtcactagcgtaaggctcacaatatacacgtataaaggttgtgaccgcctgtatattgatgtgaccccgccgcgtagtatgcgattagggagcaacatctacggcgccgttcacgctcgtgtccgattcccacaggttaagtcgctattacccaatcaggcatacagcgcactcaggtagacgctaggagaaacttggaacagcacgacagtcgggcaatgcgagcccagagtagcccgcgcgattcaaaaaagggacatggggaaagaaaaagaggtccacctaacatctacacaacgacgaggtcacgagcatgcaaaaaacagaccaaaaatggtacgaacacaggacagactaacccaacagagacgaacgaccacccagtgagacatcatgtgtgacgcacaggcgacaccacagagatgagatagcccccagcgacgtgggtaacaccgaaaggggcagtcgacaaaggtatcaacacacacgcaagtaacgtagcacacggaagcaaggatcgcacccagcaagacagagatgctaccaacgggaggacgaacagcggttagaatagtacaccatgattcgcacccagaagcacaacaagcagacggaagacaacagcaacgaccgcgaaccggagagccacacacaaacatatacaccagcaaggcaacagcagcagcaacacaggatgaggacaaagagacgactcagaccgcagcaacacagctgaaaacgaagcgagcactcaacgaagacgaaagagcaacgcggcagacaaacgagtcggtgccacatacaacacagtcacacgcaaggacaaggagaaaaacaaacaactgagacacaagaagcaagacctccgaacagcaccacaacaaacacaaacacgtacgacagcaaggatgcgtgagaaaacgcagaccgagaagtgcaagccagcgacacgcacacggaacgaaagagcgtgccacacaaagaatcaagaagcagccat

SEQ ID NO: 486701 - DNA, 426 bp, Homo sapiens
ctcgccaagagaccctcaagaaagcattcagctttatgataccatggctcaagtctgggaaactttttccagggctcaggaatccgcgtccagaggaattcattctttttaagaataaaatagtcattaagaagttggatgctagaaaatatgaagaaaacttaaaggcagaattgacaaattggattaaaaatggccaagtgaagaaggtcaaaagagtactgaagaaccttagtccggattcattgtctagttcaaaagatatggtgaaaatgtttcctcttcttgttgaaaagttaagacaaatggataagttgcctgcaatattttttttgtttaagaatgatgatgtgggaaagagagctggaagtgtgtgcacttttctggagaagacagagacaaaaagccatccccacactgaatgtc

SEQ ID NO: 486702 - DNA, 169 bp, Homo sapiens
acatcagaaaaagtcgtatgaacttcactgacccatatcctattacagcatatgagggatacctgcacgaagtatacaaaaagtatactagcatactacactaagctagaagtccagacatcctaaagaaaccaggctatgatggagtgtacccgataatgtcagacta

SEQ ID NO: 486703 - DNA, 493 bp, Homo sapiens
  misc_feature (1)..(1): n is a, c, g, or t
  misc_feature (239)..(239): n is a, c, g, or t
naggggtggaggaaccagatgtgtgtacagtgctacccaaggcggctgtgatcggtctcaccaagtccgtggctgcagacttcatccaacagggcatcagatgcaactgtgtgtgtccaggaacggttgacaccccatctctgcaagaaagaatacaagccagagacaatcccaaagaggcactgaaaactttcctaaacagacaaaagacgggaaggtttgcgtcggccgaagaggtngctctgctctgcgtatacctggcctcggacgagtcagcctatgtaactggcaaccctgtcatcattgatggggctggagcctgtgaccgcgaggatccctgctgggaagacaggcccttcctagccacggagcaaagcaagctgcctgggtgatcatctcttctgagagtgacattcatgaaaataagccctttagtgattgttcccgagagtgtgactctttaatagtctctcgtctcttctgaagctgtggt

SEQ ID NO: 486704 - DNA, 880 bp, Homo sapiens
  misc_feature (375)..(375): n is a, c, g, or t
tggggtttattattcaaagtttagtggacctccccagcaaggaaggcaaacccttccgaccgggggaaatgtccatctagtcggccctctgtggggttgcgcctatgccatgaaaggtgtactggacaccagggagggagcccgggcatgagggcaggccattaaagcgcaagagggaacgtgtgagccaggagaatcggcacactcaaccccattggatgatcgctttcgtcctcctcaggtcagggccagcggtgtggggtgacatagaacgggtcgccaaaaggtccggtggcgcagtctgccgagaggggtgaagacgcgggcctttctcaaagaactcagtggggatgccgcaacgatgaggtggaactnacaggtccctccccgggcaatggggaaagctcactcatctcgggggggcgcaggataacaccgacaggccaggctcccaggtcggggagaacagtgacaggcagtgacggggggacaccaaggggctggggggggccaccttctcctcctggcaggaggatgtaacgcgtggcggccttccaccttcggggggggctgtgaggggaacccgggttggacacatgcaccagggccccgccgaaaagtgcataccgggtataaaggcctggagaccacggggccccggagggtataattcgcgggccatcgggccctcctccaaaggggccggggtgggaaagatctcaaaggggccgtggcacccacagtgcgaggatgcactggataggtcccaaggaagtcaaaacgtcggtttcccttcctaaaaagtgcccgcctaagttgactctgtacccagggtgccacggcacgggacagagatacacgcgcccaaaggagaggaaag

SEQ ID NO: 486705 - DNA, 101 bp, Homo sapiens
gatacttggtggagaatatccgcttccccgatgatgctccctgaggagctctttgagctgcagtacaacctgtccctgtagtcggagccacagaggccctg

SEQ ID NO: 486706 - DNA, 108 bp, Homo sapiens
gaacgggaggcggagcagagtcgactgggagcgaccgagcgggcccgccgccgccgccatgaaccccgaatatgactacctgtttaagctgcttttgattggcgactc

SEQ ID NO: 486707 - DNA, 303 bp, Homo sapiens
gatctctccacccacccctcagactctccagtatacacacacgtgtacaccctaaacatttttcctttcccctgcacgatcctcacatgtatttggcacagagacagcttacatctggaactgccatcatttttcttgggttgacaaatgttgtcccagaaatggaaagaaaaacgccactttggtcatcatccatccagcaaggggttgatagctttctctaaagcgaagctaatttgtcttctttctctttgagtttttcatcacagagatccagcatggattggggtgggtggagagcgg

SEQ ID NO: 486708 - DNA, 1296 bp, Homo sapiens
gggacccggctgcgcgggtggtgcgggcgctgtggcctggtggtgtgcgccttggcctggaggctgggaggccgccccagccgctgctacccacgcagagcctggtcgctggcttcgctgggggtgcggcgggctggccgagcccctgtggctgcagctcgtactggtgggatgcccgcgtgtgctggtgatgctgccggctgctggccctgtgggggagccctggggctgtaccacactggtgcggtggcacctgcgcgcccatggacctccacgcagagcgctcagccggcgcaggatcataccctgtcgcagggccgccttgcaagggttgagcctcttgtaccatgtacaaggactgttgtcccttcttgcagcaaaggtccgcgagcgcttacctacgaggttcccattgcgcccttgcgccttacacgaggttggtggaggttgaacccttgtgccgcaagggggcattgaggatcgacaggtatctccttcctaggagagagggttgcccccagtccctgtgtggcccaggcacagggaagcaaaggctcgcaaggaattagattgactcgctctgtcatcatcaggccgccctcaaaggacctagcctgggtagtcgaggggcgagaccccttgggaaggagaatcattcagcttacttacccaagcccaattgaatggctgttgaagctacgcaaggggcgacaggcaggttgacccgaggttccggcaataaggtacgtgggttcattgctcaagggaggacggagggcccagacacagttggtaattggggatggagaccaggcgaaggggccccaaagggaccgggcgacggggacgagtatgccaaggatgggccggacaacaagtgcgccgggcaagggacacttggcgcatggggtgggcggaccctgagattctatccacccacaaggagtgatggaacgcgggagacggcgacacgaccggagaggcaccgtgggcgggtacccttatagcacataaccatatgtccccgggagagggggacaagttacgggaagcccgggcagagggtgcccgagggcgcaccaagaaacatctggctgcacaggggagcacagcaagcgcgaaagtagagcaacagcgagcagcccagaagcgagggggacgccgcaccccacgggggacagagcggtgcgaggaaggggacccgcatagggagggatgcaacggacgacgagacgcgtgagctgcgacggacggcaatggggaaaggggggcccctataccgcgagaggaggccca

SEQ ID NO: 486709 - DNA, 386 bp, Homo sapiens
ctgagcttcctacccaagttgtgggatattactccaaaacaactcaagaacccaaattatcttactgcctgattaaatgtaaccactctagctttttaaagacacattcctgttactcacattaatccatctccctcacgtttcaggtttgctggaaggaaaagtacaaaaataatggagtagagaaatgggagaatccagaggaccatctgaaatcactttcctgaaaatacaacggacatgacccaaaaaacggaagctactagtttccttcaggataaaacccaggaattttattggacaaaaatttcaatggatttcaaatgaagcatttgggacagcaaacctgaaggggccaaagggaccaaaactctaaaaatagtttt

SEQ ID NO: 486710 - DNA, 163 bp, Homo sapiens
caattctggccctttgaacgaggaaatgaagggtatgccgctgttactgatatacctttacggtcacgttcacttgagaagctttaagaaataaagagagtaattaaattctttgacaagtttccatggcggtgtgatctccatacagcaaagtgcacaactg

SEQ ID NO: 486711 - DNA, 155 bp, Homo sapiens
taggaaattgtacatctaaaatacatttgtgagaggtataacttgtaaaaatgggcttctttcactagggttctaatttttataggcaatgctacagaaataaagataattgtaggctgaagagtgcattcaaagggtcagtaactttgaaggat

SEQ ID NO: 486712 - DNA, 199 bp, Homo sapiens
  misc_feature (90)..(90): n is a, c, g, or t
gtgtgacgactcacgtgactcttgagtgccatcaacgcacacgcacactgtctaacacttatgttttcattttttaaagacatctaaatnactgagagatacaatttcagcaggttaatctacagacgtgaatcccagcacttgaacacaattcctaactctaagctcagttattgcacatcacacagtttaagcaggc

SEQ ID NO: 486713 - DNA, 341 bp, Homo sapiens
aaggtaactatttctcttgtctttcgtacagggaggaatttgacagtagatagaaaccgacctggagttactccggtctgaactcagatcacgtaggcctttaatcgttgaacaaacgaacctttaatagcgggtgcaccatagggatgtcctgatccaacatcgaggacgtaaaccctatttgttgatctggactctagaataggatagcgctggttatccctagggtacacctctgtaccgttgagtcaagttaatatggtcacttgagtatagtaattcgctttgactggtgaagtcttagcatgtactgctcggaggtagggttctgctccgaggtc

SEQ ID NO: 486714 - DNA, 410 bp, Homo sapiens
  misc_feature (46)..(46): n is a, c, g, or t
  misc_feature (172)..(172): n is a, c, g, or t
acctttctgagtcttacttggttctggaaggctctctggagctggncctcaagctccatcttagatttcatcttctggaactctcctctctccctcatccagcttcagtcactctggtgtctcctcaaacacaccaaatacactctccctctcctcgacccccgggggaatntgtacacaggtcctgggtctaaaaagttccctccacaagggggccaaatggctcctaactgtactcaggtccctactcaaacataaacaaataaaattcttcttttccaccatctctttctaccaccttctcctgcttgattctcccttataggcacgtaacgccaaccaaaatatatttatttgttctgggattaaatttggaatataagctttcatggataggcagaggacttggg

SEQ ID NO: 486715 - DNA, 193 bp, Homo sapiens
gtagtactatgcacaatcgtcgtccggcacaccttacacctggctaaatagtgaacttttttgcagataagggcttttgctactgttgctcggactggtctgaattcctgggctcaagccatctgcctgcctgcaactcccaagagtgatgggattacaggcctgggcccactgtgcctggccccaaacatct

SEQ ID NO: 486716 - DNA, 927 bp, Homo sapiens
ttggtgtgcagcccggtatctagttgtgtgactcactagatgtggatcggtggcggatcgagatctgtaggaggattttcactttatgccagttcagattgtggcataaatacgactggtcatagtagggctttgttgcgtgccgtattacacgcatggtgttgcttacgtcgagtatctcaggtggaagacactgtgacgaagcgtgtccttcagtgcaccgatggctcttctgcaagtctaggtatagctttcacgtgcctcgtgaccaagatgatatctgttgccacaaatatcgcctttttcacgctttcgcaaaggagagatgggttattacctcctaggcaggatatttcaatgatgacatttaagaaagtctgtcgtgtagtaaaggtacagctatgttgcgtttgaatgctagaagggtctttgaatagcatttgttgggttagagataagaagtgcactgtgaggagtgaagtagctatcacgaaggggcggtatgaatgatgatcaacatatttttacgtgaaaaattggtagattgattaaaactgaagtcataaggtatgcgaagttaatgaaaaagatgacagcgaagagtcacatatggttctggccagtacttggaacgttgggcgacgagaaaggataagcacctttggagggaacgtgcgggaaaggaaccaaagaatccaaaagaaccttgctgatgaggaactgaaggctgactaattttgttctggcgaaactgactttcttccccatcaccttcctaaattatccaagactgtctggggcagtgccacatataatttttcccttctggcaatatttagagggcaatgctggactggttggtaagtcccaatcggcctgtcaacattggtcagggcaagggaaaaatgcggcggcgacatcacttaa

SEQ ID NO: 486717 - DNA, 119 bp, Homo sapiens
tcaaactagagtggagctttaacatagaccagaccaaccagaagaaagaatttagagctttagaccagtctttgaattacttagttaaggcaacaaagtctctcataaatatagagtta

SEQ ID NO: 486718 - DNA, 581 bp, Homo sapiens
  misc_feature (246)..(246): n is a, c, g, or t
ggattgagataagcacggtgcatggtcggggctgagataagaatatcgcttgacgccaggaggctgaggctgcagtgagcctagattgcaccactgcactccagcctggtcgacagagtgagtctcaaagaaaaaaaaaaagcaaacagatagatttttttaggcagggtaataccagagttaattggcctattctaccaaaggtttttattgaattcttcaaagaaattcatgcccctgaaaggnttaagagccaggattttagacaggaaggaataagagctgtgaggaactctgggtgataacctactgtgtgctctgttacattgccatttgtttgttgccttggtatagtgaccctgtaattggatcatccaagtcagggaacttgaagagtgaaagagggggcattatgataatatttatactgggataggaggacttacttgtcctggagaaactgagatacttgaacttcttaaccctaacatagcgccatcatcacctttcacatgggttactgcaacagcctccttgctgtccttgtgttaactctaatccggtcccaatctaatttccac

SEQ ID NO: 486719 - DNA, 335 bp, Homo sapiens
ggagctcggtaccagatcccctttcatccaacaggcacacaaaagtttgcagaagaaggcagtggaaatatgcccaggccctggtctgggggctccaccagggcttgatcctcgtcattctgcccattcttccctccatgcctggaacatgtacacccaaacccaaatcccatcttttcccccagacccagctctcctatgtagcccatgcatgttgatggtgcttcatctggattccatacattccaacccacagggggctcgcctctacccttgcctctcatggccaaattatgtctgaggtctttggagaggtctccattcttattgttttc

SEQ ID NO: 486720 - DNA, 409 bp, Homo sapiens
cggtccggtcatgcatgctgagatgcttttgcggagctatcacctaccagccagccgacagcaccaaaatgtgcgatgcaggcgctgggcatagggttgcggagcggactcgaagaagaagcggccgccgcagaccccccgaggaatcgcagccacctcagtcccagtcgcaagtgcccccggcggtccctcactcaacatcaccaccattcgcactcggggccggtatgatctcgcggtattatcgtcgagccccacgactgggaagcgctactgccggggcgaagtgctgggaaagggtggctgtgcaaattgttacgatatgacagatttgacaatataacaaagtctacgccgcagagattattcctcacagcagagtagctgagcctcatcaacgggaatggat

SEQ ID NO: 486721 - DNA, 595 bp, Homo sapiens
gagcgggcccgcggggccggcgtcctgtcagagggaggtggcgatgagtgcgcccggtggcggtggcggcggaggttgcggaggcttccttggtcgtgattgcaacgatggcagacgatgactgaccaaccgactggctgactgaatgaatggccgtgcagccgagacgctgccgatgaggagcctgcctgagcctgggcgacagagcaaagactctgtcttcaataggaattgaatagaaacatttttcatgtctaggaattccgggccaactagagggcccataacacgctctcgagagcgcggccgcccccgcggggtcgagaggaaattaaggagcgaccgtgtataacgccaagagagtaaaaacacgcaaagaaatgggggcgtacaaacaagggggcaaacacacggaggacaaccacgggaggtgcacaaaattggggtcaaacaagcacacagggaagctccgagggagcaatatttgcaagacccaaagggcggaaacgggaccgcacaaaagccaacgagtagcgaaagagcaggaacaggacagcgacaacaacacgacaacacacaggccgaccaagaggag

SEQ ID NO: 486722 - DNA, 385 bp, Homo sapiens
agccatggtaggataggaaacggaggcgagagaggtcgggtaaccggccaggggatacacggctggcaggaggaagagccaggatcagagcagggttcaggatcagggccgtggtctccacaggccaagcactcagctagtttctgctccccacctgttcagtgaatggaggcctacaaaaggccgcaataactcaatgcacatgggcagcagcccaatggtctgcccagttcaagaataatttctagagcatctagcaaagtccagagaacagatagaatttatcatcattataaaaaagaagaggaagcccatgttgagggtggggagagagcaaaatctatcatttatggattactgtgtaatgtactaggcaatcaagctt

SEQ ID NO: 486723 - DNA, 443 bp, Homo sapiens
acgaggacacatgcatcttgtagtcagagtctaggaaccgaagtcatgcctcagcagcgagatgtgtcgcttgctaaagtacatgaagatcacgcacctgtagatgaacaatctcgtcaccctgcccattcaggaggcagaggcaattgaatggtttctgatcaactcactcaagcgagagttaatggggaccataccaccgcagaagcagactcttgcgggccagcgccatatgattatggtacaggttgtttgagcgagagtacacgtacacgatatcccggattcacatagcgcttaacggcacagagcactgcaatgccggtggcccagactcgtgcgctctacctcgacctcgccgcatagtatacgtgttgcaccacaccgctgcatatactggccatgattgtcgacagtccgccaccgctatctgtgcccgcccg

SEQ ID NO: 486724 - DNA, 170 bp, Homo sapiens
gcctgattagacatccattcccttaagaaatatttttaaatacttattaggtgccagttactactttaggtactttagggtactagagatatatccagggaaaatacatagaaaaatctccgcctccattattatgtaattactaaggcttatgacagcttaaccgccat

SEQ ID NO: 486725 - DNA, 152 bp, Homo sapiens
gatcatggattatctattagtggtgagttgtgtatgaagtccttgagataggattatgatgcgagtgtgagtgcgtcgtagtttgagttttgctaggcagaatagtaatgaggatgtaagtccttgggcgattatgagaatgactgcgccat

SEQ ID NO: 486726 - DNA, 402 bp, Homo sapiens
gctgccgcctactactactaaataagcggccggtcgaccccaagtgtccatcagctgataaatggataaacaaaatgtggtccatcaatacaatggaatattgttcagccattaaaaaaaaaagaatggggctgggtgctgggtgcagtggctcacgcctgtaatcccagcgctttgggaggccgaggcaggcggatcacgaggttgggagatcgagaccatcctggctaacacagtgaaactccatctctactaaaaatacaaaaaaattagccgggcgtggtggcacgtgcctgttagtcccagttactcgggaggctgaggcagaagaatcatttgaactggggaggcagaggttgcagtgagccaagataacgccactgcactccagcctgggtgaca

SEQ ID NO: 486727 - DNA, 135 bp, Homo sapiens
cttgcggtcgtctctagacggatccccctgatttcccggggagaacgagcctcttggatgatctggcatcctggacccggacgatcaggagcctggccaagtacaagcgggtgctgctggggcccctgccaccgg

SEQ ID NO: 486728 - DNA, 825 bp, Homo sapiens
cgagccatagctatccaaagtggtctgcatttctactgtaaaatgcaattggaaaaaaataaaagcaaaaaaagaaactgtaaagggaaaccaagagatttggtttaattttttgggccattttttcttcatcaattttttttcggtctcaacttttaaactgggtttaagcatttgatttgtaaaacagtaaataatgtatctttccatagcttttcaaatgtgaaatcattttggaagctgggatctcattaaacttcatgtctctattccattgtgtgccacacacttaaaagttagtgtactgaatggaagaagaagcattcctagttctacacttcttttatcccccctcatgtgtcaaacatgaccagaaaaactaaatttgtgccctaatacccaaggcgctacgttaatggcctcgtccttatcactgaccttgtgtaattgatacacagcgaatttcttctggacaaacgagaaatgcagtgtagtatgcagagctgctgtttaatgcctatgcatttactcttcctgattaaggcagacggtgccatttctttatgcattctcttattttttaagtgtacccctaccttcagtattactcttgtgtaacgttaggtgactggcatcttgtggccttgaatattttattcatcacatgtgggctaccagtttccccacttttagtccttcatttctttttatttggggcatttcctggtaggttcccaatggtggttcgcgtggttcccccacccgttattgtgttttaggcgaggttccccgttgcggggggtactctgccaataccgcgtgtca

SEQ ID NO: 486729 - DNA, 1212 bp, Homo sapiens
  misc_feature (122)..(122): n is a, c, g, or t
  misc_feature (262)..(262): n is a, c, g, or t
gtgagtgtgtgttgtttgtgtttttatttgtgttgattatatttggtgtgttttggtattgtgtgtgtgtagtgtagtattgtgcgtcgtgctgttgtaggttgttgttgtgttgtctatanaaagaaggagatgaagtatggggacagcggttgacagcgacaggaccaaaggagacaagcaaagccccacaccgctcagtagttgcgatcagctccgtgggttttggttgcccgcacagaatttgttcacacgcagcacncaacaccccacccgtgttggagggggcctgcacaatatcaaacagaacatcgagcggcccccatttctgcgcgggtgttttccagtggggagaacacacaccccgccgcgcgcggtgtttgggtgagtgcaccccgggggcaccacaaggaggacccccacattttgctggggcggcagaacacaattctcgccccacacggggggcagtccgtggaaccccactgggggagtttttttttttcggcgcgaaatttgcattgtttctcgcgcccccccccccgtggttgcgacctgaggggcccccgccattttgtctgcacccgggccccttgtgcgacgacgagaattgggtgctcccccccgcctgggggtgtatattctcgggagtagcgcgcctcttttgtcggaggtggcaccccaccccgggagtgcacccgggccgggagaagagatacccccgggcagcacccggtgatcatgggtctgaaagaagaccctctctggggggccgacacaaccaacgaccatactgtgtcgcccgaaacgggtggttggtgcgccctttaagaggacacttggaggagatgaaagaggcacccacaaggaaagcatcgtcaaaattttaaaaaaaggtgtgtagataaaacaccgcaagcaacacccgaggagggcttatttgtttatggaccccggcggtgactccacgagaaatgatgtggggagaagtgtttcctcaaccctcgtaaaggtgataggattgtggtgggaagttcccccaccaggaagttctcttggggcccccgagttttgattgacgaccccaacaccccgggttttttgggggacaaagagggtagaggccccctggggggcccgcttggtgccctgggccccccgttgttttccccaattaaacggggttttttcccccaccccaaaaaaaaaaaa

SEQ ID NO: 486730 - DNA, 500 bp, Homo sapiens
  misc_feature (17)..(17): n is a, c, g, or t
agaggtaggtggatagngcggtgagttggagcatggtgggatgggtggcgcgcgccgccctttgttgtatccaggtgttttttgcatcggaagatatttggcctctttctgaacaatgaccagctgggtcccagccttacagagaagctatgtccggaattagcaaacacaagcgattccgaatctgtctctgagtaacagctcagctgtccaccaccagccatacaactctcttgcgactccagcccccccagcccactcacctcgcgctttcctaccacccacctacctgtggatagtcgacgtactgccccgcccccgcctctcttcgttcagctcgtcgcgtttttctccctctaccttcccgcgcgcttatcgcatttatctccccgacccgcgtggcggtccccccgggaccaactgcgtttaccacccccccctccgctatttaacccccatcaccctcaccccaatttaacacgcctttccccccccccccc

SEQ ID NO: 486731 - DNA, 880 bp, Homo sapiens
  misc_feature (230)..(230): n is a, c, g, or t
  misc_feature (498)..(498): n is a, c, g, or t
agcggagctggtccaagtgtccctggcctgaggtgtcgggccggatccctccttctcccggcgcctcaagcggacgaccgactcctctaagaatttcgtatccgaaggctcgcaacaagtttgttgaggccacatatgatcgagatgcgtgtaccatggcatgcgacgcttgatcgcgtgaacaatcacagtgggaacctggccggaacaccagagcagaggacttcatncacgtcaagctgttggcaactccaaagcagcgacacttgacacggatctcgtcgtgcaacagatagatgcgagtcttaaggaacgcatagaatcttgatagccttacagaatcggaaaacccagttcttggaccaatatcatagaagatctcaatgtcatgctttctagatgttgtatacaaaactaatctgacatacacaagagctaacatagagaaggtgacgggattgacacccttctgttactgtactggaacactctgtctgnctgagatgcgattttatatctgttacagaactcgggagtgagaattgccaataagcttagacatgctgagcctttaggtgagctctgtgcattcgaattattctatgcaaggagtaatgttcagtatgatagaccaagagatgttaagcacaattaagcatggaggaacttccattaatgttttggtggttactcaagtgggttaatgtcctagttgagaacaacggtgtgcaaaagtggtactttggctaggaagtagcttttactggagttaagaaattttgccgttatatattcacttgaaatctttataatgattgactttgttggaaagttgaacttttggaaggcatttaggacaacctgtatgtcttattactag

SEQ ID NO: 486732 - DNA, 955 bp, Homo sapiens
cagagatggcgacgttgtggacggttcaccagcgggagttcctggcgctgtacgatcggttgtacgtcagctgagcaggagagcctcaagcgctccaaggagctcaacctggtgctggacgagatcaagagggtgcgtgtcagaaaggctggcgctggagagggagacggcaatcgcacctggggccgctaacagaggacccccgattgaagccgtggaacggctcacaccggcacgtgctgacacctgcccaccgtcttccatcagctgccacacctggtggccaaggagaggcagtctgcagcccgcggtgcgcgtgggccagggccgcaccggaagtgtcggtggtgatgggcatcccgagcgtgcggcgcgaggtgctctcgtacctgactgacaatctgcactcgctcatcctccgagctgagacccgccaaggacgatagggacggagctcggtcatcgtggtgctgatcgccgagactgactcagcagtagcacttcgggcagttgacagagaaatcaaggccttgttccccacggagatcaattctggtcctggaggtcatctaacctcccccagttgtaccctgacttctccgcatcgagagtcggtttgggacccacgacgagagtcaggggggagagacccaagagaagaacctcgatgtgctgcgtccctcaatgatcgtccgcagcacgtgccaacggcattacctaacgtgcagtggagggattgccatccggggcaagacgaatacgagagcgcacatgaagaacttgcactgggcgcgccttcaaagactggatggaaccggcaatccccagaggggttacgggaaaagcagggctggctgacacgaacgaagagctaagtaaagggaacacacggcgagacaactgggggaaagagacccagaggagacagcagaaaaaacgggcaccctcaagaaaa

SEQ ID NO: 486733 - DNA, 449 bp, Homo sapiens
aggacgagctctaatagagtccagggccatccctccccgacctctgatcgtaaagcccatgactgccctcgctgctcgaggagtgccgccacctttagcagccagaacccgaggagtacaccttcggcccagatggaaggcttcctcaatcggaaacacgagtgggaggcccacatataagtaaagcctcaagcaggtcctggcagcaatgttgtatcgtgtcatacataaccaagaaaggggttactacgaagatgcaaagactgctgcttctggaattccctaccacagcgaggtccctgtgagtttgaaagaagctgtctgcgaagtggcccttgattacaaaaagaagaaacacgtattcaagctaagactaaatgatggcaatgagcacctcttccaagccaaagacgatgaggaaatgaacacatggatccaggctatctctt

SEQ ID NO: 486734 - DNA, 374 bp, Homo sapiens
acggttattaaggcgcgtatctgcgtagggggcttgatggggcgaccactactctctacgcatcagggggaagccgtgctgacttgggcttcaagactcccaggagggatagctggagaaccaggagccaagatggctagtaggtgtaggggtggtagtatctgctttccgctattacgccttttttcttggcaaggggctgagctggaggagctgcagtaacagcaaggagcgggggtccaagcagagtgcaatgtgacttgagaagtggagaggaaatgacttgatgggtggggaatgttgaggacagtggtaggtatctcaggtggaggcgtatacaggggctgtgtgtgacacaaaagagacggcaggca

SEQ ID NO: 486735 - DNA, 210 bp, Homo sapiens
aagtgggatctgaccgtgtactgggtctggtcctccccatcccgctgccaggtcagtgtgatctccgcagggtagaagctcaggtccagcacctcaggatggcctcatggtcagagacagcgtggtgagtcatatgcgtcctgggggggtccgtgcgccgcagcgtctccttcccgttctccaggtgtctgcggagcatttccacttagg

SEQ ID NO: 486736 - DNA, 437 bp, Homo sapiens
  misc_feature (22)..(22): n is a, c, g, or t
  misc_feature (140)..(140): n is a, c, g, or t
  misc_feature (344)..(344): n is a, c, g, or t
caacggaggccctggagcgaangtcgaattacatgagtctttggcgtcgattcttgcgcttattcgttctacgaagacagacgatcagacgccaaagctgcgatggagaacatcgtccatcgtatgtacctgtctatgtnttcggacatgattacggttcagaacaagaaacacgccaaaaacgtgtttggatatatccactcgtacttgccgcattcggttagccgatatatccgggaaaccgccaactatgtggcggcgatgaaatacaacgcaaccatcgaagaactcgttgcgcgcctacaagaagaagccaaacgcccgttcccgatcctcgacgacanagaccgtgagcttgccgcggcctacgttaacaccatcgtcaaacggtggaaccaactgcggtcgcgggaagaagttcagcctgtcgttgaagg

SEQ ID NO: 486737 - DNA, 191 bp, Homo sapiens
tgtaatacacacagacactttgggagtgctgatggccttgtgcatcacttgaatgtcagaagatacgagaacagcactggtagtgaaaccccatctctactaaaaatataaaattagccgggcctggtggcacatgccttgtaaatccccagctactctgtgcaggcttgatgcagtgaggatctctatga

SEQ ID NO: 486738 - DNA, 1019 bp, Homo sapiens
tgtatgtactttcgatttcttgtattgagagttccactcgtggttatctgcttggttcttttgtattttgtttcctgtgtgggtgtttccttttttgtttatattttactttccctgcgtatttgtttcacacctagttttggtctgtagtctacttgtcttagtattttatgttacttcctcaccttcgtcataacttttcattgatgtggtacctctttgtttgttgtatgtatgggtcatttattggttatgagcccttttctcagcttttgttctcatgtagtaatagctttaatatcattttcttttttcttgttttttagtgctctttttgtgttagctttttgttgtgtcttatggttatgttttttacccccattttttacgctatactatggggtgttacttctggaatatatttcttctgggtttttgatttgtcttgtttattattatgtttcttgcttttatgcgtctgttttatccgtttttttcttttgttaattctccctgtttctctttgtttttttcccgttatggaagacgagagttctctgcatcttgtcacccagactagagtgcagtggcacggtctcacctcacatgcaacctccacctcctaggttcaagcaatgtactcactgctatcagcactcactgagtagctgggactacaggcatgcaccaccacacccggctaatttttgtatttttagtagccatggtgtttcaccatgttaggccaggtttggtctcaaactcttgacctgcaggcgatccacctgcctcggcctcccacagtgcttgggatttacaggcactgagccaccgtgcctggcacccttaatgcatgctgaagaaagaagaatagaagtaaatcaacctgagtaaaagcagcactggtattgagttttctaagctcagggtcttcagtcaccccctgtggaaaacactaaggatgatgggggtagataatccattcatccagacacacgtggcttatcataggattagaa

SEQ ID NO: 486739 - DNA, 131 bp, Homo sapiens
ttctctgtgctcttgaggatcccagctgagagttgtcccggtgacagcgtgtggttcgtacaacctcttgcggagcggggaaggtgactaccgaacaagacatgctgcctgccctgtgcaggtgggctacg

SEQ ID NO: 486740 - DNA, 282 bp, Homo sapiens
  misc_feature (138)..(138): n is a, c, g, or t
atattcggtgcggactgatgtgccagcacctacttggcagccagcttgaatactttgtggcaatcaagcgaggttttccatttcagccccatggtgcatggtggtggccgatgaatgtgtcagtctgctcggatgaangaccaaaaggcacttattttcaaatctgtgttcactgttcgggtctgtgtatggctctgcatgtttgtgtttcagtctctgtctacgtagaggtatccacatcttactccgactgtaaggttgtcttacttcatctcttccccc

SEQ ID NO: 486741 - DNA, 456 bp, Homo sapiens
ctaattagttgtatgttccctaagattttccatacacaaaatcatgtcatctgcaaacagctttctttctaatctggatttcatctatgactcttacctaattgctctggctagtacctccaggacaatgttgaatagatgtggtgagaacagacatcctcgtcttactcttgatcttagcgggaagctttcggtctctcaccattgaatgtgatgctaacaatgcagttctgtgtagatgcttctatcaggttgaaaaagttaccttctcctcctagtttgttgagtgtttttgtcataaagtattgaattttgtcagatgctttttctctatctgtcgagatgatagtatgattcttgtcctttattatagtgatacagtatattacattgtttctcatatattgaaccgaccttgcattcatggggcaaattctacttgttcatggtgtataa

SEQ ID NO: 486742 - DNA, 975 bp, Homo sapiens
atttactttaaaaaaaaaaaaaagaataaaagggcaaaaataagaccactctaaaagaacaccaaaaaaccccagcacaaaaccgacgatggagtttggtttcttatgatttctttgccagagtggccagaagatgcaaatgcccatcagcactgaggaattctttggccccctttgttggtgcccgcttgcccccaacctttcaggcttgccgagatgctccccttgattcgaacaccgaggctacaggacgccagactgccagggcctgcccggcctccgtgttcctgcccccaacctcactcactccgtgcccgtggacgagcgaaccgggttcgggtcccgggtgttcggagaaaccgttgccgggttcccagaagtccaaagtccggccctcaagcattcatcacgggggagcctggcgtgatagccacgtttgaaggcagtttccccaccgcgaggtttttcccggaagcgcttcgagaaactcccagcggaggcaatatcggcgacaggtcccccgagccccaaacctctttgaaggatgcaccaggtgcgccttgaacttgtccgcgtgtgccctggggccgttttgccccatttgtggtcccccccctgtgtggcccttcccaggaggctctcccttttcaccattcgttgcgcgccttctctcactagtgtgcacgtgtgcgcgtgttgggcgcacacgcgcgttgtgttgtgtggatgggccccttgggtggtattcccccccgagagcagtgtaccttgcgatgactggctggtcgtatatgcatcgcatgaattcgatgtggtagacgcaacattcgcaaggttgtgcacacctcggtgaggtgtttattccccgccaatacgtctatcctggctcatgtgtgggtcgtcacatatgtggggtgccctcctgtcccccccgggcggtggtgcgccccagcgcccacggaaaatattctcccc

SEQ ID NO: 486743 - DNA, 157 bp, Homo sapiens
ctctgattgctgatcgggtatgttgcgggttttggcatacatcgcagccaggtaaacctggttggcatcgtatttcaccgcggtggtccatgcggtggcgctgtcgcctttaccgtactgcagcgctttctgagcgctggtgcggttggagtcggag

SEQ ID NO: 486744 - DNA, 160 bp, Homo sapiens
  misc_feature (65)..(65): n is a, c, g, or t
  misc_feature (89)..(89): n is a, c, g, or t
  misc_feature (99)..(99): n is a, c, g, or t
  misc_feature (130)..(130): n is a, c, g, or t
  misc_feature (144)..(144): n is a, c, g, or t
  misc_feature (158)..(158): n is a, c, g, or t
gtcgcgggcgatctcgccatcttcgccgcttcctctcaagggccgcttcctcctgagccgcccanccccggggccgccgcactgcgccnaccgccaccnccgccgccgccatgaacattttccggctgantggggaatgtcccncctggcggccatcntc

SEQ ID NO: 486745 - DNA, 341 bp, Homo sapiens
cccagccaagaattggacaggagctcaatttggttaaataaatagcaaattaacctgccaaaaagttggtatcagacaacaatattgcagtttaatttcaaagatttgttgagaaacaatcatcacagacatgcctcattctgtctctcagctgaagatcccaaagtagagcaattgctggccggcttatcctgggaccaaagcctaagagcttggttcattaacacatataatatatgttgaataactaaatgaataaaacccgttttcaagctccctaacccttccactcttccatgcacttattttatacccattgtctcttaccgtatggtcctgga

SEQ ID NO: 486746 - DNA, 381 bp, Homo sapiens
tttttggtggagacggggtctcttatgttgcccaggctggtctcttaagtgatcctcctgccttggtctcccaaagtgccacagcagctggccctgaacattattttagtttagttgtttgagatggagtctcgctttgtcacctgggctggaatgcagtggcttgatctcaattcgctgcaacctccacttcccgggtttagacaattctcatgcctcggcctcccagggtggctgggattgcgggcatgcaccaccacatctggctactttttgtctttttggtgggagatgggggtttcgccatgttggcccagggcgggtctgggaatcctgaccttcaagtgatctacctgcctcggccttcccaaagtgctgggt

SEQ ID NO: 486747 - DNA, 168 bp, Homo sapiens
actctgccccgcgcacgcaagccccggacaactagtgggcgacccgaaagggaacaccctggcgtaccaacaaaatgcaaaacttggccagccattgagaacccctgaccagccatctcggccatgcgatcggtgttgaacacggcggtgtccaccattccaatgata

SEQ ID NO: 486748 - DNA, 384 bp, Homo sapiens
gacaccccagccatgtgaaccgtgagtccatcaaacccctctactttatacactactccactatcgggatatgtatatattagctgcatgcgaacaggctactacacccagccaaaaaactgcactcatcgtcccttctttacctaaccaagaaatacacctagaggagcatcgcattgtaatcggtaccactactatttacacagtacatctgggaaagcaagtcagatcgagtcactcccctgatcaagtcctctaagggtttcttatctcactaagagtaaaagccatgaccctataatgacttgaggccttacataatttgccccccatctattgcatctcacctaaactactcttcttccttgaacatgtgcctgctcc

SEQ ID NO: 486749 - DNA, 143 bp, Homo sapiens
gggggctgggcaatgtatttttgcaaaggcgcctctcaatttctgtctgtcgtagtgcatcttacgggtgccccctaattgatctctcgcgatgtcagggtttatagtcagagtttttaattccataagggtaaaacgataaa

SEQ ID NO: 486750 - DNA, 240 bp, Homo sapiens
ggtaccaatctccatgcgttcagtcgaaaggcacatatatacacacatgcacacacagcacacacacaaacgcacagcacacacaaacgcacagcacacacgcacacacagcacacacacgagcacacagcacacaaacgcacagcacacgcacacacatgcacacacagcacacacactagcacacagcacacacacaaagacacagtacacatggaatgcacacacacgactggtagg

SEQ ID NO: 486751 - DNA, 183 bp, Homo sapiens
atgcatgcagcgcgtgaggagcgctccaggccagaagggaggagatcatcaggaatttaatccagggaggaggagaccagaaaataaaacctcccatttggtctgtccttacgggcctctgtgataacttagatcagccataaaaataaaacaggcttaatctggggggaacggagctcgaat

SEQ ID NO: 486752 - DNA, 646 bp, Homo sapiens
  misc_feature (96)..(96): n is a, c, g, or t
gtttactgagtgcttggacatggattttctaacttaaatcctcttgaggtagatactcccattttacccaaagagcattttaccaaaagatcttgncccaagatcttttttccttttttttttttctttttttttttttttttgtggaagaagcggagagtgtgtgtgtgctttgttgtcccccgagggtgggaagtgtgccgaggggtgtggcagctcccgcggatcaccgtgtgaaaacctctcacaacctctcccgcgtgtgttctacagagacatattccgccgctgtgcctttaagcctctccaaaatatgacccggggatatcttaatgcgggtggcatgtgccaccacacacgtgtgaaaatataatttatgtccgcgtgtctatttctcttatttcaaaacaggagggttttcacacctatatttgttggcgccgcgacatgtggttttactaaaactctccctgagaacctctggggggaaaaactcccccgccacaaaattttgagcgtctctccacggggggtcgtcctggggagaactaccagggggctattaagcccccacacagcgcccaaacgcctgtgccccaaagaatttttcacggagcacaattaacgtggggaaaaaactccttgg

SEQ ID NO: 486753 - DNA, 203 bp, Homo sapiens
gttgatctagaggatcccggctcaaacaggcacagggaaggtatatcagtattccaatgaggtctgggaataataagcactccaacatttataggtcaggtctctaaggtaaagaagtagattggtagttagtctggtaccttggtaccttatcaagacatctgcattccttatttttttttttttttttttttctttttttt

SEQ ID NO: 486754 - DNA, 233 bp, Homo sapiens
tcgagtcgacctggcccgattcctatacgggtgtcattcgtgtgaatactttttctaacaatagtaacacgttgtttgcttttgcgcttcattcgctccctaacgtacagtgttttctagtcatcacatgacgtatggagacacaattgcaatgatggctaacgtgtttgtatagtgttgtgcatttaaaaaaaaaaatctcaattttagttctgagtaaatattaatagtta

SEQ ID NO: 486755 - DNA, 118 bp, Homo sapiens
caaatttagtagacatcctggcagcaggccaggcgcatagggcattgtctcagtctggacgagttggtggtaggatgcagtccagcagcctcaagcagcgttgagcactacgcgactg

SEQ ID NO: 486756 - DNA, 457 bp, Homo sapiens
ctcaaaggactattttaaaagtcaacaagaatatcttggggctattgttcggaattaacatgattttagtgctgcagataaactgaagatgctgtcagctgtgctctttaaggagactcattgggtttttcaatgcagaagaattgaagaacactgaatgccaaaaattctataaaaatccattaatcactcagttcagatcgtgtcaatgctgcaataagaagacaattgcttccgtgtctgtagcaaagggatcagctatcgttttcacagtgtcgtggtcttcgggccggggagccccacttcccacagcgctgtgcttcacttcagccttgaataaacgtcgtctgcacctttacgcatgcatccatcaaaatctgtatttgtgttatttctgccaaaagcaatacaacttttctcattgactcctaactcatcaatagagaatctctgagaa

SEQ ID NO: 486757 - DNA, 1124 bp, Homo sapiens
  misc_feature (319)..(319): n is a, c, g, or t
gtccgctcgggctcgcgaacgagactgcacggcattgtctttaacgaaaactggcagcacaaaccacgcacatggcgggaaactcgccagcttcgcataacggccaagcctgacagaaaacggacacgcaggaccaagaacaccctgccgaccaaagcagcaccattgacgcagcgcagaacgcggacgctgcaaactttccctaacgactccctgcgacggcatttcccttacccccgctccctccttcgcagcacccccagcctcgcctgcactgcctggcagcgaaacgcagccaaccctgccaacgcactgcgcnccaccgcagccccaccacagccctgcaacctgctgcacacccctgggcccaccctcacgccgcccggcacctgcccaccccggccccctgctgcgcgctcctcatgaacaggcgacccccaccgcccaaactcgcgaccgtgccacacactctcctcccgcgctatagtgcccccccgcgcgcaatactctactacccacacacactctacctctctgctactgcacacttacactgaaaacagtacacaaagcaaccaacctttcgggatgggcaagttgtgcaacacaaaaaaacaaacacaaacgagacagacagaacgacaaaacacaacgagcgggggagcgacaggggactctctaatagaaaagtgatatctcacccatcgaaagagagcggccccccaagtgactcattataggggcggatttaccccgcagagggcgtatctactaccttgtggctacaacaacaaacgtgggaccccccccatcataataaagcagggcacggtaccccagaaataattaatcatcaaggccctcataatgagccacagtggtgggccagcgtgtcgccagagttattcaaacacccacgagcggtgtctcacccagacagaaaaccttgctggtggaccaaacacaccatgcctgttggcagaaacaaccctgtctggtcggaggagcaaaatctcactctgtggggacagaacaagcggtgagcaccccctgttctaatccatatctcagaggaggtccatagtttatcaccccatcttcactagttgtgtggacaaacagat

SEQ ID NO: 486758 - DNA, 2008 bp, Homo sapiens
  misc_feature (1223)..(1223): n is a, c, g, or t
  misc_feature (1696)..(1696): n is a, c, g, or t
tagtattcgttgttgtggagacgacctgttgggtagtttcgtgtagttggtgacggacatctgtgtgtggtgggattcaaactgaccatattaatcaaattgtgctgtgctgtgttgagttctgtgtctgccacttctggtgggagctagttctaatgaagtgggggctttggtttggtatcatacgagtgggtagttgattgtgtccactacgtgtgttgtctgcacatcgtgtggcgtcctaacttgatcgtgttcgctactgggttgaacgagctgtcttgacaacacgtggtttcgttgagaggagcgcttcttcctcacatgttggctgctcgctgtctgtctgtgtgtgtcgtacgcgcttgagtcctgcccgtttgtgttgtgtgacgacctcctgcggtttgtattgttctgctggttgaaagacacccgatgtggcgcgttttttgttccgttcttcgtgaaaatgtgggagggtggtgggtgaggacaccaccgatggtggtgttccagtcggcctgcgagcctagacatattgggtgggggggcatcttttgttgctactggagacagatgtgatggattattcgctctaccaacggggggaggcttccccccgccgtgccgtcgagggtagaccgccctgtgccgcctgctgtgttgcgcaagggggtcatttgttttgaaggagttttgtggtgcgccacgacgtacgcttgtgtccccctccgaaggtctgtttctgtctttctaacgacgcggtatgttggatcccgcggttggggggaaataattgttgttggggtgtggtcgtcgtcctcccacaggcggtgaagggttgtttttgttgccaccggcgcgcggagagattggtgtggcaatagtatgagaccgtcggtttcgtggtaggggggcgtgtatgaccaacacaacaggtgtacgacaacaccacaacatggtggtgtctgtgtgggtgcagttggtggcgcccagcaggagtgacacacgcacagccgtttgtgggtccacaccagattcccctccacacaatcttttctcgtcgtctacacatcgttgtcgtttttgagaataatgatgttggtggttaggatatttattatgaataaaagaagtgtatgtatgtttgttgtgttatcctcctggcataaatgaatataatacacgaacaacgtgctccgcgtttcaacaaggataantagatgttacaacacatctcctgcttcactctccacatcatttggtgttgcccaacgtggtgtcactgcagagcgcgcgtcatatatcgttgtctgggcggccaaaagaggcacaaatatgtctcatgaggagagggggcgcgttatgtggtgttggagccccaacacgccgcaccaccacaggtaaaatacagtttatgatatgacacgtctcaaaagagggttgtggtgtgtaaaaaatgtgggcccagtgtgggtgcaccaagtgtgttgctacccacagctgcaagagagtctcacacaagtggggcctgtgtgtcctccacacacagagtgtgtgtgatacacgtctcagtgggacacgtgtgagggtgtataagacagtgtgtgtatatagagagatcacccacacagtgtaaagtgtttgtgtctcagagagagcccagagggcgtgatagagacactgtgtcgcnagagacaggtgtgatacaagagagacttatgccatataggaggacacttcacacacggagacacccacagtctaaggcccaatgtctattgtgcccactgtggacaccacacgccaatataaatgtgagaaaccggaggtgtaatgtgttgccgtaagagtctcccaggacacaattgtgaagaaaatatgaagtcacactaattacctgtagtattgtggtgtaccctgtagagtccacaccaacacaaacctgcccactatgtaagattataagaaaaatgtaataagagtttaaaaaaggcaccagata

SEQ ID NO: 486759 - DNA, 170 bp, Homo sapiens
cgattatctagaggatcccacgatggtctcagactgtttttacacggtggctatctctggaatgatggaagttgtcgccagtgtggcccggccgtgggggcctgtgcccctagatggtggacttggagaaggagacccgcaggtggtggttctcccctgaggtctgtggt

SEQ ID NO: 486760 - DNA, 591 bp, Homo sapiens
  misc_feature (14)..(14): n is a, c, g, or t
tctagaggatcccntattcttgcccgatgatcgtgaagaaagaggaagggtccaggatagagatagtcatgatctcctgctataaagtctgggtggggatgctgttaccgcgtgcgaaagcactggtagccctgagtacagctgaagcccaggctagtgggatctacatgccagggctcaacaaactccaagacaaacatagaacttcacaaaacagccctgtgtcccaagaccctcaacatgtgtgacaggcgctaggctccttaacataacagactccaggacacggcaatcgagttgggaagaactaactattttagtaccaagcaagagccatatctgggcatcgcagaacacgcagtgagagacagtgacgagtgagtctgtctcctggttgtcaggaggtggcatactgccaatggggtaggctctgaaccgagcatagagtatcaatctccgtagcaaggaacttccttctgagaacggtttgccaaatccctccaagagaagagacaaagattataaggctgagtcttccagaacggtggtcgcggggcaacctacatcacaagcgctggtgcagaacctgat

SEQ ID NO: 486761 - DNA, 228 bp, Homo sapiens
cgagggtactgagcctcgaagttgaagacatactgatcttggctaaagagcagtggacccaatatcaagaggaaacatttctaccttggaccgtatctcacaagaggttattcgggaaacgacaagccagcgaagaatggggcaagaagtaatcatgtagttgacagtctgtggatgcagctgttatgaagatggttcaacttgaaacaaatcattcaagcactgctt

SEQ ID NO: 486762 - DNA, 263 bp, Homo sapiens
ttcggcagcgtcggggggcagcaccaggtcccgtggagagggattgagccaagaggtgagggtgcacgtcttccctcctgtcccagctccccagcctggcgtagagcacccctcccctccgttccacccccctggagtgctgccctctggggacatacgctgtcgggttcttatccctgtactgagagttgatgacaacttggatgacgcttttcatgggagggggaagccttcctctcaatttgttgtcagtgaaattccaa

SEQ ID NO: 486763 - DNA, 141 bp, Homo sapiens
cgctcacctcgcaatcttacattcaattcccatcctaaaaagcactcatactttatgcctccccgcagtagacacacacaacacacagcacacgcatgaacacagcacacacacgagcacagcacacacacaactcacaga

SEQ ID NO: 486764 - DNA, 212 bp, Homo sapiens
taaggatttccgcgtacagttgcggacaccctatgtacgtgaccacagtattccaacccttaaacctccctgtgctgacgggcacttcatggccctcagagccaccgggtgtggtcgtccacctcaagcactgtgtctgagggcagtggcaacagcaacaatccggtctcggagtcgcacacgcaggcgttccccgcaactggtacggccgg

SEQ ID NO: 486765 - DNA, 523 bp, Homo sapiens
  misc_feature (334)..(334): n is a, c, g, or t
  misc_feature (363)..(363): n is a, c, g, or t
  misc_feature (380)..(380): n is a, c, g, or t
  misc_feature (394)..(394): n is a, c, g, or t
  misc_feature (500)..(500): n is a, c, g, or t
  misc_feature (503)..(505): n is a, c, g, or t
  misc_feature (508)..(510): n is a, c, g, or t
  misc_feature (512)..(513): n is a, c, g, or t
  misc_feature (519)..(519): n is a, c, g, or t
gccactgtttgtagcgagcacatttctaccccagccaggcctatctataagcaaataaagatgggatttcatgtcctcccatcagcttttctgcaccctcccttctaccttccagtggcacagtgcttaatgacagctgctgacaatacagtgtcacaggccttgcgccaaaattacccccaactccttccctcactcccaaatcacaactcttattatctaagtgagcaaccccagttgcaaaacacaaaggagtaataagtcctgtagaaattctcagctccaccccagcccctggttgccaatgaccctgtgaagaagctaaaactccttngctcggacattctgtcacagagagacctncagcatgtgccagatgnacttgcatcaactnaaaaccaaggtcacctctggagaccagaaatggaagtgacagtcccaggcctattcataaagcttcagttttttacaaggagattgtaatcatgcaaaactgcgtnttnnnaannntnntaaacngaaa

SEQ ID NO: 486766 - DNA, 706 bp, Homo sapiens
ggttcataataactttgcctgatgttctagcagaaactttatctaagtgaaagacatgagtttgtgatggcacaatagtgtgaatgaagtttcagggtaatgatgctacctgttgatacaagaaattgaacatgtgctataaacttactttgagaagtgctcgagagtagagtgtgcgattacaaactatgtccatgatattgcttgcgagagaatgattttgaatcactgtttccagaagtagctaatggctaaactagatgattcgtgactgttatacagcatagagaaagctagaagaagtgatgatgactgttatggagtgaagaagtagaagattgacagagacagtgctcttagaaaagttcatcaatggtgctgaaggaaattggctatgctcttcgagctgagggttattggggctgactttattgacccatcgatctggtctggcatattacttggaccatatacgaactaagcactcttttggaaactgtatgcacagcgctaccgacatttaggattctctgttgatgaccttggatgctgtaaaagtgattcgtcattagtcgtctggtggtacccatgtagtagtagggagtatcttcacataatgcaacagcagacgagcagtattatgaggaaattaagtgtgaattagcagaaatatccattcatttgctgtactattttgtatgtaata

SEQ ID NO: 486767 - DNA, 755 bp, Homo sapiens
  misc_feature (67)..(67): n is a, c, g, or t
  misc_feature (76)..(76): n is a, c, g, or t
  misc_feature (84)..(84): n is a, c, g, or t
  misc_feature (92)..(92): n is a, c, g, or t
  misc_feature (97)..(97): n is a, c, g, or t
  misc_feature (106)..(106): n is a, c, g, or t
  misc_feature (109)..(110): n is a, c, g, or t
  misc_feature (118)..(118): n is a, c, g, or t
  misc_feature (139)..(139): n is a, c, g, or t
  misc_feature (661)..(661): n is a, c, g, or t
gttgctcgccacttatgtgttgggtgaagagaacctcgattccttgaagaagttgattacagtgcanaaagtaatnataagtanaggggggngtaanctaaaaatntannaaattatnaaccttctgctcaaaaaaaantactttctgactctgaattatcaagaacatacctaccttgggcccggtggcatctcttgttaactggaaagaataaatgaaatatcttgggttttatgggcgaggaacttggagaatgagtatacaactactcaaaagacaaaagtacttgggccaggttgggttcaggataataaatggggtattaattaatggtaaaatgggcgcttggtttattttcgatattcaatgcactttatggagcattggatgatcaaatattgggtttacctttaaaaaaaaacctgggtatcattggatggatttttatctccctatggggatatcctggatcaagggggtaattttgaagggggggcagaatataaaattgggattttagagggggggaaaatcctggcttggtgaaactaatatatgggtacatgggtttctatagatgggtttggttagaaggggggagatattgcggataagactgggcttcagaatcatgggactatgggggtgggactgaagtgntccagggggtggcttggaccattacattctacatgtaccaattaaacaaggaaaacttgggctcggggggctcaggggtggagctctgcgggct

SEQ ID NO: 486768 - DNA, 154 bp, Homo sapiens
tgggcatggagacgaaaagttgccagacggcagcattgccactgccaagtgaatcctgcccaggcaggaatcatgtggacgcccatggtgcatgacggaggccccgagcctgtcagcgtgcagcccccgtccagtacgacatacccaggctcgc

SEQ ID NO: 486769 - DNA, 216 bp, Homo sapiens
aaaaaaaaaaaaaaaaccccccgaatgggggggggggggggccccctttggccttttggttttaggggaataaaaacccccccaggggtttccccttttttttaaaagggggggggggggggtacttttttttccccttaaaattttgggtcccccctggtttttgttttttgtcccgcccaagccttttttttataaagtttggccttccgttta

SEQ ID NO: 486770 - DNA, 157 bp, Homo sapiens
ataggattgacaacattgcaaatccatatgggggcatgcacagtctgcagcattgttgttacctgatttcttgcttctactagaaaaagttacatcgtcttaagtgtaacaatagcagttcttttgtgcttttacgatttcatttgtttattttttt

SEQ ID NO: 486771 - DNA, 714 bp, Homo sapiens
  misc_feature (27)..(27): n is a, c, g, or t
  misc_feature (32)..(32): n is a, c, g, or t
  misc_feature (176)..(176): n is a, c, g, or t
  misc_feature (443)..(443): n is a, c, g, or t
  misc_feature (516)..(517): n is a, c, g, or t
  misc_feature (565)..(565): n is a, c, g, or t
  misc_feature (678)..(678): n is a, c, g, or t
gacgcgggagccatgcgccccctccgncctgncactcactaggcccccacttgcctcttccttgaagaactgcaggccctggcctcccctgccaccaggccacctccccagcattccagcccctctggtcgctcctgcccacggagtcctggggtgtgctgggagctccactctgnttctctgacttctgcctggagacttagggcaccaggggtttctcgcataggacctttccaccacagccagcacctggcatcgcaccattctgactcggtttctccaaactgaagcagcctctccccaggtccagctctggaggggagggggatccgactgctttggacctaaatggcctcaggtggctggaagatcctgcggttggagccttgggcgctcacacacctgtagcacttactggtaggaccaagcatcttgggggtggntggccgctgagtggcaggggacaggagtccactttgtttcgtggggaggtctaatctagatatcgacttgttnntgcacatgtttcctctagttctttgttcatagcccagtagaccttgtnacttctgaggtaagttaagtaagttgattcggtatccccccatcttgcttccctaatctatggtcgggagaaagcatcagggttaagaagactttttttttttttttaaactnaggggggggaaccaaaaatttcttggggaaaaggcc

SEQ ID NO: 486772 - DNA, 670 bp, Homo sapiens
  misc_feature (27)..(27): n is a, c, g, or t
  misc_feature (32)..(32): n is a, c, g, or t
  misc_feature (176)..(176): n is a, c, g, or t
  misc_feature (443)..(443): n is a, c, g, or t
  misc_feature (658)..(658): n is a, c, g, or t
gacgcgggagccatgcgccccctccgncctgncactcactaggcccccacttgcctcttccttgaagaactgcaggccctggcctcccctgccaccaggccacctccccagcattccagcccctctggtcgctcctgcccacggagtcctggggtgtgctgggagctccactctgnttctctgacttctgcctggagacttagggcaccaggggtttctcgcataggacctttccaccacagccagcacctggcatcgcaccattctgactcggtttctccaaactgaagcagcctctccccaggtccagctctggaggggagggggatccgactgctttggacctaaatggcctcaggtggctggaagatcctgcggttggagccttgggcgctcacacacctgtagcacttactggtaggaccaagcatcttgggggtggntggccgctgagtggcaggggacaggagtccactttgtttcgtggggaggcttgatctgatagacactgtgatgctggcatgtgtccactgagtcttcgggcctagcctagtctttggaacttatggagtaacttgagacacttgatgaatgatgtccccgacgtgcttccctcaagtatggtcaggagacggcctatcgggtattaacactattnatgtgtattggc

SEQ ID NO: 486773 - DNA, 219 bp, Homo sapiens
acaggttgtgatattccggcttgatgccggcccaagtggtcatttgacatatctctggccagtcgcctaaatgataggtctctccttatctttctgtacctgtccacagtaggaaatgtgacatatctctgggcccagcacctatgtgatgtgaccctcctgtcatgccaaggccttgcctactgtagtgattgtgccatatagctgggcctctgctct

SEQ ID NO: 486774 - DNA, 260 bp, Homo sapiens
acaacaacaaacaaaaaatgagagaaaggctaaaaaaaaaagggtagggggtgagcagtaaatgggtatacatcccacatacaatatctggtgtaaacacggatctcctggtagaaagtacgctcaaaggggttatgggctctagaaataccggtgggtctatcctatagagcactcacgccaggcttatctccccgcgggtttaaacacttcaaataacttccagaaaatgggcagagcaaaaatttgggctggtccac

SEQ ID NO: 486775 - DNA, 529 bp, Homo sapiens
gtcatcagcgatcctacgacggtttcatgatgccttatcagatatgtggatcgctttcatgtatatatagcttagaaacaagaaatccacctaatattaaaacaaaccataaaaagtcataaaagcgagctaatgaacaaaaaaccctaggttggtggtgcttttctttcacatttcctacagggagatttgtatatctcagatactttcaaaatctaataggtaagtaaaattagtgccttaaccaaacagtaagataccaaagaatcctccatcagcaagttactgaatcaaacttctcatgacattggcggtatattcagatttgaagattttttaaatttagaatttaaaacaaactttagactgctgattttccatatttcaaagactgtagttgtctgcagcatataaatggacagagtagtgcaaaacgcatcaagtgttatatgataaatatatactttcaaccaagagtgtcgcgcgacactcttggatgcaaggaactgacacaccgttagaacaactg

SEQ ID NO: 486776 - DNA, 198 bp, Homo sapiens
taaacgattatccagatcaaaaatagcagcattaaaaatataacgctccactggtaactcatactgctcacaataagcatttaagtcagcaatgcccaatgctaacggtgtgccttgctcatatctgcgtgagcgtgaaatgacgttgtaggctttaattaaggcattggctgtatagctatactcaggctttttcac

SEQ ID NO: 486777 - DNA, 329 bp, Homo sapiens
caactatctggctaaatggctttacacctgcaaaactgaccctaggttgttgctacccgatatggttggctgcgtccccacccaaatttcatcttgaattgtagttcccataatccccatgtgtcgtgggagggacccggtaggaggtaatcgaatcatgggggcaggtttttcccatactgttctcgtgatagtgaatacatctcactaaatctgatggttttataaagggcagtttccctgcacgtgctctcttgcctgctgccatggaagacatacctttttgctccttctttgccttccaccatgattctgaggcctctccagcc

SEQ ID NO: 486778 - DNA, 199 bp, Homo sapiens
ccacatcattatctccatcctaatacatggctagattatctaatgataacatagcctgtgtccaatgcttatttgattctaagcttttttattctgttactgagatatttaaatagctttgcaacaatatgctgaccagtttaaggaaagtactgattcttctagcaagcaacagactttatggccaccttcttccaat

SEQ ID NO: 486779 - DNA, 379 bp, Homo sapiens
aaacatgcccaagcagtcatgtagatgtgactttcaagcccagcacgccgggcccaagattgatgagaagctggtctcactgaagtatattatcaagtctccagacgggcatatagttggcaaaggcagaccagcaccaacggtctcacctctgccagctaaaacttgcaacggatgccgatacgagttcgccatcatcgaacctagcagaaccaggacgcagactgggatgtcacagaaagttgaaggtcccaattgagcaaggactaagaatggtgagcccacgctgggggaggggtggggatgatgtgtgtaccagaactcaactccagctgatagagccctctcagtgcagagggctctacaataaccctaacag

SEQ ID NO: 486780 - DNA, 496 bp, Homo sapiens
  misc_feature (296)..(296): n is a, c, g, or t
  misc_feature (384)..(384): n is a, c, g, or t
ggtgatggtgcgctgtttaatactttagaggcctcaaaataagtagaggcttttcctacagggtctgagaaggcaccgaagtcatttcttctgttctgtcagacataattcctcagtttagccttcccacctcaatacagtctgataacagacgagcctttattagtcatatcagccaagcagttcttcaggctcttagtattcagtgaaacctttatatcccttatggtcctccatcttcaagaaaagtagagtggactaaaggtcttttaaaaacacacctcaccaagctcagncagcaacttaaaaaggactggacaatactttttaccactttcccttctcagaattcaggcctgtcctcagaatgctacagggtacagnccatttaaggtcctgtatagacgctcctttttatctaaggcccagtctcattccagacaccagaacaacttagactgtgctcaaaaaaacaacaaaccccaaaaactgggaa

SEQ ID NO: 486781 - DNA, 160 bp, Homo sapiens
tacctcaaatcacttggccacccatggtactgaagctacgagtacaccgcctacggcggactcactcttcaactcctacatacttcccccattatacctcagaaccaggcgagctgcgactccttgacgttgacaatcgcgtagtactcccgattgaagc

SEQ ID NO: 486782 - DNA, 1289 bp, Homo sapiens
  misc_feature (856)..(856): n is a, c, g, or t
agcggatcagacgtttcggggaccgggggacacgggctcggagctagcgatttccaggggacccaagaacattgacgtggtccgtacgatgtggaacatgtacggggcttgatatgacgatcacggtaactaaagtgatagattttacgctcgaggtcctaactaatcatgggggtcctaggtcgggtccgccggactgactccgtgctgggcgatgcactgacgtgccagaattgacataattggagatagcaacataacttgaggcagctggtgcaggaaactaccgcatataggatattccgcatgaactggtgaggagtagagggtctatatatgggtggtaaggggggcaacatgaatgaggtcacattaagaggctgtgcattatagcgctaggaataagtaggtaaagggaaaagagagcagatattcagcatgcaccgtgggcagacgacttgtcgtgagaattaaaggtggctaaggtatccatgggtagctttgtacagaagacctgccgtggaggagtggattagaactattgctggaggctaaatatgcacaccaaatttacaaggtaatctttggccaaaatattttagacggcgttgactgacagagtgaatgaaacgaagagaatgcgttggggggagcaatattgggaccattatggggtatttcatgtgggtggacagcctattaatccaataaggatggaggttggaaacttagcgctgaacatgtgactaagacatttgacaatgtgtaacacgaagaaagtgtgtggggtttactcccaatagtgccattagaaggagccgaacaatgtgtaaggccacctaagtacttcgcctangggtacgcgagtgaacatacatgacgaagagacccacctttggatccatgtgctgacagagaggggggtacgtttggttcacggtactcgacactaaccccgtggaattgcagagttacaagaggcgctcaagccaagacaaagggccacagtgtgggtgcccatttacaaggccgaggggggcacaggagggagaccaagtgacgaacagttaaattacgccggtgcatcaccatggagtcgccttaacacagtccacaacggagggagttacagtaaggatccaaagaaattgttcactgcgctggaggcacccctctatgagccgagcaagagagcagaaacgactgtacaaatatgccgcggcaaacagaccaacacccccatgtgcgagatcgacgatttataacgccgcttaaggtacatgagggca

SEQ ID NO: 486783 - DNA, 679 bp, Homo sapiens
ctacagacataggagacactcccgtaaaatctagcttggccagtcgggatgtaccctggaaaagtcttagcagagaatttttgcattcccacccaaaagccctctcagccactcaaatgcctatcttctccagtctacaagtaacgtgtacccacccagcattacagttcttgaacatgtcatgtcctcccttactggtctacgttggactaactcactggataagtattataatagagctacttagctgtggtttaaatacccttctgttaacaatgagcaggcaaaataatggtcttttctaacatagttcaacccaccacagacctcgacaccatcgttacctttaaaccgattatggatcatgcccacaaggatccaagctactggccgtctcaagataaggggttgagggtctgtgctagatcaaaaggcacgggaaggcgatgtggcagaaaagttgctagtggggagacctggcctttaacaggcttctggaaaagctagggaaaagtggtagcccgctttccccctttccctccccttcaagcaccgcttgagatctgggctaattattaagagctgcttataaaaccagtgcttaatgttagagagccagggtcttcagcatcctcgatctcctcaaaagagggtgagcgtcccatataaaaatcggagt

SEQ ID NO: 486784 - DNA, 316 bp, Homo sapiens
ctttcagtcaaggttccttaatcagtccagtttacatcaggactatgacttggggggcggggctaatcctttttgctgttttgagctactattgtcaaccgctgttggacaacctgttatgggtaaggggggaaaaatatttattatgttggtaaaattcattgcagaccaaggttgcttttctgtgaaaaatgggaaattatgttttaaagcccctcttggaaaccaattagagaacttagtattttgatggactaagccctattttaagtttaaaattttcctttgcaaaaactttaattaaagatgtttttta

SEQ ID NO: 486785 - DNA, 477 bp, Homo sapiens
cgtcaggaagtaacacagctgggccagtacacacagcttcatcaggtagatatttttgtcctaggaaactttccaaatgcactgtggcaggcattctgaggaaagtcccttgggtcactgagcacccagtagtcctccttgtcccagtgagaactctgctcagggttctttgatgttgctttggtgtgctgattataattagtacacttaacaattgtggcttgccaagaatggtaaatttagtatgattaggagcgatcattccacgctaggctggttggcgaatgcttcttagtagagcttgaccagcgtcctgaagcctttgtcagtgaacagtgaaagaaacgtgtgttgcaagtctttacagagcacagcacagactgtgaataggaggagaatgggggctctcagatcggtgtgttcctgttgtagcacagagcaagagtccttgacaacagtttccagagaggtcgacgc

SEQ ID NO: 486786 - DNA, 659 bp, Homo sapiens
  misc_feature (7)..(7): n is a, c, g, or t
  misc_feature (40)..(40): n is a, c, g, or t
  misc_feature (45)..(45): n is a, c, g, or t
  misc_feature (54)..(54): n is a, c, g, or t
  misc_feature (66)..(66): n is a, c, g, or t
  misc_feature (76)..(76): n is a, c, g, or t
  misc_feature (83)..(83): n is a, c, g, or t
  misc_feature (86)..(86): n is a, c, g, or t
  misc_feature (106)..(107): n is a, c, g, or t
  misc_feature (109)..(109): n is a, c, g, or t
  misc_feature (119)..(119): n is a, c, g, or t
  misc_feature (130)..(130): n is a, c, g, or t
  misc_feature (138)..(138): n is a, c, g, or t
  misc_feature (152)..(153): n is a, c, g, or t
  misc_feature (171)..(171): n is a, c, g, or t
  misc_feature (180)..(180): n is a, c, g, or t
  misc_feature (188)..(188): n is a, c, g, or t
  misc_feature (192)..(192): n is a, c, g, or t
  misc_feature (199)..(199): n is a, c, g, or t
  misc_feature (209)..(209): n is a, c, g, or t
  misc_feature (215)..(215): n is a, c, g, or t
  misc_feature (240)..(240): n is a, c, g, or t
  misc_feature (245)..(245): n is a, c, g, or t
  misc_feature (258)..(258): n is a, c, g, or t
  misc_feature (271)..(271): n is a, c, g, or t
  misc_feature (287)..(287): n is a, c, g, or t
  misc_feature (294)..(294): n is a, c, g, or t
  misc_feature (309)..(309): n is a, c, g, or t
  misc_feature (317)..(317): n is a, c, g, or t
  misc_feature (341)..(341): n is a, c, g, or t
  misc_feature (349)..(349): n is a, c, g, or t
  misc_feature (367)..(367): n is a, c, g, or t
  misc_feature (371)..(371): n is a, c, g, or t
  misc_feature (389)..(389): n is a, c, g, or t
  misc_feature (399)..(399): n is a, c, g, or t
  misc_feature (404)..(404): n is a, c, g, or t
  misc_feature (408)..(408): n is a, c, g, or t
  misc_feature (427)..(428): n is a, c, g, or t
  misc_feature (430)..(430): n is a, c, g, or t
  misc_feature (440)..(441): n is a, c, g, or t
  misc_feature (449)..(449): n is a, c, g, or t
  misc_feature (454)..(455): n is a, c, g, or t
  misc_feature (516)..(516): n is a, c, g, or t
  misc_feature (595)..(595): n is a, c, g, or t
  misc_feature (597)..(597): n is a, c, g, or t
  misc_feature (640)..(640): n is a, c, g, or t
tgtttcncactgcctgtaaaaacagggctttattcaaaanaagcngtccaaaangatttgaccttnatggaaaaancaaattnaanagtttatgcagcaggcttcnncncccctgtagnaggtttcttcnctgcaggnttcttttcaggggnnggtttcttgggagccgcngcctttttncccaccanaggnttctccngcttctaaanaccaanagcagccttctttcctttcttaccnaccanaggcttcttgccngcaaccgccgccntcccaactgaatgggnttgtagngccgcggcggcagcngcggcctnaaccacccggagcttgtaaatccnggccgggngaagaagggggtcccggngcangggctttgcaaaagggtnaagcttcaanaagantttnaagtttttcagtgggttcnncnttaggacccnncgaagganccccnngcggggggcccgaagggctctttggatccctgggcttttcaagaatctgcaaagaactgtnttaatcatcttgtgcatgggaagattgttgttactcttgagggaagcggctttacgccaagtgccgtacaattcatctnanttccggaaagcactttcagttcaaatgcagaaacgtcccaaangcccaccaggagcaagctt

SEQ ID NO: 486787 - DNA, 383 bp, Homo sapiens
cttcaagatttttgcgaagttttcttcatgggggggtcagccccttggctcccatttgaacccctttgcctctgaaacttaattccatccagaaagaaggccccttgtatgctagtctatggtccgttgaggaatatgcctgtttttatatgcccctgtaaccccaatgtcccatataaattggcttattttttaaaataattttaaaagttgggaaaagtgtttttttttggcctgcttaaatattgaataagttttcttcctccgcctttaattaatgtataggccgatgtaaggtaatttctgtgttttttgagataatgtccaaatcctgaatttttccaaattaactggggggttttaaaaatccccctagagattta

SEQ ID NO: 486788 - DNA, 388 bp, Homo sapiens
  misc_feature (322)..(322): n is a, c, g, or t
  misc_feature (384)..(384): n is a, c, g, or t
  misc_feature (387)..(387): n is a, c, g, or t
aaaacccaaaattacttggaaagtctacaaggtaaacatccgtgacttctttttttttcttgaagatggagtttcccctcttgttgcccaagctggagtgcagtggtgaaatctcggctcactgcaacctccgctcccgggttcaagtaattctcctgcctcatcctcccaagtagctgggattacaggcatcggtcaccacacctggctaattttttgtatttttaaaagaaacggggtttcatcatgttagcaggctggcctggaactcctaacctcaggtgatccgcccacctcggcctcccaaagtgctgggattacngatgcatgagccaccgtgcctggccccatgtacttttcaacaatgaataatgacaataggtnttng

SEQ ID NO: 486789 - DNA, 88 bp, Homo sapiens
gatcaccaacatgaacaacaattatgagccccgcagtggcaagttcaactgcaaagtgccccgggtctctacttactttaacttacca

SEQ ID NO: 486790 - DNA, 803 bp, Homo sapiens
cctggaatccgagcgggtgccgctgtgtatgaaagaagctatagcacttccagagcctgtccggagctcagaggttcggaagacttatcgaccatgtgagcgcgcgtcctgcttgttgctgctgctgctgccgctggtgcatcgtctctgcgagcactcctagaaccttgtgagtctggacgatgaagatttccgcgtgcgtctgcacacttctccgatacctcagcccgactggtccgaagccttccagtgtgtgtctgcagtagaggtggagatccatgccggcggtctctagacctagagccgtttctaaagcgctgtcgatgcggacgccgacccgtcgtgcagtatgctgaccactggtcaatgtgctctcctgcgtgcggtggctcacagtgggagccgcacaggttcctgctcatgctacttggttaggcgccctgctgttgtgctagcgtactccctggctcaaggaactgattgctcgaggacctaaagataaccggctaccatgcctccggtgcctctggaaaggccacaggagttgcactttccagcttgcgcctacgcaactgtgtcgtgggcgacagggcgtacttggctcgccgagcttgcagcagtggctcaagccaggcctcaaggtactgagccattgcccaagcacactcggctgccttttcctgcgaacaggttcgccgccttcccgggccttaccagcctagacctgtctggacaatcctggacttgggcgaacggcggactgatggcgggtctctggtcccaacaaggttcccgggcatcca

SEQ ID NO: 486791 - DNA, 102 bp, Homo sapiens
aggagtggggtgcggctcttgtcaggcaaccttcctgcacatgtcctcctggagctaggaggaggttcaatctgacttagggcagatgcaatccatcccttc

SEQ ID NO: 486792 - DNA, 304 bp, Homo sapiens
ggggggaaaaaaaaaaaaatttttttaaaaaagggcccccccgggtttttttaaccccctttttaaaaaagggcttttccgggaaaaatatttttgttttaaaaggggaaaaacccaggtttaaaagggggaaaaattttttttaaaatttaaaacccaggccccccctttttgtttaaaacccgaaaaaaaagcttttattttttttatttttatttatttgggaaaaaaaaccccttaatccctttaattggcggggaattaaaattgggcaaaaaaaccccaatttttggggggaaaggga

SEQ ID NO: 486793 - DNA, 451 bp, Homo sapiens
agtttctgctatattagccagaaaatagaaagcctgttggggacagggaaatgcctataaggactccagagcagtcacagataatgacatttctgagtagctgggattacaggcgcccaccaccatgcccggctaattttcgtatttctcggtagagatggggttgcagcatgttggccgggctggtctccaactcttgacttcaggtgatccacccaccttgggctcccaaagtgttgggattacaggcatgagccactgcgtccagccatgacatttattaatttacaacgtgacccataatgccatttgcctttgccaactagacttttgatatgtgactatgcctgaggggaccacacaaggaagggtgtcagaacttcgacaactcataacgtgacagaaatttacacgtaaacagctaaaataatcgtatcagctcataaaacgg

SEQ ID NO: 486794 - DNA, 650 bp, Homo sapiens
atacacaccactcctctctcgtcgaggtgtgactcgcgcgccccgcgcagaacacctgtttttccccccgcacgatctacagagggtgtctctcttagtagagcctctcctctcgtcgtgagggagcactctttttctctctcccgacgagatatatctactcatttttgttgttgctctctctctgacgcgcgagcgggcgcccccccctcagagagagaaagagaggcgaccactctctgtgtgggcaccacactcgtgcggggggtgggggggggcccccccgtctcgtatatcccctcgcgtcgagagagatagaacacgcgcgcgccccatctcatctctgtgtgaggtgagagataacacactccgtgtgtcctatcgcggccgctccgctctcgagaaagataaaagaagagggtgacgacatctcctctcacgagggggcgcaacacacaccgagaagaagaaaaaaagaagaaaaacaccggtcggggggaaacgcgcgagggtacactggaccaccccgggcctgtttgaaacaccttgggggcccccccttgtgacaaaaaaagagggccccaaccccctttttaattttttttaatttgtgggtttttttaaaaaaaaaccccctttggttttttcca

SEQ ID NO: 486795 - DNA, 172 bp, Homo sapiens
  misc_feature (123)..(123): n is a, c, g, or t
  misc_feature (144)..(144): n is a, c, g, or t
  misc_feature (153)..(153): n is a, c, g, or t
agcggtcagaggcgtctggatgatgtttggacagggatagctgtttgggtctcaagttccaagagatcccattttcaggctctaaatcctcctcaatagctacactcactattggcctcctgngcaagcaacctagctcatcgnacttcatcntgacttccacgttcaggtg

SEQ ID NO: 486796 - DNA, 172 bp, Homo sapiens
tattttaggacgtgtactctgaacattctggagccgtcaaaggagctgcagcaaagtcacatatgttcgacgtgcgaaatgcttgtggtatgtgttttccaaactgccccctatatgtaaagttcagtttagaccagtgattaccgtgttattactaggtcctttgagatta

SEQ ID NO: 486797 - DNA, 1102 bp, Homo sapiens
ggagtcccagctcagagccgcaacctgtacagccatgccacggggcgaagacacttcaggacagcttgaatggctcatctagatgctccatggtgtcgcttaggtgctctcagtggttgtcgtatgggggcgccctgtctctggccgatggcgagcccgtgcaagtttcccgggatccctcaagagtttacactccgaagtactcctgattccgatagcttgctggaaaggctcacgaggactctgcttaattcaaggctgcagggtccaagcagagctgggaggattcgatacgatacgagctcggtcccaggtcctccgtgcaagttccgggagtacatcgacgctaagtaaagtgctggactaggtgcatcccgtgcagaggcccaccttgacaacactggacagtatactcttcgagcgccctgtccctttgctctgtagtggcgctactccacggggtcctactcactgaactatcgctcgggtcttcgtgtttccggagctggtcaccccgcatcggcagttcgaatggttcggggtgaactgcttgtacaacgtgaagcggcatgatgaggcggctctacgtttcgaatgacttatggcaaattactccctagcgagaccccgcggtcgggaagactctttgaccgcaagcgtggtcaggccgatctgctcgattcgactacgtccgggaagcgaaactttgcttgtgcaggcaatttctcttccggtttcccggaactgggccccaagtcttggaacgtatcgcaacttgtggcgtgcccgggtacggccgtccatgggtgggctgcctcggtcaagagggcgctgttcgcgccgtcataacgtgggcacctaattgtgcctggtcgggaggcgccgtgtgctgtttgcattggccctggcgcttggaacatgtcggtgcttgagacgcggtccggcttgagttaggaacctagggggtgggggaccgccttcgggtgggttggttggcgccacaggtacgtggcgtggaattctggactcattggggccttccggaggcattgggcagatcccaggttccggggggggaggacatttgaatggcgcagattga

SEQ ID NO: 486798 - DNA, 504 bp, Homo sapiens
cgagaaggaggtaaggaccaagcaacagtaagtagaccacagccaaggccgggtagataacattggccttttgagtgggaaattaggctataacaggagagtggctaagatagggcacagagctccggcatctctcgccggcattcccaaatgctatctcacatgagcaggcacagggagcaagacgtgcacgaccacgggcacaggcggtccgctaaaccacagacttctcagcgctcgccagtgcttcggcttcggtgtccactccagatcccagatggcacttagtggtcaaatcttttcagtccatttctaacctatattagctccggtgtcttgcctggtcttgcagggccttgacacttacaaaaggggggggtcaggtacttggcacactggtctaaccaggtcggtccagcgggggtaacctcaggatgcaatggaggttatgcccatctaatcacagggaccagagagacttttaagcaccactcttcaagaatt

SEQ ID NO: 486799 - DNA, 202 bp, Homo sapiens
tcatatccctctagaggagctgttctgtactcgatagacccgataactcgacactcttggtcagctatataccgacatcttcagccaatcctgatgccggctaccaccagtaagcgcaagtacccacgtacacaggacgtataggtctacctgtggggttaccctgggttaggtctacctggggggtacggacctcgcattt

SEQ ID NO: 486800 - DNA, 325 bp, Homo sapiens
  misc_feature (128)..(128): n is a, c, g, or t
  misc_feature (200)..(200): n is a, c, g, or t
  misc_feature (218)..(218): n is a, c, g, or t
  misc_feature (280)..(280): n is a, c, g, or t
  misc_feature (302)..(302): n is a, c, g, or t
  misc_feature (314)..(314): n is a, c, g, or t
caagagggtagcccactcccctgaagagtaagtcccaggcctggcagcattcaccacaaactgactggagagtccttgggccttagctgaacatcagcagtagcctggcggcactctccatgggcctntggtagtagtggccatgagcagcggctcctccgcatgtggaaagcagatggaagaggaggaaggactttttnttgtggcttgaaggccancttagctgcaggagtttagagcataaggtagacttctaaggtttttaactccagctcttagntcccagacagcatcttttgganccgacccagggnctgggggggga

SEQ ID NO: 486801 - DNA, 133 bp, Homo sapiens
gtgtgcacctgtagttgcagctacttagggaggctgaggtgggaggattgattgcaacttttaggtttaggctttagttagcttttatttttccaattcccttccagcttggttacaaaaacaagcccaccct

SEQ ID NO: 486802 - DNA, 783 bp, Homo sapiens
  misc_feature (30)..(30): n is a, c, g, or t
  misc_feature (521)..(521): n is a, c, g, or t
  misc_feature (776)..(776): n is a, c, g, or t
cggacgcgtggggtttttataggtggtttntattcacagaaagttacaactaatccaaaccttaggatcatcagtctaaacacaaacttgtactacggcccaaatataatgacactgaacaagactgacccagccaaccagtttgaatggctagaaagtacattgaacaactctcagcagaataaggagaaggtagatcccatagaccaaaaccatctgggaataaacggaaggcaaaatttgtatgtttattaaactcggggtagactccagtatcaataaaagtattataatttgaagattttttttgcataaacactttacaactcatggattttctttctttttttttttttttaaatttcgagatggagtcttactctgttgcccaggctggagtgcaatggcgtggtctcggctcactgcaacctctacctcctaggctgaagcgattctcctgcctctgcctccccagttgctgggattacaggcacccaccaccacgcctggctaatttttgnatttttagcagagacggggttttaccatgttggccaggttggtcttgaactactgacctaggtgatccacccacctcggccttccaaagtgctgggattacaggtgtgagccactatgcctggccaactcattttagttttaaatttttttttttttcagagacaggggtctcactctgttgcccaggctagagtgcagtggtgtgatcatggctcactgcagcttcagcctcctgggctcaagtgattctcccncctcaaa

SEQ ID NO: 486803 - DNA, 439 bp, Homo sapiens
gtctatagaatatccgcggcgatgtggtctgtgcacggactgacctcgaactcctgcgctcaagcgatcctgctgcttcagcctggtgtgcagctgggattacagtcacctgccaccgtacccggctaattcttgtatttttagcgcagacgggatttcgctatgttgaccaggctgatctctaactcctgacctcaggcaggtgatctgcccgcctcagcctcccaatgtgttgggattacagggtaagccaccgcgcccggcattaaacatttattgagtacctgtcatgagcctatatggaaaaactttgttgctttgctgtcacaccacagcagtagtcagcacagaagacttctgtgaccaaagcatgcaagcaagcagttctgcagcgaccactgtctggatgctctctaattaaattacgacctgtctactt

SEQ ID NO: 486804 - DNA, 709 bp, Homo sapiens
gagagagagagagagagagagagagagagagagagagagagagagagcagagagacttcatagaccaatacactgacagagagtcagctcgcgtgtggcatctgtctatgggagacacccgtatccgcaccgtcgcctacagtgcatggctgctcgggctgctggggcggcgcgggtgccggcgggtgctgggcgtggcctgtgacactggggtgggctccattgtggctgtggaagacgtcttgggtgtgacggctgtggatggcggtggcctgatgctgcagtatgcgcttggggtgctctggaaccgggggcacggggggcgcgtgcgctgggggcggggggggggggcggctgcatggcgtctgggcacgatgtggcccggtcatgagatgggggctttgatgctggggtctgccggtggagcggggtgggtcacttgcggggcgggagaggggggcggggtgagcgcgggctgtggctgggggacattggcagcgtagtccgtgcgggggggctgctgggcggtggtcgtgggacctgcgagcgcgtccgtcgtgcagggtgggggcctgcgggaaggagatgtcggtaggagtgctggccggacggcctgggtgcgggcggatggtgagcaggcgggcccgcgtggtggccctggggtcgcgggtcgacggtgcgggtcctggccgggtgggtgtcggggtgg

SEQ ID NO: 486805 - DNA, 91 bp, Homo sapiens
taatcccagctactttggaggatgaggcaggagaattgcttgaactgagaggaggttcataaaataaaaataaaggctgtgtttgtatcca

SEQ ID NO: 486806 - DNA, 996 bp, Homo sapiens
agccagcccagactgggaagaagtatctctaaaaagcctatactcccaatttatgggatggcaatgccctgcatccatccacgcatgtattcattcttctttgcaaatgtagagtgatgacagacatgaggagagaaggtatgctactcaacgaatgccatattacatccacacatattttgtgtgcatagcctaatgcgcccacagtccataccacccaagttacttcatttctcctatgacaaagtagggtgacgatgaacatcttctacatctgttgacttacataagtccacactttttatacagttgttagtaccaattgttactacaatacacagtgtattgaccccactgcgacgcatatcacgtcacagaaattgcgatgtgacttcactggtcgccacgatcgcgacagtttcacttagtttcatactaccgtcacttttgtggcgcttgaaaaagttgtggagagcaactcattgctagtctctgtgacaaccacaacatcactcactcatgtgttccgatcctctgccatggttggttcgctacgagcgagtatcattggcacacacagcattgtggatgcggacgctacttccaacagttgcgcctacttaccggcgtgggacagagaagtgacaagagcccttggcgacactgaacttcttgaaccttcagtaccccaaactctcattctcatccgggcatatcctgggtacatcttggcacggacatgacagcagccaggcatggcaaacatgtcccgtggaaacggcaggccccgcttggggcatacacccggtaatccctggtgcacgcatcacgggtgaatgtactccagacataccccggctgcctcggtcccatacccgtgtcccatctagcagcgaaggcctcccaaacggcaactgtgacccccagtggtcccaactacaaactacgcggccacactatgaaggcccacgtgatcagccctagcacaccccgccc

SEQ ID NO: 486807 - DNA, 877 bp, Homo sapiens
aggtacaaacgcttctcacagtcgcatgataatcctctctcagggatcttcaaagcatctactcccgagctaatagcttgttagatcgactgctatgccacgccctcgtataagcaactacgcactgtatccctcacactattatccttacttgacgtagaaattcatcttgatgctgacgtattaaccatcaattactctcatgaatcgaaaaataatctaattctcgctagtctacaggtattcaaaatacttactctacaagctccatatactcccatctacgatttttattcaacaatgactaatgaggctacatcattccactcacataaaccaatgataataaatcctcgattcactacgtataaaaatatcctctagtgttcatacaccttattcctgatatcatcctccgattccttcgagaccggacttcattgcctggattcactccatatataacaacggattttctatatgcaaggaggtgtcctacaacaactaggttcttgctgacgtacataaaaaatatttgggtggtcagagctcgatagttcacaaactttctcaggaggcctgagggtgcccagaaatcagcttcgagacctggacccaagctctgagtctgtaacaacataaaaaaagaaccccagtctcttaaccacaaactcctgtggacagaaaacggatgcccgggacagcgatcctaatcgcagctcacaccgcacgggtcactggacctcattgttaaccccacgccagattaatcagtacttatggaccgactatgcagcctactcacagactcaggtctgtaacagcacaacaatgacgccgtctaatcgcacaacttgacatcacaggcaacacaaaa

SEQ ID NO: 486808 - DNA, 366 bp, Homo sapiens
aatgtgctcctcatgacaccttgctacacagccaactttgtggcgcgtgaggcgctgcagcgccaggtcctcgatgacggctgctacatctggagcctgggcattctgctgtacatcatgctggcaggatttactccatttgccaacggtcccagtgacacaccagaggaaatcctaacgcggatcggcagtgggacgtttaccctcagtgggggttattggcacacactttctgcgaaagccaaggacctggtgtccaagatgctacacgtggatccccaccagcgcctcacagctaaggcggttctgcagcatccatgggtcacccagaaagagagcttcccaaaggcagctgtcccacctgcc

SEQ ID NO: 486809 - DNA, 389 bp, Homo sapiens
gatctcatggggataagtggcggaaggggaaaatatagtactgctactggacacgagattcttttggggtgaggaaaatgttctaaaattatatattgtggtgccaggcgcagtggctcatgcctgtaatcccagcagttgggaaggctgaggcaggtggatcgcttgaggtcaggagttctagaccagcctggctaacatggtgaaatcccgtctgtactgaaaatacaaaattagctgggcatgatggcacacgcctgtaatcccagctatttgggggggtgaggcaggagaatcacttgaacctgggagacggaggttgcaggcggagtggagcagagatcgcaccactgcactccagcctgatcaacagagggagactccatctc

SEQ ID NO: 486810 - DNA, 245 bp, Homo sapiens
ccctttttttttcccttttgggcccaggggcagggtttgccccaaaagtttttccctttccccccaacagggaaattgggcccccccgggggggaaataacccccctttgggaaaggggttggttggccccaaccccccttttgggaaaaaggccggggggggccaaaaaaccggggcacccccccggggtggtcccccaacccccaaaccccgtttaaaaaggggctttggcccttttttttta

SEQ ID NO: 486811 - DNA, 125 bp, Homo sapiens
ctctagacggatccccttatcacttggtcctggtgatacggtattggccgccgaaaccttgggagtactctctcggggagtcgggcttctcggtctggcccggaagggagcccaaggggtaccgg

SEQ ID NO: 486812 - DNA, 305 bp, Homo sapiens
ccccccccttttccccaattggggggtggggggttccgggggggggtttttttaaccaggctttttttttttgccccccggtttccctggggccccccccccccttttttttcccccctttaaaacccccggggccgttcccccccccggctttttccttgggcccggggggggtttccctttttccccggggaccccttttgccctttgggccttttttggggccctttttaaccagttttgtccaaaaaaccggggggggccgggccggggttttccgggtttttttccccccccgggcccca

SEQ ID NO: 486813 - DNA, 1716 bp, Homo sapiens
taaaaaaactgatgttaatttcccatcaaccattatttccatggctgcttaaaaagccatatgtgcaagaaacagctttaagaaccagatcaggtgggtgtgctctccttacccatttcaggtggccgtgagcaggtgggagcgtgcaaaccagtctttccggtggggaggcgtgagcgcctccagttctttcgagaatgagggaaatgtgcggtgacatatgaggcgacgagagagggcacacctgtgtgtacaccccttctcgagacacacgagtctctgtgcaaacactctcgagggcgtgaagaataccagagagtgcaactcctcgaggagagactgggagagacgagctcacagtatatcacaccctgtgaacatatctctcctcactgtgtgtgtgtcacactagtgcgctctctctctctgagacgagaggcacgaccactgtgtcgactctatctcttattatctcacacactctctctatctcatgagagagatactatctgtgtgtaaagaaagaggtcacagagaaactcaagaggacgatgtagatctctctctcacatgtgagccgtgtgtattatcacagggggagatacagctgtgtgtgtgccccaccagcctattgtgtcgcgcagcagacacaccttttctcacacgagagagagcacacgtacatatcaccacacacacacactctcacacacacgcccacactgttgagggtgtgaagaggaccctccccgacattgtgatcttgtggtgttgtgccaccattgttgtgcgacaattgttgtggcagcaaacaaagttgcgttcttctaccccaacattattactgtgccgcacaacactatggcggtaacaaaaaatcttctggtggggtgatatacataacaacaccaacggcgtgcgccccacatgtcgtggtagtacgccgcgcatcacggcggggctataaaccccccatactacctacatgcgtactgtgctcacacccctgcgtcccgacgatgaaaacagaacgcggccgctggagccgatgactgacatacaaagagcaccccctgtggagaggagtaaatccaaggacaacaaaccacaacacacaagacaaccacggcccaggactgagacactcacccgggaggagacacgagggactaaggcacccgtggagaaaaaataccgtggggatcaacagcagagcaaacggcggctgccacccacgcgaacgtactcgaaacacagcggagcaccaacgaccaacaaatgagtcgggaacaagtgcagcgccacccaccaacggagcggcagtgacaggcgaacgacaacaccagatcatatcaacacaggacaacaacagccgcccccttacagtgtggcaccacaagcacaactcaccccccgagcagacagaaggacacacatatatcaccacaagatggagacaactcatccccagaacaagggcggataacatcacacagccagtgcgaaacacacaaaacaagtgaggactcaacaccacagtagaccaatgacacatacacagactgctacctccaccaaggcggcccactatctcgagaaggccgcacatcctacggtaccacacaatcagacgagcctgccagcacgcagctcagatcagccccaacaaacacaagagcaagacaagccgcacccccacatcagtacaagactaac

SEQ ID NO: 486814 - DNA, 473 bp, Homo sapiens
  misc_feature (103)..(103): n is a, c, g, or t
ggagagccctggtttgaagaacataagaatcgataaaggatatggcgaaggccaccctagctgctgaaggagcgccgtagtgaagaatttctggtacctgtcnagcatctcacaagccactacatcttgcctgactctcatgggggcacctcgctatagtagagtatacgattgcgtacaaggtctcagaatggtgctaagatcgactggatccttctgagaacggcaatgtatcctgattagctcttgctcaagagagacagtggaacgataactatggagggaaagttgggaaagagagattaacgcagttcgtaggagaaatcgcaactggtggtcctgtaaactgaagctgtccctcctgcgcgaaaggaaagtgctgatattgcacatactgtggtggtatattgtgacaagaccctgagagcggccactgtagaaagagagagacattatcgcttatgcttgcaagg

SEQ ID NO: 486815 - DNA, 473 bp, Homo sapiens
aactatacaattgagctcggtcctccatggagatcgtagataacgtatgctcatactaaatgtctgtcgtctctgtaatagaattctagtccgtacttcattttttactcccttcttatgacccaagattgctttgacaagaatgcatgacttagtgctgactcatcactcaagataccactttctttatggaacctctaccaaattttgaggggagatcgtggcttttgccctttttaactttttttccgtcaaaatcaatgacactggcccattatctgtccagcagaacccgttgtgaaatagtacaaggtgaacaggccttcactgattacaggcgagtgttacagtagcctagccataaggaaggggagttacatcatagtacaaaatacagtataaaagcgttatttaacattccagactgaagattactctgatgccttcaaacagtcgtttggatgttagccact

SEQ ID NO: 486816 - DNA, 151 bp, Homo sapiens
ggcatccaaaaaatgttcccttggggggtgggggtgccagaaagtgggaacagggaggtgggaggtggattttgtttatttttttagcccctttccaggggggggaatttttttttaaaatgggtcataaaaaaagttgtttttgaaaaaa

SEQ ID NO: 486817 - DNA, 703 bp, Homo sapiens
  misc_feature (17)..(17): n is a, c, g, or t
  misc_feature (25)..(25): n is a, c, g, or t
  misc_feature (28)..(28): n is a, c, g, or t
  misc_feature (53)..(53): n is a, c, g, or t
  misc_feature (58)..(58): n is a, c, g, or t
gggctaattttagtggngtacaacnatnatgaaaaccacgctggtgggttcanagaanagcaggtgtcgccgataccggatgtggacattgaagctgctaggacaataagcaggagagatgtcataagaccatgcaaaacttagtatgcatatagtatcggtatgtcggggggcagctcattaaaaaatatgtgaatgaatctgtgaagctgcagtagcgagaagagcgacaggtcttcttaatgaaccgctacctgtgacagtaattgtacactgtatagtttgttaagaatttttaattaaatcccatgttgtaaagctaacttttaacaattataatggaactatatgtgtttccattttttaaagtaaacaagaatattccttgtttagagactggacttgaggttaaaactctccagtctcttaaggttatgtattaaaaagaaaatttgtccatgttaggagttatttcacagattcctgtgcttgaaaagcataggatactaatcctttaaaaaagtgtaaatggagaaaagttatatttatgaaggttattggtgtatttagtattggaaaagttggtttcccgagcatttcagaatgtcgaagcaccactgtcttttattagtatatacggctttgcaaaagtttgtgattgttacgtgatggtattaaggttaagtttccagagcattcagga

SEQ ID NO: 486818 - DNA, 2053 bp, Homo sapiens
  misc_feature (1941)..(1941): n is a, c, g, or t
gcacacgtgggtagccagagcccggccgagagccctggccgggagcccgcgggggccccgtccgagtgtcaccggcaccccatgggcatgacgaccatgaccaggatactggcttttattttgacctttcagtggtagtaccttgccactggcgtagtcgaagggagcccaatatatatttagcgagtccctgtgcgagctaacagagcgctactgtaccgtcaggaaacagccgtgcgtcttgcatgtgcgaggatcgtcggcacagctctgcgacttaccgagggaggagagagcactcggccgacctaggagcaacatacacgtatgaaactgcctatttgcaatctctaaagaggggtaggaaaacatcactgcgacgacacgcggagcgcgcattcgagcaccattgctgagttgccctccacacaacgcgacaccgagtcattactctcgagaccccggcctaacatttggaagagacgagaacatactaaagtgaccagagaccaaagcgcagggcgcaattcaccagcaactggtaaggcctacagatggcaaaacacagacaggacaacacacaccactacagagccggaatcacgagcagcaaccccaggcgatgtagaccaggacacacttgggagacagaccagcgagacagcccacgccgctctttgtacggcgccgtccactaacccaggaccgcccgtgctggcagcatcaacactcgaatagtcgcggcacacacattccgcaccccgtcccagggaccgacggactaggagagcagaaccagacagagacgaggccagcaagacagagcaaggagacccaagatcgtggacccaccagcacacacacggagcaggcagcccaccgacgcgcagaaggaagacacgactccacggaaaataggcacgagaacagcgcagcggcacacgcacacatttagagactcgtacggccgctcatagccacaccgacgaaagcagagtgagcattagagtatacaaaaacataaggcagcgtacctattatgtagacggcacccccaccattttttgggcgaccaacgtagagcaactcatgacgctcgctactgtagcagtcacaaatttcagactcagctaccaccaaactgtcgctgtatacgtatctacgtagacaaattaccgtcacgacacctactcatgaggataagtatacaacagatttcaccacactagacaagataatgaagttatgcatgactgtctcccaagagtttgctctatcagtgttggtagtagcagctgtctatccaggcgacatgtctcttagcacacacagctacagatttgtacgcacgatgactcaaacagtgcaggctagcacgacccatgagacccacgacagagatagcaatccaatttttcagagcagcaattgttgcactacgtgtactttggtgacaccagacagtattaatactaacgtaacagagcggtgtgagccaaatatctttgcactgcgcacataggagaacgatctcacaggagccgcatgggaagcgcccacttctcaacgacgacaagaaactggctctcccttaggacgaataattacagctaggcggcgcaaaagcagatcgtagcagcgccgcacgtatagattacgacatccggaacaacacacaaccactgcacaacatcacaacctctagaaggatcttttgaggctgagcatagtcgatccacggtaggaaactatgacggcatgacgataattcaagcaacagattttgacgacttctgcgccacagcagaaggatgatatcgaggtatggcacgtataacagccaagtgacactccacacgacacatgtctaccacacgagcataatagcaagacaagcgtcaagaggttaaagtgtatcaaaggatgcagaccagcagctgnctgacagctaatacagcaaggatgtacgtcgagaagagcaatcatcccacaagccactgaatgattcgtctctcttaacggtcaatgcatactacaccgcgtgtcctacgcg

SEQ ID NO: 486819 - DNA, 3107 bp, Homo sapiens
gatgggagtgacgggggaaatgttaccgctctccttgaagggggtttaaaagagagagagaaccccttttgggggaaaagagttttgaggccaaaatgtgtttcgttaacgagggagaagaaaggctggcaaatttggggtgaaaaaagggggttggggctcacaacttgggacctttcatgagggatgccaaaacgtaaaggtctaagttgataaaacaaattggcacattttttgccaaatgattctggagatcctcaggatttgtgcaactctcaatattttttctggagcgctccttagaagcgtatcgtactgttgaagagctttacaaacgtccagatgaagaatataatgaaggcacaagtagtgttcaaaatcgtgttcgttttgaattgcttccaattttgaaaaagggattgttttttgaccctgaattttggaacttcgtaatgattaagaaaaactgtgtagcattattgagtgataaatcagcagttagatttctaaatgaaagcacactggaaaataatgcaggtaatctaaaaaggacggaggaacagcaaggtttggatgaagggtttgactctcttacagatcagagcactggagagactgatcctgatgatgtatctggagtgcagcctaaaggtcatattaatacgaagaaaaatcttacagctctcaatacttccaaagtagatcacaatgtcccaaggcatcgttgtatgttatgtaacaaggaatttttaggtggtcacattgtaaggcatgcccaggctcatcagaaaaaaggcagttttgcatgtgtaatatgtggtaggaaatttagaaacagaggacttatgcagaagcatttgaagaatcatgttaagaagatacagaggcagcaaattgctgcagctcaacaggatgatcaggaagtcactgctttggaagaaataaattgttctagttcttccatttcatttgaaaatgggaattctgatagtaaggatttggaagtggagacacttactgcttctagtgaaggaaacaaagaagtcatccctgagcatgtggctgaattcattgaaattcccataagtgtaccagaagatgttattgaaaatgttattgaaaatggcagtcctaataattctttaaataatgttttcaagcctttaactgaatgtggggatgattatgaggaggaagaggatgaagaaggtgattatgaagaagatgattatgacctgaatcaagaaacttcagtaattcataaaatcaatggaactgtgtgccatccaaaagacatatatgccacagatcaagaaggaaactttaagtgtcctgctcttggttgtgtccggatatttaaaagaattgggtttctaaataaacatgcaatgaccgtacatccaaccgatttaaatgtgcgacaaacagtaatgaagtggagcaaaggaaaatgcaaattttgtcaaaggcaatttgaagattctcaacattttatagaccaacttaatagacatagctatccaaatgtgtatttttgtttgcattttaattgcaacgagtcgtttaagctgccgttccagcttgcccagcacacaaaaagtcacaggacatttcaggctcagtgtagttttccagaatgccatgagctttttgaagatcttcctctgctgtatgaacatgaagctcaacactatttaagtaaaacaccagagtcatctgcacaaccaagtgaaacaattctttgggatgttcagacagactcaaatcctaatcaggaaaaagactcatctagtaatgagaaacaaactattagtctgccagtttctactagcaaatcaaggaaagagtctacagaaccaaggacatgtatagaaagtatggaaaagaaaacagacagtttagttcagaatggaaacgaacgttctgatgacactgtttcaaatataagcttgatagaccaaaagatgcctgacatagagccaaattctgaaaataattgtagtagtagtgatatagtcaatggacacagtgaaatagagcaaacacctttagtttcatcagatcctgctttgaaaattgatacaaacagaatcaggacagaaaatggttccattttgcccagtgttgtaccacaagaacacaacaccttgccagtatctcaggcaccttccaaaccaaatctgacaagtgaacatacttcatatggcttaattttaacaaaaccatacgtcagaccattgcctcccagttaccttgatgaacggtatcttagtatgccaaaacgcagaaaatttctgactgatagagtagatgcctgttctgatcaagataacgtgtataaaaaatcagtgaaaagattaagatgtggcaaatgcctgaccacctactgtaatgcagaagcacttgaggctcatcttgcacaaaagaaatgtcagacactctttggatttgattcagatgatgaaagtgcctgatgaaaatggttcagaaagatctgtcaatcaagcagtagtgtgaaaaaagcactataagaaaatgcatcatcagtttgctatttccctgatggccttaattttagagtggtcttggattactaaagataaagacaaagcacattttctagaatgaactcacagagatgtgctggcttagactccaaaaggattataaaactcccaaagtaccagttttccagaaaaccacattttacagtttatgatgattaatagcagcagcatgttcagtttcgcttatatgagaaacatgtttaggcaactagtcagaaaaccagctatggccttacagaaagggaaaagtttaacccattattaaaaagtgtgtgtgggaggggggctggtttacaatattaaaccatttaaagtattttattctacaaatggggtttgttttcttgtcatgcataatcagattatgtcccctcccttctggttaaacatggtttaaggaaccgctgctgtttggtttgtgattgatttagaaacttatacattaacttaccacagtgctatcaattaaagattgtaacaggtttccagatgattaattaggtcaaagttcaatgaatggcacgccagcattgaaaatta

SEQ ID NO: 486820 - DNA, 5493 bp, Homo sapiens
  misc_feature (3680)..(3680): n is a, c, g, or t
  misc_feature (4640)..(4640): n is a, c, g, or t
gatgggagtgacgggggaaatgttaccgctctccttgaagggggtttaaaagagagagagaaccccttttgggggaaaagagttttgaggccaaaatgtgtttcgttaacgagggagaagaaaggctggcaaatttggggtgaaaaaagggggttggggctcacaacttgggacctttcatgagggatgccaaaacgtaaaggtctaagttgataaaacaaattggcacattttttgccaaatgattctggagatcctcaggatttgtgcaactctcaatattttttctggagcgctccttagaagcgtatcgtactgttgaagagctttacaaacgtccagatgaagaatataatgaaggcacaagtagtgttcaaaatcgtgttcgttttgaattgcttccaattttgaaaaagggattgttttttgaccctgaattttggaacttcgtaatgattaagaaaaactgtgtagcattattgagtgataaatcagcagttagatttctaaatgaaagcacactggaaaataatgcaggtaatctaaaaaggacggaggaacagcaaggtttggatgaagggtttgactctcttacagatcagagcactggagagactgatcctgatgatgtatctggagtgcagcctaaaggtcatattaatacgaagaaaaatcttacagctctcaatacttccaaagtagatcacaatgtcccaaggcatcgttgtatgttatgtaacaaggaatttttaggtggtcacattgtaaggcatgcccaggctcatcagaaaaaaggcagttttgcatgtgtaatatgtggtaggaaatttagaaacagaggacttatgcagaagcatttgaagaatcatgttaagaagatacagaggcagcaaattgctgcagctcaacaggatgatcaggaagtcactgctttggaagaaataaattgttctagttcttccatttcatttgaaaatgggaattctgatagtaaggatttggaagtggagacacttactgcttctagtgaaggaaacaaagaagtcatccctgagcatgtggctgaattcattgaaattcccataagtgtaccagaagatgttattgaaaatgttattgaaaatggcagtcctaataattctttaaataatgttttcaagcctttaactgaatgtggggatgattatgaggaggaagaggatgaagaaggtgattatgaagaagatgattatgacctgaatcaagaaacttcagtaattcataaaatcaatggaactgtgtgccatccaaaagacatatatgccacagatcaagaaggaaactttaagtgtcctgctcttggttgtgtccggatatttaaaagaattgggtttctaaataaacatgcaatgaccgtacatccaaccgatttaaatgtgcgacaaacagtaatgaagtggagcaaaggaaaatgcaaattttgtcaaaggcaatttgaagattctcaacattttatagaccaacttaatagacatagctatccaaatgtgtatttttgtttgcattttaattgcaacgagtcgtttaagctgccgttccagcttgcccagcacacaaaaagtcacaggacatttcaggctcagtgtagttttccagaatgccatgagctttttgaagatcttcctctgctgtatgaacatgaagctcaacactatttaagtaaaacaccagagtcatctgcacaaccaagtgaaacaattctttgggatgttcagacagactcaaatcctaatcaggaaaaagactcatctagtaatgagaaacaaactattagtctgccagtttctactagcaaatcaaggaaagagtctacagaaccaaggacatgtatagaaagtatggaaaagaaaacagacagtttagttcagaatggaaacgaacgttctgatgacactgtttcaaatataagcttgatagaccaaaagatgcctgacatagagccaaattctgaaaataattgtagtagtagtgatatagtcaatggacacagtgaaatagagcaaacacctttagtttcatcagatcctgctttgaaaattgatacaaacagaatcaggacagaaaatggttccattttgcccagtgttgtaccacaagaacacaacaccttgccagtatctcaggcaccttccaaaccaaatctgacaagtgaacatacttcatatggcttaattttaacaaaaccatacgtcagaccattgcctcccagttaccttgatgaacggtatcttagtatgccaaaacgcagaaaatttctgactgatagagtagatgcctgttctgatcaagataacgtgtataaaaaatcagtgaaaagattaagatgtggcaaatgcctgaccacctactgtaatgcagaagcacttgaggctcatcttgcacaaaagaaatgtcagacactctttggatttgattcagatgatgaaagtgcctgatgaaaatggttcagaaagatctgtcaatcaagcagtagtgtgaaaaaagcactataagaaaatgcatcatcagtttgctatttccctgatggccttaattttagagtggtcttggattactaaagataaagacaaagcacattttctagaatgaactcacagagatgtgctggcttagactccaaaaggattataaaactcccaaagtaccagttttccagaaaaccacattttacagtttatgatgattaatagcagcagcatgttcagtttcgcttatatgagaaacatgtttaggcaactagtcagaaaaccagctatggccttacagaaagggaaaagtttaacccattattaaaaagtgtgtgtgggaggggggctggtttacaatattaaaccatttaaagtattttattctacaaatggggtttgttttcttgtcatgcataatcagattatgtcccctcccttctggttaaacatggtttaaggaaccgctgctgtttggtttgtgattgatttagaaacttatacattaacttaccacagtgctatcaattaaagattgtaacaggtttccagatgattaattaggtcaaagttcaatgaatggcacgccagcattgaaaattaaaaaacaaaacaaaaaaaaaaccacagtgctttgctaataagctcttgatagaacctcccactaaccacttttgtggtacaaattagttaacatttaaagggcagcagtgtcaataaaatagaaaaaaaccgatcagtactctggggagagatgaaaggaatctaagactttacaggctttgtagttgaaggaaaacactgaattgcaaattattcaatgtgaataatggtaaaagcacactgggatacttctgtttgtgtatatgttgggacattgcttgatgattcatagtaaggtcctttagacattaatgtgagttatctaagtacagtcctattaaaataactggctcaaaaaatcagctaagaatcaggttgagaaatcattcattttattctattaggagaggtaattccaaaataagccatactattcctgtttttttaattcattagtgatgactctggtctgaacaggtaatttttatatgtaaaaggaagtatttacacaaaacatttgcacaagaacacagtaagagatacattcaagcatgttttccttagtgatgttantttcctaagaagattttaacttaataaagtgttaaaacaataaatatttttaaaaataccctctcagatgttttccatttgtccattattgaaaggaagatgcttaaagacttccttttactaatagtgtgtaaatctaaaacagggattaaaataacaaaaaggcagtgtttcaaaacagatctcctaatgtcccaatgtcaaatattccagttattctaaataataaaatctttgttcaaggcagataatctcatcagaccctattagagcttcttgaatgaggctattacggaagtggggaatttcttccaggtagcatccatattttattaaattaggatttccagatcatgatagatcagatgatttttttttaatttcccggttttattggtttatcatcagcattcactgctatgcaatgatggtcataagtccattccaaatttaaatttgtttctgttatgtagcctacattaggctgtggaatttacatttaggtaactaaacacagctcataattaaaatcttttctttaaggtcagctaaaaaaaatgtttcctgtatttcttgatactaaaaatgtaatgatttttattttagttcattctaaaagtatgtcttgtaataaaaagtctgtttggaaactggttcatttggacagtgaagtcttttgaaatatttctgctttgtacattttccagaagtttaatattttatcacattttccacaagttgtaacaattgatataaatccatgcccacaaagtattccattttcattacttttactgttcatgccaagatgtttcaaatatattccatttgtaatctgtctttaacttgaggtttatttctacttttgtgttgctaaaattatttctgcaagactgagatcaaactggtttatatataactaaatcaaggaatgttttataaaattctatttgaccacantgtcttaacctcggtttatatacttctcaaatagctattgaaagaatgtgttcattttattacatctgcttttaaaacataaacctacatcattttgcttttatagggtgcataaacttccaacagttctaatttgagcgcttcagaagaaaaggaagcttgcttcttattcctcagattcttctttttttctgttttgaggatgtattcatcctacatggaccaagtttcaaatctttgtttttaaataaaaatttccttcaaaaaattaaatgttaaatttctgctgtgtgtcagtaaggtgaagaaaatagcaaatctgaatttttgctgctcagatattatggaggaggtaaaaaggggaatctccgtggacaaggacactggtactttgggctttagccatattcatttttttgaaaccaccaattatataatacttaaataatttatatcattgaacttgtgattcttttcaaatcacactgaaggttcagccgtactcctttcatgtttggtttaatactgttgtatggatgaaaaacctaaaagggatgatagtgtttattttttaatttatttggtactgtaaaacaccttttcagaatgagtaaatgctgcatatgcattttggagttgttaatatgtgaaagatattacagattcagcaagaaaggaaatttgtgcttccttgttgaatgttaaattattttactttgcattttataagagtacaaattaaaactgagccattgaactgcaataaatcaacaatagtgtctcatttcaagaaattttttgtactgtacatagatttgttcaataaaacgtccttgttggtaaaaaaaaaaaa

SEQ ID NO: 486821 - DNA, 274 bp, Homo sapiens
gccctgtgtagcacacctaggtcagttttgcagtgtgtaagcatttaccaagatagttgtaggtaagaagggcagatttattagagaaattgtgaaaatatgttgcagtgggcagctcagcagagaaggggctacctgcaaaggaggcaagggctggaggaaagttttatagggtcctgctgaagggtgctacgtgtggaatgaggtcattgtgcccgcaggttgtttgtgattagctgtctctaacaattgttcatacaataattgttcatta

SEQ ID NO: 486822 - DNA, 1041 bp, Homo sapiens
  misc_feature (252)..(252): n is a, c, g, or t
  misc_feature (490)..(490): n is a, c, g, or t
  misc_feature (552)..(552): n is a, c, g, or t
  misc_feature (704)..(704): n is a, c, g, or t
ggcgccgcgcggcggaggcggcggcggaggcggcgcgggcgagcccgggggcgccgagcgggcggccgggacaagccgccggcgcgggctccgggcgtgcgacgaggagttcgcttgcccagagctggaggcgctgttccgcggctacacgctgcggctggagcaggcggccacgctgaaggcgctggccgttctcagcctgctggcgggcgcgctggcgctggccgagctgctgggcgcgccggggcccgngcccggcctggccaagggctcacacccggtgcactgcgtcctcttcctggcgctgctcgtggtaaccaacgtccggtccctgcaggtgccccagctgcagcaggtcggccagctggcgctgctcttcagcctcaccttcgcgctgctctgctgtcctttcgcgctgggcggcccgcccggggttccgccggggccgctggggggccagcgaccgccgaacaaggggtttggcagctcnttttggtcaccttcgtgtcctatgccttgctgcccgtgcgcagcctgctggccataggcttngggctcgtggtggctgcgtcgcacttgctggtcacagccaccttggtccccgccaagcgcccacgtctctggaggacgctcggtgccaatgccttgctcttcggcggtgtgaccatgtatgggggtcttggtgcggattctgactgagcgtncacagaggaaggggtcattgcaggcccggagctgcattgagggaccgatgaggctggaggatgagaacgagaagcaggagcggcgtcctcatgaggcctcctgcccgggacgtttgcctggggacttacgggggacgtcctgaagcccctggggaggatctccccgcgattttacttccgaggcggcacctgttggagctccggtgggggacacgacggggttacggcggtgggatcccacgtgcgagcccgcagagggtgggaagagctccaggacgatatgcgagagagagtggataataccggcgacaacaaggggcaccaaacatgagggagc

SEQ ID NO: 486823 - DNA, 5439 bp, Homo sapiens
  misc_feature (3680)..(3680): n is a, c, g, or t
  misc_feature (4586)..(4586): n is a, c, g, or t
gatgggagtgacgggggaaatgttaccgctctccttgaagggggtttaaaagagagagagaaccccttttgggggaaaagagttttgaggccaaaatgtgtttcgttaacgagggagaagaaaggctggcaaatttggggtgaaaaaagggggttggggctcacaacttgggacctttcatgagggatgccaaaacgtaaaggtctaagttgataaaacaaattggcacattttttgccaaatgattctggagatcctcaggatttgtgcaactctcaatattttttctggagcgctccttagaagcgtatcgtactgttgaagagctttacaaacgtccagatgaagaatataatgaaggcacaagtagtgttcaaaatcgtgttcgttttgaattgcttccaattttgaaaaagggattgttttttgaccctgaattttggaacttcgtaatgattaagaaaaactgtgtagcattattgagtgataaatcagcagttagatttctaaatgaaagcacactggaaaataatgcaggtaatctaaaaaggacggaggaacagcaaggtttggatgaagggtttgactctcttacagatcagagcactggagagactgatcctgatgatgtatctggagtgcagcctaaaggtcatattaatacgaagaaaaatcttacagctctcaatacttccaaagtagatcacaatgtcccaaggcatcgttgtatgttatgtaacaaggaatttttaggtggtcacattgtaaggcatgcccaggctcatcagaaaaaaggcagttttgcatgtgtaatatgtggtaggaaatttagaaacagaggacttatgcagaagcatttgaagaatcatgttaagaagatacagaggcagcaaattgctgcagctcaacaggatgatcaggaagtcactgctttggaagaaataaattgttctagttcttccatttcatttgaaaatgggaattctgatagtaaggatttggaagtggagacacttactgcttctagtgaaggaaacaaagaagtcatccctgagcatgtggctgaattcattgaaattcccataagtgtaccagaagatgttattgaaaatgttattgaaaatggcagtcctaataattctttaaataatgttttcaagcctttaactgaatgtggggatgattatgaggaggaagaggatgaagaaggtgattatgaagaagatgattatgacctgaatcaagaaacttcagtaattcataaaatcaatggaactgtgtgccatccaaaagacatatatgccacagatcaagaaggaaactttaagtgtcctgctcttggttgtgtccggatatttaaaagaattgggtttctaaataaacatgcaatgaccgtacatccaaccgatttaaatgtgcgacaaacagtaatgaagtggagcaaaggaaaatgcaaattttgtcaaaggcaatttgaagattctcaacattttatagaccaacttaatagacatagctatccaaatgtgtatttttgtttgcattttaattgcaacgagtcgtttaagctgccgttccagcttgcccagcacacaaaaagtcacaggacatttcaggctcagtgtagttttccagaatgccatgagctttttgaagatcttcctctgctgtatgaacatgaagctcaacactatttaagtaaaacaccagagtcatctgcacaaccaagtgaaacaattctttgggatgttcagacagactcaaatcctaatcaggaaaaagactcatctagtaatgagaaacaaactattagtctgccagtttctactagcaaatcaaggaaagagtctacagaaccaaggacatgtatagaaagtatggaaaagaaaacagacagtttagttcagaatggaaacgaacgttctgatgacactgtttcaaatataagcttgatagaccaaaagatgcctgacatagagccaaattctgaaaataattgtagtagtagtgatatagtcaatggacacagtgaaatagagcaaacacctttagtttcatcagatcctgctttgaaaattgatacaaacagaatcaggacagaaaatggttccattttgcccagtgttgtaccacaagaacacaacaccttgccagtatctcaggcaccttccaaaccaaatctgacaagtgaacatacttcatatggcttaattttaacaaaaccatacgtcagaccattgcctcccagttaccttgatgaacggtatcttagtatgccaaaacgcagaaaatttctgactgatagagtagatgcctgttctgatcaagataacgtgtataaaaaatcagtgaaaagattaagatgtggcaaatgcctgaccacctactgtaatgcagaagcacttgaggctcatcttgcacaaaagaaatgtcagacactctttggatttgattcagatgatgaaagtgcctgatgaaaatggttcagaaagatctgtcaatcaagcagtagtgtgaaaaaagcactataagaaaatgcatcatcagtttgctatttccctgatggccttaattttagagtggtcttggattactaaagataaagacaaagcacattttctagaatgaactcacagagatgtgctggcttagactccaaaaggattataaaactcccaaagtaccagttttccagaaaaccacattttacagtttatgatgattaatagcagcagcatgttcagtttcgcttatatgagaaacatgtttaggcaactagtcagaaaaccagctatggccttacagaaagggaaaagtttaacccattattaaaaagtgtgtgtgggaggggggctggtttacaatattaaaccatttaaagtattttattctacaaatggggtttgttttcttgtcatgcataatcagattatgtcccctcccttctggttaaacatggtttaaggaaccgctgctgtttggtttgtgattgatttagaaacttatacattaacttaccacagtgctatcaattaaagattgtaacaggtttccagatgattaattaggtcaaagttcaatgaatggcacgccagcattgaaaattaaaaaacaaaacaaaaaaaaaaccacagtgctttgctaataagctcttgatagaacctcccactaaccacttttgtggtacaaattagttaacatttaaagggcagcagtgtcaataaaatagaaaaaaaccgatcagtactctggggagagatgaaaggaatctaagactttacaggctttgtagttgaaggaaaacactgaattgcaaattattcaatgtgaataatggtaaaagcacactgggatacttctgtttgtgtatatgttgggacattgcttgatgattcatagtaaggtcctttagacattaatgtgagttatctaagtacagtcctattaaaataactggctcaaaaaatcagctaagaatcaggttgagaaatcattcattttattctattaggagaggtaattccaaaataagccatactattcctgtttttttaattcattagtgatgactctggtctgaacaggtaatttttatatgtaaaaggaagtatttacacaaaacatttgcacaagaacacagtaagagatacattcaagcatgttttccttagtgatgttantttcctaagaagattttaacttaataaagtgttaaaacaataaatatttttaaaaataccctctcagatgttttccatttgtccattattgaaaggaagatgcttaaagacttccttttactaatagtgtgtaaatctaaaacagggattaaaataacaaaaaggcagtgtttcaaaacagatctcctaatgtcccaatgtcaaatattccagttattctaaataataaaatctttgttcaaggcagataatctcatcagaccctattagagcttcttgaatgaggctattacggaagtggggaatttcttccaggtagcatccatattttattaaattaggatttccagatcatgatagatcagatgatttttttttaatttcccggttttattggtttatcatcagcattcactgctatgcaatgatggtcataagtccattccaaatttaaatttgtttctgttatgtagcctacattaggctgtggaatttacatttaggtaactaaacacagctcataattaaaatcttttctttaaggtcagctaaaaaaaatgtttcctgtatttcttgatactaaaaatgtaatgatttttattttagttcattctaaaagtatgtcttgtaatactgctttgtacattttccagaagtttaatattttatcacattttccacaagttgtaacaattgatataaatccatgcccacaaagtattccattttcattacttttactgttcatgccaagatgtttcaaatatattccatttgtaatctgtctttaacttgaggtttatttctacttttgtgttgctaaaattatttctgcaagactgagatcaaactggtttatatataactaaatcaaggaatgttttataaaattctatttgaccacantgtcttaacctcggtttatatacttctcaaatagctattgaaagaatgtgttcattttattacatctgcttttaaaacataaacctacatcattttgcttttatagggtgcataaacttccaacagttctaatttgagcgcttcagaagaaaaggaagcttgcttcttattcctcagattcttctttttttctgttttgaggatgtattcatcctacatggaccaagtttcaaatctttgtttttaaataaaaatttccttcaaaaaattaaatgttaaatttctgctgtgtgtcagtaaggtgaagaaaatagcaaatctgaatttttgctgctcagatattatggaggaggtaaaaaggggaatctccgtggacaaggacactggtactttgggctttagccatattcatttttttgaaaccaccaattatataatacttaaataatttatatcattgaacttgtgattcttttcaaatcacactgaaggttcagccgtactcctttcatgtttggtttaatactgttgtatggatgaaaaacctaaaagggatgatagtgtttattttttaatttatttggtactgtaaaacaccttttcagaatgagtaaatgctgcatatgcattttggagttgttaatatgtgaaagatattacagattcagcaagaaaggaaatttgtgcttccttgttgaatgttaaattattttactttgcattttataagagtacaaattaaaactgagccattgaactgcaataaatcaacaatagtgtctcatttcaagaaattttttgtactgtacatagatttgttcaataaaacgtccttgttggtaaaaaaaaaaaa

SEQ ID NO: 486824 - DNA, 923 bp, Homo sapiens
ttttttaggaagaaggacgttttattgaagaaatgtatgtagagtcgaaaaaatttgttgaaatgagacactattgttgatttattgcagttcaatggctcagttttaattgtactcttataaaatgcaaagtaaaataattaacattcaacaaggaagcacaaattccttcttgctgaatctgtaatatcttcacatattaacaactccaaaatgcatatgcagcattactcattctgaaaaggtgttttacagtaccaaataaattaaaaaataaacactatcatcccttttaggtttttcatccatacaacagtattaaaccaaacatgaaaggagtacggctgaaccttcagtgtgatttgaaaagaatcacaagttcaatgatataaattatttaagtattatataattggtggtttcaaaaaaggggaatctccgtggacaaggacactggtactttgggctttagccatattcatttttttgaaaccaccaattatataatacttaaataatttatatcattgaacttgtgattcttttcaaatcacactgaaggttcagccgtactcctttcatgtttggtttaatactgttgtatggatgaaaaacctaaaagggatgatagtgtttattttttaatttatttggtactgtaaaacaccttttcagaatgagtaaatgctgcatatgcattttggagttgttaatatgtgaaagatattacagattcagcaagaaaggaaatttgtgcttccttgttgaatgttaaattattttactttgcattttataagagtacaaattaaaactgagccattgaactgcaataaatcaacaatagtgtctcatttcaagaaattttttgtactgtacatagatttgttcaataaaacgtccttgttggtaaaaaaaaaaaa

SEQ ID NO: 486825 - DNA, 173 bp, Homo sapiens
tggaggaatgaaacagctcccgacgcgccactgtaagagctcactgagaaggtctccggcttcactcctgaagtcaggcaagaccacgaacccgccagaaggaagaaactccggacgtatctgaacatcagaaggaaccaatcccggacacactgtttgcagggaggtgtaga

SEQ ID NO: 486826 - DNA, 120 bp, Homo sapiens
tgagtagaataagacatggatgccactcctggcacccccgtcacacagtacgtggaagtcctagccagagcactcgaagcaagagaaagaaataaaaggcatccagaataggatagagag

SEQ ID NO: 486827 - DNA, 428 bp, Homo sapiens
  misc_feature (21)..(21): n is a, c, g, or t
  misc_feature (54)..(54): n is a, c, g, or t
cgggcattttagtatcaaaanatttaacaaggatataacttcagaaaaaaaganaaaagtccattaaattgaaaaacctgctattatcattgattagcaagtctcaaagagacagtagtttgggaactactatcatatacatgtaaattaatttcttagatcaatctctttgccctcagtgagaccctggtttgaaatgcactgttatgatatcttgcaaagatggccaaaaccaaaacagtaaagccaaactaagtaagcaactaaaaaaggaaaataagggaagcttatttctaatcactggctctttcctttacaaaaagacattttatatatgactggtaaagtccctaaattgaagagcagcaaagggtcaaatgcccagtttggtttatataagaaaagctgtaaagatctttggtcgacgc

SEQ ID NO: 486828 - DNA, 194 bp, Homo sapiens
ggttttttttgggggggggggccccgggggttttttaaccagggtggaggccccccccgggggggggggggccccccccccccccccatggggggggggggcccaggtttttggtatttttaggaagggtttggggggagccccctaatttttttttttttttgttaaaaaaaaaggggcccccttccccctga

SEQ ID NO: 486829 - DNA, 776 bp, Homo sapiens
  misc_feature (279)..(279): n is a, c, g, or t
tccactcagtaggtgtcttatccatactggtggacttttcccagggggaatggttgaagggaggggcaggaagggctgaccggaaagccacggttgggtttccctccatccaggggaaaaaaaactcggtagggacaatgcttaggttagagttgaacgggggaaaccactcactagtgttgggcgtgagaatgcacgtggtgcaggtgactttcagaacaaccgtgagttccttcgtgctcgaggaacagtgcacatttcttagagtgtggcaaaaanaaaacacgaagcacctcaaagaaaaacaccaaggttgcttacaagacgcaaatgtgctatgtgtaagaagggttcttagggcagccagcagtttgaaaagccgggggtttgtggcgtgtggccacctgtggccattgccctgtgttcccactgtgccctgtggtgccgggcttgtcgggccaccagttgcccttctttgagacagttcttccagtggggtctccagggggttctggtgagccacagaagggttggtgaacgggagaaggagcctgagattgttggcagccacccgggggcagtcccaaaggcgggggcttgcggttgacaacttttcaggggactctctctgaggggggtgggcccgagggggttggtgggccttggcgggggcaagcgggcgcctggtgagggattccggctcagcgttctatttcttgggggcccgggggtggacgcccctctcgggaaatctctaatacccgttggcgttgcct

SEQ ID NO: 486830 - DNA, 449 bp, Homo sapiens
cacgagggttcagcgcggcggcgatcagcagcgacggcggtcgtatcggcaggcgggcgatcagcgtgcgcagagcggcgggcggcggcggcagtgccggcagcctgatcgggaacgaggtgttcatgcgggtatcctttccagtccgggacggcggtgggcgtaaccattgaccagaccgccgggcaggctcagcgctgcgagcgccgcggcggcttcagcgacgtcggcctgaccgttccaggtgcgctcgaacaggtcgaccacggtggcgaaatcgcgcgaggtgggcgacagccgggcgcggctgacgccggcggcgcgcagtgccggggcgtcggcgatcaggcaatgctgcgccgccgactgcgtctgtatgccattcaaggcgaggaagtgctgctgttcggtggtgtcgagcagcaggccgtccgggtgttcgatgcagc

SEQ ID NO: 486831 - DNA, 157 bp, Homo sapiens
tcagtgatgctaaaaaggacaacagattaacgctgactgtagtcacccgtcgttgtcgtcaaagacgagatctgattcattcttgatgtgaactgttgggaatgggaacgcattgcatgcatggagctgcagacggagcgcactcgtgcggccaggc

SEQ ID NO: 486832 - DNA, 263 bp, Homo sapiens
ggtgaactccgacatcggacgcgatgatctgcgatgtgatcccgtaaccgctgccaaacgacatcccaccgctgagccatccgagaatcgccacgatcaagccacagccacccgcgaaccagacagggtgcaggcgacgccattcccagatgacaaagtgacgatgccgctgcggccacagcagcatccgactgaacaatccccccatcaggccacagccaataccaatcgccagaaccggggccacgagatcgaggctgacc

SEQ ID NO: 486833 - DNA, 750 bp, Homo sapiens
gtgccccagacaggttttttcgcacccctcgctggtccccacggtgcttggcccagttatggaaggctccctccgtgggcctttggtttcgaccggccgctaggcgtcctttcttttatccgggcctccccaccagaggggcgagcggcactgttttgaactacgtgcttggttacacacaggagagttctctcgagtgcgggttactatcccccatatatggagggcccttctcgagtgcggtgtcttactggttccgacacaaggcccgcggtgtccccacagcagagggtggccacagcggtggtgacgagccgcgcgtgctgtgtcgccgtctcttctagatatagttcttggtatcgcgcccttctttcaatagcgtctcctccgctgctccccacagatgagtacgacgctcgttatatttcacgggtctctctcgcgggagatcaagagtgagacctgagctcgtttatagggtcgcgcgaagataatagcaagaggagaataagatcgagaaactagagagaagaggagattaataggggatgaggcgccacagacgagttatagcaagaataccacctcccaacgcgcgggggaatactgggaaccacctccacaaggtggagtattgcacactcctgcccccaccactgagcacgagcccacaccccgagctcacagcgcgggttcttcgcagacacccccccacaacgtcggagagagcccctggaaagcaccgtacag

SEQ ID NO: 486834 - DNA, 223 bp, Homo sapiens
acctcgagttcggtaccgtaacattcgtgtcccatgatcagggcctgctacagcagtggagctgtagacagcagtgtaaacgtctgtgacatgcccatgcgagttacctgagtgaaggttatgactactctgactgaccatcatcatcgtgggactgactttggtggaagtccttggttacatgtcattattgcgtttccgacaagttataaagttgtcatta

SEQ ID NO: 486835 - DNA, 429 bp, Homo sapiens
  misc_feature (324)..(324): n is a, c, g, or t
ctattcgactatgcgtgagctcaggtgattcatatgctttatgcgagtaatccgaatgtgtttagcagtgggacttttaggggattcagaggatgtcacgcctgttgcggcccagttccctcgtatttgaggggtactctatagtctggagtggtaaaagcgtcagaaaaatccccgattgacatgaatttctgaggtaagacatagctttatcaggtatggaggacctgattgcataggtagtgtgtggtggccttggaatgacctttctggtgtcatatagagccatcactggtatagggtcagtgtgttggttagtaggcntagagtgaggagcgctatggagtgcaagtgcaatcacatgcataggccggaggtcattaggagctctaagatggcccctgttaaggatcatattctagtttagct

SEQ ID NO: 486836 - DNA, 170 bp, Homo sapiens
aaaaaaaaaaaaaaaaattagcccggggggatgcctcccccctaagggccccgcttctcaggggggttaggcaggagaatcaatttagccccccggaggtttggggtgcagtgagctgtgaaagcccccctgcccccccccctgggcaaaaaaacaaaaccctgtttcca

SEQ ID NO: 486837 - DNA, 217 bp, Homo sapiens
gtcgacctaaggatccacacgtacgctcatgtatatatccttaaggcctcatacatcacttcattttacagatggatattggacatgcagtcactcttctagaaactggggatatagcaggaacaaaacaggcacaatccctgccctcagtgagcttacattctagtagaagcaggactaaatagagtagaatattgtaatattgttagagtgatgc

SEQ ID NO: 486838 - DNA, 681 bp, Homo sapiens
ctctggtggatgatacgtgaagtcacaggatccagcatacatcttcctgaagtgccaggctacttatctaatcacagttgaattaagtcctatagctgctagactaaagcttgcttttgactctgagtattatgatggcctgtctgttgaatcagcactattgctagctatgacgtgggtgattatgacaagggatacaggttcatagaagacccttggacttctaccaaactgagggtctgtcatggccaggcctttgccattgataagaccatgtggaaatctgagtccattacaggcgatacgtgatttctgacgatcgcagttcactcagacgttgtcaagtgcatttttacatgtcgctcataagcatactgtggtgcctagacatctggtactgacctcagagataccgtgcaagttcagtcagagactagacttactgtcacgccagccaacgctgtcttttacagtgatatgtgccaatctgagcctgtatctttacaaattgaaaccactacaccccgctttgtacagatacagcgtaggacttggttacgccaattttgcccattttcagaccctgtagcccaccgcccttatacctcacaagggcccctaccctcttgccggggtcccctattcttgcagatggtttatcaccccctgctttccccccct

SEQ ID NO: 486839 - DNA, 344 bp, Homo sapiens
  misc_feature (63)..(63): n is a, c, g, or t
  misc_feature (187)..(187): n is a, c, g, or t
  misc_feature (229)..(229): n is a, c, g, or t
  misc_feature (236)..(236): n is a, c, g, or t
tcacgccatgtcacaatgaccccttggctcccctttcccggatgaggtcctggagcagcaggngcccctagggttgggggagccctcggaaaccgagggaggagaactgggttccggagcagcccctgctgggttctaagcagcccatcccaggcacatcatttaacctgctctggaaaagaaggcnaggcacactgtgctcacacacagcctggtgtgtgtgtgtatntcgtgtngtgtgttgtgtgcacgtgtatgtgtgtgcggtgtgtgtgtggtgtgtgtggtatgtggttgtgtgcatgtggtgtgtgtgatgtgtgtgtggtgtgtagtgtgtgtgg

SEQ ID NO: 486840 - DNA, 212 bp, Homo sapiens
aggtccgggtacatacaggataacagataatcacgcaccataattataacagaggcctctgatcaaccgcatactaagtgttacaagtacaattttttccgtataagaatactgggaaaaatggataaataacaggtaagagaaagatatctctaggcgattactaggatcattgggaaaaagtgagtacggtggatatttaaaatatcaca

SEQ ID NO: 486841 - DNA, 274 bp, Homo sapiens
cccgacggaagatgggaggaaaggcgagcctgacaaggcccctaaacgctgattccccaagtcgcccactggagggatgccttgggggaccagagaggaagaccagcgacagggtctagctctgttgccccggctggtatcaaactcctcgacccaaacgaaagtgctgggattccaggcatgagccagcgctcccggcctgcatacgggatgattccatgtggactgccacctcaaggaagcaaacaccaaggaaagcctggcgctgcgtgga

SEQ ID NO: 486842 - DNA, 437 bp, Homo sapiens
accttgtggggtgtttcagcacagaaaaacgctgttccctttacaagagggaaaacgctgagtatgtcttatctggcgcaacactgctgaaaatcagtgagcgtacaccactctgcacttgccattactggagaacgccaacgtgctggcccgtaatgccaatatctgccagcagaatggcatagtgcctattgtggaacctgaaatattgcctgatggaggagcacgacctcaaacgttgtcagtatgttacagagaaggtcttggctgctgtgtacaaaggccctaaagtgaacatcatgtatacctggaggggaccctgctcaagcccaacattggtgaccccggaccatgctgtaccatcaagtataccccagaggaagattgccatggcaattgtcactgacctgcgttcgaatgtggcccccgctttccca

SEQ ID NO: 486843 - DNA, 208 bp, Homo sapiens
ttctccctctcctaaaaatacaaaaattagctggttcatggtggcatgtgcctgtagtcccagctactcaggaggaggagggataagaagcacaatgaagcacaaaaaaacacaagaaggaaaaggctgtggctgcagctgctgcagttgttgtgacccctgcagccattgcagttgcacaaccacattagcacaggaagagccagtg

SEQ ID NO: 486844 - DNA, 281 bp, Homo sapiens
tttgcagcgtactcggcatacattcagcattgactgcagccctcataatactgtcaagaagactgccaatgaattttccctgttttgcctacatgcaagcttgccttggatcctggtccacaatgccaggttttcatgttatccagcagttacttccagctgtgttccctgcaaggctaagaatccccaggagtaagatcctcttcaccaaggctgaggactctttgttagctttaggactgaagcattttgacgggactgatgtttcttatccctcttat

SEQ ID NO: 486845 - DNA, 339 bp, Homo sapiens
cctgggaaaggtgaccaagggtctcagtaactctgcgggtttcctgacaatgcccaccctggacaacatcccgttcgtggcttatcgtgagtcaggacgtggtgaaagctgcagtggctgctgtgctctatccagaagaattcatggtcctgttggactctgtgcttcctgagagtgcccatcggctgaagtcaagcatcgggctgatcaatgaaaaggctgcagataagctgggatctacccagatcgtgaagatcctaactcaggacactcccgagttttttatagaccaaggccatgccaaggtggcccaactgatcgtgctggaagtgtttccct

SEQ ID NO: 486846 - DNA, 126 bp, Homo sapiens
  misc_feature (6)..(6): n is a, c, g, or t
caccanttgtgcggcatcagggatcgggtttacagcaacagtcatctatgagcttctggagaacgggcagcggaacctgcagatgacagcagctgctcgctgtcccaggatggttctcctggcacc

SEQ ID NO: 486847 - DNA, 499 bp, Homo sapiens
tctatttcaacaacccctcataaaatcctccaaatataaggagtccacgtctaattgctatgacaatggctgcctcaattccccagtgaggctgcttaaccaccccctcagccactcctcccacaatgacaagtatgcacaccatctgccagcttctgccatcatcaccaccacccaaaaaggcccacggacagacgtccctgtggttttccttctaaagggcaaattcccaggagtcagacttaagggtactgctctccaaaaaggttgccacaagtcacatctggttctctatcacctccagtctgaagcgtgttcttcccttcgtcagagtcacgctgccaactcggcgccaggtttgactcgcatcgcaaactgctgacctcagaggctaccaagcatctccacccccactccacagcagccgcccggcggtccccagtgcccagagatcgctgccaccactcaccctcccgctgcgccgaatccgatatcacgc

SEQ ID NO: 486848 - DNA, 432 bp, Homo sapiens
aagactccatctcaaacaaagtaaataatagaaagagagagagagaaaaaaaaaaaaagaaaagaacacttcttaatttgagggacttccccaacaccaggtgctgggggatttctaagaagatcaccaaccgactccctcacggtgaaataaaaccaagtactgaaaacgtaactaaacagcgaaccatgtagcttcacctgactcagtgctggggggcctctgccatctactggtgcttgtgtcatggatgctttttctctagaagtgggtgtgggaagtacaccaggggaactgggcaaaagccctaggcccatctctaatcttttaaccagccaatctggatggatgttctttccagaaggtgagggtacccgagcctcgatatccgtaaatcctatgggtccaaagctgttacccgggaggtgaaaa

SEQ ID NO: 486849 - DNA, 136 bp, Homo sapiens
gcggagtgcgagcgacaggacaggcctgtgtgtacaactgcacaggcatactccttgtgccagaaaggctctgaggacggcagacctgcctctcagtgacaaggccaagcaccagtagtgagagcaggctcctgta

SEQ ID NO: 486850 - DNA, 246 bp, Homo sapiens
ggatcaaccaggtggcattggaggcgtggcgcagccggcgggaccccgaggagatcctcctgcaggagcttgagccggtcatcttccgcgcggtgcttgacaacccgcaccatggcttctcaaactcgggcatcatggaagagcgccttctagacgcagttgtgtccctttcttccggttcagcggcaccacagtcccgcactgtcgtgctcaaacgagctctggccaactctgggctctgagaca

SEQ ID NO: 486851 - DNA, 784 bp, Homo sapiens
  misc_feature (2)..(2): n is a, c, g, or t
  misc_feature (83)..(83): n is a, c, g, or t
  misc_feature (110)..(112): n is a, c, g, or t
  misc_feature (126)..(126): n is a, c, g, or t
  misc_feature (208)..(208): n is a, c, g, or t
  misc_feature (210)..(211): n is a, c, g, or t
  misc_feature (225)..(225): n is a, c, g, or t
  misc_feature (228)..(228): n is a, c, g, or t
  misc_feature (230)..(231): n is a, c, g, or t
  misc_feature (233)..(233): n is a, c, g, or t
  misc_feature (235)..(236): n is a, c, g, or t
  misc_feature (239)..(239): n is a, c, g, or t
  misc_feature (241)..(241): n is a, c, g, or t
  misc_feature (243)..(243): n is a, c, g, or t
  misc_feature (245)..(245): n is a, c, g, or t
  misc_feature (258)..(258): n is a, c, g, or t
  misc_feature (260)..(260): n is a, c, g, or t
  misc_feature (264)..(264): n is a, c, g, or t
  misc_feature (270)..(270): n is a, c, g, or t
  misc_feature (273)..(273): n is a, c, g, or t
  misc_feature (282)..(282): n is a, c, g, or t
  misc_feature (310)..(311): n is a, c, g, or t
  misc_feature (419)..(419): n is a, c, g, or t
  misc_feature (421)..(421): n is a, c, g, or t
  misc_feature (426)..(426): n is a, c, g, or t
  misc_feature (430)..(430): n is a, c, g, or t
  misc_feature (433)..(433): n is a, c, g, or t
  misc_feature (750)..(751): n is a, c, g, or t
  misc_feature (760)..(760): n is a, c, g, or t
  misc_feature (764)..(765): n is a, c, g, or t
  misc_feature (782)..(782): n is a, c, g, or t
gntggtccttcacttgtgttggatttagaagtgaatgtgtttggaatatggcctacagagaatagaaacaaatccatgtaaanaattttgaaggaggcatgggagctaannngcctgtgatactangatctcagtcatatgaattacaacgtagtatttactggcaagaaggagaaagttgataggactctatgctaaaggagggcgngnntttgttgttactgnggngnngngnnttngnangntgctgactggggngntttntgccangtntcagaattnttggtcttttgggtttttgctttttaanngaggtgtgggagcagaggaatggagacaatcgtgagtttttgagctagggaaagttggagctcctttaatctttttaaaggatcagtgctgccctaagtgaataaacncnattgnccanctntattttagagttttaatgaattcaaggaagggagcatagcatatctgtggcaaactattttcccactcaaatccctgagttattgctgcatgctttaatttcttccctttcagcatctgagaaccttaaagccaatgtctgcgatctttttttggatatttatacttttagatatatagtacctttaagtagcagtatgggacaaggcttgtaaatgttttgtctaatgttctattgtcaccttttatgcatttatcacttccaaatctaactttgcacaagtaacccatgtaaaaaaaaatgtacatttttcaaannttgtaaatntttnngtccttaaaattttaantt

SEQ ID NO: 486852 - DNA, 202 bp, Homo sapiens
cgagcaggtgactctgaggatcttaaagcagtcgggcagacccgagctttaagggaaagcaggcagggtgtacgcagcccgggccggtcagcctttgacacaattaggggcggcaaccgaagtgaccgcaggattggccgggtacaggggctggaggaccagaaagccccttgcttcctgaacctccaacttccaggccctg

SEQ ID NO: 486853 - DNA, 207 bp, Homo sapiens
agctggatggagtatgcttcaccgaaatagggaataaatcttaatgtagaaagacagattaaggacccagagaatctaactagaacccataaggctagataacaaaaacaaaaaccaacagaaatcaatgatgtcaaacagccctgaaagaatccagatattggaattattaaacacaaataataaaacaactatatttactatgtt

SEQ ID NO: 486854 - DNA, 599 bp, Homo sapiens
ctggattatagtgaggagttagtaaaagtggccactattgggcttattctctgctctatagtctgtgacttgaagagtgatgaacgaatttgtttgactattttaaaattatattagaccttaagctgttttagcaagcattaaagcaaatgtatggctgccttttgaaatatttgatgtgttgcctggcaggatactgcaaagaacatggtttattttaaaatttataaacaagtcacttaaatgccagttgtctgaaaaatcttataaggttttacccttgatacggaatttacacaggtagggagtgtttagtggacaatagtgtaggttatggatggaggtgtcggtactaaattgaataacgagtaaataatcttacttgggtagagatggcctttgccaacaaagtgaactgttttggttgttttaaactcatgaagtatgggttcagtgggaatgtttggaactctgaaggatttagacaaggttttgaaaaggataatcatgggttagaaggaagtgtttgaaagtcactttgaaagttagttttgggccagcacggtagctcacccttgtaatcccagcactttgggagg

SEQ ID NO: 486855 - DNA, 111 bp, Homo sapiens
ggacttactggatctcgtcatggatatgcatcccgatccatcacgatggtgtcacgggtaccgcgcctgctgcgtatgttagcacacgctgatgcagtcagtgtagcgcgc

SEQ ID NO: 486856 - DNA, 240 bp, Homo sapiens
tggtgaaaccctgtctctactaaaaatacaaaaaattagccagtcatggtggtgtgcacctgtagtcccagctacttgtgaaggctgaacgtgggaggatcacctgagtcctgaggagtcgacggctgctatgagctgtgatcacatcacgtgcacctccaaggccttgtggttgaccacctagtgataatcttgttctcacagaaaaacaataacaacaatcaaatatcaaaataaacc

SEQ ID NO: 486857 - DNA, 267 bp, Homo sapiens
  misc_feature (189)..(189): n is a, c, g, or t
gaagtctcgaaagatgtctgtgtcttttctttgtagcccctatgaattctgatgagaaatccagtcattcaaatcatttttctttatagataatacatctgtagactgataatacatcgattttctctggctgcttttaagatttttatttttatttttgaggcagaattttacccgtatcacccaggnatgagagtgcagtgggcagtgatctcacgtgcaaccgtccgccgttccagggttcacacgtgagttccttgtgccctc

SEQ ID NO: 486858 - DNA, 112 bp, Homo sapiens
tgtgctccggtcgattctagaggaccgagagacgtgttgcattgatcaggcagccaaaagatttaaatgatctataataatttccaagcggtagattatgtggcattttatt

SEQ ID NO: 486859 - DNA, 188 bp, Homo sapiens
  misc_feature (41)..(41): n is a, c, g, or t
  misc_feature (172)..(172): n is a, c, g, or t
gccggtgagcccccatcctgcccctgcccaccaggtactgntggcctgtggcagcaagataggtggagagagacccagagatgtgagagagagtcagagacagagacagagagagagagagagacacagagagagacagagagagagcgagcgagcgcgcggcagccgcggngcgtgggcctttgctg

SEQ ID NO: 486860 - DNA, 858 bp, Homo sapiens
  misc_feature (276)..(276): n is a, c, g, or t
atcggcacgaggaggaggctgtcccgtaagaagaagtgccccactgtagtgctgaacccccacccgagccttgtgctacaaggagatcctggaaaggcgagagtcggtcggagtgctctggctgtggatggagctgggaagcctggggctgagtgaggctcagtgaccccgaagggaagggagaacaggagcactcccagcagaaagaggaggaggaggagatggcagtggtccctgcaaggcctcttcctggggtgggaatgagctggagagctnggagcaggaggaggagcggctctccaaggagtgggatggactccaaacgctggagcaagatggaccagctggccaaggagctgactggctgagaatgctggcttggatgtggtgcacgtgagtgaggcatgtgagtgacaagcctgggacagtttccatgaatgctctccattcctggtgccctggggcctacgagcttcatgggtgccctgttgcctgcagctgcagacagagtgctggagagccatccatccctgggaggacagccttgatggctgggcctgcccctccatgggtccgaggctacccctgaggagcacgaacagagtgagtgcagggcaggctggcaaacctgacagacacagcagggaccaagtgacctggagagccctgtcggccaattgagtgcaggaactggagtaaagtggccccaacagtctgcaggacactaaggaggggactgagaacccggctggcaggggctggcccaagggaccctgtggcctggctcggtttcccttggaaggtctggcaatggcggaaggagtccggaagaggacacagatcaacaggacctatgcc

SEQ ID NO: 486861 - DNA, 920 bp, Homo sapiens
  misc_feature (276)..(276): n is a, c, g, or t
  misc_feature (305)..(305): n is a, c, g, or t
atcggcacgaggaggaggctgtcccgtaagaagaagtgccccactgtagtgctgaacccccacccgagccttgtgctacaaggagatcctggaaaggcgagagtcggtcggagtgctctggctgtggatggagctgggaagcctggggctgagtgaggctcagtgaccccgaagggaagggagaacaggagcactcccagcagaaagaggaggaggaggagatggcagtggtccctgcaaggcctcttcctggggtgggaatgagctggagagctnggagcagtgatgtgatgtgatgctgtganctctccaatgtgagttggtgatgtgacctccagaactgcttgtgatgacaatgattgtgacacatgcttgtggccaatgtgatgcttgactgtgcttgaagaatgctgtgcttgtgatgtgtggcatgtgatgtgatgtgatgtgatgtgaccaacctgtggacatgttccattgaatgctctcacttcctgtgtgccctgtgtgctctactgtgcttcatgtggttgctccttgtgtgcctgcatgctgctgacttgagtgctttggatgtgtccattcctccctgtggatggacatgcctttgagtgctgtggccttgccccttccatggtcctgatgtgctaccctcgatgtgatgaatggacaatgatggatgtgatgtgtgcatgctgcaatacctgcatgaccatgatgtgaccatggaagctggaagatgcctgtctgggccatttgatgtgcatgatgcttgggacgaacatgtgtggcccaccatgtcttgcatgtgcactacgtggcgggtgctgatgacaccgggctaggcaggtggcttggccccatgggcaccctgttggccctgggctctgctgtccccttgggatggtcctgggccagtc

SEQ ID NO: 486862 - DNA, 1009 bp, Homo sapiens
  misc_feature (317)..(317): n is a, c, g, or t
  misc_feature (328)..(328): n is a, c, g, or t
agcggggctcggaccacaatcccagacgcggatgtgcagtgagttacttctcctccctggtgggtctcagttgcatctgcttgtgctctctgcctgcgataactcgcctcgaagcgaagggtatagttgagacactcaatcattgtttcttgcattgggagaggcccaacgagcatccagataaccattggctcggctctgtcatctttcattcaaactcgttattcgtgtcttcgtcacgacgactctcgtcttgtctcttcggttcatcggtcatctcaccttgcctccgttatacaatctcgtctggacccaangcacgtcctcntctcgtggactgctgaggatgggtagctaactattgaactatgtgttgcctgcgagcatgggagatctgagtaatttcttgaatctgtgaatgtctctgtggcgtcttcttccatgcacaagtataggataggagacattacacatgagagtcatgcattggagggcgcgctcggttgcagagagctcccatgctgccatgttgtggttcacatggctttcctctacggcgtctttccttctctgtgattgcattcactattccgccacaagtgtgaaaaatttaagtctttgccgcgctaactacttgaggtgtgcattatttcctcccaacaaaaggcctcgtagggctgaattacaacggtgcaaggttccacgggagtttgttacctagaggactcacccgtaactagacagaagctgtagaaaaaacctaacggggctgacgcccccagcaggggaaaaccgcttgtaagggggccagtcacaccgtatgtcggttcgaaacctgcctgctgggtttcgaggctgggggggcgttgggaacaagtctgattctccaggaacatacttgcccccaaggaaggaccgtactcgaaaagcttacacctggaaggtcctgtccttgatgcccatcaaagaggtcttcgacaattaaatttcccattcatcggcgctgtgg

SEQ ID NO: 486863 - DNA, 265 bp, Homo sapiens
aaactgatgttaacaaataatttgaactcgaaaatggacccattattttgtttcttccccagctgacattggtttggccttattatttatacttttaaaactgtttctcactgaagaacgtgataaataataaccgtggtagtcttcatgatttgtctgtctattgtgtgcctcacatgccactttacctaaattatgtcatgtaatcctcataacaccctgtgaaataggtggcagtatcccatttcacagaaggaaaccagag

SEQ ID NO: 486864 - DNA, 722 bp, Homo sapiens
cgggaccatgtgcgcgtccgggacgactggcgctgtgcgcgctccatgcacgagttggccggccaaggacatcgacgggcacatggttaacctggacaagtaccggggacttcgtgtgcatcgtcacacaacgatggacatcccagatgaggcaagaccgaagtaaactacactcagctcgtcgaccatgaacgcccgatacgctgaggtgtggtattgcggatcctggacttcccgatgtaaccagtacagggaagcaggagccagggagtaacgaagaagatcaaagagtatcagccgcgggctcacaacgtcaacaattcgatatgttcagcaagatctgcagtgaacggggacagacgacccacccgactgtggaagtcggatgaagatcccacccaagggacaagggcatactgggaaatgccatcaagtggaacttcaaccaagattacctcatcgacaagaaacggctgacgtggtgacagacgctacgagacaccataggaggagccacacagggcgaatagcagacaggacacatgacaccaacatataactaggcatccagacaggtagtgaagagacaccggcacaagcagccacccaggcaccaaaagcccatcaggcagacgaccaaacgcgaacacatgaaagagaccgccagaaagaagacagaaagggggacaaccaagaaaaccaggagcacccgccagggagag

SEQ ID NO: 486865 - DNA, 305 bp, Homo sapiens
gagactttataaaagagactggaaaatacgtggaattagaacatgcaatttaaaccaagccacataggtaaacacagcatgtctgtgactaccagaggggaatacgtatggctgtcaggtcccatagcgtttgagggaattcgcccactaggaaggctttggaattgcgtgtgagaacctgtggctggaagcacacagcaataacaatcccatcaaggcaagctggtatctgtatccaaccacagcaaaaccagtcccaaggaacacagggcttgcctggcaaaactgccaaaacagaaagcggt

SEQ ID NO: 486866 - DNA, 315 bp, Homo sapiens
  misc_feature (299)..(299): n is a, c, g, or t
agaatatcagctggtagtaacggggatgatatatgatttgttaaatagtgaatacaagaagaattccctgcttcggagcccttgttatgtaagctggccttctcaatgacacgattgtaaagaaaagaaacaactttttctcctggtactaagtacaggcctggataggtcagcctgcttcatgcttctccagactcatttgtagcactttcttcttgtactctaagcctgactgtgcaacatccagctgtctcctggtattttcattggctctacctccagcctagcacagggatccnctagagtccgagcgca

SEQ ID NO: 486867 - DNA, 80 bp, Homo sapiens
aggtgagcattagccttcatcttcgttattattcctccatgtatcttgcaataaggctctgtgaaatctggtcccagttt

SEQ ID NO: 486868 - DNA, 462 bp, Homo sapiens
catccacataaatcccttaacttcctatctttctgaagatttttaaaattattttttctagtgccctatgattttattatatacacatgtatttgtcatgtattttgaaaggggcatgaacataatcaactgttttaattagaaaactctttaatggtttcaatgctcactaaaaatccttttaaactatgactttcttgactgctttattttgacatatctattgatttgctaagtcacctctatgactaatttcttcctggtgtaacaatgcatccacataaaactttctaagttgtacttatgagaatgtatttctgttgccaaatatttttaatatttcaattaatattctatatcatagcatgcatagcaggtttgattgaatttgattttttaaatcataattttgcattcataactctgttaaagtagatgtttatatttaatgtcaaaaaaaaa

SEQ ID NO: 486869 - DNA, 558 bp, Homo sapiens
agaatatcagctggtagtaacggggatgatatatgatttgttaaatagtgaatacaagaagaattccctgcttcggagcccttgttatgtaagctggccttctcaatgacacgattgtaaagaaaagaaacaactttttctcctggtactaagtacaggcctggataggtcagcctgcttcatgcttctccagactcatttgtagcactttcttcttgtactctaagcctgactgtgcaacatccagctgtctcctggtattttcattggctctacctccagcctagcacccacagtctttatcttgctagctttctcattcttcaggtctcagtgtaaatgtcacttccttagagaggcctcctgtatctcctgaattaaaattattttctttgacccagatgcttgtatctcagtctcctatgtgcattattgcatttgttattgtttgcctcccttccacaagggcagggattatgtgtgattcctcatctctgtccccagcacccagcactgtgaatcttccctaattagtgttcaataaatgtttgtcaaatg

SEQ ID NO: 486870 - DNA, 691 bp, Homo sapiens
agaaatagtagaccccgggatattgggtggtacaccacttataaagggtcatccacttcaaccatttcaaaaatgtatttttagcccctaagttttggtaaccaacttttagcccacaaaagttaattgatcccgggggaatagcaggacccttcaaaagtccattatgttttccatccccaaaagaatgggatgcccagctcttttggcatggaaatgggaaatattgcttttcacgccattatgtggaataagggctaataaaagtgggtaaacgttaaggttattatagtcctgagattcgacttaatgtgtgattcaggtctttctgtcactccttttaaagcctaattaaggacgtcttaagtgtttctggaaaaatctgtaaaagtcctccagtggatttgcctttgcctcttaaaaaactaaatatgttggtgctgacattgtaaaggaacagattctcccgtacctgcaaaataatttctcagaagctggtatctgtaaggtaccttttaaaggctctaatttatttgtgtggttaacaaaggaggaattaattaataaattgtagaaaatgcgccgcggctaggttttccctcctcatatttgtaggctttcatttcaagctccctcacccgggcattggtcaaaacatagtttgttcaatagaacctggcccagttttcta

SEQ ID NO: 486871 - DNA, 205 bp, Homo sapiens
ccttccgcacacccctgcagctcgacccgcagcaggagcagcagctgtttccggcgccttggaagaggagttccttggccaattgccggggccctttgaggcttgttgctagctgaaccccactggaaccagccctgaccagctcgggcccccgaccctccagagctctgactctgcctatgcttctcagtctcttgctgctaga

SEQ ID NO: 486872 - DNA, 187 bp, Homo sapiens
tcgtgactcgctatcatcgccacggggctggggagcttcttgcgaagaactgccgagaatcctggacatcccggatggccccgggcctgagcacagcctctgccgactccagacgctgcctcttcctgcgggcgaggcgctgccgggcctgcagctgccacttcttcttggtgccgatgaatagcga

SEQ ID NO: 486873 - DNA, 254 bp, Homo sapiens
tgcgcgctcgtgagaggcaccggattcgcgacggagaggaacgccgcggggatgtcgttgttctgccagcgatgcgacacgtatgcgccgtactcggcggtcgtcttgtcggccttgcgacggcggtttcgcgtctcctcgtccttgtactgcagcgcagcaaacgtgatggtgcgcacgtcgaccgagggctccacgtccaccatgtgcgtcggattcgtggtggtgcccgacagcgggccgatggcactgaa

SEQ ID NO: 486874 - DNA, 125 bp, Homo sapiens
  misc_feature (19)..(19): n is a, c, g, or t
  misc_feature (94)..(95): n is a, c, g, or t
  misc_feature (118)..(118): n is a, c, g, or t
agtaacccccttaccaggngctgggcatggggccaagtgctttaagtatataatttgaagattatagaagaagggaaatagcaaatggacacannttacaaatgtgtgtgcgtggccnaggaggt

SEQ ID NO: 486875 - DNA, 584 bp, Homo sapiens
  misc_feature (6)..(6): n is a, c, g, or t
  misc_feature (72)..(72): n is a, c, g, or t
  misc_feature (97)..(97): n is a, c, g, or t
  misc_feature (99)..(99): n is a, c, g, or t
  misc_feature (113)..(113): n is a, c, g, or t
  misc_feature (118)..(118): n is a, c, g, or t
  misc_feature (123)..(123): n is a, c, g, or t
  misc_feature (144)..(144): n is a, c, g, or t
  misc_feature (164)..(164): n is a, c, g, or t
  misc_feature (172)..(172): n is a, c, g, or t
  misc_feature (175)..(175): n is a, c, g, or t
  misc_feature (185)..(186): n is a, c, g, or t
  misc_feature (188)..(188): n is a, c, g, or t
  misc_feature (232)..(232): n is a, c, g, or t
  misc_feature (248)..(248): n is a, c, g, or t
  misc_feature (307)..(307): n is a, c, g, or t
  misc_feature (309)..(309): n is a, c, g, or t
  misc_feature (311)..(311): n is a, c, g, or t
  misc_feature (335)..(335): n is a, c, g, or t
  misc_feature (341)..(341): n is a, c, g, or t
  misc_feature (388)..(389): n is a, c, g, or t
  misc_feature (394)..(394): n is a, c, g, or t
  misc_feature (396)..(397): n is a, c, g, or t
  misc_feature (575)..(575): n is a, c, g, or t
gctggnagacccctaggccactctgaggaggcaggccttctatcttagtgaatgtctatttgtgttgtctgnaggtgacgcttttattcccctaggngnttgccatctttttnggtgngaagntttctaaagcggggggtaggnatctacatcttacaaaaaancaaaaaanggnaaggaagggnncntataagcaaaaagcacttccttcttctagaaggaattctgagtntcaaataaagagaagntcttcttttaatatcgtttttctttgtatgttagaggagcagacgttattattcatgantntnaatggatctgcatatgtgattatngttgcnatgcaatacatatgaatataatttttttttttttttgagacggagtnngcttngnncacccaggctgcagtggctcgacctcggctcactgcaagctccacctcccgggttcacgccattctcctgcctcagcctctccgagtagctgggactacaggcgcccgccaccacgcccggctaattttttgtattttttagtagagacagggtttcaccgtggtctcgaactcctgncctcgtgat

SEQ ID NO: 486876 - DNA, 1275 bp, Homo sapiens
ggagtgatgacatcaccagcgccgagatcggagagcagctgaggatgtgaggagggggagcagggcgacccccagaactgcaatcctggcagcagcatgctggacgtgggatgacatccacgcctcagctactgaccctgtgccccacagtaccaatgggtccacgatgtacaaagtcatttcgtgccagataggtgtgcagaacaccatcacaccgaccacgatcgtcgacatgctgcattggatgatgtaggacccataggccatcccacgcaccagcacatcatgccctggatcagaagcaatcttcagaataaccaacgacggcacgcatgacaacagatccatcatcatggccactgaacgatcacgagctcattactgccaaccaagaggatgaacacaattcccaccaaagacaggcaccataccaaaagacacacaacagaaggtatatatggatcgtcactcgggcacagattcttaccacacactctggggtcgagacgacatgggaaccaacattggagccccaccattcggacaaccgtactcaaaacaacatctaggcgcccccagttgaaccccaacgccattgagcggcctattcacgttactgaacgagaaacagtctgatcatacaacacacacaaaatagtacgttctagcagtaatccagcacgcgcccccggggtttacaataccacctctacccaagccagctacaattacatatatgtccatacaaccaagccaacaagggattcctcatacacacgatagtgactagcaacacccacacgaacccttacccattgacccaaattgcattcatataaaacactctcacccatgtgcgccaccgtccaacatgcgagaggcagagctaacccgctgccagacataacacacaatgacacaacatacaccgcacgacaaactaatataacgaccaagcacaataatctacaaagtgtgacaacaataacacagctacacacgcgcaactaagacccacacgacaaggaacgcacaagcaacgcaccacaacacacagcatcgctacaccaccccagcagctacaacccggcggagaacaacagaaaaaagccagcaggcacacgcacgacagcgagaaagcccaccacgcgaagccaaacacagagcacgcaacagacaaccccccgcgaacgagacagagaaagccacacagaccacacgaccacgtcaaaccacaacaagcaggcaacaacactagacacaaaaaaccgaaga

SEQ ID NO: 486877 - DNA, 314 bp, Homo sapiens
  misc_feature (2)..(2): n is a, c, g, or t
  misc_feature (13)..(13): n is a, c, g, or t
  misc_feature (57)..(57): n is a, c, g, or t
  misc_feature (84)..(84): n is a, c, g, or t
  misc_feature (113)..(113): n is a, c, g, or t
  misc_feature (122)..(122): n is a, c, g, or t
  misc_feature (127)..(128): n is a, c, g, or t
  misc_feature (134)..(134): n is a, c, g, or t
  misc_feature (142)..(142): n is a, c, g, or t
  misc_feature (163)..(163): n is a, c, g, or t
  misc_feature (165)..(165): n is a, c, g, or t
  misc_feature (194)..(194): n is a, c, g, or t
  misc_feature (196)..(196): n is a, c, g, or t
  misc_feature (204)..(204): n is a, c, g, or t
  misc_feature (218)..(218): n is a, c, g, or t
  misc_feature (279)..(280): n is a, c, g, or t
cngaaaatgtacngttttagaatgtattacaatatcaatgtgaatatcttgaatccngttacaaatcctgcactgtattaaacntgtaaattaattgtttgtctgattagccnatctcaccncccgnntggggnggtatacntgtttgaagaactgtgtaacncngtaattgatttgtgtctgatgttgtaacncnatagaagngttttggaaggaancatggtgtgtgagacagtgtctgttcttttgtgccagctctgtatgatgtttgtaagaccnngtttgtaagacgtgaataaattgctgcttttgcc

SEQ ID NO: 486878 - DNA, 525 bp, Homo sapiens
  misc_feature (119)..(119): n is a, c, g, or t
  misc_feature (260)..(260): n is a, c, g, or t
aataaatcagaaatggtacctttttaagaattgcatatatttttagagacaactattaacacattgagagggaagcaaagccgggcatggtggctcacgcctgtagtcccagcgcttcnggaggcggaggcgggcggatcacctgaggtcaggagttcgagaccaacctggccaacgtgaagaaaccccgtctctactaaaaatacagaattggccgggcgtggtggcgtatgctgtggtcctagctactcgggaggctnaggtagaatcacttgaacccgggaggcacgggttgcggtgggccggtatcacaccattgcactccagcctgtgcaacaagagcgaaactccgtctcataaaaaagaaatgagagagagcagcctttcgttattgtctgtttaaaactgtaagcagttactctcttaactcccttattacctaaacttgtctggctcccaggacagccttctagagacagggagtattgggaggaaaacgttacttaactattgactgaacgttaa

SEQ ID NO: 486879 - DNA, 821 bp, Homo sapiens
atgatgctccagtgggaggagcaactcaagttcatcattgtcctgagagagaggagcagcgcggttctcggcgggacagcagaacgccagggaccctcacctggcgcgccggggcacggcctttgatttgtcctgaggtcgctggagacccgcgggcgctgccctgtcacgccgggcggtaccctttgcagtcgcgttggtgctgcgatcggccggcggtccctgccgaaggctcggtgcttctgtccacctcttacatttcttcattatcggtgcgtcatgtccgagagtcccgtctggtacatgtggggccttggtaacttatggcttctttctgggcgacggtcccagccattcgcgagaaccggggacaatggcaagtcttgagcccggagacgagcgaacatatggggaccccgggttaaaagcaagaggtcgtccttcacggccgcgtattctatcttcaggcagttgcatacatcagcgacttatttcacgatcttctccaggcgaaacggtctcccaggtgaagtctcagcaccagaggaggcaattccagttagaagttgccgtcccaggttttaggaccgaacagatggggcccttccaaagtaaggctacggacttgtgtgcaaggttacacaaaactcttgcgcgggacactacattcccggggcaactgggtgccaatcccatatctttaaacagcgcggttcccatgagaactgtcggctctgaaaatagtgacggtacggaaatgaactgcctgactgtcagatcgacagttgcattccgctggccccaaatggaaatccccgtgg

SEQ ID NO: 486880 - DNA, 365 bp, Homo sapiens
  misc_feature (1)..(1): n is a, c, g, or t
  misc_feature (98)..(98): n is a, c, g, or t
  misc_feature (203)..(203): n is a, c, g, or t
  misc_feature (208)..(208): n is a, c, g, or t
  misc_feature (231)..(231): n is a, c, g, or t
  misc_feature (279)..(279): n is a, c, g, or t
  misc_feature (292)..(292): n is a, c, g, or t
  misc_feature (333)..(333): n is a, c, g, or t
ntttccttgtgagggcccggatcccatgacccctatcaccccattgaagcttaatcacctcccagagacctcctcataccatcacgtcgggcctaggnttccacatgggaatttcagagtgaccattcagcccgtagcagaagctcctctgggtctgtcctggcccacagaccctgtgtaggaaaagcacttgcccctgcgcngaggnccccctggcagagcccggttgangcagtgagggccctgcaggataagtggaaatctccccagggggattantgggggtgccttnctcttacagagtccaaggctgggtaaaaagcgcatgtgtgntttcgtgtcctggtttggtcccctgccccagc

SEQ ID NO: 486881 - DNA, 320 bp, Homo sapiens
agcctacgctacgtgttagcaccaacagttgtacacagcatacatcgtgtacgataagtggctagcgatagatgtgctcgttccgctacatatagagtgcccatgtcgcatgaagcactatgtccctggcacttaacactactatggacgttgcatgatacctcgccactgactctcaagactctacatacagcttgtccactagagtcgacgctcaggcggccatactcatgaggtctggctgactgtggctcgatcagtacattcgagtctttagctgtcatgcagcgacggatccgacataggcacactgattgcgg

SEQ ID NO: 486882 - DNA, 1054 bp, Homo sapiens
  misc_feature (355)..(355): n is a, c, g, or t
  misc_feature (367)..(367): n is a, c, g, or t
  misc_feature (372)..(372): n is a, c, g, or t
  misc_feature (376)..(376): n is a, c, g, or t
  misc_feature (379)..(379): n is a, c, g, or t
  misc_feature (387)..(387): n is a, c, g, or t
  misc_feature (390)..(390): n is a, c, g, or t
  misc_feature (394)..(394): n is a, c, g, or t
  misc_feature (404)..(405): n is a, c, g, or t
  misc_feature (422)..(422): n is a, c, g, or t
  misc_feature (455)..(455): n is a, c, g, or t
  misc_feature (566)..(566): n is a, c, g, or t
  misc_feature (570)..(570): n is a, c, g, or t
  misc_feature (626)..(626): n is a, c, g, or t
  misc_feature (650)..(650): n is a, c, g, or t
  misc_feature (803)..(803): n is a, c, g, or t
  misc_feature (821)..(821): n is a, c, g, or t
  misc_feature (959)..(959): n is a, c, g, or t
  misc_feature (974)..(974): n is a, c, g, or t
  misc_feature (977)..(977): n is a, c, g, or t
  misc_feature (991)..(991): n is a, c, g, or t
  misc_feature (1040)..(1040): n is a, c, g, or t
cagatatgttatatgtgatttctgtacataaggagtatgagagtaacccttttacaaatggaactaatttactagaacaatgacaaaactgaactggtatttgatgtgaatccacaggagtttaagcttcaaatccagccaagaaatttgttacaatctctttcagctttgcatctgattgttctgagatctttccatcagccctgatagtgcccaacaaggcttggtgctggctgacgacatgagacaagaaagcattctcaaactttgtaatcttgctgggctccagtttatcaagatatccccttacacccgcatagataacagccacttgttcttcaatagccatgggagnatactgtccttncttcngcanctnagttagangcncgcnacgactcaanngttgttgagtggcagcntcgaggtcagacccgaactgggcaaaagcagcnacctcacgatactgagccaattccagcttcatggtacctgctacctgcttcatagccctggtttgggcagcggatccgacacgagatacagacagaccaacgttaattgcngggnggatacctttgtagaacaattctgtttccaagaagatctgtccgtcagtgatgganatgacatttgttggaatgtaagcngacacatcaccagcctgtgtttctatgactggcaaagcagtcaaggagccaccaccaaaagcatcgttcattttggctgctctctccagcaaccgggagtgtaggtagaacacatcaccaggataggcctcacgaccagggggtcggcggagnaacagagacatctgacgntaagcaacagcctgtttggataagtcgtcatagatgatcaaagcatgtttgccattgtctctaaaatactctcccatggaacagccagagtaaggagccaggtactgaagtgggggagcatccgaggccgtagccganaccacaatggtgtanttnatggcatctgcatntgttagtctcttcaccaatgggcaaaatggatctcttttgaccatagcnacataataaataca

SEQ ID NO: 486883 - DNA, 762 bp, Homo sapiens
ttgtttttccaacttctgctggaaagtcggggatttctcgtaggtccttccccttgttgggcctcttacttgtatggagaacctggccttttaggatactacactggtctcaatgttgttttggtcgaaacttttcctgagctttttctagggggttcgctctacgtgcaaggtccaagcatcctcagatttggtgacctacctgagaagaaagggcaacctggacagggacacacagtcgctcccagcaaggcgcaaaagctttccgtttttcaccgtagtgctgtctgcctatccagaagacggccatggatgcctcgatgcccgtcgagggctagctcatcaggctgttcatgatgtccggtgcgaggcatagtggctgctaaggacagggcaccaagcaatacaggttgccactggagggtccgggtgcatgcggcgtcagagttcagcagcattgtccactcctcctcttagctctgacgtctagtgcatcctagcttcgtgagtggacatctcgtggaggggacacgaaatgactgatctcacccgtttcccagtattcagagctagtgaacccctgtggccgcaggattggcctgtgtcatgttattcttcggattgtaaatcattctcctgtggaattggcaaaagcgtacatttgttcactgtccttaccagtcaacagcttcgcgtctgtgcacactggctagtgacgtgtgggctcgtcggtgtctccgtgtgtgtacatatgtgtatact

SEQ ID NO: 486884 - DNA, 287 bp, Homo sapiens
cgagatccgctcgcctcggacacccaaagagctgggattacaggcgtgagccaccttgccggccttatcagataatttatttaaaagaaaagagagagagagagataaagatgggtagattatacacaatgtatacaccaaaaagaggacatctttatccgtgagtcagggaatatataagagagatatcaaaagtccctcgccgcatgagttccacatcacatataaagtgctttcatttgaatagacaaaaaataatcttggggaaaatacgagagtaaaaacag

SEQ ID NO: 486885 - DNA, 1241 bp, Homo sapiens
  misc_feature (342)..(342): n is a, c, g, or t
  misc_feature (814)..(814): n is a, c, g, or t
  misc_feature (920)..(920): n is a, c, g, or t
  misc_feature (926)..(926): n is a, c, g, or t
  misc_feature (954)..(954): n is a, c, g, or t
  misc_feature (1107)..(1107): n is a, c, g, or t
  misc_feature (1114)..(1115): n is a, c, g, or t
  misc_feature (1119)..(1119): n is a, c, g, or t
  misc_feature (1122)..(1122): n is a, c, g, or t
  misc_feature (1124)..(1124): n is a, c, g, or t
atttggagaagtatcgtcctaaaatgcggctgcgtttcaaacgattccaacggctcatagaaacaactgttgcattcaactaaaattggggtgcctaatgctactggaagtggaacttgacgatagggcctacatttgtctatacatacttagccaacatgttggcttagctaagtctaactgaagctcccataggagtattgacaacggcagttttaccaggcctcaagctagacagatttggcaacctctgtattcgggttacagtcaacctatcttggatacttggcaacaagattcttgctgtcagcatataaaatgtgctgtcattgtatcaatganctttccccaaatcatgcagtatgagttatgactgttaaatctattcccatgccagaatcttatcaatacataagaaatttaggaagattaggtgccaaaatacccagcacaatacttgtatatttttagtaccatacagaagtaaaatcccaggaactatgaacactagaccttatgtggtttattccttcaatcatttcaaacattgaaagtagggcctacatggttatttgcctgctcactttatgtttacatctcccacattcataccaatatacgtcaggttgcttaaccatgatttttttttttttttaaccaagtcttacagggattatttacgtgtttccatggtttctcacttggggcggtattaaaaaaacctccatttggaaaatctacgttggtacagaagcacatggtctttaatggtgcttcagacaaaaaaagccttacattaatttaatggtgtggnactctggaggtggcaacttaacaggggagggcctgagaaaagaagggggagggggctataaattatttttagcaaaaggtggccttggtctggtggcaaacttgtngaatangctctttaatttagtaaaatattttttnaaaagggtagagatgcttggtatggtaatcataaattcctgaaattctggtaattttttcccatacttatcagaggtgtgtttaccacttatttggttggaaggtgatttttttttccttcccaactctttggaaaaagagtgcttctggtanggatggnngaanttnanttttatatggtaggcggggataaattggggctgacatggttttgctcgcaaggggtggtctgggtggaccattattgggggtggctgctgcgcgacaattcgggtccgtgtatggga

SEQ ID NO: 486886 - DNA, 906 bp, Homo sapiens
  misc_feature (36)..(36): n is a, c, g, or t
  misc_feature (44)..(44): n is a, c, g, or t
  misc_feature (49)..(50): n is a, c, g, or t
  misc_feature (52)..(52): n is a, c, g, or t
  misc_feature (57)..(57): n is a, c, g, or t
  misc_feature (479)..(479): n is a, c, g, or t
  misc_feature (585)..(585): n is a, c, g, or t
  misc_feature (591)..(591): n is a, c, g, or t
  misc_feature (619)..(619): n is a, c, g, or t
  misc_feature (772)..(772): n is a, c, g, or t
  misc_feature (779)..(780): n is a, c, g, or t
  misc_feature (784)..(784): n is a, c, g, or t
  misc_feature (787)..(787): n is a, c, g, or t
  misc_feature (789)..(789): n is a, c, g, or t
tcgtcgagctcggcctagttagaagttcatagcatnagcaaganacccnngncagcnatgccaggcagcaatgtgctattgaaacttaggaagattaggtgccaaaatacccagcacaatacttgtatatttttagtaccatacagaagtaaaatcccaggaactatgaacactagaccttatgtggtttattccttcaatcatttcaaacattgaaagtagggcctacatggttatttgcctgctcactttatgtttacatctcccacattcataccaatatacgtcaggttgcttaaccatgatttttttttttttttaaccaagtcttacagggattatttacgtgtttccatggtttctcacttggggcggtattaaaaaaacctccatttggaaaatctacgttggtacagaagcacatggtctttaatggtgcttcagacaaaaaaagccttacattaatttaatggtgtggnactctggaggtggcaacttaacaggggagggcctgagaaaagaagggggagggggctataaattatttttagcaaaaggtggccttggtctggtggcaaacttgtngaatangctctttaatttagtaaaatattttttnaaaagggtagagatgcttggtatggtaatcataaattcctgaaattctggtaattttttcccatacttatcagaggtgtgtttaccacttatttggttggaaggtgatttttttttccttcccaactctttggaaaaagagtgcttctggtanggatggnngaanttnanttttatatggtaggcggggataaattggggctgacatggttttgctcgcaaggggtggtctgggtggaccattattgggggtggctgctgcgcgacaattcgggtccgtgtatggga

SEQ ID NO: 486887 - DNA, 211 bp, Homo sapiens
ttactctaggagatgaaaggaaagtgcatgaaggtagtttcctcaattttttgcaagatgacatgtgaaaaaatattggtgaacctagctattcctttcctgtatttgtgacaagatattctataataggaggatataatcaagccattaatgtcaatgtcgtttttgttatcatacaaccagtaaggatctaatgagtaatgcgcaaaca

SEQ ID NO: 486888 - DNA, 112 bp, Homo sapiens
aattcacgcacgcgcaattacgcaaagcgtccaagcctcacacacccactacctccaaaactcccaaacataataactgaactactacacaacccaaatagagaccaatctt

SEQ ID NO: 486889 - DNA, 119 bp, Homo sapiens
acttccaggacttaaaacacgcaatctcacccctctgctggttatagggaaccagaatgatggcctcagcaggaccaccccaacaaggatgccagcagcaacaaggtccaccacctcct

SEQ ID NO: 486890 - DNA, 107 bp, Homo sapiens
aggtaaggttgtcacgtggaacaactgataaaggtcagctatatatgtagagctatatatgtgagtcacaaggtgtgtgacatacgtgtatacgtataatatgcgtt

SEQ ID NO: 486891 - DNA, 842 bp, Homo sapiens
  misc_feature (145)..(145): n is a, c, g, or t
catgatggctgcaacactgtgtggatccccgatgtacatggctcctgaggttattatgtctcaacattatgatgctaaggctgagctttgtgcgagcgattagggaacagtgatataccaatgcctacgttggaaaacccacccnttttcagggccaaataagtttccccttttccaaaaagggaaccagttttaaaaaacggggggaaacttttgggttttgttctaacgtttgggaaaaatctacacaaaaaaaaaaccccaaaggggggaacggcctttttatatatgtgggcgccccattaataagggttataattttctcccccaaagcggaacaggaggacagaaacccacaacagcccgccacacagagttttctctcttccacaaaaaaacgccccgccccctttgttgttttttcgaactacaaacttttttttctgcagctacgggggggggggggggccctgttgattttaaccaaagttgcctcttccgctttatattagttccccgcgccagatgttgatgtatcgattttctctagggcgggggggaggaggaggggcagggggctcaccaatttaacattctgggcggaggggggagaccccttaatatgtttttgcacgcgttcacacccgagaatggcggcgacatcaagacaagtgcggcgggaaaaaacactaaacagatgacaaccaagcgcccgcaccacacagtgaaagatgcaaacagccgaaaacacgtaacaatcagtcgggaggagcagggacaaaaatagctatcttttttcgtagcagacgaagagccaaaaacaacacacactactgtcgggt

SEQ ID NO: 486892 - DNA, 126 bp, Homo sapiens
tcaggtatactttgcaggagtgatgggggtgttgagtaagatgcaggaagaaaatgcaggaatctaacataacaaacgcactcttgcgcaacaagcacgtgcatttgagtcactttgtacttttca

SEQ ID NO: 486893 - DNA, 504 bp, Homo sapiens
cgcggtggctcacgcctgtaatcccagctctcagggaggctaagaggcgggaggatagctgtgagcccaggagttcgagacctgccgtgggcaatatagcggagaccccggttctccagaaaagcggaaaaaaaaaacacaaaggacaaaaaaaaaaaaaaggggaaaaaaaaaaaatttgtgtggggcgggattggggcttttggaaaggttttacaagagcccattgcggtgaggagcgcgcgggggccacagaggaggggcaacggcgacacactggggccaaaacgcgtggtccaaaaggggaacccggggggccaggagcaaagggcgcgggagatccctccaccacaatattaaaaaaaggcgcccggggggggagacacacggggaagggcgtctctgggaacaaacttcccaagagggggagaacaccggagaggggcccaaaccgggggagacactaacccaacccaggggggctcccaaggagagagccgagat

SEQ ID NO: 486894 - DNA, 156 bp, Homo sapiens
  misc_feature (150)..(150): n is a, c, g, or t
taacagatatgacgaatatcaccctagaggaacatagtgtttataaccaatttgaagaaaaagtgatttacagattgcttaagcattatctatcaaatctaaatggaatactttaaatcagctccatagaaaagcaacactgtgggatgnatttcc

SEQ ID NO: 486895 - DNA, 312 bp, Homo sapiens
gagacggaggaggatgtcttaatttcttgcagaggaacccacttaggtggcaccaaatcttgacttccagatggaatagtacatctatacaaggaaacagtgatggcatctatatcataaatctccagaggcactgggagaagcttctgctggcagctcgtgcaattgttgccattgaaaaccctgctgatgtcagtgttatatcctccaggaatactggccagagggctgtgctgaagttagctgcatgtcactggagccactctaattgctggccgcttcactcctggaaccttcaataaccagatccag

SEQ ID NO: 486896 - DNA, 385 bp, Homo sapiens
ccctcatgaatctcccgcatctcccacgatgccatcactatcagaccacattgtagaaagctcattactcgcttggactacatgtctggccgtgggacaagtgcatacatccaggtagggctttgagggccatttaaatcacaccaccttgctccaaggttgctggagaaaaccaatcctgactcccttagcccccaggaaaattctaaccatggagggagcgtttagtatgcggggctgggtgcataatttagctgctcttcccccgtaggggaccaccacattgtttactccctgggaactaccgggcacatttcaccgtgaagcacaatgcatctttgctattttcaggcagcatagcgtgtgtcactcactgtggggcagg

SEQ ID NO: 486897 - DNA, 197 bp, Homo sapiens
  misc_feature (184)..(185): n is a, c, g, or t
ctgaagcatcctaacagagacaggcaaactgtaaaccatggtgagaaattgacgacttcacactatggacagcttttcccaagatgtcaaaacaagactcctcatcatgataaggctcttacccccttttaatttgtcctttgcttaatgccctgcctctttcggcttgcgcaaaggatgatgnnctgtcgggtacc

SEQ ID NO: 486898 - DNA, 492 bp, Homo sapiens
gtttctccccgttgataggcatttaggttgattccatgtctgccattatgaatagtgctgcaatgaacacagacatacatgtgtctttatggtagaaagatttatattcctatgggtatatacccaataatggaattgctgggtcaaatggttgttctgtgttctttgagaaatctacagactgctctgcacaataacggaataatttacattcccaccaacaatatatgagcattccctcaccaacagtatataagcattccctgttttccacagcctcgccagcatttattttttgactttttaaataataaccattctgactagtataagatgatatctaattatggttttgatttccatttctctaatgaatagtgatgttaaacattctttcatatgcttgttgaccatgtgtttgtcttcttaaaaatgtgtctgttccggttgggctgtgctggctcgcgcctactatcccaacggggaagaacg

SEQ ID NO: 486899 - DNA, 154 bp, Homo sapiens
  misc_feature (88)..(88): n is a, c, g, or t
  misc_feature (112)..(112): n is a, c, g, or t
aggcactgacacattgaaaggaagcagagcaacaatgacacagcacggatgtgggaaaggggatcccccctttgtatgatgcaaatgntgaaatgtacaaaatcaaccatgncaacaaagaaaaagaccttgtacagcaaataaaaaaaaaaaa

SEQ ID NO: 486900 - DNA, 913 bp, Homo sapiens
gggatccgtctcgatctctgcctgggaggggcgccccggtggtgtgtgacatgttctccggccggtcgggccggcggtggggcgttcctgcgggtggacggctgggccctcggggtgtggcaccccgtgctcccgcctgcgccgcctcctccgcgtgcggtatcccagggttgtgtgtgtcgcaccaggtcttctgtttcccagcgcagctggggcggcggggccccttccaaggttccccggggaccatgggccaaccctgggagcgcacctttcattcggcatcaaagccgggacggggttgcagccgggaccttggtgggcacgaagaactcattcaaagggcgcttgccggaagccagaagggggaattccccgcgcttctgttgggccaattggaaaggtttccctccgggggcccttcttggaaagaaaacacctgggaagcagccagctaatctttgtgcctcttggaagagaacccggaacccgattctttccccttgggcgtgggtcgacagttaacatttggaaacctccaagggccaggttttgtggcacacattggtctggcgaaaggggcgcttggaacgtgttggtagaaaacaaggggccgaagttagttgcctttggggggaggaccccaataccaggacagaatttcaaagagccgcggacaccaattcggggggggaactttcgggcattacaggggttgggcaggaaacatccatttcatgggcaggtgacttcacagtacacaaggttgtgtgaaaacggacaattcacgcctatgtggttgaacgtcctgaagaaactggttggacatacaagttcttgggcatcactggacgggtcttacgacatacagagggggcccacagaagcaggcctcttcaaacggggtggtgtc

SEQ ID NO: 486901 - DNA, 192 bp, Homo sapiens
actggcggtctactagagaagaaatcattcctgagaaatccaaaagaaaaaaaaaaaagaggaatggtagctagtatcttctagcctattctttttggccacttttctttcttttttttttttttttttgtggaaacaaattgttccactctttggcccgggttccttcgggtgggcgggttacccgcgccc

SEQ ID NO: 486902 - DNA, 703 bp, Homo sapiens
ggtggtgtgtgggctgagggggccggggctgggagaagcccgatgggcggagagacgcgaacggggactttgattgaagcagttggcgcgaggcgcagagcgcgagaggacaccgcaggccctgcgcatcgctagacgcacaaagcctctggttcggcgcccagactgggtgcgcgccgacaacatgacgcgaggtgccgaggtgtgtgctcgctgggggtgtggactgactggagggcctccaatccttagttcctcatacttgcctgtaactgtgccctcggctggtgcaggcacgtgtctccgtgccgtttgcgccgctggcataacctggacggctatctggaagacctacttactgcacgggtacgctgtgactgccagcgactgtgtgtgttcatgttgggtcaactccagttcgcctgcactgatgctgttgatgccccgtgacctccagggtgtagagtaaagtagggccaggccagcggctctatgctgatccttgggaggtaggaggacagatgtgatggactactcgtgtgcccgatggaccacatgggcctttgagctagcgtgcgagaccattgcgaggtttgagagggggatcctgggcttgagattcacggctacctcctgttgtggcagcgtgtgcactgacgtacctaactctggtgtgtctgtctcccaccgtggcaggggagga

SEQ ID NO: 486903 - DNA, 211 bp, Homo sapiens
  misc_feature (47)..(47): n is a, c, g, or t
  misc_feature (145)..(145): n is a, c, g, or t
tactctagagatcgcggcggtgcatggtgtcgggggtgcagcatagngagatgggtagtggagtgagggagatggggtaagtgagtgagggaactggggcaggcacatcacatcctggctaggattcgtgtagtgcttcacgtgncatgtcacggacttgccggctaggcactgtgttgccggagtgcaatggctgctcgtggtgtacagg

SEQ ID NO: 486904 - DNA, 205 bp, Homo sapiens
ataagtgtagagggaaggttaatggttgatattgctagaggtggcgcttccaattaggtgcatgagtaggcttactagaagtgtgaaaacgtatgcttggattaagtgcgacagcgtatttctaaggatagtccagtagaatatagaacttgtgaagatagataagtgtagaagggaaggttaaatggttgatatatgctaggtt

SEQ ID NO: 486905 - DNA, 136 bp, Homo sapiens
gcttaaagggggggaaaccaaaaaaaaaatttggttttttaaaaggcccttttaagttttaaaaaccagggcccccccggggtaaaggccaaaaatttgaaagttatgggcccaaaattgtttaaatttcccccca

SEQ ID NO: 486906 - DNA, 334 bp, Homo sapiens
gagatggctttctattgcctgctcagtgagcacctaacttagtattagtatttggtagatgcctactaagcactgagtgaatgcatacatatcaggccattaagagctaaaaatacttttttttgagatggagcctcgctctgttgccaggctggagtgcagtggcacgatctcagctcactgcaacctccgccttccgggttcaagcaattctcctgcctcagcctcccgagtagctgggactacaggctcgtgccaccgcgcccagctaattttttgtatttttagtagagacagggtttcatcatgttagccagaatggtctcaatctcct

SEQ ID NO: 486907 - DNA, 181 bp, Homo sapiens
atacgattagccaaggtccacttggcccagcactaagaaaaagatgcgtagtttgcacagaaggggttgtgagtactgactcgtcaacagcaccagcagagttgggaacgtagcaagagcacatgttgttgcagtcagtcagagtgtcctcagagtggaaaagtcacgtcaagtagtacgg

SEQ ID NO: 486908 - DNA, 226 bp, Homo sapiens
tatcccgtgtagcgaatcgggggtatagctgttcgaattcataagaacaggcaggttagaaataaggtcttgcgtgacaaaatatgttgtgtaagtacaggcgaaagtgcctcatatgttgttcctacgaagattgtattgtttagggtgtatattattattatgttcgtgtttccggctattaagaatagggcgaccgggcctgcggcgtactcgatgttgatcc

SEQ ID NO: 486909 - DNA, 340 bp, Homo sapiens
tggtagagacaagatctcactatgttgcccaggctggtctcaaattgctgggctcaagggatcctgccgtcttggcctcctgaagtgctgagactacaggcgtgacgaccggagccagacattatcttacattcaatgaaacagtaactttctggtgctgatgctacagttaacttaatttttgttacctttctgcgacttaaaatgtttctttcaaagtaccaatgtaaactcccttggaaaggctatcctaccagattaaccagatatctatgttacttacataactccccagactcaagcttgacttaagcaaacaaacctttagttttgtttagtc

SEQ ID NO: 486910 - DNA, 551 bp, Homo sapiens
ggatctgcaacctgccgtcgaatcgacgagcatcgcacaacgcgtcgacacgatcgactggccaaccgtcgatgccgaactcgatcgctacggatgcgcgcacgtaccgggcctgatgccggcaagcgagtgcgatgccctcacgtcgctctatccacgggatgcgctctatcgttcacgcgtcgtgatggcgcggcacgggttcggacgcggcgaatacaagtatttcgcgtatccgctgcctgcgctcatcgccgagttgcgcgaaacgctctacccgcatctcgcaccgatcgcgaatcgctggaaccaggcactcggaatcgacgtccgctatccgaaagaccacacgacattcctcgatcgcctccatgcggcgggacagacgcgaccgacgccgctgatcctgcaatacggccccgacgactacaactgcctccatcaggatctctatggcgaacacgtgttcccgctccaggtcgcgatcctgctgtcggcgccgggccgcgatttcaccggaggggagttcgtgttgacggaacagcggccgc

SEQ ID NO: 486911 - DNA, 199 bp, Homo sapiens
acgctcatctagatggctgatcatccgcaagcctgtgacggtccattcccgggctcgatgccggaaaaacaccttgtgccgccgtgaagggcaggcacatgggcataggctagcggaagggtacagccaattgcccgaattgccacgagaaggtcacatggattagcgagaatgactgattttgtcgccggcttgctca

SEQ ID NO: 486912 - DNA, 378 bp, Homo sapiens
ggccgcacagcttctcggccgcctggagaataagtgtgtcactccctccctttttcctccttccccatgaaggtcaatgagaaactgtaaatagcaaggatgagggaaagtgaggaggccagggaggccattgcattcatctgtgttctaaaatatccaactcagccacatgcggtggctcacgcctgcaatcccagcactttgggaggccaagacagatggatcacgaggtcaggagattaagaccatcctggccaacatggtgaaaccccgtctctactaaaaatacaaaaaattagctgggcgtggtggggtgtgcctgtagtcccagctactcgggaggctgaggcaggagaatcgcttgaactaggaagttgg

SEQ ID NO: 486913 - DNA, 487 bp, Homo sapiens
cagaaggcatcagaggccatcgggggctccatcctggtcccctgcccgccaaaaaaatggccttaggaatgacccaggtgggtgggcatcctgcttgtaacattccccaagggccccagttggttgcccagaacttgggcttcagcctggccaacttgttgttgagcaaaggagccaaaaacatcctgggatgttgcccggcagcttaacaatgcccattaactggtttgtggggcccaaatgcctgggttgttgctgtccagtgcctacatcccgggcctcagtgccccattttccctgctatttggggagtgattaccccgggagattgaactgcagggttcaacccttccagggatttgcctccccttggggccttgatgactcccttgcccccccagtatgtggggggttcatttttttaaaaaagtccaagcaccaccctttgaatgtaaccaatcctactaataaaccagttttgaaggta

SEQ ID NO: 486914 - DNA, 737 bp, Homo sapiens
aacaaaacttagaagttcgtcctgcctgggcccatggcaataaatcaagagctcaaaattaaatccgtttgtggacctcaaacacccctgagggctgcaatgtagggtccagaaggattttgacccacagaaaggaagcccatggaacacaagttaaagaggttttgctggccaggtatgtggctcacgcctgtatcccagcacttgggaggctaaggtggcgggatcacctgatgtcaggagttcaagaccagcctggccagcatggtgaaaccccatctttactaaaaatacaaaaaactagccaggcgtggtggtgggcacctgtaatcccagctacttgggaggctgaggcaggagaatctcttgaacccaggaggcggaggttgcagtgagccgagatcgctccactgcactccagcccaggtgacagtgtgagactccatctcaaaaaaaaaaataagaggccgggtgcggtggctcaagcctgtaatcccagcactttgggaggccgaggcaggcagatcacgaggtcaggagatccagaccatcctggctaacacggtgaaaccccgtctctactaaaaatacaaaaaaattagtcgggcgtggtggcggacgcctgtattcacagctactcgggaggttgaggcaggagaatggggtgaacccgggaggaagagcttgcagtgagccgagatcgcgccactgcactccagcctgggtgacagagccag

SEQ ID NO: 486915 - DNA, 164 bp, Homo sapiens
gatttataggtcctagctgttcttgagtaacaccgtcgagaaagcgtatatactgaagagtgccttagttgacaggaggtggaagtcaggcggtatcttggctaagggaacaggtggtaaaagaaagcatgtaatgatattaggatgaccactcaagatgactg

SEQ ID NO: 486916 - DNA, 548 bp, Homo sapiens
gagaagacgtgcggagggagacgcagagacagaggagagtgccgggcatgccacccagtctcgggggagcacttagctcccccgccccggctcccaccctgtccggggggctcctgaagccctcaggcccaaccccgggtctccctcatggaagccacgcgtgtgccccagcgaggtagcaggagtgcaggtggacgtcggctgaatgcgcacggtgcgctcgtgggccttctgagtcccatcccgctcctagccggtgtccttaagggccgttctgagaacacgacacacccgtaccaaagcttatgactctggactctcatcacgttcagagcaccctagacacccgataaacctcgacataaagcactagcctacaccgcatgaaaattgcacgaaaccccctccctacaattcctcgcaaagtcaaatcccattgggaagacccagcatatactagtacactacaagaataatacttgaacattcagacattaccactaagaataccgaaatacatcacttgaatccttctagacactacacag

SEQ ID NO: 486917 - DNA, 218 bp, Homo sapiens
acatgaggcggcacacaataggcagcaacaactgtgtggaaagctggatgaactggtcagtagcggaacatgggaggtgacactgggtattaccatgagctcaaccttagattggatgagctcaatagaatacacagtgttcccaaacagagaggggcatagcccaaagcccctttctctgcaggcctccttaatgagaaaaaggcactcagagaaaa

SEQ ID NO: 486918 - DNA, 785 bp, Homo sapiens
  misc_feature (754)..(754): n is a, c, g, or t
ggcggccgcctttgcaaggttgctggacagatggaactggaagggcagccgtctgccgcccacgaacaccttctcaagcactttgagtgaccacggcttgcaagctggtggctggccccccgagtcccgggctctgaggcacggccgtcgacttaagcgttgcatcctgttacctggagaccctctgagctctcacctgctacttctgccgctgcttctgcacagagcccgggcgaggacccctccaggatgcaggtcccgaacagcaccggcccggacaacgcgacgctgcagatgctgcggaacccggcgatcgcggtggccctgcccgtggtgtactcgctggtggcggcggtcagcatcccgggcaacctcttctctctgtgggtgctgtgccggcgcatggggcccagatccccgtcggtcatcttcatgatcaacctgagcgtcacggacctgatgctggccagcgtgttgcctttccaaatctactaccattgcaaccgccaccactgggtattcggggtgctgctttgcaacgtggtgaccgtggccttttacgcaaacatgtattccagcatcctcaccatgacctgtatcagcgtggaggcttcctgggggtcctgtacccgctcagctccaagcgctggcgccgccgtcgttacgcggtggccgcgtgtgcagggacctggctgctgctcctgaacgccctgtccccgctggcgcgcaccgatctcactaaccggtgcaagcnctgggcatcaccactgcttcgacgtcctcaa

SEQ ID NO: 486919 - DNA, 842 bp, Homo sapiens
  misc_feature (84)..(84): n is a, c, g, or t
  misc_feature (811)..(811): n is a, c, g, or t
gagatgacagatcgcagctaagagcagcttgctgggtctccggaggctgctggtgtctgtctcagggtacggtgcaggcacagncagtgggatttttttcccagcagagcagagagctggccctccactcctgctcctgtgcggagctcactcccatagggcagccgcctctcgcccaggaggagggtcccccaggaccccctgcctagcttgacggctgctcagacaagcaccaccagaccagcatcacccaggacgtctgccctccctgcagccaccgttagcccgggcgaggacccctccaggatgcaggtcccgaacagcaccggcccggacaacgcgacgctgcagatgctgcggaacccggcgatcgcggtggccctgcccgtggtgtactcgctggtggcggcggtcagcatcccgggcaacctcttctctctgtgggtgctgtgccggcgcatggggcccagatccccgtcggtcatcttcatgatcaacctgagcgtcacggacctgatgctggccagcgtgttgcctttccaaatctactaccattgcaaccgccaccactgggtattcggggtgctgctttgcaacgtggtgaccgtggccttttacgcaaacatgtattccagcatcctcaccatgacctgtatcagcgtggaggcttcctgggggtcctgtacccgctcagctccaagcgctggcgccgccgtcgttacgcggtggccgcgtgtgcagggacctggctgctgctcctgaacgccctgtccccgctggcgcgcaccgatctcactaaccggtgcaagcnctgggcatcaccactgcttcgacgtcctcaa

SEQ ID NO: 486920 - DNA, 217 bp, Homo sapiens
gctcgacctagagattactgaaaaaataaatcacaaatcccaaatacatgaagattaaacaacatacttctaaataacacatgaattaaataagaaatctcaagacacatttaaaaatactttgaactaaatgaaaatggaaaacacagactgaaatttgtgggatgtatgaaagcaaagttacagggaaatttatagcattgaatgcatacattag

SEQ ID NO: 486921 - DNA, 216 bp, Homo sapiens
cgggaggatctcttgagaccaggagctcaagaccagcctaggcaacatagcaaaactccatctctacaaaaaaaaaaaaaaatttttttttaaaattacccagtctagggtgtcatgcaccgggggtccgggctactcaaaaagccagggcaagaggatggcgtgatcccaggagtccacggttgcagggagctatgatcaggacactgttctcaa

SEQ ID NO: 486922 - DNA, 409 bp, Homo sapiens
  misc_feature (362)..(362): n is a, c, g, or t
attcgacacaagggaatcatacagtatttgtccttttgtgactggtttcacttagcataaagtctttaagatgcatccatgtttccagtgtttcggtttttttagaaaaactcatacgtgattgcagccgggcatggtggctcacgcctgtaatcccagcacttgggaggccaaggcaggcggatcacctgaggtcaggagttaaagacgagcctgacaaacatggagaaaccccatctctactaaaaatacaaaattagctgggcgtggtggcacatgcctgtaatcccagctactcaggaggctgggacaggagaattggttgaacccaggaggcggaggttgcagtgagcccgagattntgccactgcactccagcctgggcaacaagagttgaaactctgtctca

SEQ ID NO: 486923 - DNA, 156 bp, Homo sapiens
cccattctggcaatttttctacataaaggcttcctaaccagcccaacccaacttaacattcctttttccttctcttaaggaggggcaatagtccttactggctataccatccggggtgcacttttttttaaactaccttaaactgaattatctttg

SEQ ID NO: 486924 - DNA, 176 bp, Homo sapiens
accagacgcttgcaggacaggcgccgccagtcaggggcttgcggccgaccctcccctcccactccccactgcgcgtactccagatatgccagtgcacgtataaggtcacttcgcgtcccgtggactccccttccctgacgtcgtcacgtggactggcgtgcggcttcctggagatc

SEQ ID NO: 486925 - DNA, 257 bp, Homo sapiens
agctcgtacccttatccgggagtgaggaggatattggggaaaacatcaaagaggtgggacaagcgttggatttgtgttctagtcccccagatccagtggcttattgtggctcttaggtattaagttccacctctgtgggcttcagtttgctctactctaaaacagaaggtgaggactaaatgtgtcttctactgtctttcagtctgtaacaatacacgtattctaatggacgaatgccaagaactagggaaggtgag

SEQ ID NO: 486926 - DNA, 1703 bp, Homo sapiens
  misc_feature (845)..(845): n is a, c, g, or t
cccacgcgtccggcatttaccatctcacttctaggaatactagatatatcagctcaccacctcatatcctccctatctatgcctaggaagcgaagtaaatactagtcagctggtccgagtgtatagactactgctcatatacccctcaactacgccgatctcccatcgttgatgccagagtagtagatgctctagtgtgctcaatagcatatgtcgtgttagcacgctcctgcgaggccatgcgaggatgggacctaggcacctacctacgctctcaactcttaccgaagacatattagagcactaagacttacagtaacactacaccttagagactctagcttcgcaactgcttacgagagcgataaatcgtcccagagctaaattatgatttcactcactcacgtgcacgatgtgagctgttaccaacagaggtacgacaaataagtaatgagaattcatagcacgcaagccgacctacacagattctgaacctattagagagcattcagtccgctctcactaatgttgatggaagccacatgtcaaagcgaaccaacgcgatgagtgcaagagctgcttcccgcccagagactaagggaccatcacgaacaccgcgcgtaaagcagaaccgccacaatcgcgttagatcacgtaacaccataggctggagctcccagtacgcgccaatcacgaaacacaattgcgccgaaaggagcagatcgccacaggcgttcaatgccacagcatgcaaaacgagcttaagtcaatcggtcaccaagatggaacttccttagaccgtgccatcgttactcatcgttaccatacgtccacacgttaggganacacaacgttcccatattcaagctgcgcgtaagcacggtacccgaccacggcaaccaacggagaagggctatcaactcgacaatcaacttcagtggacatacctccaattgtcatatcccgaataacagagccaagacaacaatgtccaatttgccgcgcatacaacctattttggagcattatctcaccattgcaacccgctgtgaatgatgaacgtgggcaaatgacgctacgccacacagtgactattcggacccagttggtactaacgtgcctatgtgacaacatactttacacctattatactacatatctcatccttaccaaggacactatatggatagaggtcatccacggagtatcaccccctttacatctccattcctgcccaacgcttataactctctaaccaccgctaaacataggaacaccgccctaatgaatactacatttaaaacagcaacattctctatgactaactccaacctagtctaacatgtaccccccaagaaaacattatcaccagaccttcaggaagcgtccgacccccaccggttcacaacatggacactactaggtctttaacaagacacgctgcgtcaccctgaaacaggggccactgggttcgagatacaccacattatggagacactacatacacaccaccgattagaacccgacccagggcggggccataaaacaaactgcgcagggaatatcacacaacagcggggcatacaagaaagcgccaacagaagtaactacccacgacagtagcctaacgacacctgataaacaaagacgatctagaaagccattggtcgacacactacaacctactaaccgcaccgaacaca

SEQ ID NO: 486927 - DNA, 718 bp, Homo sapiens
  misc_feature (124)..(124): n is a, c, g, or t
ttacatatcgatgacgatgacaagtcaggctttgattagagatggagacgagagaagatgcaatggcaatggttgaccatagtcggaaaataagctccgttagtgattccaagggggagatgtngatgaaagtcgaccctgttctgtacgaacatcataacagaaactgggcttcgtgcaggactatccaaacggacgaggcatagatgttacatgaagaacaagcactattgtccacggaagaagtatcttactcttcgcaagatggcaatggaatctccgaaggatgataatcaactccaaaacgtgatggtgtccgcaggaatgactagagtaggttctaaacagaaggtaagaggaacaatggagagagaagtccggtgaagatggtgatgaatagcacttcaataggatgacacagaccagagcaggaatctaatatgcttctttgaatctgaaagtatgagctactgtgtatcatggaagaatgaagctagtcagcatctgctagaaagtggcaagttcagtgggagcacgtaggaccgactgctttgctaagtctataggtagactgttggcttctgcatgggaataacagtgctaccatcagataagtgctgtgaaaacatcgcatgggaacgtgcttccggagccatgctagagaaaagggtttaccaaacggtgtgacaagatcgaggaactctgatcaacgaaaaac

SEQ ID NO: 486928 - DNA, 145 bp, Homo sapiens
tttatcctctggagcctggtggtgatgattatctggagtcgcacacacgcgtgagaagtaagtgcatctcaggaaagtgttccaactggagccaggacgctgtcttcagagaagaaaagagacacagccaaccctgtagttggag

SEQ ID NO: 486929 - DNA, 802 bp, Homo sapiens
  misc_feature (748)..(748): n is a, c, g, or t
  misc_feature (802)..(802): n is a, c, g, or t
gctcacgtcatcgacctctcgatccgatccatacgatctccgatggactgaagaatgcggactcgatcgtgtggctgccttgtctgattctcgacagagtcagccactgggactattccatagccctactgctgctagtcagcgcagatgggcttcagagcgccatgtgtatccatcaatcgctcccatatgcacctcgtgagacgtgaacatttatgcgacgtgaactcgagtcctgactaacccttgcaacggcccagaatggccgtcgcgtcatagtatctctgtgtgatgctggcactgcgttgctctaacagcagtcggtgcgaggcctagtattagcggtactcgatgttcgtctactgcagtaacatgcgtgggagacaacgagtccgtgtcattgtaatccatcgcctgtctttgcaaagcgtactagggccaaacacgaaccttctcattaagggtcctaatgatcatgtccccaggtgcatggcccgagagaatagtcgaatattcgtggaagtgcggtcgcaaccaagctagaatttaacaaatagcatttagcgtagtcgcgcgcattcgccgaatagcgattggggaacagaccctagttcgaatgaatctgagggaggctactcaagtaagacgagtccgcagccgcgtcacagcgagttctttacgctttcacttcagtcttgcccttcattattgcaggccctagcagcactccagcctcctattcttgcancgaaacggggattcaaacaagcccctaggaatcacctcccattccgataaagtn

SEQ ID NO: 486930 - DNA, 201 bp, Homo sapiens
agccggaccgacgtatcgccaaaccacgccgggtactttttgtgttcagtagagatggggttcaccatgtaagccaggatggtctgatctcctgacctcatgatccgcccatcttggctcccaaagtgctgagattacaggtgtgagccaccacgcctggtcgtctggctcattttcttactttttgtagtgttggggata

SEQ ID NO: 486931 - DNA, 243 bp, Homo sapiens
  misc_feature (19)..(19): n is a, c, g, or t
  misc_feature (60)..(60): n is a, c, g, or t
ggagaaggtacgcatagcngctaaattcatcactcatgcacccccagggaatttaatgangtattcaatgacggtcggctactacttaataatgacaatcttctcaggggaggggcagcacatgcctttgcccagtataacatggagcagtgtcacgcgtgtgaagatagaaggatatgtagatcaggtcttaattacagagcgcggtgacctcggtgatagcagattttagatccaagaaac

SEQ ID NO: 486932 - DNA, 555 bp, Homo sapiens
tcctgaagaagcttagactgggatagacacacaattaggagttattagaccaaatggtggtctaagcccagtggaaagaatgcagctgttatgagtaattcccaccataaatcttagacactttgcaaaaagaaatctaagaccagatttgactggcttatctgccaaaatatggacagtttttgacaatgcagatgagtctgttaaaaatagttgaaaactggtttaggtagcatttttggtagcccgaatgatggacaaaccatgcagatgtggagtttgagcctggttgagtggtgtgtcctgaaagcctgcttgtttttctaacccataacaaaatgcatctgaacctctacagtctgcaaatgtgggctgggaattttgcacaaacagtccctctcctgagatttatggcacttcctaattcctagggaggccagagctaccacaagaagtgccattctcgcaatactttgaacttctggcttctccctccggcgaaaatctttgagcacgggaacactcaggttgtcctcaacgctgccacgtttctgt

SEQ ID NO: 486933 - DNA, 269 bp, Homo sapiens
ggccagagtaatcactcccagtccacaactgactgactagggtggaactgactcaatccaagccgaatcaggtctccctgaggtctctgcctatggctacaccgaggagaattgcttgaacctgggaggtggaagttgcagtgagctggagattgcaccactgcactccagactgggagacagagcgggactctgtctaaaaaaaaaaagcttctttttcaattatacaggttctgattgaacctaatttgtcaaacgaaaaattgaaa

SEQ ID NO: 486934 - DNA, 1248 bp, Homo sapiens
ttctggcgccgagaagaccagcaggttatcgatgcatacacttacccggtaatcacgtgccaaactgggcacagtgagaagacatccatatcaggcagttgttacgtacaatagtgaacacgctagagtgtcgcggcacacgctccaacgcagcatgagctggtgcaagtctggagtactactagaactagcggaggtcagtcggaacataaatggaacgcatttcgcatgcaaatccttcctgacgacacgtgaggcggtgcgtggacgatgaggcagtacggggcctgcctatcacgagttaatgccgttgggtgatcgttagcgcattgaacatcctagaacaaccgccgtgaaggcagatgcaaacggttggcggtaagtactaactcaatagggaaactacttcggtgcccattttggttggggcccacacttttgccgaacacaaccccttaagtcgcaaaaggctaaaccgtaaactttggctaggaacgatacattccatttggggccataggcgcccaccaacgggaggcaagtcacagtaggaagcccattccttgttctaccatcaaaaggaccagatggcgacctcctacgcctgccgtggccacccaaggttcctttccaaggggtgcttggccagccttcttggccaatggctctcgctgcaaaattggggctcaagggcctggccgcttgtgcctaggattacgaggcgtcgctaacaattcacctggaataacgccttagggggattacttccaatcactcaacacagtaaaggtaggcggcgcaatggaatcggctcctgtccgtaaaagccaccttggtccccccttacttgtggggcgcgttagtaacaatcaaacctttggcgggttggcttggaaacacccatagcccataaccctaacggtacccgcacctggcatctaaacccactctacaccttgggcaccttcatccaacctatggtaggaccactataccccctttttaaccaaggttctccgaacaggaacgcacttactttggaccgtgggacaaccttttgcgtccacccacgcgggcacagcatcccaagtaccacctttgataaccccatatttacacgcaacacacacccattcggggccattataccaatctcccccatgaaaccctaccaatgaataaagacagatattttatgggttggcgcgacaatgcaattaccctggggcatatgggacacacactggg

SEQ ID NO: 486935 - DNA, 516 bp, Homo sapiens
  misc_feature (238)..(238): n is a, c, g, or t
  misc_feature (294)..(294): n is a, c, g, or t
  misc_feature (304)..(304): n is a, c, g, or t
  misc_feature (329)..(329): n is a, c, g, or t
  misc_feature (388)..(388): n is a, c, g, or t
  misc_feature (393)..(393): n is a, c, g, or t
  misc_feature (422)..(422): n is a, c, g, or t
  misc_feature (462)..(462): n is a, c, g, or t
  misc_feature (513)..(513): n is a, c, g, or t
cactctagcctgggcaacagagtgagactccgtctcaaaaaaaaaaaaaaaagaagaagaaacaaaagtttttaaaaacaaaccaggcatggtgacatgcacctgtagtcccagctactcatgaggctgaggtggggggatcacttgaacctaggaggtcgaggctgcagtgagccaagatcataccactgtactccaacctgggtgacagagtgagaccctgactcaaaaagagtanttctgtagtgaaaccattaatatctacagcaataataaagactaaacatagcttcnttcagttacnttttaccctatgagttgtggcaccntacagcaaaataaaacaaaacttagggttttttagattctgaaggccgcagggcttatngctcngcctgcatcccagcactctggaaggccangtgggtagactgctgagcccaagggttcagaccacctggncaacaggtgccttgtctctacgtactagcgggtgtgtggcatgtgccgttnccc

SEQ ID NO: 486936 - DNA, 164 bp, Homo sapiens
tctataaaggaaccaattaacaggcacatattggacaccagtgtgtttgacactgtgccctactgcgtatccctgctgttcttctacaggagctctaccattctatttacggggcagatcagaataaaacacagttctactttgaacgcttgtgagtatacgtg

SEQ ID NO: 486937 - DNA, 163 bp, Homo sapiens
ataattctgggaagaggttgtaactgtgggcacactgtcaacgaagtgcttgaaccaacctacgtgatgactcgtgctttgacccctacacagtttcccattatgcctgttggagatgagtgggaacgaatgtctgaatcagtgctttaaactgttgtgctgt

SEQ ID NO: 486938 - DNA, 132 bp, Homo sapiens
  misc_feature (32)..(32): n is a, c, g, or t
acacgaacgctttactggttgttaggcacatntgtaatttactctctctacaggttttctagtgtcaagagctgtcctctttggctaacagttacattaccaggggattagacgggtctgtgggcaatttaa

SEQ ID NO: 486939 - DNA, 761 bp, Homo sapiens
gagcgggtggggggctcggaagatggctgcggagccgagcaccgggcagtggctgcagtgcggcgtgcggcggcggcgggccgtgagcgctggcgggcggggtgctccgcccttgcggacgtggggcgctgagcccgagaggcgcggaggcggcgagggcgcgggggctctgaggaccgctcgggcgcccggactcctggcacaccatgggccagccgcagagggacgcagtccaaagagcaaaactgcgtgtggaaaccgtgacgaaagggatgcgtgacatgctcaactcagtggcaggcagggctatacacccaaggaaaggttctaggtgcagtgaccgaacaaagcagccaagcaattcatttggctgacactgctagcgttgcaacaggacgggcaattgcccgtccatttgacagttccacgcctggacgaactgccaatggaccgaccatgggcactcatccctggacggcagcacgaacaaaggaactgggcaatgcgccggtggtagcgaagcaaacgggagtgaggcaaacgaacggatgaccccaagttggccggcgcgcagaagcagtagtatggcccacaacgggatagccgggaaggcgttgcacaagcaaagccaaaggccagcagggggcaagagaaagaccccgtcaaaggggatcaacacgcggaaaggaccccatgcgggaagaagaagggtacatcatgacacagaaggcgaacgggccccagggcccttctacccactc

SEQ ID NO: 486940 - DNA, 229 bp, Homo sapiens
aggaagcaaacgttctcacggccatctgtgacatggtagcctggctaggctacacaccttacaaagtcacatatgcgtctgactattttgaccagctatatgcgtgggctgtggagccatcagcatggctaattcaatggcagaggcacccgcgagttagaggcacccgcgatgatagaaggcacccgtgaggtagaaggcaccgaggtagaggcacccgggaggtaga

SEQ ID NO: 486941 - DNA, 301 bp, Homo sapiens
agaatgtggtgttcggtggtttcatcactgtgtgaacctcagtgttcagacaaatctagatggtatagcctactacacacatgggctctatggtatagtctattgctcttaggctacaaacctgtatagcatgtactatagtactgaatactgtaggcagttataacacaaaggtaagtatttgtgcatctaaacataggacaggtacagtaagaatacagcacaaaagataaaaaaatggtatgccatttttatggcatagctcctgctttcgagtgagtcagtgagtgagtggtgagta

SEQ ID NO: 486942 - DNA, 490 bp, Homo sapiens
  misc_feature (81)..(81): n is a, c, g, or t
agtttctaacactccaatgctaactttttggatgtatttctttctagcatgtagaaagggcttttcctggcagccaagaanagccctttcttggctgccaggaagtagggagcagggatgtggcatggtgatgatctgaggacagccaggcatatgctcagacactttggaaaactggggagggggagcagggagacagaatcttcatcttcttccttttgtgaactggggaggagggtgcttggtgacattttcctgagtataaagaaggaatacaggtttgaaaggtttgtaattgtatatgaaaacaggtattgaaaaccaatactgggggaaaaaaggcattgtaaacacttctatttaaaatgaagatttctggaacaactatactatatagtggtatcacaagtctttagctggcaagatctagcactgaaacaactcttaatttttaacttgtgagggttctttttaaagcaccacttaagac

SEQ ID NO: 486943 - DNA, 1030 bp, Homo sapiens
aactaggctaggagaggcgggtggtgaatcggccgagggatgcatgatgtagaacatcatctcgggtccgacgtgcccttggttggcaatgccccagtcctagagacttgtcctgacagtgccgcacggcctacttttgatctctcagagcaggtggctccatccccagactagacctggctgctctccgaggccctccactgctccccttattgccccattcttgtggcttgccggggcacttggctcccttcttggccggtgactgcgttccatcatctcgcccgactccccaagggccaactgcttctcactcaggcgtggtgtcattctcaggaggaccagagccgtgcgtgagcctttatttacttttcagtaaacactggtgccgtttttagtccttacttcgagatactatatatgaatatctaagtgtaaaatgagaccttttcgtacggagctgtagagtatcgctttacagagctcagctaaatcaggcttcaccaatcttgagctctgtggtctcctcaccctgtctgcatggaagacctggctggacgctctcgggagagcagacatagcaccagaagccagtgggagaagtgtgcgatccgtgtctgggccacagtagtattcactgtgtagtcttagagttccgtaagcagtctcttcatacatgtcttacagtctggagtgtactgactgaatctgtgtaagccaatgagaatacgccatccttggaggtaggccgtcccaggcgtcctttgattgccctccagggatagattctcaatccaaattgcctctaccgtccgcagggaccgcgatcgtttcccctcacggtgggccggggcggtgcaggtgggtacacgaagacgggtccccggagagggccggacacggggaccaaaccaagaggggaggggggcgtactaaaaaggaccttcaaaggccgaagggaattgacacaaaaccaccgggcgccgcgagggcccaaccaagcttccccgcgcggaagccgccgcctcgc

SEQ ID NO: 486944 - DNA, 119 bp, Homo sapiens
ccacgcgtctgcggacgcgtgggccgggctgtcatggggacccccaacaatctgacccccaccaactgcagctggtgtgcccatctccgcgctggagagcgatgcgtgccaatgccagc

SEQ ID NO: 486945 - DNA, 859 bp, Homo sapiens
ttggaggtgaccgggggctgcatggaggtgaagccgcatggggacttggtgtctgccatcagggctggtgggaacgaccaccaagtctgcctggtggtggactgtgcaaactgacgagttcttcaagaaatgcagagtgatccgcatctctaggcagcgacctgaatggtcccctgcctgtgcccttcaccaatggggtagtatacagcaaaggagcacacagtcgtgaagcccttggcagaggcaggccttggagagccccaggccagtcctggtgagatccggcctccagtgacatcagcgaggagctgaattcccagagacgagcccccaaaacaggactccactagctgccctcgtcgtacctcctccgtccgatcccatcctagacttcaacatctccctgtgccatggtcaaagagagggccgcagcatgaaacgcagcagcaaacgggccccgcagatggactgcgagcaatgaaagacgaactcttcgaggaacctctgagcgccgtggtgcacccagtgactgggagggcgatgccagctattcgcacccacgttatttccttcttccccaattactcccctggatcggtgtcaagttcgagcaccccatagtcccctttcttgacaaatggatttttctagagaactatgttcttccctgactttagcggaacggtgaatgtgttcccggtcgtcgccgcaaggcgggcaggggactcctgcctccgcgtcctccctccgtgggtgcttatccttgcgggtgtccctttggcggctgccttggacttcgctggactggcccgcccgggtctcgggcccgggagagggggctccttgcgccctgtggatg

SEQ ID NO: 486946 - DNA, 215 bp, Homo sapiens
caggccggaaccgcggatcgagaacttcacgccttcattattcgccgccttggcatagacgccggcctggtacttgaacacgtcttcgttggtgctgacgcgcccctgttgcacgctgctcatatcgatgaaattggtgccaccgggcacgctcttgagctgcgcctgggccacctcgccagcgctggcttcgctgctggagacctcgaccgggg

SEQ ID NO: 486947 - DNA, 294 bp, Homo sapiens
cctcggccggatgagcggctcaatcaacataaactggatcctgggggctgctgagaccacaggaaaacagtggggagcttgctggagctgcatggtttggagatactggaagaaaggtgtacaacctacaggttctgtctcgggggagagaaagaggagtgaagggtgcacttggcctcttggctcatcggggctgcccaagggtaatggtttaaaattttgagacctatttctcagttagttccaggaggttgaaccacctctctgtctcaccacagccttagaccgctctta

SEQ ID NO: 486948 - DNA, 181 bp, Homo sapiens
gaagccaagaccaaaaaaaaaaaaaaaaatggacataggacttgaatagacattccaaagagtggcaggtgccaacaagcacatgaaaagatgatcagcatcatgaatcgttagagaagtgcaaattgaatctgcagtgagatccctcttcatggccagtaggacagccatttcctaaaaa

SEQ ID NO: 486949 - DNA, 218 bp, Homo sapiens
catgaaagtggtgaatgttagaaggtgaactccacggatagcaattcaggatggagtaacacgtctctcgtgctgtcagacctatctctttgtgaatcaacatggaaggtaacctttaagcaaagatttgaaggagaagaagacatgagttatgaagctatgagtgggaggagggatgcaggcagataccatcctagtgcagacaaggtagagccgag

SEQ ID NO: 486950 - DNA, 836 bp, Homo sapiens
aaaaaaaaagtatagtaccataagaccatttttaccattttaagggtacacaatttggtgactttaagtacattcacagttctggtaaaaatcaacattatccattggccagaatgttttcatcatcccaaatagaaaccatactcattagcattcctggtctccccttcctcaagccccggtgtaacttctggtctaccttctggtatcgaactacctcatgaatgggaatcacaatattggtccttaggggtctgggcctacttcacttagcataacggtttccaaagtcatctatgtggtagtaatgtatcacaagtttaattcactggttaaagctgtataatatcccccggtgtatgttaaccaaaattttatttacgccgtccactctgtggacactgagggtggtagacaccttttggccgttgtgaacatgcttctgtgatcatggtggtcacagggtatctatcggagtcattgcttcaagcaaataggggggtaaataatctcaccagttggaacttgactggggtcaatagattgaattatccacagttgtgaactctggggggaaaccataaaactgtattctcccacaggtggtggtacccatttaccactttgtctacaagcaaatatggaaacgagttcccacattccgtgaaaaggtccttttatccaagcactttacctgttgtaaaaaattgtcctccactcttttcaccgtgttgtgagtcatgtcacgcatggattgagatgcgatagatagttatgcacacacattacattgtttgatgacagcactgttgcacctggtcatagtatactacagc

SEQ ID NO: 486951 - DNA, 248 bp, Homo sapiens
gcaaaaaacctttggtaggtaaaaaaagaaaaaaggctcctgttggggttaaaaaacaaaaaaaacccctggggggaaaaaaggccgccggttcccaaaaacccgccccctaaaaaaagcccgcaaaaaaaaaacccccccccaaggaaaaaaagcccgcggcaaaaacttttaaatttggtttttcccaaaagggccaatccttttgggcagcttttttttaataaaaccccgtttttcccggccca

SEQ ID NO: 486952 - DNA, 630 bp, Homo sapiens
tgagacgttgtttgactaatactgggtatgtacactacaagtatgggaaatagtataaagttgattaaaggttaccttctgataatttaggccatacgtattataattgggagaactatcccccgaaaaaaaaacccccttaaaccccgagtaattactaaatagtgagtagaagagattaaaaggaaaacttggctagtccatagtcgccgcgtggtgtttcaccacccgattgccagctagttcacagaattgtttcttctcccactccccctgcttcacttgactacgccctttaaaaaaaaatatataaattaaccatttaatcaggaataagtccaggaaaggaggaataaagaaagaaagataaaatagggcccaatacgccaatgaccagatgatacactgtaaccctccacccatattaataactgttaaatatgagtagccttaaatattcccatccaaaggccgagattgtcatactagattggggaaaaaaaaagacctaggctggtgccatggctcacccctgtagtcccagccctttgggaggccgaggtgggtggatcacttgaggtcaggacttcaggaccaccctgacccacctggccaaacctgtctctacta

SEQ ID NO: 486953 - DNA, 1661 bp, Homo sapiens
  misc_feature (1020)..(1021): n is a, c, g, or t
  misc_feature (1030)..(1030): n is a, c, g, or t
  misc_feature (1038)..(1038): n is a, c, g, or t
  misc_feature (1044)..(1044): n is a, c, g, or t
  misc_feature (1046)..(1046): n is a, c, g, or t
  misc_feature (1052)..(1052): n is a, c, g, or t
  misc_feature (1055)..(1055): n is a, c, g, or t
  misc_feature (1087)..(1087): n is a, c, g, or t
  misc_feature (1092)..(1092): n is a, c, g, or t
  misc_feature (1094)..(1094): n is a, c, g, or t
  misc_feature (1099)..(1099): n is a, c, g, or t
  misc_feature (1101)..(1101): n is a, c, g, or t
  misc_feature (1103)..(1103): n is a, c, g, or t
  misc_feature (1106)..(1106): n is a, c, g, or t
  misc_feature (1117)..(1118): n is a, c, g, or t
  misc_feature (1123)..(1123): n is a, c, g, or t
  misc_feature (1169)..(1170): n is a, c, g, or t
  misc_feature (1172)..(1173): n is a, c, g, or t
  misc_feature (1177)..(1177): n is a, c, g, or t
  misc_feature (1185)..(1185): n is a, c, g, or t
  misc_feature (1210)..(1210): n is a, c, g, or t
  misc_feature (1220)..(1220): n is a, c, g, or t
  misc_feature (1249)..(1249): n is a, c, g, or t
  misc_feature (1253)..(1253): n is a, c, g, or t
  misc_feature (1257)..(1258): n is a, c, g, or t
  misc_feature (1268)..(1268): n is a, c, g, or t
  misc_feature (1270)..(1270): n is a, c, g, or t
  misc_feature (1277)..(1278): n is a, c, g, or t
  misc_feature (1307)..(1307): n is a, c, g, or t
  misc_feature (1310)..(1310): n is a, c, g, or t
  misc_feature (1333)..(1333): n is a, c, g, or t
  misc_feature (1341)..(1341): n is a, c, g, or t
  misc_feature (1552)..(1552): n is a, c, g, or t
  misc_feature (1569)..(1569): n is a, c, g, or t
  misc_feature (1615)..(1615): n is a, c, g, or t
aatcaatcacggtcgttagtgtgttgtgctgacgcaccaacatcagccgtgtgtgattaaagacacggtgttggtccccctattagcctgtcgaggcgcccacccagtgggtttgcccaagagagcgcggttgttttatccgtccgccgccctcgttatctttattcccggtctccttaagggatgccaggcgcccttgggtgtgccaaatatttccggacaccaaggggcgtggagcaccaaagcacagccattgggcgggtgtgggccaaaagacaacacagcgcgctctttttccagaataggcgcgcgcccatagaagggggagagagccacaacaagaaggaaaaaagtgggggtggagagccaccacacgtgtgttctaaaggaaaaaaagaatttggggtatatgagatgggggaaagaacccaccccgtcgcggtaattggcttccacagaaattgatgaggaaattatttttggggagaaaggcaccccgctgtttggtgctacaccccagggggcgccccaacaagggagacccccccaaaatggtcgcgcaatccgctgaagtggggtccttcaacaaagggggttcttctctgttgtgttttggaaaagatgggaggagtttctctttgccggtggaaatgtttcgcccaaagagaattggagttggagagagtgtcgcgcaatttgttatagagagaaagatttcctccaagagcgcttggagattttatcctttggagaagaaagaatgtgtctcacaaagggggttattaaaaaaacctctgcgcgcgcttggagcagtagaacacgtgttccccacaactggcgccccaattgggagatcttctttgtaccaccccgtgggcgacccacaaaataggagggtgtgccccccataggggtgcccacacacaaatatatgcgccacgacaaccacatagggatattggaaagactccctcacaccgtgtggaataaggtcgccacaggagcatttaccacccgcannaggggtgtnacatctgngctctntnccgtgnctntgtgtgctctgtgtttgtgggggtgttttacncttananaaaancncnccncacccacactnntctanagagatactcccggagaagagcctctctcttatatgcgctcaacgnncnncccnacacacgngggtctccgcgccacatatctccgngagaagaganagagatgagagtgtgagaatatctacttngagncccnnagagagaggngntcacagnncacacaatgagacttgtagaaagagaagntgngctcacacataaaatgtgagatntccacgancacgccacattgtgagaaaagaacacatatgagaaaagggcttgcccacacatctatatttatatcctctcccactagaagttcttcgcttatgagaaaagtataaaaatgtctcgagaagaagccccacaggtttgagaattgggaaagctcactggaggcttcactggtgaaaggcacgtagtttctgggaaaagcccctcggggaacnaagacccggtgctaaanttggacgagctgatggatatgaaccccccgtcccagaatctgtttnaagttccagacttccaatagtggccaattaaaagtgctatttgtga

SEQ ID NO: 486954 - DNA, 291 bp, Homo sapiens
agactgcttagtatgctaatgtgaacacaaaatatctgagacaggtctcagtcaatttaggaaagtttattttaccaaagttaaagatgcacccatgacacagcctcaggaagtcctgagacatgtgccccacggtggttgggggtacagtttgcttttatgtatttcagggagacatgagacatcaatcaatatgtgtaagatgtacattggtttagtccagtaagggcagcaacaacttcaaagtggggggtttccacgttaggacataggatagggagacaaaaggtg

SEQ ID NO: 486955 - DNA, 787 bp, Homo sapiens
  misc_feature (3)..(3): n is a, c, g, or t
  misc_feature (87)..(87): n is a, c, g, or t
  misc_feature (106)..(106): n is a, c, g, or t
  misc_feature (138)..(138): n is a, c, g, or t
  misc_feature (146)..(146): n is a, c, g, or t
  misc_feature (270)..(270): n is a, c, g, or t
  misc_feature (275)..(275): n is a, c, g, or t
  misc_feature (284)..(284): n is a, c, g, or t
  misc_feature (357)..(357): n is a, c, g, or t
  misc_feature (424)..(424): n is a, c, g, or t
  misc_feature (711)..(711): n is a, c, g, or t
  misc_feature (720)..(720): n is a, c, g, or t
  misc_feature (724)..(724): n is a, c, g, or t
tgnctcccattttcattttagccattttgtcgcctgcacccactcccttcatacaatctagtcagaatagcagttctagagcacagnttctcagtctaagctatgnaaaagctccccttatccaacagagtttaaaantagtgacntgggtttttgcgagtgctttgtttactaaggactttggggaggaaccatgctaagccatgaccagtgaggagaagcaacagagcctgtctgcccccatgagcggagtctgccctctgctcctcngcagncaggtcacngcctactgcctgggggctctagtcatcccagtggaagacgaatgtaacctgcgtggtgatgtgacaactgttncccccctgaccccagaggatctggctctaggttgggatcaatcctgaatttcgttatgtgttaattnacttttattaaaaaagtatagtatatataatacaaaacaataacccttctggggtttcttgtggcggttgaaatagtcccacatgtggtcatcagaaaataagccattcctcataccaatataggatcagctccttgacctctgaggggcaggagtgcttcctggtgtgtgtattagaatcccttcctgccttgtttcatggcagtgaaatgcctcttggtcctgtccaagtgtatctttcactgatttctgaatcatgttctagttgcttgaccctgccacatggntaccagtgngcantctgagcataactgtactaaatcctttttccatatcagtataataaaggagtgatgtgcaata

SEQ ID NO: 486956 - DNA, 152 bp, Homo sapiens
aggtatgttgaggctgcatgagtcgtgattgcaccactgcgctccagcctgggtggaatgccagagtgacaccgtgagacagcgggagtgggtgagcgtagcatttctttatatataattttatttatataggacaaccagggagacccatt

SEQ ID NO: 486957 - DNA, 307 bp, Homo sapiens
cagaggttgaggtggaggatcctttgagcctggaggtggaggctgcagtagccatgctcatgccactgcattccagcctgggtgacaaagcaagaccttctctcaaaaaggggtggggaggacagttatggtatcaggtaataaaggagagagagatggcatcctgagctcagttgagggttaaacgaaagcagagaaactagccaccacacgagagagcatgtgtacacttgtagatttttggtgagagatatcgcatttctttgtttctcagaggaactcatagctagagtcagagaaaagagtt

SEQ ID NO: 486958 - DNA, 146 bp, Homo sapiens
ggtcgatctctgcaggatcccttatttaccttcttattggtacaggtcgtgacacagctacaaatcacagggcatagaatataagcccactccactatctccgtcccctcctagcaccaataggaggatttaatacagaacaaaca

SEQ ID NO: 486959 - DNA, 348 bp, Homo sapiens
  misc_feature (283)..(283): n is a, c, g, or t
agagggagcggcggaggccctagtgcttttgcttgacctggcgaagtaggagccctcgaatgcgacccggcttcactagaagtaacccttgcagatgaagatttcttcttaggcgacttgggagacttggctggaattatcaataggggcttaggaggatggggatgaatatgagaatattaatatatatagggcgagctgcttttatcgggcttggagagcgatcgggggaggagagctaacgcggggcggccgagatcctggactcataggggcctaatantttattttggcatttatggtgaggcctctgactcaggacgaacaaatcagggctctgctgaagga

SEQ ID NO: 486960 - DNA, 986 bp, Homo sapiens
  misc_feature (38)..(39): n is a, c, g, or t
  misc_feature (46)..(46): n is a, c, g, or t
  misc_feature (60)..(60): n is a, c, g, or t
  misc_feature (64)..(64): n is a, c, g, or t
  misc_feature (68)..(68): n is a, c, g, or t
  misc_feature (100)..(100): n is a, c, g, or t
  misc_feature (113)..(113): n is a, c, g, or t
  misc_feature (122)..(122): n is a, c, g, or t
  misc_feature (129)..(129): n is a, c, g, or t
  misc_feature (164)..(164): n is a, c, g, or t
  misc_feature (171)..(171): n is a, c, g, or t
  misc_feature (174)..(174): n is a, c, g, or t
  misc_feature (189)..(189): n is a, c, g, or t
  misc_feature (198)..(198): n is a, c, g, or t
  misc_feature (203)..(203): n is a, c, g, or t
  misc_feature (210)..(210): n is a, c, g, or t
  misc_feature (214)..(214): n is a, c, g, or t
  misc_feature (217)..(217): n is a, c, g, or t
  misc_feature (222)..(222): n is a, c, g, or t
  misc_feature (232)..(232): n is a, c, g, or t
  misc_feature (240)..(240): n is a, c, g, or t
  misc_feature (249)..(249): n is a, c, g, or t
  misc_feature (264)..(267): n is a, c, g, or t
  misc_feature (269)..(269): n is a, c, g, or t
  misc_feature (271)..(272): n is a, c, g, or t
  misc_feature (276)..(277): n is a, c, g, or t
  misc_feature (281)..(281): n is a, c, g, or t
  misc_feature (284)..(284): n is a, c, g, or t
  misc_feature (295)..(295): n is a, c, g, or t
  misc_feature (301)..(301): n is a, c, g, or t
  misc_feature (303)..(303): n is a, c, g, or t
  misc_feature (305)..(305): n is a, c, g, or t
  misc_feature (307)..(307): n is a, c, g, or t
  misc_feature (311)..(311): n is a, c, g, or t
  misc_feature (320)..(321): n is a, c, g, or t
  misc_feature (323)..(325): n is a, c, g, or t
  misc_feature (331)..(331): n is a, c, g, or t
  misc_feature (333)..(335): n is a, c, g, or t
  misc_feature (345)..(345): n is a, c, g, or t
  misc_feature (347)..(347): n is a, c, g, or t
  misc_feature (351)..(351): n is a, c, g, or t
  misc_feature (355)..(356): n is a, c, g, or t
  misc_feature (364)..(364): n is a, c, g, or t
  misc_feature (374)..(374): n is a, c, g, or t
  misc_feature (387)..(387): n is a, c, g, or t
  misc_feature (391)..(391): n is a, c, g, or t
  misc_feature (442)..(442): n is a, c, g, or t
  misc_feature (445)..(446): n is a, c, g, or t
  misc_feature (455)..(455): n is a, c, g, or t
  misc_feature (480)..(481): n is a, c, g, or t
  misc_feature (504)..(504): n is a, c, g, or t
  misc_feature (508)..(508): n is a, c, g, or t
  misc_feature (510)..(510): n is a, c, g, or t
  misc_feature (516)..(516): n is a, c, g, or t
  misc_feature (916)..(916): n is a, c, g, or t
  misc_feature (968)..(968): n is a, c, g, or t
ggcggcggctatttcccgccattgtgcgaagtgaaggnnaggagcncgtacgcgcccgcntgantgtngccagcagctcctcggcggccccaccgcagcngccgctccctgangcgcgggangcccgcnccccgcggctcgctgtgcgtgggagggcgcgagcnaacgcgngcnaggagcggccgagcngctgaagangagcngggcgcnggcngcncggcngcgctcggcncgcggatngcctccgcncggtcttcgccggcnnnngnanntggnnaaangcngtgtggggagnattggntnancnaccngctgggaanngnnnagggantnnncgcaaaaaananagtnaatnntaaatggnagaagaaaanaattaaatatttnaaanaaaaactgaaggaaaataatgctcctaaatgggtaacatcactgaaaaatnccnnttcattatntgaaacctaataattttgtgaaaanncgttgcataattcaagatatgtntganantgagtnttacatgggagtttatgaaacggttaaccaaaacacaaaagcacatgttcttcattttggaaaatatagagatgtagcagagtgtgggcctcaacaagaacttgatttaaactctccacgaaataccactttggaaagacagactttctattgtgttccggtgcctggggaatctacgtgggtaaaagaagcctatgttaatgcaaaccaagctcgagtcagtccctcaacatcctacactcctagtcgccacaagaggagttatgaagatgatgacgatatggacctacagcccaataagcagaaagaccaacatgcaggtgccagacaagcagggagtgttggtggtctcaatggtgtggagagcaaaacgtttagaaactgaacttctactgggcanagctgaactctctgaacttggcctctccttttgatttgaatttccattgcangagagaaggccttcatgc

SEQ ID NO: 486961 - DNA, 658 bp, Homo sapiens
agatagatccttttaacggtctaaagcaagctcatacttggtcaggtctgtcaattatagcaagtagctgagtctctgtctactatagaatagaaagaaaatggggttctagccataagaaggcttataaatctgaccatgcgtttagtcccatatgaataaacacaaaactgtgctacttggatacacagttgttatttaatgttttgtacgatctagcctttccacgtacaggcactttcatgagagaaccttagtcctcacttgaggcacttttgttgtcgggttattagtgtattgtttttgtcgggtatttgcctacattcaacccctgagcatttcaggtagacagagcgtgagttcaaaactctgttctaacggtgtttattgtagtggagtaatgggtttcgcagtgataagtcatacttttccaccgaaagggagggcttgggaatccctgagattagctaaagttaagcttgttggaagaattccttgattggaaattgtacctttgtgttttgttgctctgtttcctgaaaataactaggggatgctcctggcttcgtccatctaagtgctttgattaccttggatgcccaccgattctttcacttcaagaaaaaacaaattactgtgcagagtctctgtacccttt

SEQ ID NO: 486962 - DNA, 1019 bp, Homo sapiens
  misc_feature (1019)..(1019): n is a, c, g, or t
gggagcgaaggaggtagagaagagtggcggcgccagtgcgagggagcgtagcttggttgctccgtagtacggttggctcgcgaggaatgaatcccgagcgggctccgggactggactagagatggcgggcgtgggatggtgtgcggggctgtggctcctgacgttcctcccagtggcgcgtgagcggcactgatttgtccctggggcgtgccagtgctgaccgccggagatgaggcgtccgattagcaaggtaaaagtaacagaagcatggctcatttgcccaacaccttttggtggctagcctgtgatatctgggccataactgtagaggaaagagcgaacgtcatgatcagcaggttccttagtctaaagcctatatctggattcattactggtgatcaagctagacaactttttttttcaatctgggttacctcaacctgtttgtcgcacagattatgggcactagcttgaccatgaactaagtgattggaagacatggatcaaggttgccggttttgccctattatatcatacgttactgtactgtgaactcaattaagcagcgatatcaggacttacactctgggaattaccgcactgtactatgcatacagcgtacagagttgcagtattactagcgcactgagcatttagagtatcgggatcgtatacggcaagactgacatcgtgctacactgtgatgcatgcacgcgttgagggatccaaacacagttgctggaagtctctcccaacatacaattttcttgtacatcaagaattagcaccctgactgacagttccccttgtaattaaccttcctcattttgcttcctgctcacatggacagacctacttatcatctgtcagcaccatcaacttaactcccggcacccctctctttcagtcctctcgaaactctctctcaaaaccaagctatcacattcctatgtcatcccaactttcaaacaccacacaccagcatactattgtgttactcactttctcaaacagacaan

SEQ ID NO: 486963 - DNA, 172 bp, Homo sapiens
tggggctaactcgaaatacgtgtaagcccataaaattacttttggcataagaagatagggactcatgcttgctctgagaatttgaggacgtttttggtttgcttgtgtgtttgttttagatttaaattgagggaaatcgcacattttgaaatgcaccaagactgtgtcttac

SEQ ID NO: 486964 - DNA, 177 bp, Homo sapiens
tctatctttctaaaaagcagacccatacctttccagggtcaaagtacagaatagaatacattgatacaaagtacagaaaaatactttgaactttatccatatctttaactctgtgtaaagacttgagaagtctaatacacaggcaaaccaatacagaattgactgcagatgaacaga

SEQ ID NO: 486965 - DNA, 279 bp, Homo sapiens
agtgagccggtccaaccctaagtgccaaatgtacatatataatgaattggatagaaattgtagcatatccatacaatggaatatcattcagccataagaaagaaatggcaggcaggcgcaacagctcatgactataatcccagtgctttgggaggccgaggcaggaggattgcttgaagccaggagtttgagaccagcctgggtaacatagtgagaccccatttttacaaaaacttttaaaaattgaccaggcatggaggcacacctgtagtcccagct

SEQ ID NO: 486966 - DNA, 136 bp, Homo sapiens
tggctctttgtcacccaggctggagtacaatggcgtggtctcagctcactgcaactatccgcctacccaggttagaagtagatactacccgcctacagcctacctaacacgactatcgaacagccgcaattctagc

SEQ ID NO: 486967 - DNA, 511 bp, Homo sapiens
  misc_feature (297)..(297): n is a, c, g, or t
  misc_feature (332)..(332): n is a, c, g, or t
  misc_feature (410)..(410): n is a, c, g, or t
  misc_feature (443)..(443): n is a, c, g, or t
  misc_feature (478)..(478): n is a, c, g, or t
  misc_feature (500)..(500): n is a, c, g, or t
gagaataaaagcaggctgcctgagccaccagtggaactcgctggggtccccttccacactgcctttatgagctgtaacactcaacacaaaggtctgcagcttcactcctgaagccagcgagaccacgaacccacaagaaggaaaaaactcccaacacatccagcaagaccatgaacccaccgggaggaatgaacaaactgcggacacgtctcctttaagaactgtaacactgaccgcgaggaagttcagtgaggaccaaggaacccaccaattctgggacacaataggcatttccantctgttttcaaattgggtgtcctctttggatagtnggatgtggctttgtcttcacccacagtagttttacattgctctctctgtttgacatactttggaacattttgcccagncttggaattaatgtggtggctttcccagtttanttttccccccccaaccccccccaaaaaaaagggcnataggttggagggttacatttncccctttgggg

SEQ ID NO: 486968 - DNA, 305 bp, Homo sapiens
gcagctagttgtggtttaggcactaaaagtaatacagacatttctaagactacatttcaggaaagagtcctgaaaaagataaatgtgattcaatgcttgttgaactagcgatctagtcaggaaccgaaaaacaagacattggaagtaacagcccagagcagggctagatttgcccggtgggtaatgaagcttcagggtctcttcatatgcacaggctccttccttccttccgttccttcctctctgtctctctctctctttctttctttcctttctttctttcatggaggtttcactgttgtcag

SEQ ID NO: 486969 - DNA, 1264 bp, Homo sapiens
  misc_feature (635)..(635): n is a, c, g, or t
cgaaacccaggggcggagatcagctgactggcccggagacctcgctggtccgcttcactacgcgcggtaggcacgtgagactagatggtgtctggagctccaggccataatgcactgaatggtcgcttgcaagttggctgcgcgcgccaggtcttgatgcatccaaacttgctccctggtgcacggtgaggagcagggtggtgcaggagacgccactggtgagaacatgcttgtgtcggccttgctcattcgtacaccttctttggagttctattccattgtggcttctatgtctcggcagattgacctctttgagctcgttgttgcgcgtttgtcgattcgctgatgacgcgagcgatagagtccctgtggaaccacctggacccaacatgttgtcaccgttggatgggcattcgtggcgcgtagggccgagctatgatccgtggcagtgccttggattcactgtcctcgaccacgttcgcttgtgatcctcagcgcaactttcacatacgtgggggtgcagacacatcgtgggacgcaaattatggggggggagaacctcggcatagtggcgcggttcgtcaaacccggggtcgtttcgccttcaatttgcgtagcgcatctaaatcgattgntgagcaggcctagggcggattcattagcgtctctccgtcgacttcgtggcgaattcgaacgcggcccagaaggcaggtctatcccggtgggcccaactagagatggcaacaccctgtgtgtccaaacgtggtcccgttcgacatgcgttccctgacgactcgggcctccccattctaaccgggacaaccagcggcgttgtggccctttggttgtccctttatccccgttggctggagggcttggaggttcggggcttggggccttggtatgggccccactttgggggcaccccctagggtgtgggacttgcggtggatggcccccagacgaagggaaacaccgggtgtgaccacgggaccatccaaggaatcagcagagcagacggcggaagggagatacctatgcggcaccataggtaaacagcagctgatgggttaaccaccggcgatggacgggaaacagcgggcgccagttgcgccgagaaccccaaataaggtcacacggtggaggattggtgcccccacgatgggagcacaagagtgggggacccttgcacacacagcggtatcagcccgggtatacaagatcagcaacacagaggggagagtaagaacctagggggaaaccc

SEQ ID NO: 486970 - DNA, 724 bp, Homo sapiens
tacaaaaaaaaggtagctttttttatgacaataggaaagactacaaagcaccggggggggaggaggagtgacccagcccctcaaaaagggagggggaaaggaaaatgtaaacatccgtgggtaaaataaagctcctccacccccagcacagctcagtgggaatttttttctcttactttttatatttcacaaccctctccagcataacacaaccacaactcccttatcactgtgtgctcaaacaaaccagcactctttcccccaccagtgaagaagcactacaccacccaaccccaaacatctaccaacatagaccactctcgagggctctataatactggtgtcgcacggggagtggcgtgggcctcgtggagagggaaatgtcgcccgaagggacaggccgtgccccgagtgctctccaccagcgaaaacccccgagagtctccccgcggcgagcggtactccacaggtgctcccaccaagagggcgcccccggcggcgcccacaaggaggaggcgccgcgcccacaatctctcccagacaactatacaccccgtggctctcacacaagagcatctccccccttccagcgggcattctacgaaagacggcgaaaaggccccatggtagtcatcccctgcggcgaaggcacctaggaaagggccacgcccacgctatctcccaaaaatgggccgggccctttaacccatctcgtgggaacatg

SEQ ID NO: 486971 - DNA, 116 bp, Homo sapiens
aatcagctcgtacccccttcatgttttgtcatgatattggaaataagctttcatataataatttggaaggtgaataaacttttgaagctgctatgttgggacaggcagaagaagtg

SEQ ID NO: 486972 - DNA, 247 bp, Homo sapiens
  misc_feature (204)..(204): n is a, c, g, or t
gacgtgtagcagtggacagctacaggaagacactctcaggttcaccacagcgcagcgccaagaacttaaaacgtacacagtaagacaacatgtaacttcctagagttaacgtttacagttcaaactagttccaattacttttcttttgcttggtgttttttttttttcttttaagagagagtctcgctctgtcgcccaggtggnagtacaggggtgtgatctcagctcatggcaacagggtctctca

SEQ ID NO: 486973 - DNA, 265 bp, Homo sapiens
ccaaattttttcccccctttacccaaaaaaaagcccgggggggcccccatttttgggttctttccccccccccccccccccctttttttgaacccttttttccccaagggttttaaaaacccccccctttttggggggccccccccttttttttttttcccctttccccccccccctcccccccttttgggtttttttcccccccggtttttttttcaatttttttcccctgggggtttccccccaattttttttttttccccca

SEQ ID NO: 486974 - DNA, 143 bp, Homo sapiens
tgctgtctagaggatccctacactgggtcgagttcagctaatcatcaaacatgtccacatccatcccctcacactgtgcagtgtgtatcagttttgtgcgaaaggaaaaactactctctctgggctgtcagcaccagtttttg

SEQ ID NO: 486975 - DNA, 116 bp, Homo sapiens
gccgcccttattgttttttttaagagcttaattggtagctttttcagctattaaaaccatttaaattgttaaccacctgatgagggcttcaggtaaattaaaggatttgcgggaag

SEQ ID NO: 486976 - DNA, 825 bp, Homo sapiens
agcggctgtgcgagttggtaggaaacttggatcttattcggtccaaggaaaaggaatgtctgacaggcttaggcttgtgcgtccccttggacttagactcgaagcttcagtatatcctctgaaatggctttttcaatagcagacttgcacaaagatggcagttgtacggatttgcatagcatgcttgtaatttgcagattttcatgcgtgacattaggctgagtacggtatgacgagtcaggttaacgactcactgtctatgactttcagctcgtaaggactggtcaaaaggacagcagtcttctatgttctgtagttcatagtattcactttcagctagaaggttaatcgtatatcgtaatttcttgagaccaggaagtaacgccgttatgtaacggtaaagccgtcagacaattatcattttagtggtaatactgacgcattttagtcccactaggtttagagatgggagatagtgactaaactggtgtctgacttttgatcctagagatttctcctctgaaaaatacatagggctgttggtgagagcagacttgaggtgatgatagttggtctctggtctaccacagatttcataagctccttggaaagcttgcttatgatcattcttaacttcttggtagctagaaattgagaggtagttgaaatctttaggagtgaacttctgagagggcataagaatgtgacgtgacgggaacaatacttaaatctgattgaactaggtgtaatataggttgtgggaaatttatttggacctggtgttgtacctggtgggataatctgtccctattaaatcaagtgttg

SEQ ID NO: 486977 - DNA, 141 bp, Homo sapiens
cacccccccgttccccgatgtcgtaactcacccacactagaagataacttctattggtatttgctgtcaggaaaggacatagaaaaaaaaagggtcttagtattcagttcagaaaaggggagaaaccattacctaccaccc

SEQ ID NO: 486978 - DNA, 699 bp, Homo sapiens
gctgcaggaattcggcacgaggagagagagagagagagagagagagagagagagagagagagagagagagagagagagagagagagagatagagagagctgttaccgttactggaactgccgtttcggcttgagcctgatcacgatgtcaacctcccacatgcacttagtcttcgtggccgtgcccatgggggcgaagccagtccggagcctggctgggattggtgaagtcctgagcatgaagctggaggaatgtggttttgacatggcctatcttgtccttggcctgtttctggtgctaaagaaagatctatacctcttccgggtatggctgacagacacttgtggcgccaacgccaagcagtcctggttctgcttcctatgcctttgagagtggtgctacgccttcttgtgatgctctctgggaagctctcaatccctagtcctcattctgagtttgcagcccgattgggactccttcccttttctctacgaaggttattgttattttcttactcaccttcctcctacttcggggtctttttggagttttcttcccttaccattttcacttttttttttgatttttgctttttcatgcccttccccgttctttttcctctttccattttcctctgtgccaggttcccgcctattcttgattggattccccggccctttccctcacccctcctttttt

SEQ ID NO: 486979 - DNA, 406 bp, Homo sapiens
gaacatcgctgttatcctgttttttttttcaaggtgcagatttcatattgtttaaacaatttgtgcagttaacacaatcatcacagggtcctgaggtgacattcgtcctcagcttaggaagatgatggtattaagagattaaagtaaagacaggcataggaaatcacaagagtattgattggggaagtggtaagtgtccatgaaattttcacaatttatgttcagagattgcagtaaagacaggtgtaagaaattatgaatgaatttggggaactaataaatgtctgtgaaatcttcacaatttatcttcttctgccatggcttcagctggtccctccgttcggagtccctgacttcctgaaacatatagatgtgaatttgggagctctgtaactatgtttttctc

SEQ ID NO: 486980 - DNA, 228 bp, Homo sapiens
tcatctgggggggcccgttcacgccttgtgcaggactgaaggccagttcaccctgtaggtcctaagctcgcttggcccatggcgctgccgggacgctaggggagggtttgaatggtagcagctggggacctaggaggggccccaaggtatggaggtagtagtagtcctgcgtgtcccagggattgtagagtagggtccatctagacccatacttggggattcctacta

SEQ ID NO: 486981 - DNA, 284 bp, Homo sapiens
aggcgtgggattcctggagcaccttcttcgggcgcaatgcagcatacggcgcgatgatggttacgcgcccgcagactatcggttacctgctggccgattcgcctaccggaactgccgcgtggatgtacgaaaaaatcgccgcgtggacggacagtgatggccagcctgaacgggtattgacccgtgacgagatgctggacgatatcagcctgtactggctgacgaacgcaggcgcatcgtcatcgcgtttctacggggaaaacaacaacaacaatttcagcgct

SEQ ID NO: 486982 - DNA, 386 bp, Homo sapiens
tgagcctcccactggttgccaggcgatggctgaactcaggagtcaagaccagcctgggcaacgtggtgaaattccatctctactaaaaatacaaaaactagctgggggtgggggtgtgcgcctgtggtcccagctactcgggaggctgaggcagaatggcctgaactcaggaggcagaggtgtgcagtgagccaagatggtaccactgcactccagccggggcaacagagcgagattccatcttcaaaaaaaaaggaaagaaagaaaataacagggtaacaagggagatcctgcggccacggggcacatcctcaaacattcacagggattggggggtcaaaacatggacaccgggaaaacgaacacgtggcctagtgatggtggaa

SEQ ID NO: 486983 - DNA, 357 bp, Homo sapiens
agaaaagttgagccaataatcacgtagagtccgtgaaagcctgtggctacaaaaaatgttgaccggtagatcccgtcgaaaatggtaaaggaagcctcaaagtactctgaggctgtgtagaagggtaaaatagagctattagactatggtgagctcaggtgattgatactcctgatgcgagtaatgcgaatgtgtttagaagtgggacttctaggggattatagcggggtaatgcctgttggggcacagtgcccccctagttggggggtagggtatagcctggagtggtaaaaggctcagaaatatcgtgcaaagaaaaactcttctgaggtaatatataggattatcgcgtgtcgt

SEQ ID NO: 486984 - DNA, 116 bp, Homo sapiens
aaaccatgacatacattccccaccaacagtaaatccccctcgcctgactagttataatgcgatgcatgcgatatcaggacggggaatgatcgacaggcttaaaagaactcattcat

SEQ ID NO: 486985 - DNA, 138 bp, Homo sapiens
caagtatacgtcatgtcatagggtaagttcatgacgtcatgtccagtggcaataaagcacagacgagacgatgagcttaacgtgggatgagaggcagatagaatagtgaacagaagcatacgcccaggtaagcagggt

SEQ ID NO: 486986 - DNA, 110 bp, Homo sapiens
acagggggtcgtgttatcgctcccagaaggcgcgcgtgtgcagcagcaaaagctcagaagaacctaaagtcggaatcggaggaagatcgaacattacgtgtgattaaagc

SEQ ID NO: 486987 - DNA, 1392 bp, Homo sapiens
ggatggagaggtcattaatggagtccaacgcaggagcacaaggatgtgatgtgaggcaggagccacctggatggccatctgtccgcgatctcatgaggggcccgagcagaagcaggatagttgctccgactctgctggcacatttccccagaacctgagctcccgaccgagcccagacatgctcgccctccactccgtcatgtccctaggtcagccttagctgccctagcgctccggtccaggtatcaggcctgaccagacggacaccacacaccagcacccagcaaaactccaacctaacaaggaacagtcacccccaaggcggccagaactgcgacgcggcgcactgagaccagccacgacctgacgctccccacccctgacccgaccgaccgcgacgacgccagcgcgcccacgcgccgcggccgcgcgcgggacacccgtaccccacccctcgccactaccaacaagtccccgggcatacacacatgcaatgctaaaatgcgaagaaacatggacaaggcccaagacagaaatgcgacagcgctacaaccatcgacacaggcacatcccagccggcaaccacggcaggcccacagcggacagcacaaccatacagcgacccagcccagcggcagcgcaaaaccacacagcggccccacccaccaccgcaccaagcgcacaccggcgacacagggcacgcacacacacagacccccacccggacacaagacaccacggagcacaccagcacagacgacaggcgacaacacgaccctaaccagggcacaccacccaaacacgacacagccgcacgccatacaccccccccaacctaccccggccccacagggacctggaacgccagacgaaacacaaccaccagcgcgccccacaacgagccacgccacccgccaccacccacgacaacagcaccctaccgcagtgaacgccacccccaagcccccccctcaccatccgcaccccgcgtccagccccgacacacgcggaccgcaagaccgacaaaccaggcaacggacccaccccccaacaaccacggcgaaaccccagaacaccaccgacgaaaggcaaggacgacagggacgaaagacaccacgcccccaccccgcgcaacacaaaaccaccagagcaacccgcaccacccgaacaaaccacaacaagaaacgagagaacccacaaagagcatcgaaagcaacactgacacagcaaaccgaggaaacaaacaaaaagaagaaagccaacagaccacagaccgcaacaccgcgcaccagcccaccacagacaccaccgacaccacgcacacgacaaacaaccgacgaccacacagcgagcaccgcccaccacacagaccgacgacaaactcaagcaaac

SEQ ID NO: 486988 - DNA, 274 bp, Homo sapiens
gcgagagacaaaggggggggtgtgtgatgccatcatcacaggcaggtgacatgtctttagcatgcttcctcctggtggccaagacaggctgtaacagagggttgttttgtgaggggtgtgggtgttatcaagtgaattagtcacttgaaagatgggcgtcagacttgcatacgcagcagatcagcatccttcgctgccccttagcaacttaggtggttgatttgaaactgtgaaggtgtgattttttcaggagctggaagtcttagaaaagcct

SEQ ID NO: 486989 - DNA, 769 bp, Homo sapiens
tggggttccttaacagtcatacttccccagtaccatccccgcaggggagggcgtctggggaaggccctggtgggagctcggtcaaacaggatgggtactggggacagaatatgcacgggtaaagaagccaaagaagcacaatcaaaagaggcgaccagcaaggtaacttcttgtggaagtagaagaatagcatcgccattcagaacataccctcactcacaccactactcgtggcaaacacaccagctccagcgtggccacccaactaatctctttcgaacctcgcaattaccacagagcaggaaaaattcagcaatgtggtgactcatattccatatgtgtgtggtcacaactcacacagacatataaaccacacatatgtgaccaggtggtggtgttcaatcgtgtattcgcacatacactacgtgtgtctcaagagagtgtgtgagtagaggagtaaataagcagcggaaacgagagtgtcacgagacagagggctcaccccgcggcggtaccacctggttcccagccgcggtggtatacaaaaccccttattacatatttttgttagggacccccagtacacacaccggagtattactaatacaccacgcggaattcccaggaccgagacacacatactacctatcacattgtggcactgtgaaagtactctccttcagttgtcagtaatgctggacgataccaacagacaatattatgaaaaccacaaaaagttgtgtaaccgcagttggaggtgaacaccact

SEQ ID NO: 486990 - DNA, 117 bp, Homo sapiens
cttagaggatccccctattcagcggcacctcgcttttcatcggcaccattagctctagaggtccatgcattcttcatattatacttgaattcaatacggggtgccgatgaatagcga

SEQ ID NO: 486991 - DNA, 109 bp, Homo sapiens
tctagagcatccccttacaacccacgatcaccccgcaaacccatcaatactaaaaccccttaaataggagaaggcttagggctttgatctgctatattaggcgttgatt

SEQ ID NO: 486992 - DNA, 156 bp, Homo sapiens
ttagaggcgaagatgttgtaggtataggcgatacacactgcccggtatcggttagcgccaaccgtcgtccttcgcgagtgaacaagtcttcgccgatacgctcttccaactgacgaatctgggccgagaccgccgattgagaggtatgcaactcct

SEQ ID NO: 486993 - DNA, 240 bp, Homo sapiens
cacattctcaacagaaaacaaacaaatcacatattgcaagaatttaacttaataaaaagaacattcacacagaaaatattgcttgagaaataagaaatagaaggtgaaaaagaaattttcaaaccccaaataatgataaaaatagatgtatcctctgtaaaaatctggactaaactattcagtcattcatggttattcagtattcagagcatgaagtgaaacaccaaagctataaaaatt

SEQ ID NO: 486994 - DNA, 934 bp, Homo sapiens
  misc_feature (498)..(498): n is a, c, g, or t
aaatattgtcaagctaacaaggttaggaaaacaaggtgtgagatatgtcaaattcaggtgtacggcgtttgttgtattgaccatgatgaggagaagcagtcgaaatgttcgcaacagtaacggacgcggactgcacctccattggaggtagagtgggactgaacgcccgaaccggagcctggactccgcttttcgactcctcccgacaagtaaattatggaccgggtgtggtggctcacgcctgcaatcccagcactttgggaggtatgaggcgggtggatcacttcaggtcaggagatcgagaccacggcgtaaatcccgtctctactacaaacatactatagacaattggccaggcatggtggcagggtgcctgtggtcccagctactcaagagaggctgaggcaggagaatggctgaagcccgggaggcggagcttgcagtgagctgagatcgcgccactgcactccagcctgtgtgacagagcgagactcgtcntcagaataaaaaaagaatctacacaagagtgaaaatttcccgggggcgtatggaagatttatttttgagtggtgttcttagatttggacttcatttggaagcacgggggtcatcggctgtggtccacccaaatagtggaatcccgccaagggtggatattggactccgtcagggtctccaccgtggcagcccctcagacccctcacgggcgcatcaaggtgtgactccctcacacaagccctgtccaagcgccctcccccatgcagcgggggtctggacacaccccacgccggcagcactccggccaccacaccccagggccccagtcgggcctaaaacttatgggggtaaccctcttccttggctagaacaaacgcgcggcccctccacgctcatcttgtggcccacgggcttgcgcatcctcaaaacgtcctgg

SEQ ID NO: 486995 - DNA, 733 bp, Homo sapiens
gaggtaggaggtcctgggtgacttcggaagtccgtagtgtctacatcgcacgatcattcgatacgctctagggcctgtgtggctaggtcggttctctcctttccagtcggagacctgctggccgtgaaatgatgctccgccagatccatcggtacaggtccaatgaagcatgcgagacgtcaagtatcgtgaccgatctgcctaatgttttaccctgtgtcctatctatgtcgttcgagggtgcgccatcgtgttctagttccctgggaacgtccatcgatttacgagcgcatttactcgtccgtcagatgcagatcctgactcgtctagtgttgtgtcatcttagttggtcccaggtctctgtgaaacctctacgccatgcattgtgggcgtctctgtctgacaggatggacaggagaccggacattggtcgggatacaatacaaagctagtttttcctagttagtgaatatcggaagcagtctggtggccgctcatcttgtgcacggttgtgctggtccaggagggatagatgtgcgcttgtgtgggtcatgagactagcataggtcaggttccctatgtgttataccatctctggaggtctctggtattcgccgtatgcaccaacaggccttcggtacataacaggggtccgtgattcttggaatcctcacttggtcatggacgtcgtagttcggggaaaacttcgacagtgtggaatttttgcagttaa

SEQ ID NO: 486996 - DNA, 278 bp, Homo sapiens
aagaggggtacagatcattgcacatggaaaatattcccagcagtatctgtgatctacagcttttaaaaaggagcatctcagaataagatgtctgagatcaaaaaacatgagtatattacaaggggaaacgatggaatgtgattctcatgattgaaagcttgatttagattgcatacagcttttgctacccaagaccaagaggctctggcaagacagggtggttttccgaatgccagactgaggtgccttatgaaggcagctcgcgagtccgctgcatt

SEQ ID NO: 486997 - DNA, 106 bp, Homo sapiens
ttgcttcattacaggcaattaatttataatatatcctgaacagctcttttgtgctgctggtgtcatggctatatgagcatgcagattttgcaggtagtggacacgc

SEQ ID NO: 486998 - DNA, 409 bp, Homo sapiens
  misc_feature (15)..(15): n is a, c, g, or t
ctgcgggtcgcgganggttctggtccgcccgggatggggccgagacgagtgggtttcccgtacgtcccgccgctgtgtgagcaggactgtgcgtccgctcgctgagcaggcgcacgagggcgcggagaccactccgtggcactccacctcgcgggtggtcgtcgccccaggggactgaagcgcagtggaataactacacgcgtgggcgagcctctgagccgggcttcctctctccgtgctctccctgaggtcctgccgggaactgagaaatgagctgcaccattgagaaggcacttgctgacgctaaagcccttgttgaaaggttgagagatcatgatgatgcagcagagtctctcatcgagcagaccactgccctcagcaagcgaagtggaagcgaatgaagcagaac

SEQ ID NO: 486999 - DNA, 286 bp, Homo sapiens
gcacgtacttacctctacccaccaactgaccaagccacacgtactaaaggtcgaactcaaagatatgtacagggtatcaaccaaataccaaggggaacagtcaaccttcaatacaaggtcaaaatcagcaacaagttctacaatccagtgctgatatcagatacaagcttcaaggacaatctcttttcgaaggcttattccagtttcgtgaggctagcatgaggtgtgtgcattagccagggcgcaatttctattctcaatcaaccaatgcagcaaatgctacgca

SEQ ID NO: 487000 - DNA, 940 bp, Homo sapiens
  misc_feature (535)..(535): n is a, c, g, or t
  misc_feature (539)..(539): n is a, c, g, or t
  misc_feature (601)..(601): n is a, c, g, or t
  misc_feature (629)..(629): n is a, c, g, or t
  misc_feature (633)..(633): n is a, c, g, or t
  misc_feature (658)..(658): n is a, c, g, or t
  misc_feature (693)..(694): n is a, c, g, or t
  misc_feature (763)..(764): n is a, c, g, or t
  misc_feature (803)..(803): n is a, c, g, or t
  misc_feature (830)..(830): n is a, c, g, or t
  misc_feature (838)..(838): n is a, c, g, or t
  misc_feature (861)..(861): n is a, c, g, or t
ggttttcctgcgcaggagccgcagggccgtaggcagccatggcgcccagccggaatggcatggtcttgaagccccacttccacaatggactggcaggtcggcgctgtgtgccacagtgtgttcaatccatgcgcggccgcgtacaggactccgcagcacgtaatggcctcggctaatgccgaatgtgcgctgcccgacatcgctccctgcgctcccgctgtcaggcgtccctagtccgtgcccaatccgtgtcgcatgcctccaccggattcctgtgtagccacatcgaaatggctgcggctgcctggcctgcgtgcgttcaagccttggatggacgctctaggggtgtgccgggctacttcaccacatgacacggtgtgcctcggaccctatcgcgacatattgcttgtgcgcataccgcaatggagggcctggaacacagacgtcccaacgtgcagcgtcctcttggcaaggatcgcacatctgttggcaaagacgcgctcgagagggcaagtagctcggctccagagatctncatnctctgcgttcacccgatgagacaagtccgcttcagtgcccccaacaagaaacgtggaagacnacgtatcgtggcgtagaaagtgaacctngaanaaacctcgtgcgcaagccccaggcnttagacgcttggaaccgtggtcccattgcgcctgnntccggaagacatgtctaattacatgcaaacgggaagagaaggcgtcggaaagtccatcaacgttgcagnngagacgagcacagcacatttccgaaagacccttgcgctnagttcctcacgctagttggtcccctgntgaccaanatgcgcctcgggcgtcgtttcgngacaataactgcgcgcaaaataaagtaagcaccaacggtagaagcccgacatgaaacgagcgacctgttctgacatcaa

SEQ ID NO: 487001 - DNA, 437 bp, Homo sapiens
ctctagagtgtaaaaggaggtgagtattacctatagacattgggcagtggagctagaagcgatcatcagattgaggtttgattatttgtggaagagtattacaaagtggtggtgtatactttgtaagaaggcacatcatgtcttgtacctttatcgtgtgatcgactatagatgtcaatgcctagactctatccattcattaggggttcaatcttatcattccttatttatttatttgtgtgttgaaacatcttcataaagggaaactttgtcgtatccactatcatgttaccctgatgcaaactgcacaggaactgcaaggtaattccttgatcctttccttttgtcagctttcaaagtaatggactggttgtctagcatctttcaaagatgaccaattaccttactttatttggtgtcattatgacgtcacaact

SEQ ID NO: 487002 - DNA, 130 bp, Homo sapiens
atatttgcccaggctagagtacagcggctattcacaggtgcaatcaaagcatactacagcctcaaactcccggcgccaagcaatcctccagcctcagcctcctgagtagctgggattatgggcccgtgcc

SEQ ID NO: 487003 - DNA, 105 bp, Homo sapiens
tgggtgtttataaaaacgggtgttttccgggggtttaaagtgatgggtcacttcagtgttttttaaagataaaattttgtgcaaattttaaaacaaaaaaaaaag

SEQ ID NO: 487004 - DNA, 1168 bp, Homo sapiens
  misc_feature (625)..(625): n is a, c, g, or t
gaccagtccgagtgcggccttgcttgagtcacgtctgagcgcgattccggagactgcctgggggccgaaaaagcgggcgctaccagcaaaagggtcgtccagatagtcccgtttggagagcacacaccaacctggacggctgacagcgaagtgtggaccgacaggacagcattcacgagcatcgagtcttgatgtacggtaccgaagcgcgtgccgcagaggagatgaccgagtctcatgggcgctatagggaaagtcgtggcgagacttttcgttcgatgcgcgcggcttgacaaagttggttagtcaccttcgataagtggcaaaagagagtcgatcccaagtggtaggatacgtatcgaactcgatactcttcacatgacctgacgtcttgctgtgcgttaaccaaggaactccgtaggtcgtaataagagaaatctagccttctgtgggcttctattcgtactaagttgacaactctggcgagccgagcaagattgcgctatcgaaagttacctaccctatagtcagacttggggctctgaggaggcacggacggacaggaccagcgctaggtcgccatcggtcgggagcttgcgcctgtaggaacagacatggcaccatntcatcgaacaatcacttgaaaaagaacgtaaatcttaacacaggacatacattatgcatgtcacgctaagcctttattggtgactaggtacttggggccaatgacacacggcactattgtctccaacccagattacttaagtctcaagataaacttacccttgacgggagtggccacttttccagcaaacttctctatggcggagggcaggcagatggcacgtcatacatctgctctgagtggccttatttcgagccgttgtcaacaacgggaccctggtaggaacacaggtgatttgcgtcacgcagacctgtgcacctcgtgccttacttggtagccgtataaaataggttgccaatcgcaagggtaaaagtacagaataactggagttcatattagtggatacaggaacactaaaggagacgccgactacatggtgcttaatatctgcggacttcccacttgcgcaaagcagggtgttatcttcaattcccaacgatgtggttagcactcatcacagggtgacggtatgcacattagaga

SEQ ID NO: 487005 - DNA, 224 bp, Homo sapiens
cgtagatagatggatgcccatttagaaaattattctattcctattatacagaggaatgtaacctggattggaaaccatggtattcaaggcgcaactgaaagaatgggggtgtttatctaggagaaagatgagggggcacaggctgtgactatcttcaggcagctgaccaactttacatacattagacagatgccatgtttagagttctcaccaactgaagagtg

SEQ ID NO: 487006 - DNA, 487 bp, Homo sapiens
  misc_feature (370)..(370): n is a, c, g, or t
  misc_feature (372)..(372): n is a, c, g, or t
taacttctacaccactgacttcagactcaagtgtggcagcctcagctttactgctgttcatccatctatctccattgtgagcctttttcttaatatgtccttcccaagtgacagaattagttgtcccatcatttcaattggttgggggaaaaaaatcccagtatttttggttaggaagccagagggttaacatatttcatctgtttaatgtctgattaagacattgatagtgtatctctatccgctttcttatccatcatcctggggaaaaatgtctcagcagcgttatgaacttagcttaccctatttattcagaactgaaataagtaaataaactagcaaatttggaactaaaccactagtccaattnanagcaattgccctggacaccctgtgtttagacatattgatgttttgtataagtcttaactgattcatctcttaagcaaaattacaaataaataccacttacaaagcttaaaaaaaa

SEQ ID NO: 487007 - DNA, 1506 bp, Homo sapiens
  misc_feature (268)..(268): n is a, c, g, or t
tggctgtaacagtgttaattggatgatgagtccagggctcctgctgaagcccggggggggaggggcacagagcgaaagtggggcgctaagtggaagtgcttgaaggctgcctccggtaatgtcggctcggagcttccaaacataggcagagggcacgggttgaggccttcgggcacacagccggcgcccagttcacccggacccagaagtggaaggcgcgggccggggcccgtgacacgaggccacttgtgccaaagggtgcgcatcnacacacctcacagcacaacctccgtcacgtgagaacctcagaggccagtcatccaacaacttccaacccacggtgcacaatgtgactataagcggcacaatttaccatctcaagaacgggaccggggggaaaccagagctcgggagagggcattaggaaaatcctcatcaaaacaaacggagaaacgacacggagaacacgcctcaaacaacaaccaacacaaaagcagcacaaaaacgggagtgaaacacacaagaccaacacacccacgggcacgcgctgagcaagaggacacaagcgcaaaacacaacacacacgacaagcacacgacaagacacccacacccacccagggcacaacagacctcacgaccacgaacacagcacacggagcacacacaccagaccccagcagcaaaacagagcgaagagaccgagaaacaagaagaaacaaaaaatgacaaaaaccaacacagagtataaacagcagacaatgaagaaagacaaagcagcaaaccaacgcgaacgcggaccacaacaaaagacccgtaaaccacagcaccagaacagacacaacaacagaaagacacaatgggacaccacacacaacacacaacacacacaaacacacaaagaacgagacgaaaaaaacgcgagagaccgaacaaacaaaaacaaaacacaagatggaaatggccacaagagcccagaaaaaaagacaaaaacaaaaacaccaagacaataacagacagacacaataatcgaagcaaacaagtagtaacaagcaggtcgcaaccagggacaaatgtacaccagtagcacacaaacacaacaacacaccaacacacaaacgagaagaagcacaacaagaaaaacgaccacaaagaagagagaaaaaaacaaaagaagagtagaaaaaaccaaaagagagaaaaaaaagacacagaactagaaaggacacacgaaaaagaacaacacacaacaacaacgcgaaaaggagaaccagaacgaggacggcgaagcagcacgaaaaagagaagaagaagaagcaagaaacggtacaagtaacaacgaggacgccacacaacacaacaacaaagcagacacaacaccgcacgaagcaaacaccacacgagaaaagacaagcagaaaacgacgaagaaaaacaaagaaggaccagacagcaacacacgagaaccgaaaccacgacacgaaaaaaagcaaaaaacacgcagcgac

SEQ ID NO: 487008 - DNA, 872 bp, Homo sapiens
aggggggtccaggcccttcttcctttggggggaacccgcttcgaccttaactttggagggttggatgtggtccccgccccacaattggggaattttctgggggaagaaatctttggggggtttatttggagaggagattatgtgacctctttggaaattcttgtcgcgcgagacttttggggaaggtgccccgtgcatgcccccgctgctttagaccgggttgccggcgctcaaccaatggttggggggtattatttcgcggcattatcccccgagggcgcgagcggggttcgtcggaggccaggctctggttgtggggaacacgcctgtgtctcatgtgacgcccccagggcttctcctgttaggaccccccccggcctccgcctaattattactcttttctttgcccgctgccccgaagcgatcctattgtgcgaaccacgcctgtgggatatctccctgtgcgccgaccgcgctcccacatctcgagacagacccccaaaaacgctttcccccccggaagactttagacctcgccctctgtgcctttccctcccccctcctatagccagagaacaccacttatatgtgggagcaaccgtgtttaggaagattaaagagtaggcaccaccgctttgatattttacattgggatttcatctggttatatatagactttttccccaaaacttatttcccccacccaaccacgacacccaaatataccatgatttttccccttaaattttataaaaattgggggtttttttttttaaaaaaatttttctttttcaaaaaattcttctccatttttgtgatttttttttttttgggaaaaaaaatagattttttaaggagtttcccccccccca

SEQ ID NO: 487009 - DNA, 218 bp, Homo sapiens
catctgcttctgcgctgaatcttctgtagctgtaaggcattttacccctttgtccgtccagcatcccttcacgtcctcatcctctctaacatttatcttgtctattattcatagttttttccatgtaggtttagctcctcaggtctatttacgtccttctaatcatgtgtgaacagtggtgtctgtcttgtcggcgctgacatatacgacatgaccga

SEQ ID NO: 487010 - DNA, 104 bp, Homo sapiens
gccaagctacctcgtggagtctttgtttgtatccgacaaagagctaggctaagggcgagggctccatctgatcagatttggtggtcagcagcagcagcaggacg

SEQ ID NO: 487011 - DNA, 261 bp, Homo sapiens
ggcagctatccggttcaattaggagaaatagcatgggcaaggtcctgaataaagggagggtatgggtttaaagaatggaaaaacagcagcgtggtttggtaagagaaaggaagaatggcaacagagaaagtagcagaaaaaataggggtcatatcatgcaggacatttcagcccatgggaaggagtttgtattttattttaaatgcagtcatttttattgctgtctgtctttgtgcacaactgattgaaccggatagcttg

SEQ ID NO: 487012 - DNA, 172 bp, Homo sapiens
gcatccaatctgcctgattctgctgattctacctccctaaaaagccctcaaggccaggtgtggtggctcatgcctgtaatgctaccactctgggaggccgaggtgggaggatcacttgagcccaggagttcaagaccagcctgggcaacacggcaaaagcctatctctacca

SEQ ID NO: 487013 - DNA, 592 bp, Homo sapiens
  misc_feature (20)..(20): n is a, c, g, or t
  misc_feature (23)..(23): n is a, c, g, or t
  misc_feature (29)..(29): n is a, c, g, or t
  misc_feature (133)..(133): n is a, c, g, or t
cggccggggcacgaatcccnctntctctngggatagcagagccgctctaagttgctccatatcattggagtatagggtgctggtgtttggtttcttcatgcgttactggactcagatttaagcggtacaaagngaaacgctctggccgtcacacgtaggacgcaggaaggtcactcgtggtgaggctgacatgctcacacagtacaacagtagagggggaagatcctaagacaggggaactccagagatgagtggcggagcgcttcagttcagctttaaaggccaggacggcgcacacgtggctggcgcgctcgttccagtggcggcacgtccttgggcggctctaatgtctgcagctcaagggctggcgctgtgttaagtataaaaatgggtgtgatttttatgttttgttgtaaagtgattgttggtcttctgttgacattcggggtgatcctgttctgcgctgtgtacaatgtgagatcggtgcgttctcgtgatgttttgcggtggctgtgggggttgtacgcgggaccagctcgcgtaatgcattgcctgtagcaatgtaagaaaaggcctgtttctttaaaaaaaa

SEQ ID NO: 487014 - DNA, 259 bp, Homo sapiens
ctctaaggatcctacacgctcgtacgacgcgtatgagcccgaattatatcaatagaatgggatgcttttagattaaatgaaggtgacttaaacagcttacagtttagtttaaaagttgtaggtgattacaataatttgaaggcgatcttcttaaaagagattaaaccgaaggtgattaaaaagatcttggaaatctcatgactgcaggggcgaaattgccgtcactttaacagccctagtttaaccgcagtttaactaa

SEQ ID NO: 487015 - DNA, 201 bp, Homo sapiens
taaggatcccctgttgaccaggtaggggagtgtggtagacccagaaacttctggggacgtcagtcatatttactaatatttggaggcagtgggatgcatgctggtcccctaaggttgatgcgtatcacgttacgagcacgaacaattcgtgacctacgagctggttttctccttctggggtttccgcgttgtacggttgac

SEQ ID NO: 487016 - DNA, 1505 bp, Homo sapiens
  misc_feature (211)..(211): n is a, c, g, or t
gaccaaatgggcggatgacgccggtgcagggggggcgtgcccgcggggccctggtggacctgggatggtgtaaccgcggttggtttccgtggaagtgtttcgtcacgggtggatcccggtggccagtcggctcgctgagcccgtggactgcgtggccggaggccgaagtgccggtgtgaagcctcagcgagaacgcagaggtccgaaggantaacgtgaagtagtcatcgcccagttagccaaacgtatggcgctctgcgttgggtcgatagggacgattagtcgaattcaagtcccgtgagcggagatctagtcgtcgttgctcccttgtccacttaatcggaattcagaagactctatcgagtattcttcccttggggcgcctcttctgcaggaggatcgaagggattcaagaagcaatttagttgccaccggatgcagtagaggcactaggcgcagttgccggagaccatcgtgcatcctatgggttcaagtgggcaattgaagtgctagcgtagatacggggggagcctatcatagattgggcacaggagtactgcggtctggcagttgtatcaattgttgcgcttcacttaagttagtaggtgctaggaccattgactggcccatttacccggttggggggggcacaattcaattccccttagaggacaaaaggatttcttccaattacggatacccgctgggtgcagcacgaggggcttaacttgtggtggggcaaatcagaatgaattcggggcgatatggcccgcgcgaccaaactttgtctcccccttttggccggaggaagttcgcacctatgggccgcaggtagacaaggcgcttcctttgtatgcatgggataaccggcccattcagaatccccctttgacaagcctcgaaggggtacctactttgggcgcaagttccgtaccttcccctgattatccctttggtgggccccttaaaggaaagagtcttgcttcgatttgtagttggcgccgttgggactccatccggaagtggaccgtggctgttaactagcccttcaagggcgctccagggtggtgcattgtccgagcgtttgtcgcaagaccaccgttgagggcgataaccatttcggagccttagaaacgggtgcgagcaccgtttttggagggtgcccaggaattttctcttagtatggaacccttaaacgagggggttagccgtttggagcccgccccgaaccgtccgttggaaaacgggaggacctctgggttatttaccagcaccaaagaggttttcgccttaaatttcaagcggaagggtttccaactttggactccgagcctttccgggttcaaaagagagccgcgcagagagcagaagagaggtccttcccccgcgtgggcaggctggggagctcccaggggactccccaagagcttggtggggttaagcaaacgagtatgggcggtttttaagttaccgagtgcacacaagatctaaagcgtcgcaagttc

SEQ ID NO: 487017 - DNA, 198 bp, Homo sapiens
tgactagggggggggggtttgctttgagggaagtacgcttattttttttttttagtctttggttttctttttcccttttttctgaaaaaggggttctcgctatttttccccaggcgttctcaaactcctgggctcaacctatcctcccgccttttaccccccctaaaacctggaattacaggcgtaacccaccgcccc

SEQ ID NO: 487018 - DNA, 395 bp, Homo sapiens
  misc_feature (331)..(331): n is a, c, g, or t
  misc_feature (342)..(342): n is a, c, g, or t
  misc_feature (367)..(367): n is a, c, g, or t
  misc_feature (371)..(371): n is a, c, g, or t
  misc_feature (373)..(373): n is a, c, g, or t
aaaattgggcctttaaaaaaaaaaaaaaaaaaaaaaaaaaaaaaaaaaaaaaaaaaaaaaaaaaaaaaaaaaaaaaaagcgctcgtcgcgcaggcgcttctggtcctcctccgagaggcccttcttgaagcccttgacggcttcgcccagatcctggccgatgttgcgcagacgcttggtgccgaagatcagcacgacgaccgccagcacgatcagccagtgccagatgctgaaactgcccatggggtggctcgcggtgggaaggagggatcgaaggataacgcagcgcccgccggccgccgtgtgacggcgcgtccgtcagggcagcggntcgaccttggncgggctctcgacggtctcgaacggntgcngngtgggctcggtgggggccggct

SEQ ID NO: 487019 - DNA, 441 bp, Homo sapiens
aggcttcaggaactgcgcaaggaggaggaggttgcagtgggccgagatcctgccactgtactccagcttgtgcaacagagtgagaccccatctcaaaaaaaaaaaaaaggaaaaaaaaaaaaaatttttgggcggcttgggccttggaaaaagttttttaaacctttggtttgggggcggggccccaggtgggtacgtgtggacctggggccaaaaggcgtggtccctaagggaaactccggggccaaagagacaaggtggcgtggagttctttcaaccaattaaaaaaagcgcgccggggggggacaccccgagggcgttctcttggaacaattctcaagaagtgggagttccgaggaaggccataacggggattctatcaccggggaggtccaaggaagacgtctcagattttcatatttaccgcccggtcctgtagct

SEQ ID NO: 487020 - DNA, 303 bp, Homo sapiens
  misc_feature (76)..(76): n is a, c, g, or t
cctggatccatccagaatacatttcctttagtcatcatgtctcctgtggctcttcttggctgtgacagtttctcanctgggcagggggtgatgaacttgccattttcatcagattgtaccaagacctactatcaatatgacttatgactagtggtgttgaccttgatcacctggctgaggtagttcttgtcaggcttctccactgtcgagttgctctccccatcccccttttccatggggtactctttgaaagaaagtcactatatgcagcccttccttaaaaatattaaaatgaactagctt

SEQ ID NO: 487021 - DNA, 1092 bp, Homo sapiens
  misc_feature (114)..(114): n is a, c, g, or t
  misc_feature (329)..(329): n is a, c, g, or t
  misc_feature (443)..(443): n is a, c, g, or t
gctgagaggacgcgcgtgagcgtcgcgggagcctcgtggctaccactgagcgacgtggctattggtgaaaggagaggttggctgcaacgagaacagaggtggtagattctatcnatggtaccttgagactggcacacgactactttctcgtctcgtcacagcaatgactggactaccctatcaatatggcatactatatggaggcggtctgccaagggtattgtggacctagacgtgatggctcctcgctcgaacatatcttgttcttcatgctcgagctgctaggtagctccagccgtagtagtggcaatgcactggtatgcggagcntccccgtggccccaatcagcttctcatgcgatctctgaatgacacgtgacgagtggagcacacaacttcgtacatcaggaacagcaacacattccgatagtgggcagagttccntgaagtgaagcgcggtgaaggatgttgcgcacaacacagcacgatgtacgaggagcaatgtgcgcatgatcgcgcgccatctagcagaatgcaacgcgagggatgcgacgcgagcatgcgacctctaacggttcggtggcatcgatccacgagactggaccacagcggtccaaagcgggtgccttagagacccataatctggcggaggcggtgttgcgcaacatcgagggccctaaagactcactacaaaacgagcccgaaaaggaagaacttctacttcggagaggcaaacactgttgtcttggaagcttagcacctttgaagacgcctttgttcttgcgcccgggatcggggggcaccatttcactgcggaccccacgtgcttgaagtgcacctcggcgctatgccaagagtgtgagggaggcgacaggtatgccgacactggcttccaatccttaaagcctctaccgagattccaaatgcttcgacaagagaatcacgagcaattggtacaagtacgtgaagtgaaggcaacaccgcgagcaagtaggaggttgggggacacccgggcacccaacatccaaccgccgggaagaaaaaccctgcggtttcaccttgttcgaggaaaactctccccagaggtagaccc

SEQ ID NO: 487022 - DNA, 548 bp, Homo sapiens
  misc_feature (31)..(31): n is a, c, g, or t
  misc_feature (67)..(67): n is a, c, g, or t
  misc_feature (108)..(108): n is a, c, g, or t
accccccacgttccaaccacccaattcatgnctccagctcgacgtgtattcaccactgcggtgcatncctccctgtacaagctccttggacacgtgagctccgtgctnacctcccaatctcgcaaacatggagcctggtcgacgtgtattcaccactggcggtgcatgcctccctgtacaagttccgtcgacacgtgagcaccgtgctgacctccaaatatcgttaagctggagcctggtcgactttagaggatcctccagtacccgagcatgcatgcatgcctccagctcgacgtgtattcaccactgcggtgcatgcctccctggacaagttccgtcgacacgtgagcaccgtgctgacctccaaatatcgttaagctggagcctggtcgacgtgtattcaccactgcggtgcatgcctccctgtacaagttccgtcgacacgtgagcaccgtgctgacctccaaatatcgttaagctggagcctggtcgactctagaggatcctccagtacccgagtcgattcactggtaccgagcgcatgtata

SEQ ID NO: 487023 - DNA, 757 bp, Homo sapiens
  misc_feature (698)..(698): n is a, c, g, or t
  misc_feature (701)..(702): n is a, c, g, or t
  misc_feature (705)..(705): n is a, c, g, or t
  misc_feature (725)..(725): n is a, c, g, or t
  misc_feature (733)..(733): n is a, c, g, or t
cgctgctgctctggcgttctagaggatcccgacatgacccaagcatgcatgcatgctgcaggtcgacgtgtattcaccactgcggtgcatgcctccctgtacaagttccgtcgacacgtgagcaccgtgctgacctccaaatatcgttaagctggagcctggtcgactttagaggatcctccagtacccgagcatgcatgcatgcctccagctcgacgtgtattcaccactgcggtgcatgcctccctggacaagttccgtcgacacgtgagcaccgtgctgacctccaaatatcgttaagctggagcctggtcgacgtgtattcaccactgcggtgcatgcctccctgtacaagttccgtcgacacgtgagcaccgtgctgacctccaaatatcgttaagctggagcctggtcgactctagaggatcctccaatacccgagcatgcatgcatgcctggaggtcgacgtgtattcaccactgcggtgcatgcctccctgtacaagttccgtcgacacgtgagcaccgtgctgacctccaaatatcgttaagctggagcctggtcgacgtgtattcaccactgcggtgcatgcctccctgtacaagttccgtcgacacgtgagcaccgtgctgacctccaaatatcgttaagctggagcctggtcgactctagaggatccttcagtacccgagcatgcntgnntgnttgcaggtcgacgtgtattnaccactgnggtgcatgcctccttggacaagtt

SEQ ID NO: 487024 - DNA, 195 bp, Homo sapiens
tgattatcatctcgtctactgcttcttggtactattcccgtcttgagggctagtttgctcccgcctctaggtatgccacctggtgaagggacagaagactgcacggttacaggagccgggaccgcccttgtggacgctgaggcccactacaccttcctagcccggcctgttggcccgacctagctagggtcccat

SEQ ID NO: 487025 - DNA, 310 bp, Homo sapiens
agtgtgctgcggcgattctagaggatcccgacatgagccaagcatgcatgcatgcctgcaggtcgacgtgtattcaccactgcggtgcatgcctccctgtacaagttccgtcgacacgtgagcaccgtgctgacctccaaatatcgttaagctggagcctggtcgacgtgtattcaccactgcggtgcatgcctccctgtacaagttccgtcgacacgtgagcaccgtgctgacactcctaatctcgttaaactggagcctgctcgatctatagaggatcctgctataacccgtttccgagtttatagta

SEQ ID NO: 487026 - DNA, 471 bp, Homo sapiens
cgctgctgctctggcgttctagaggatcccgacatgacccaagcatgcatgcatgctgcaggtcgacgtgtattcaccactgcggtgcatgcctccctgtacaagttccgtcgacacgtgagcaccgtgctgacctccaaatatcgttaagctggagcctggtcgactttagaggatcctccagtacccgagcatgcatgcatgcctccagctcgacgtgtattcaccactgcggtgcatgcctccctggacaagttccgtcgacacgtgagcaccgtgctgacctccaaatatcgttaagctggagcctggtcgacgtgtattcaccactgcggtgcatgcctccctgtacaagttccgtcgacacgtgagcaccgtgctgacctccaaatatcgttaagctggagcctggtcgactctagaggatcctccagtacccgagtcgattcactggtaccgagcgcatgtata

SEQ ID NO: 487027 - DNA, 104 bp, Homo sapiens
cgctggccaatggcagtacacagcatcatccttggcaagaatctactaccttccacagcggccaggctccactgaaacaacactcttacctgacaacacacagc

SEQ ID NO: 487028 - DNA, 825 bp, Homo sapiens
  misc_feature (7)..(7): n is a, c, g, or t
  misc_feature (130)..(130): n is a, c, g, or t
  misc_feature (143)..(143): n is a, c, g, or t
  misc_feature (169)..(169): n is a, c, g, or t
  misc_feature (258)..(258): n is a, c, g, or t
  misc_feature (275)..(275): n is a, c, g, or t
  misc_feature (367)..(367): n is a, c, g, or t
  misc_feature (382)..(383): n is a, c, g, or t
  misc_feature (474)..(474): n is a, c, g, or t
  misc_feature (494)..(494): n is a, c, g, or t
  misc_feature (497)..(497): n is a, c, g, or t
  misc_feature (504)..(506): n is a, c, g, or t
  misc_feature (805)..(805): n is a, c, g, or t
gcctgcngggccctccagtcccgctggggggttttactttttcccttgtccctttgggccattgattccccccattttcaaataaatccttattccgactcccctccgttggaaagttttgctgaaaatntttctggataacncccaaaacccctcctgttggaaatcncctgtccttcccctttgggacccttaaggggggtcccccggggaccctggtattaggtgaaaatggttcctggggtcccccgtgttgtncccccccttgggggccnccccccagcttagatgtgacaaagttccttctcatttggctgttccctcagggtaggcctagggtgggggggggggaaaaagattcctaaancggccaatttttaannattctgctttggctggttttgtgcttttatgggtggctggtttctaagaatcatttttcttcaaggggttttttttcggggggggggctanatgtgttgtgcctttccttntcntcccggnnnccccctgtggtatttcccaccttctccccctctctactttcatgaaatagtaactatttcactacaaacctatttttcactaaatacacacatttcctaatcctggagcctcctgggaaaagcagtgggttctccctgggtcttgcaagactccagtgttcacaggagagtgtggggaatagcttcaccccgtctcctgggatgggctttgtcagaggtcacgtgcagagacgctatcagacttccaccaggcatgtttaagcaattacccctacttgtaccagttatgtgatttcccnatctccaacacttcccctta

SEQ ID NO: 487029 - DNA, 465 bp, Homo sapiens
  misc_feature (42)..(42): n is a, c, g, or t
  misc_feature (44)..(44): n is a, c, g, or t
ggctgttctagaggtacacggacgatgagccaaaacatgatncntggttgtaagatcgacgtgtattcaccactggcggtgcatgcctccctgtacaagttccgtcgacacgtgagcaccgtgctgacctccaaatatcgttaagctggagcctggtcgactttagaggatcctccagtacccgagcatgcatgcatgcctccagctcgacgtgtattcaccactgcggtgcatgcctccctggacaagttccgtcgacacgtgagcaccgtgctgacctccaaatatcgttaagctggagcctggtcgacgtgtattcaccactgcggtgcatgcctccctgtacaagttccgtcgacacgtgagcaccgtgctgacctccaaatatcgttaagctggagcctggtcgactctagaggatcctccagtacccgagtcgattcactggtaccgagcgcatgtata

SEQ ID NO: 487030 - DNA, 345 bp, Homo sapiens
ggaggtggaggttgcattgaggtgagattgcgatgacactgcacactagtctgggcaacaagagcaaaaactctggccaggcgcggtggctcacgcttgtaatcccagcactttgggaggccgaggcgggtggattacttgagcccaagggttggagaccagcctggccaacatggtgaaaccctgtctctactaaaaatacacaaattagctgtgcgtggtggcttgtgcctgtaattccagccacttgggaggctgaggcaggagaatcacttgaacccaggaggtggaggctgcagtgagccgagatgtcgccactgcactccagcctaggcgacagagtga

SEQ ID NO: 487031 - DNA, 284 bp, Homo sapiens
ccccccccccccccccctcccttgggaaagggtttaaaaccccccaaagggggccccaaaaggggggggtttggggggggggaccccccaattaaaaccccttggggtctctggaaaaactatggggtttaaaaaagattcccccatggggctttaaaaagcgggggaaaattaaaggggagccgccctggttaaaggggaattttttttagccttttaacccccttgggttttttggttttttttccccaaaaaaaaaaaaggtttcgccccttttgctttta

SEQ ID NO: 487032 - DNA, 452 bp, Homo sapiens
cctgtgtaaaagacggacctggcatgatcgtgattcgtgaagtccgaggcgttgcaccacatgcggtgcatgcctccctgtacaagttccgtcgacacgtgagcaccgtgctgacctccaaatatcgttaagctggagcctggtcgactttagaggatcctccagtacccgagcatgcatgcatgcctccagctcgacgtgtattcaccactgcggtgcatgcctccctggacaagttccgtcgacacgtgagcaccgtgctgacctccaaatatcgttaagctggagcctggtcgacgtgtattcaccactgcggtgcatgcctccctgtacaagttccgtcgacacgtgagcaccgtgctgacctccaaatatcgttaagctggagcctggtcgactctagaggatcctccagtacccgagtcgattcactggtaccgagcgcatgtata

SEQ ID NO: 487033 - DNA, 403 bp, Homo sapiens
taattttttattttgataaaataaatataaaatttgccattttatccatttttaagtatacaattcattgtcattaattacattcaaaatattgtgcaaccaccactattatctctttgggggttttttgttttgttttgttttgtttcgtttttgagatggaatcttgctctgttgcccagtctggagtgcagtggtgcaatctcagctcactgcaacctccgcctcctgggttcaagtgattctcctgcctcagcctcccaagtagctgggactacaggtgcataccaccatgcccagctaaattttttttgtatttttactagagacattttttttgtattttttgtattttcccccatgttgagcaggctggtcttgaactcctgactcaggtggtgtg

SEQ ID NO: 487034 - DNA, 450 bp, Homo sapiens
  misc_feature (18)..(18): n is a, c, g, or t
tgactctaaggagcgtantagaccaagcatcatcgtgcgggattgacgtgtatacaccacgcggtgcatgcctccctgtacaagttccgtcgacacgtgagcaccgtgctgacctccaaatatcgttaagctggagcctggtcgactttagaggatcctccagtacccgagcatgcatgcatgcctccagctcgacgtgtattcaccactgcggtgcatgcctccctggacaagttccgtcgacacgtgagcaccgtgctgacctccaaatatcgttaagctggagcctggtcgacgtgtattcaccactgcggtgcatgcctccctgtacaagttccgtcgacacgtgagcaccgtgctgacctccaaatatcgttaagctggagcctggtcgactctagaggatcctccagtacccgagtcgattcactggtaccgagcgcatgtata

SEQ ID NO: 487035 - DNA, 505 bp, Homo sapiens
gaatgtccagacctggacccgtgaagtcctcagctcctgcagctttgaagtgcttctgaacacaccacatccatcagcagtggaatgcaaagtcccgaacaaaccgaaggaagcctgcagccaagccggggcagtttcagtctccaccccaaatccaggactgtagaaacggccaggaagaaaaccaccccctcttaaggttgttattgtgaccgttctttggaccatttttttaaaaatgggaaattacatatttctgtgccaagggcaacaaacacctgcagttaaaggactaccttccgcgaggcgccctttcggagcatccatttttatagttccagccaggccagaccgaggggtggtgcataacccctgcttggtgcatttctttacttgcaaggggacagatgtgtgggcttaagtttgggattagagggggctctggcacatatggtgctcaggtgattatccatcgttcgtatagccaataaacatttatcacgca

SEQ ID NO: 487036 - DNA, 499 bp, Homo sapiens
ctacatcataaatgttaggaacagtatatgccactcactgaaactgcatcatagttatgcaattatgtatgtttcattagccaaaaaacagcttacatgtgtatgtggactgtactataacgtcacgctatctagatatacataagaatatgatttttcccatacgtataacttcacttgttattcatcactgattatttgggttacattggactcatttcaagcaggtcgcttttgtacatctcgtgtattagaaacctaatagtgtaatttgatttgagccataaaacacattttaatattagcttgtatatatagttattaagcttgtttttgtggaaaaaaaacttactaaaacctaggtaactctagattaggccagttcaggtgtattttgtatctttagtactggatcatatcgtaaaaatagagataaagttgggaagatatattgattatgctgttctttgaggggaaaagaccctggggtaccgagctc

SEQ ID NO: 487037 - DNA, 356 bp, Homo sapiens
  misc_feature (188)..(188): n is a, c, g, or t
tgagatggaatctcactctgtcgcccaggctggagagcagtggcgcgatctccgctcactgcaagctccgcctcccgggttcacgccattcccctgccttagcctcccgagtagctgggactacaggcacctgtcaccacgcctggctaattttttgtatttttagtagagacagggtttcaccctgnttagccaggatggtctcaatctcctgaccttgtgatctgcccgcctcggcctcccaaagtgctgggattacaggcatgaaccaccatgcccggcctggagcctgtgatcttaaccactcacttacaagctgtaactcactcatttaaaacctgtgccatcggtcgacg

SEQ ID NO: 487038 - DNA, 447 bp, Homo sapiens
tctagagcactgacctaagcactgcgactgcactgcgctgcatgtcgacgtttacacgcggtgcatgcctccctgtacaagttccgtcgacacgtgagcaccgtgctgacctccaaatatcgttaagctggagcctggtcgactttagaggatcctccagtacccgagcatgcatgcatgcctccagctcgacgtgtattcaccactgcggtgcatgcctccctggacaagttccgtcgacacgtgagcaccgtgctgacctccaaatatcgttaagctggagcctggtcgacgtgtattcaccactgcggtgcatgcctccctgtacaagttccgtcgacacgtgagcaccgtgctgacctccaaatatcgttaagctggagcctggtcgactctagaggatcctccagtacccgagtcgattcactggtaccgagcgcatgtata

SEQ ID NO: 487039 - DNA, 1401 bp, Homo sapiens
actgctcgctaacttcatccacacgcactcctgcccgcacatgcgcaacgccactcaccacacacgcgccctgcactgccacaccatgcaaccatcgcccacccgcgcccctccagccaccctcgccccgcccctcgccgctcctccctactcccgccccactgccctgcacaacaaacggcggcgcccgcaccccacaccctcgacccccacaactccgcgcccccacgcctcccaccactccacacacccgccctgcacacccccaccccacccggcactccggcccgcccaccgcacaccacccacctatcccctccacccaccaccccccccccccgcgcccacacaccacccgccccacgcgcccccccacccacgcccaaccaccgccacccactccccgcccccccccctcatacactcacgcctcccacccccgccccggccccaccccagccccagccgcccactcccaccctcccccacaccacgcaccccaccccacgccccccccccacacccgacaccccaccgcccccacccccccccacgccccccccacacagcccctcgcaccacccccccacaccccccgcacccacccaacacccagcccccccaaccccgcacccccacacccacccccgacccccccccaccaccacaccccccgcagcgccaccgcccacccccacacccaccccccccacgacccccccccacaccccacccgccgccccccactccccccgaccaagccaccacccacacacacacactctggcccctcccccctcaccaccgcaccacccacccaacaaccgccccaccccacctcaccccccccaccgcccccgcccccccaccactcccccacccccgcaacacccccgacaccagcgcaccccacctccccccccacaccccccccccaccccaacacacgaccccgcgccaccactcgccccccccgacgcacccccgcgcttcccctcccctcccctcccacggacgccaccacggccgccacatccctacgctcgcaaccagactcacgtcgcactccactcacatcacccacacccgccgacaccccctactacccacctcccccaacctcccacccacacctatctcacgcctacatagcacctcccccgccagaccacacaagcatccccacaactaaccaactgccgacacgtaacgccccgcaacacccctcctcgcacgcacatccgccactcaccgagccgccctcctacccaagcgactgggccacacacacccgaccaccccccgcccacacccaccaccctaccgccgcaactcacatacctcgaacacgctaccgcaacacacagctgaacacagacacaaacacggagccggcacgcc

SEQ ID NO: 487040 - DNA, 710 bp, Homo sapiens
cgctgctgctctggcgttctagaggatcccgacatgacccaagcatgcatgcatgctgcaggtcgacgtgtattcaccactgcggtgcatgcctccctgtacaagttccgtcgacacgtgagcaccgtgctgacctccaaatatcgttaagctggagcctggtcgactttagaggatcctccagtacccgagcatgcatgcatgcctccagctcgacgtgtattcaccactgcggtgcatgcctccctggacaagttccgtcgacacgtgagcaccgtgctgacctccaaatatcgttaagctggagcctggtcgacgtgtattcaccactgcggtgcatgcctccctgtacaagttccgtcgacacgtgagcaccgtgctgacctccaaatatcgttaagctggagcctggtcgactctagaggatcctccaatacccgagcatgcatgcatgcctggaggtcgacgtgtattcaccactgcggtgcatgcctccctgtacaagttccgtcgacacgtgagcaccgtgctgacctccaaatatcgttaagctggagcctggtcgacgtgtattcaccactgcggtgcatgcctccctgtacaagttccgtcgacacgtgagcaccgtgctgacactcctaatctcgttaaactggagcctgctcgatctatagaggatcctgctataacccgtttccgagtttatagta

SEQ ID NO: 487041 - DNA, 1821 bp, Homo sapiens
aggaggatttggtgcagtgttgtgtatgcgaggtggagcgtggtttggaggggggggcggtagtgagcgatgtgggattgtccgtaggaggaaaatgagggagggtgggtggagggtgaggggaatgaggagctggggggtagatgttggtgggagttggttgtgtaggaatcatgatgtggtttgagttggtgagggatggatggggtggagggtatggtttttgtggatggggcaagttacggcgaggtctagggcgactcactcggcctcggcggccgcgcgcggcggggtggccgcctggtggagcgcgcacgcacgacagatgcgtcgaggagctgtgctgtgtcgggctcgggtgtgtcgtggcgggctgcgctggtgtggcggcgggatcgggcgtgccgcggcgggcgtgtcaccacggtggcgcgatgccgagtgtcgttgtggctgctgacctgcgctagctggcgcgcgtttgtggtgggttagtttatggtgtgtactggatgagtgtggtgggttagtgttttgggtggtagggtatggggtgaagtggtgggttgtgtggtgtggtgtggggagtcgttggtgtgtgctgttgggtatctgtgaggttggtgtgtcgtgagtgtgttgattgtcgagcacggagtgggggtggagagagggagagagaatagtgatatgtggagtgtggggatgagtggagtgagtggggggttgagctggctcgctgatttaggacttatgactgacgagtctgctcgcgccgtggccgttgtgcacgctcgcgggtctggtgagcagagctggggtctgggttgcgtggtatgtgcgggtatgccagcgcgtgcgccgctgtcggtgcagcgaggacggcccgccccacggcacgcaaccttactgtactactgcgagccagcattgctcatgcgagggggcagcaggatattagggtggcattaagtaattagaggaagactaatagcttgagtttctctatttgttgtaggtgttacaataagtagtcgagtgctgaacacgggattgatgaacatactacagtgggtcggtctcagcacgagatggttatataccagaatacggcccatgtgatcagtgggcacgctttaataactatgggagacggacggagtagtggacctccaatatgttagtggagccctcatgtcctatattagtgcagctgttgaaaggatattggggaaaggtacttcttgagtgaatgcttgcactgactgtcgctagcatgtgttgacaggtgtgacttggctttgtaggtcgatgcaggcaggacgtgcatgggtatgtccatgtacctaccctaccgaggcgcagagtgtgagctcagtatagggtagattaaggttgcgtcatgtgggttaaaccaggagtgggtcagcgtgcatgggccgcagtgcgtttgcgtgggctttgctggctgcgcttcgatgcatctagtctccagtgtaccagtcgtccgtgtggaatgtgggtggcgtcagtgtggatgacccagtgaagtcaatgggctccgcacgttcagccaacgactgatgagtgactcatctctgtcaccctagcacgaataaagaaaggcggaatcaagatagacaacatagcaacaaggaatcacaaaatcagacaccaaagaaaaacaaaaataaatacaacaaaaatataacaatacaaaaacaataaataacaaaacacaacaatcacatcattactacaagaaagctaagcatataaataataaataaaacaaaaaaaatcaaatatcaaacaaatcac

SEQ ID NO: 487042 - DNA, 476 bp, Homo sapiens
cgctgctgctctggcgttctagaggatcccgacatgacccaagcatgcatgcatgctgcaggtcgacgtgtattcaccactgcggtgcatgcctccctgtacaagttccgtcgacacgtgagcaccgtgctgacctccaaatatcgttaagctggagcctggtcgactttagaggatcctccagtacccgagcatgcatgcatgcctccagctcgacgtgtattcaccactgcggtgcatgcctccctggacaagttccgtcgacacgtgagcaccgtgctgacctccaaatatcgttaagctggagcctggtcgacgtgtattcaccactgcggtgcatgcctccctgtacaagttccgtcgacacgtgagcaccgtgctgacctccaaatatcgttaagctggagcctggtcgactctagaggatcctccacgacaggtattaccacgtcatcgaacgttgtaagagcgacgcc

SEQ ID NO: 487043 - DNA, 105 bp, Homo sapiens
cccgtatacgctgagtgtggtttagcggatcctggccttcccgtgtaaccagttcgggaagcaggagccaggagtaacgaagagatcaaagagttcgccgcggag

SEQ ID NO: 487044 - DNA, 719 bp, Homo sapiens
tggggggggggaaaattattccctaggggtgtaccccccgggttgggacctttcgccaaatccccccttttcccaaaggggggcgccgggggggggtgcgtgctacattgatacaccagtaggatgctggcccagcaacttggatcttggggggggacccccgatgtgtccacccggtggccagaaaacaacagagatggggttggatcattacagtgtgtggtgagaaagccgcacgaggaagaagatagctggtgtgttctagcaaaaaaatatggaggcacgacatggtgggacacacgttgtggcgcactgtctgtcataaccccgctctcagggatccagacaagcaatcttattaccctcaccgacgccaataaagggcctcgggggaacatataagacaaagccaacagctgggaggggcgccagagaagggcgcccacccagagtaagtagctcaccacagaagagcgcccaaaccaacccacaggatgatatcaaacgatctacaagggcgacaattgtgaggaacacaggcggccacaggatataagaggaaaaacactatcgtggggagaagtggccacggctcagttcatgagaaacacaagaggggcgctccatcttacaaaaatagcacccaggatgagcaaccaaataaggctccagtgaaaacaaaccacagaagcaaaggaggagccataggagaaaaagac

SEQ ID NO: 487045 - DNA, 773 bp, Homo sapiens
  misc_feature (10)..(10): n is a, c, g, or t
  misc_feature (12)..(12): n is a, c, g, or t
  misc_feature (40)..(40): n is a, c, g, or t
  misc_feature (66)..(66): n is a, c, g, or t
  misc_feature (85)..(85): n is a, c, g, or t
  misc_feature (114)..(114): n is a, c, g, or t
  misc_feature (121)..(121): n is a, c, g, or t
  misc_feature (139)..(139): n is a, c, g, or t
  misc_feature (147)..(147): n is a, c, g, or t
  misc_feature (149)..(149): n is a, c, g, or t
  misc_feature (151)..(151): n is a, c, g, or t
  misc_feature (161)..(161): n is a, c, g, or t
  misc_feature (189)..(189): n is a, c, g, or t
  misc_feature (204)..(204): n is a, c, g, or t
  misc_feature (206)..(206): n is a, c, g, or t
  misc_feature (219)..(219): n is a, c, g, or t
  misc_feature (239)..(239): n is a, c, g, or t
  misc_feature (257)..(257): n is a, c, g, or t
  misc_feature (271)..(271): n is a, c, g, or t
  misc_feature (273)..(273): n is a, c, g, or t
  misc_feature (313)..(313): n is a, c, g, or t
  misc_feature (321)..(321): n is a, c, g, or t
  misc_feature (356)..(356): n is a, c, g, or t
  misc_feature (370)..(370): n is a, c, g, or t
  misc_feature (373)..(373): n is a, c, g, or t
  misc_feature (376)..(376): n is a, c, g, or t
  misc_feature (404)..(404): n is a, c, g, or t
  misc_feature (428)..(428): n is a, c, g, or t
  misc_feature (452)..(452): n is a, c, g, or t
  misc_feature (467)..(467): n is a, c, g, or t
  misc_feature (536)..(536): n is a, c, g, or t
  misc_feature (594)..(594): n is a, c, g, or t
  misc_feature (613)..(613): n is a, c, g, or t
  misc_feature (640)..(640): n is a, c, g, or t
  misc_feature (665)..(665): n is a, c, g, or t
  misc_feature (700)..(700): n is a, c, g, or t
  misc_feature (765)..(765): n is a, c, g, or t
taaaaaaaananatttattcagcgtcacgatcagactgtnacatttagcaatcaacagcatggggngcaaaaaaaaaaaatctanattaaaaccctttgttggaatgctttacnctttccncagaacagaaactaaaanaacctgtnananaattagtcanaaatacagtcctcgagttttttgcccanacacatgagtttttntntaaaacatgtttnctttgtagcagccaggcccngccaccactgtgcttggntgagttcacaaatntnttgtaacctgtagcttccctgttacttctctggctctccnctcctgcnaagctttgtttcctaattaaaatcttctgccactnccatagctactgcngcngcnggaaccgccaaagccaccttggtttcgnggttttgcaaagtattggcctccnccgccataggggccagagcttctncctccaaaatttccncccttcatgggtccaaaatttgaagactgattgttgtaattcccaaaatcattgtagcttccaccaccnccaaaattgcttccatcattaccaaatccattatagccatccccactgccaccatatncaccaccaccacggctgcnaccaaagccaccacgaccactgaagtntcctccacgaccgaagttgtgattnccaccgaaaccacctccacgaccaccaccaaagtntccagaaccacttcgacctctttggctggatgacgcactagccatctcttgctttgacagggctnttctaact

SEQ ID NO: 487046 - DNA, 673 bp, Homo sapiens
cgaaatgggagaaatgcagcgatgtgatgaggggaatgtgggctgccagtgcgagcaccctgtggagccagcgggacctgggcaggggcgcccggagcaggctgcgcatgcgtggcccctgctgcggggatccgtgctgtaagagagctgtagcactggctctgcactgagtcctggggcctgatgtaccattgtgagctgtgccagctgcccctctggctgctgacgctgcccatatgtgagcccccaagctgcagccccgtggcccagcccagaccctatccctccttcctggtgctggagtgtagtaagcagtgatccagctcacccatgctgggaggtgcagcaccatgatggaggggctcccgttggaggtggagtgcggcaaccccgcattgccccaaggcaattggcccttggcaattcccccagtggccttggacaggcaaatgacctcggacgtccccacaggaagcttgtgacatgccaagcctcaggggaacccctttgggcttgcagcccacactttcttgccgaaattgactcttggccacccctcaagagcttgtgcggcaccagaacgggctggtgtaattggttgccttgtgttggccccaatggcccaccggggaagttgcagaacacacccatctctcgccagccagggaggcag

SEQ ID NO: 487047 - DNA, 283 bp, Homo sapiens
agaagaaactttgtagtgactcctagaatctgcctgccatgggagaggactcgataatctaagggacattatcttgtagtgaaaaattatctccctcctggctgggagcggtggtagacaccttattatctcagcacattgggaggccgaggtgggtggatcacgaggacaggagatcgagaccatcctggtgtgacacagttaaacctcatctctgctaaagatacaaaaaattagccgggtgtggtagccggtgccctgtgatcccaggttactcaggagg

SEQ ID NO: 487048 - DNA, 374 bp, Homo sapiens
tctcctcctcatccacaaacagagtttttattgcttgaccaaggaacagttcgtccatttgtaattgccaattggacgttggagaaatcatcaaagtgctgcttgtcaccctcggcacaggggatccatatgggcataatagttagcccatatttcagtttgttccttaggtcactcagccacaggtaatagtcataaaactaaggaattcgggctgctttggcccaataagtgcagtaggtggggtaacatagcaccacttgtatctagaggtcgttcttgtcgcctcacacctctccccttgataaagtgctatgtgtcacccacagtaccgctatgtggccccgtcaacacagagtacacaaacaccagct

SEQ ID NO: 487049 - DNA, 868 bp, Homo sapiens
  misc_feature (53)..(53): n is a, c, g, or t
  misc_feature (57)..(57): n is a, c, g, or t
  misc_feature (60)..(60): n is a, c, g, or t
  misc_feature (74)..(74): n is a, c, g, or t
  misc_feature (79)..(79): n is a, c, g, or t
  misc_feature (86)..(86): n is a, c, g, or t
  misc_feature (90)..(90): n is a, c, g, or t
  misc_feature (110)..(110): n is a, c, g, or t
  misc_feature (112)..(112): n is a, c, g, or t
  misc_feature (148)..(151): n is a, c, g, or t
  misc_feature (153)..(153): n is a, c, g, or t
  misc_feature (165)..(165): n is a, c, g, or t
  misc_feature (167)..(167): n is a, c, g, or t
  misc_feature (171)..(171): n is a, c, g, or t
  misc_feature (192)..(192): n is a, c, g, or t
  misc_feature (215)..(215): n is a, c, g, or t
  misc_feature (220)..(220): n is a, c, g, or t
  misc_feature (230)..(230): n is a, c, g, or t
  misc_feature (280)..(280): n is a, c, g, or t
  misc_feature (308)..(308): n is a, c, g, or t
  misc_feature (330)..(330): n is a, c, g, or t
  misc_feature (342)..(342): n is a, c, g, or t
  misc_feature (363)..(363): n is a, c, g, or t
  misc_feature (387)..(387): n is a, c, g, or t
  misc_feature (393)..(393): n is a, c, g, or t
  misc_feature (402)..(402): n is a, c, g, or t
  misc_feature (407)..(407): n is a, c, g, or t
  misc_feature (533)..(533): n is a, c, g, or t
  misc_feature (557)..(557): n is a, c, g, or t
  misc_feature (562)..(562): n is a, c, g, or t
  misc_feature (566)..(566): n is a, c, g, or t
  misc_feature (571)..(572): n is a, c, g, or t
  misc_feature (579)..(579): n is a, c, g, or t
  misc_feature (688)..(688): n is a, c, g, or t
  misc_feature (800)..(800): n is a, c, g, or t
  misc_feature (861)..(861): n is a, c, g, or t
gttccaaatcttccggcagctaaaccagagtcaggtggcatggacagggagtngtcngcnctttccgggatagnaaatnccatctnagtncagcaagattcagtcatctncntttgggattggaacgagccaaacctacccggcagannnntnttcctacagctncntctncagcccagctacttcctcgcnaagtgggaatgcttactccagtnttgcnaacaggactncagggttcgctgaaagtggacaaagtagcgggcagttccaagggcggccntcggaagtttggtcgcagtggcaaagcnagcaccatggccagcagagcgntgagcagcattnccaccagcagctcggtcagantgaagtgttccaggaaatgttgcncatgcnaggagatcnaaccnaggggactggcaactataaaatggaagattttgctgacttgggcatgtttccactgttttttgagtagctgcggccagagtgaggctcctgctgtacagtgccacccatactgtgatgtggatgcncatgtgaatgaggccaaccttagntttgnttgntctgnnggagccncccaccagaagccatctcccccgctgtgtgtccccaggcgcatcatcgctccactctcccctgcagccgcggctgttcggccactgaccaggggccctggcagacattnggggatcagttgtatttattgtattttatctgtgtgtgctcaggaggtgagcctagtgggtccttaagtttggttgtgaataatctcttgatagacaatttatacccatganagttcagccaatgcccagagtgaccaagcaacaccagcaggcctgcccaggatgctgaaanagaattt

SEQ ID NO: 487050 - DNA, 971 bp, Homo sapiens
gtgtgttgggttagctatatgttttttgacacgcttggtgtgctttggagccgtagacggatgtaactatgtgtgcccagccggtcgatatgagcgcaattatgcgaactacagttccgtcggccgaaaatccggttcccctcgcggtgtcaccacgcgcaatgggtaccaaggtgtcccccgctatagggcgttcccctctggtcggccgtcgaacattttgcgtatgggtctctatcccgtgtgcccgtgtcgcaaagtccccacgcaacggtggttattgttccccttctcgcgcgttcccgtatttgccgctgtggatattttctgccgcgcccgtcattcgttggtcgtccgtgcccctgtccagttcctgagccttcccttacaaaacaggacgagggtcaacgggatgcgcctccgatgccacccaagccatggggcacccccaggtgctgtacctatacggggaccccccactttcggtgcgcggcttatgcttgccaactgcctgaacaaaaatctgttccccccgctattgttccttgtaaccccgcgcgcgacctctgcgagacttccgctgacgctgtgacaccacttcgcgagtatggtatattccccgcgctttgagcccccccccattcgtatttatattacccatctcaccaagacagttctgttgcgactccataaggactggtctccccaccaataagcgttgtataaacacagaaccccaattttctccggaaacgttttaaccccacccaacactttgctcccacgcacacaaaacgacacggtgtataataccgggcctcaacatcgtctctgtaaatctttttgggacccaacacacccatgtctatgccccactcccgtctcctagaaattattctccccttaaaaaattttgaaaaggggccctttttcccctttcccccccccttcccccctttgagcccaaaaaa

SEQ ID NO: 487051 - DNA, 192 bp, Homo sapiens
gtaacaagaagcttatagaggaacttagaaacttaaaagacatttgttctcccaaaacagattactagaaatattaacctatatactgacagcatgtcactgtattacgctcgcttgagcaggaatacaagtatatagctggcaggaatggtggcttctttactttgtatcattcatcttcttctttaatca

SEQ ID NO: 487052 - DNA, 106 bp, Homo sapiens
aagcgcatcattcaaataaaacaaaataaaaaagtattacaggcaagattaaaaaatttgcattacataatttacacgaaagcaatgcatcacctcacctgtgtct

SEQ ID NO: 487053 - DNA, 526 bp, Homo sapiens
  misc_feature (211)..(211): n is a, c, g, or t
gacttctgcacgtcaggttgtatgcctaggaggaaggtatggtgtgaagctgtctatggtccgaattgaggttatggcacgatgggatggtgatgtcttgtttgaggcggtgctgttcggtcggttggggggggaagaattcgtagcgcatctgcgtttttctctggtgcaggccggaggggagaaaaccaccttgccggagagatccccncccccgcggtctaagagcccaggagagctctggccccacctgttatgcccgcgagattccccggggtggatatatgcggataggagggttgggacatcgaggagagttgttcataaaagacttttcttcggaagagaaagggccgcggatttggaaaattaattggtgcccccactcggtcccccctcgagaggtttgaacacccccccccccaatttccagggttttttaaagagccctttggtttttttaaaattgccaccacaagaagccaacatttttttggtccacaaaaaaaaaggggaaaccccggga

SEQ ID NO: 487054 - DNA, 151 bp, Homo sapiens
aagatgaacagcagttacaagaacttgcactggaagaaaggcaaccattgatcaaaaaatcacatgttgtacaatgagcttttccagagacttgtgcaaaagggagaaatatgacaaacaatgatgttattttcagaggtgacagcctgga

SEQ ID NO: 487055 - DNA, 610 bp, Homo sapiens
  misc_feature (117)..(117): n is a, c, g, or t
aaactgaggacattttggtgggttaaacccttttttttctcattggggtggagggggggctttagggcagagggacagggtgtaggctgggggattaaggtggggaattattttagntggggtcagccccttttcccttcctcctgtgcccaagaacatttgtccctccaaatattttcttcagaaggttaatttattttgccccctcggttagggcccttttttaaggggaaaaaaggcaagtggtagggatggggttttttaaaacccccgggtggagagggaaatttttgggcagcggttttcctcaccctttccctttcccagcccatttccaaatggggcccccatgggggggttagggacatgggaaaaaccccgggtaagccattttttttttttgttcccttcctcccccccgggggggggggggaaaatgttttttggggttagggggccccccccctgttccctgtttggggttttcccccgtcggtttcccctttgggccgggttgggtccccaaatccccccccccttttttttgcccgttgttgagggtcccggcttccccccagttcccggtttgggccataaagggggacccata

SEQ ID NO: 487056 - DNA, 721 bp, Homo sapiens
tgttataagcgtgcgtgactgggaaacaggtgcacgtgcagtcctggctatgcatccatgggttcaattgttggtttatagatcccacaaataagtgagaacatgtgatatttgtcttcctctgcccgacttatttcagttaacatagtgacctccagttccacccatgttgttccagatgataggatctcattctttttttgtggctgaatagtactccattgtttatatgtagcacattttctttactcattcatctgtggatggaaacttaggttacttctaaatcttggctatcatgaacagtgttgtaacaaacatgggagtgcagatacctctttgatatactgatttcctctcttttgggcatatacccagcagtgggattgcgggctcatatagtagctcaatttttagtttttttgaggaatctctaaactgttctccataatggttgtactaatttacattcccactaacagtgtagaaaggcttcctttctccacatcctcacaagcatttgttattgcctgtctttaggctataactataagccattttacctgtggtgagatgatatcatattgtagtttagattggcatttccctgatgatcagttatgttgagcaccttttcatattcatattttgactacaatattaaactgctttgggatcaggatcaatgaccctggattgtggtgaatacttttacattccg

SEQ ID NO: 487057 - DNA, 564 bp, Homo sapiens
  misc_feature (547)..(547): n is a, c, g, or t
taggtggaaaggaagtctaagtggaattcttgaatggatgttaggttctggggtatgaagcgaagattctgtgtgccggagtaccaagtgtgagtggtagttggagaaggcgaagggtaaaggtgggcctcatgggagatggcatgggtgatgtagtgggtgaaatagggaatactggagtcatcatgtgatctcgggtggccccggcttcccctggatatcaacatgacacactaggagaccaggagtcgttcgagggcttgccggccagcgacggttggcaaataactcaggcacacggcctagctgggcctgttccccgcagcccaaggtgtagaggtcaccatcagctgtcatgcatcaccaagtggtcgtttcctgaggccacctttaccacaggcacatccagctgcacctgcacaggcaccatgctcttcttcatgggctccaacagtccaatcacaccgttattgtcccggaaggagccccagaggaagacacggccatcatcggtgagcggtgctgtgtgactgtctcctgctgacanctgttacaacttctctt

SEQ ID NO: 487058 - DNA, 1112 bp, Homo sapiens
cagtgagctgagatcacgccacatcagccggggcaaaagagcaaaacttcgtctcaaaaaaaaaaaaaagggaatcggtatattttggtttcggataaatagtgtcgggtttcccatttctaagaattacacacttattttatactcccttccaaacagtgaagcagaactccccttttcttcatttcctgccagtgcttcattatacagttttcccatctttagccactctgttcggtgacaatccagttttccgatttcccatttctcggcatttcttcagtaagtaattggcggcaattggtcccatggtctaatatctcttaacgctttcctggtgacctggctggtggtaaatcttccttgcccgttggcttaatttgggacattcatggcgcccatttccttaacctggaatctttctcacagccgggacaagggagtttcctataattcttaaattacgcgtcttaactaaagcgcataatcctgggggttttaaaagaaaagcaaaaaaaaacaactaacacacacaaccatacatacaaccaacacaaaaaacatgtttgtgtggggagcgcagctcattgtgcgccccctctaaacaaaaagcgttctttttttgacagaaaccccatattgcggtgtgggaggcaccgccgggggggggcccccacaatctagtgactactgtgtgcacaccacggtgggccccacacagaagaggagggtcgtaccccccaaggaggagaaaacaaccctgcggcgggcagcacaatcaaaacccaacaacgcggtggtcgatgaggcgtttctctctccaccccacgcatgattataaaaaaaacaggccccgcccggcgggggaggggagccaaaccaccacagacgacagcgtgtttttcgtcatagcaaacacacacaatctctccctccaccaaagagatcaggaggcagtctcaccaagcgagagcgcgacgacacaataacaatgcggcaggcgcttcacatacaccaaccagccagagggagatgcactcacaaccggaagaggcgcgtcgaacgatatatctacaagatatataaccgcgccggcgtctactgctggtggc

SEQ ID NO: 487059 - DNA, 116 bp, Homo sapiens
tcccccccccgggggggggcccccccccctttcccctccccaaaaaaaggggaaatttaaaagccttcccaaatttttttttggtttaaaacccccccaaggggggggttttttga

SEQ ID NO: 487060 - DNA, 960 bp, Homo sapiens
gattcggtttggagcgcgacgcgagtctgtaagtggatcatgggctgcagtagcttgtgcctagtaagctgcctgtcttcgacgagtgcttggttctctcctaagttaaaaagcccggcgcaactgagcgtcttggactacctctcagatgggtgtcctgaggtcgttgccgtgtgatcttatcagcagggagtcccaagcgagctcgaaatttaacatagagtaagctcgaccctggttgaggtggtccaagcatatagaaggtgacagctagtttaagtgtcgagactcttatttgctctttgcacggctgccttacaggcctagaagtcaatgcaaattcaaccaggtatggctggaggagtttgtgactcatctgtacctgttgaattgattcagacccaagtggctgatctcctgcctgtacgttagtaaccttagtaggcaataaccgtaatggtaactcaggccgagtacccattttgcacaaatcactggttataacattatgaagccggataccagatcatattacaaacaccttaactagtaggtaatccctggctaggggaatgtcaaattccaatccttgtattaagtttaccccttacagtgtcaggtgagaaaagtaaatcaggtgagttccaatagcccccatctttggcatggagacggaacgagcgtttaaagacggatgacggtgaaactcatcgcgagaattacgcaagtcaaggtggacaccgtttatttggaggagaagacataatataacacagaaaagatgccggtcgaccaatgaagatgttacaaccacgttttggggggcgaccagagagtaagcaagtgaagcggtctagagactggagtaatgggcggatccaccataaaagctggacttgtgtgcacacgcagacagatggtcaacacaaaacaatagcgcgggatagataagcactagaa

SEQ ID NO: 487061 - DNA, 354 bp, Homo sapiens
gggctggctctatatctccatcggacgtgactaagtatgggtagcctaaagttccattaggatccaattgtgattctctaaaacgttctctcgatgtgtatatctgtacagatagaatcttaatcgaatgacagtaactacacagtttgatacctgtggcaaatactgtattagcatctatagatttagggcgatctttaagaaaaagatggaatggtcagagtctaagttatttcatcactgtactttggttaatgtgaactatgattcatatattttatcctttcaaactgaaattacctgctagagtgagcaaccatctcaccactgtggctctttagcttttcccatatg

SEQ ID NO: 487062 - DNA, 1084 bp, Homo sapiens
  misc_feature (1084)..(1084): n is a, c, g, or t
ggtgtggtggagcccgagaacctggcccgggagaggaagatgcagtgggtgcagcgtgcagcggctggagcgcaaggtgcacgtgcccatctaccctggtgagatggagctgctcctacaaccctgttcctgatgaacccactgcctgtgctgctacatggatggctctgtggtgcctggtgtgccggtgccccactgtgtggatgatgactactccctggtgcccagctcctgtgaatgatgctcctgcctgtgcttgaatgtgatattgcacaatgatgcaatgtgagttgcccccatgcggccacccatggccgcagcccaggtcccctgcatgggtgatgtgcctgccacgcaccaacacgctcatcatcctttctcatctgctaacaccaccaccatccatcggacacccaatgcgggcatcataccccccacactgctcagggtgagtgggagggatcatggcgatgagacttgtgagtgccaaaagaagggggcctgttggatggctgggaaccccgcagcgcgaggctgcctcatcaacgtgcaagaggaaatggaggggtctcgtggacatctccagacccatacacaactgggagggtccccatccatccttcccgtactcctgggacaggcagcaatggacattgtgggctgcatgtagcattctccgtcagagagggcctcatctcactgtagccctggaacccagggaccattctttgcccttcccccatccattggttgggaaagaacgctcaggaccctcaacagtgagctcaaggtgtgatgccttacacaagcagcactcaagaatggcaagttggacctgatgacctgagactttgggcgtaatcgcgaaggactccctgacacgaccaatccgatgaaagaggaaaaagtagaaagaaaaaataaatcataaagaaagataaggagtgaagagattaatgggaggaaagagctgaaaggacgtagtagaggaaagagggggattaatagatagaagaatgaaagagtaagagagtagtatgagtcgatgctcaaaatagagaagtagaataaacgaggagagtan

SEQ ID NO: 487063 - DNA, 680 bp, Homo sapiens
  misc_feature (680)..(680): n is a, c, g, or t
gtattatattttttcactgatggtgtcaatcgtctgaccgaagaactcggctgtgatgagattatgatagagagtagttagatgctgttaaaagaggaggaaactacttgaggagggacccaactttccgctatctttgggttcattccaaatagttttgtgccactatgaaaacacttgaccttcaaaaaaaatttgtttttcacgaatagacacacgaataggcacagtgactgcacaggttggtgaaaaaggaagaggaatcacttaaacgcaacacacgaacaacaagattttaagaccgttgaaatcaattatcaagaacgtcctaaaacacctatggcttgacttgttatgatccagattattttccttgcatggggaaaactatctttcatatctgttcgctgtacagatggtttgcaagaataagtcatgaccaagacaaactgccaatacaaaagcccactgatactaattatatacatgagaccaaaaccgtatccaactaggacacatatctttcgagttatctggactgaaagcttcacgaaactcggaaaacttctatttccgtgatctagtcaagccacagttatcaaaggctacatcctcaggtccgatactggatgagtcacactcactatgtactcacgcgggcttgtatccttaggacgggn

SEQ ID NO: 487064 - DNA, 433 bp, Homo sapiens
cccaattagattttaaactgcctatgggtagttgctgttacttatagctgtagtgctcctgagccaactgaacaactgctgagataatcctaggaataatgtatgctgagggtatgccgtgctctctatgtaatgagttcctcacattgattcatctatggaagacttgcttgagcatggtgggagtgatgtctcttcagtggcacagtcttcattctatttcttaccctttaaataattcacatttttcagtgcatggaattaaattttcaagattccattggccgtgacatccccaaaatgcttgaattatttaaaaatggacatgaaattaaggtagatgaagaaagggagaactttctccagaccagaatagcaacattggatatgtcaagtgaccagatagctgccaatctgcaagcagttattaatg

SEQ ID NO: 487065 - DNA, 285 bp, Homo sapiens
gctccctcgtggcgccgggtacgcatcaatcatcggtggataacaaacgcggtccggcggtcattgatagagatgatgttctaccggtcgcttggcacaacagagtcgcactactgccagcagattctgcgtgtgcagaaccgaagaactcgctcatgtagtcgcgccagacacatactgcgtaccgctatggacacggtattagggcagggtttactgtcatcgacagtctgactgaaagtagagagttgctgaaacaggcgcatcatagtacggtatcgtcca

SEQ ID NO: 487066 - DNA, 709 bp, Homo sapiens
cagtcgtggggcgcccacgaatttgcgcgctctcttgctagtgctccccagctctcgagatacggccgaaaccatggcctttcgaaaacctgaaaagccctgcgggactccaggtgctcaacgattacctgggggactaggtagctacatcgagggtgtattgtgccatctaacaacggcagatgtggcagtactttgagagccgtgtcctagcccaaccgcctgccgcagattgtgtcatgccctacgatgagtaataatcacattcaagtcttaccgaaagaggaaaaggccagcatgccaggagtgaagaaagcttggggcaaatagtggtgcctgccgactgtggagtcatcactacaggaagtggagctaacagatcgtgctaggagtgatgattgacttttgacctctttggatcttgatcgatgaggagagacagtgaaagcaatgcctcagatggctaagggaacgaacgtgttgcccacttatgaactcactgaaagccgaaaaaacctgcactttgtctgccatgtccttccccattctcacttagcatgtgaaagctcgcggatgatgcagaccagattattgccgaaatccagagggactgcgtccagaaggctttcaagcagacggcttaggtctggggggctcatctaaacctagttcccgtggggatacgggaattaagaacgctttcaatacg

SEQ ID NO: 487067 - DNA, 449 bp, Homo sapiens
  misc_feature (28)..(28): n is a, c, g, or t
gcggacaaaccttacaaagcaaaacgtntaatcacaaagagggggctaccaaagagacaaagctttgcctgccacttctgcctccagatcaggcctttatgatactgtagcctgattctactgtacaatgtaaaaccatccttgtacttgcatgtctaaccccttcatgattcccaacactcactttctcttccccacccctctccaataaaaacaaacccagacaggaaacgacaaaaaaacggggggatacgttgcaagtttcttccacagaaattgtacgaagcctgattagcagacacaccaacacaacctaattatccctaagctgaagcatgattctagccactatagaaatatggtacgaagtgtaatcatgcataggtcaaaaataatcagcacaagatcagccgtcttccaacaattaccatgcgacatggtaatcccac

SEQ ID NO: 487068 - DNA, 634 bp, Homo sapiens
actagttagctaccatgcgtcattatttatcaaaagatatatgctgcttaaacacaaatacgttttaaaatatattttaggcagtacggttttgggtttttttttttgcaagttctttaggtgagtaaatttagtgataaatgatattattttcttttgagacaggttgctttgtcgactaggatggagtgcagtgcaatggcgcgatcctgtaacctccggctctcgagttcaaacgattctcctgcctcagcctcccgagtagctgggattacagacacgcgccatccgacccagatgatctttttaaatgcaaaatgccattgacgcataaaatcaaagaatcagcttaagttccagaaaagagaccaaccatatgaacaagtagacaacaacgacaactacataataggccttttgggattttggatgatattgcatcaaatccatacattaacctgagagacgagcgacttctttaacattgagcctgtcaatcatgatttttaattcatttacgtcttctgtaatgtttgttaatataattgtattttgtgctatgcagaagtttcactgatctttcattatgtctatatatacttgatatttctgacactattgttaggatctttct

SEQ ID NO: 487069 - DNA, 337 bp, Homo sapiens
  misc_feature (51)..(52): n is a, c, g, or t
  misc_feature (60)..(60): n is a, c, g, or t
  misc_feature (63)..(67): n is a, c, g, or t
  misc_feature (69)..(69): n is a, c, g, or t
  misc_feature (108)..(108): n is a, c, g, or t
  misc_feature (112)..(112): n is a, c, g, or t
  misc_feature (153)..(153): n is a, c, g, or t
  misc_feature (171)..(176): n is a, c, g, or t
  misc_feature (192)..(192): n is a, c, g, or t
  misc_feature (210)..(210): n is a, c, g, or t
  misc_feature (264)..(264): n is a, c, g, or t
  misc_feature (290)..(290): n is a, c, g, or t
  misc_feature (299)..(299): n is a, c, g, or t
accagaggtgcacacaaatatacctgcaataaagcatattctagctatttnntattagtnaannnnntnatagcaataaagtatctattaatatgccagttatttatntctnatatctagctaatctcattaataaacaaaacaacccctgangcaggtattattactctnnnnnnacagagaaggtaactnaggcttaagaggataatnaccaaattgcctggtgacaaacagttaggtagtatgtactgaatatggtgactncaatctaacccgtctgtgtgattatnatgcctttntgtaacttggtaaatgttaacagtttttatacttgagt

SEQ ID NO: 487070 - DNA, 99 bp, Homo sapiens
ccaacttgtctcagcatcacatctcctgtgctctttatttttgccggaccagtttcggttaggagaatgtgcctttttgtacctttgcatttaggttta

SEQ ID NO: 487071 - DNA, 130 bp, Homo sapiens
  misc_feature (45)..(45): n is a, c, g, or t
tttaagtttgctatgaaaacaatgtacttttattaattaaaagtnaaaaacaacaaaagggaaatttcacaacctttgtttgcaactatataatctttatatagaaaaactataaagtgacagtctgatc

SEQ ID NO: 487072 - DNA, 226 bp, Homo sapiens
catcccatatctttgggacgctaaggcaggcagatgctggagtacaggagttcgagaccagcctaagcaacatggcgaaaccctgcctctataaaaaacacacaaaaatcaaggtgtggtgatgcacccctgtggtcccagctattggggaggctgaggtgggagaatcacctgagcccaggctacagagagctgtgatccacactactgcattccagcctaggtg

SEQ ID NO: 487073 - DNA, 418 bp, Homo sapiens
gcacagttccacagaactgtacaagaatggcatcagcatctgctcagcttctggggaggcctcaggaacttatactcatggtgcagggtgaagtgggagcaggcacatcacatggtgagagagggaacaagagagtgaggaggaggagccagacccctttaaacgcaccaaagtctcatatgaactaactggagcgaataactcagttcatcgaacaaggggatggtgctagtgccattcatgaggggtctgccctgatgatccaacacttcccaactagggccccagcctccaacattggagattgcatttcagcattgagaatttggcagggggtcaacaccattttcaaaactacatcaggatgcagtcacatgttgaaaatattttggatatattaatatttagtagtgtacta

SEQ ID NO: 487074 - DNA, 946 bp, Homo sapiens
gctagacttgacgagctgtgtctatggtcgggccctctgccgtcagctgctccggaccgagctcgggtgtatggggccagtaggaaccgtgatccggggccccgataacgtggcctgccccacatttatcccgtggactggacagtgagtggtctaccctatgcatctgagaatggactaccatctcgatatgagccagtggctgttattggtgtacggtagccatataggagacacctgtacacaggccctgtgataccccacagtaggccactttgtggaccctcaaagagtgtgagaagttaccccaaatggcagagaaggaaggatggaaaggaaggccggaaaccacaatcaaaaaaaagatacagagaagagatgagaccttacactgcaggccgaacatgaaagggcaacaagacgacaatacccacaaaagaaagtaccggaacatgcaaggaaacgatcatggtgaccacaataccccggaaacacagcacaacccagagaagatccaaaagggtaagccccatgggaagcatcaagaaacacgtggtacgaaacaaggcaaccgtaaatagaacataatacgtgggaaccacagggaaacacaccacaaaaacataggacaatgacaacgaaacgaaaaggcgaatccaacgcatactagccttgccagcaacacgataacacagtaaaaagaagcggaacaaatagaacaacatcccattctgaagttgccccaaaaactggccaagaccgaattcaacccagaggaaataaaaagaaagacacaaaaagaaaaacaaaaagcgtggagggaacagaaggatgtgttgagacacaaaggacacaaagccaggagaatagaacatcacaggaggcatgggacaccagaaaacatcgtaagaaggcataaaccaaggaactgggacacgatacccac

SEQ ID NO: 487075 - DNA, 361 bp, Homo sapiens
  misc_feature (285)..(285): n is a, c, g, or t
  misc_feature (304)..(304): n is a, c, g, or t
  misc_feature (317)..(317): n is a, c, g, or t
attttatttatttatttattttgtttttgagacaaagtcttgctcttgttgcccaggctggagtgcaatttcatgatctcggctcactgcagtctccatctcccaacttcaattgattctcctgcctcagcctcccaagtagctgggattacaggcatgcaccaccacgcctggctaattttgtatttttagtagatatagggttttaccatgttggtcaggctggtctcggattcctgacctcatgtgatccacccaccttagtctcccaaagtgctgggattncaggcgtgagaaatcgtgncccagccaaggantaggaatttccaaagcttacaaactgagagtcttcacagagggg

SEQ ID NO: 487076 - DNA, 505 bp, Homo sapiens
  misc_feature (227)..(227): n is a, c, g, or t
  misc_feature (295)..(295): n is a, c, g, or t
  misc_feature (365)..(365): n is a, c, g, or t
  misc_feature (370)..(370): n is a, c, g, or t
  misc_feature (376)..(377): n is a, c, g, or t
  misc_feature (459)..(459): n is a, c, g, or t
  misc_feature (498)..(498): n is a, c, g, or t
ggcagctctagaatgagggtgctttgggcataacaggctcagccatccttctggtgtctcgccctgtctcctttcccatccttgggttcacttctctccctttttctcttcacttcaaaagtggttagctccagttaaatacctggagttgggacagcagaaaagctgctaaatgcagatttgctttttctcactaaagaaagaggaacattttagtcactaatttncacttcatttaacctttctttccacagaatggcctgacttttgctggaaggggacaaagccctaaganatttatatccatgagtagaacatttatgatatcacttacacagcttcctggcctgtagcttttccagacntagcntatatnntagtcaaagtagagggatggatttaaggaattgtctaagataagtgagaagagaggacatttgtcctacctaaaggcaatgngcagcttgtggggtggtggcggggggaatctatctcgtnggctggg

SEQ ID NO: 487077 - DNA, 186 bp, Homo sapiens
taacaggctttggagcactctagattcctgttaatcctacaaggggctgtgtgcggtggctcacacctgtaaccccagcactttgggaggctgaagtgggcggatcacaaggtcaggagtttgagaccagcctgaccaacatgatgacaccccgtctctactaaagatacaaaaattagctgggcg

SEQ ID NO: 487078 - DNA, 1263 bp, Homo sapiens
ggagagagaactagtctcgagtttgatgtttatgttctctactcattaaactttttaaatggggtctcacaaattctgtgacaaattttgggtcaatttgttcccattaaaaagtcctgattttaaaaacttaattaactttaaaacgtgccacacgcaaaaaagaaacaccaagaggtggtctccacaaaacatttcctcctttctccttctcgtgagaggtttacacgagtgcattgtgcttactcatttacccagctctttatactacttaaacttaaaagtggccaattgtgaacacaaacgagtctcgtgagaaaccgttctctttcccacccacgtggatataaacagtgtggggtgtggcaggttatttgagggcactaatcatcgcacttatagccctctcgtgaagccttttcgtgggcccaacacttggggtgcacctatggcccaagactctcacgagcaaacccatctcgtgtgcatccacacagtgcctttttggaatgtgaacaacccgagcgcgacacagcgtgtctcagtgcatctctcaatattccaccagaccactagcccacacacggcagaacacacacagaggtgtggacacataagcgctcgtgagagagacgcctctctcaaacaaaacaacctagtaggagctctttgccccgaaggaaacacccccactcaataccacacgccatagtaggacgaagaacataatacgcacccgaagaatctcctccaacacgacatatttttagaggggccccctctatcttttgcaccaagctcttctttacaccacaacgaaaaagcgagcgacgaaatccacacaaccacctatagacaccctataagagactctcaacaaacccaaaacagtcttgtcgaccaagtcgccacaacgtaggttaggaacaccccctgtatatttggggccaacaactccccaaaaatataacgcagaggggcggaccaatattagcacgcagggggccgccatattaactacgctgcgccccccctggcgacagtggagattaaccagacgacgacaaataaaatctcacaaccaactgtgacacaccgcgacgcttagaaaaagtccccccagggacgtggcattactccccacaaagcatggcagcagggaggcacaccaaaaaatttgacgcaggcgatggaatccacacccaccaagaacacaagacgcgtagttgggccaccaagcacgcagagcacatacagatatcc

SEQ ID NO: 487079 - DNA, 155 bp, Homo sapiens
gaggatcccgtggcagttatcggactttttcctcctggtgtgttctaatgcaacaaggcttgcaagggcagcacagccaggcacagcctagggtgggagagacagggtcataaggctggaagacataatagaacagggtcagttttagcctcaat

SEQ ID NO: 487080 - DNA, 169 bp, Homo sapiens
ctcattagcgagattcatccgagctcaaacaagatgagtgctagatcgagagaagttgctacgccaacagccataacaccatcacatgttgcagcagcagcctatggaggcttcacttactcacgacttcaggctcaccctgttgagctctcgcgctcgtcatcaatga

SEQ ID NO: 487081 - DNA, 2731 bp, Homo sapiens
gccttggacgcggttcaggaatccgccgccgctagccggctcgggcctgagcggggagggcgccaggcaggacctctcgcaggctcgctgcgcaggacggcgcccgcctggcgccgcttcccttccagcgtgccgaccggcccggcagcgcctccatccctccggcccgccccggagaagacgcacagctcgggcccgcgggcgttggggcttggaaccgcttctgccgggatcttccaggaggaaagcgaagttgcgagcggatgctgcccgcgccggaccccagccgcggagggtcggggccgccggtggagtctcggcggccggggacaagggtgtcccccacctgaagacggcaagctgggtcctgagtgatgcccctcagctgagtgtccaaggctggcccgaggagccccacggccccacctttccccatggagaaaggactcactttgccccaggactgccgggactttgtgcacagcctgaagatgagaagcaaatacgcccttttcttggtttttgtggtgatagtttttgtcttcatcgaaaaggaaaataaaatcatatcaagggtctcagacaagctgaagcagattccccaagctctagcagatgccaacagcaccgacccagccctgatcttagctgagaacgcatctctcttgtccctgagcgagctcgattcagccttctcccagcttcagagccgtctccgcaacctcagcttgcagctgggcgtggagccagccatggaggccgcaggggaggaagaggaagagcagagaaaggaggaggagccgcccagaccggccgtggcggggccccggcgccacgtgctgctcatggccaccacgcgcaccggctcctcgttcgtgggcgagttcttcaaccagcagggcaacatcttctacctcttcgagccgctgtggcacatcgagcgcacagtgtccttcgagccggggggcgccaacgccgcgggctcggccctggtgtaccgcgacgtgctcaagcagctcttcctgtgcgacctgtacgtgctggagcacttcatcacgccgctgcccgaggaccacctgactcagttcatgttccgccggggctccagccgctccctgtgcgaggaccccgtctgtacgcccttcgtcaagaaggtcttcgagaagtaccactgcaagaaccgccgctgcggccccctcaacgtgacgctggccgcagaggcctgccgccgcaaggagcacatggccctcaaggcggtgcgcatccggcagctggagttcctgcagccgctggccgaggacccccgcctggacctgcgcgtcatccagctggtgcgcgacccccgggccgtgctggcctcgcgcatggtggccttcgccggcaagtataagacctggaagaagtggctggacgacgagggccaggacggcctgagggaagaggaggtgcagcggctgcggggcaactgcgagagcatccgcctgtccgcggagctggggctgcggcagcccgcctggctgcggggccgctacatgctggtgcgctacgaggacgtggcacgcgggccgctgcagaaggcccgcgagatgtacccgttcgccggcatccccctgaccccgcaggtggaagactggatccaaaagaacacgcaggcggcccacgacggcagcggcatctactccacgcagaagaactcctcggagcagttcgagaagtggcgcttcagcatgcccttcaagctggcccaggtggtgcaggccccgtgcggccctgccatgcgcctcttcggctacaaactggcgcgggacgccgccgccctcaccaaccgctcagtcagcctgctggaggagaggggcaccttctgggtcacgtaggggggtctggggccgtatgccctccttgtggaaaggcctgggcccgtctttctggctgaaaggcctgccccgtctttctgccccagccctcgcagcagagagccggcacagcgccatgagcggagcagcgcctcctgtagcagtagggcccccagccagcgctccagccaaagcggcggccccaagggttaatgtggcggagaaacagggacaggtgcccgaggtccccttggaagggccatcacacccagacccaacgggttgcagcctcctgagcaggcctaggcaggcccgggcctgttggcaagcttcgatctcgaactacaacaaccagaaacatacattcgtgcctggagaccctgcaggccagagtccaaatatttaacaatcagaaggggcaaggctctgaccagtgacagtcagacctcctgctttatttggtgttaaccgtttcttgtctggatggtgaagtctggaatctgggtgggctccttggaggaggggctaggacagccgtgggtgtcaaaggtggcatttgaggctcgtttgaggtgacagtggctgtttccgaactagtacagagcgattcagcgttttcatgaatgggttggctgtgctggttactgatgaatatgggccccttatagagctgcaaaacacacacatgcgtatagacatacatacatgtacaccatacatagacaagcatcataaaggcacaagtgcacacacatctatgcagacaagcttcctcgctgcttatgcccacagggtttttctgtatgacacacctcagaggagcctgtgcttaacatttgtaggattatttcgagggcagggcaggggaaagaaacgcg

SEQ ID NO: 487082 - DNA, 194 bp, Homo sapiens
cactctagaggatcgctcaaatgacagagaggaagtgagagagacaggtgtcggggaggtgccaggctcttttaaacaagcagttcttcaggaactaagagtgagtcactcccatgagaacagcaccaagccattcatgggggaatctgcccccatgacccagacccctcccgttaggcttcacctccaacact

SEQ ID NO: 487083 - DNA, 688 bp, Homo sapiens
gttatttcttgccttctgctagcttttgaatgtgtttgctcttgcttttctagttcttttaattgtgatactagggtgtcaattttggatctttcctgctttctcttgtgggcatttagtgctataaatttccctctacacgctgctttgaatgcgtcccagagatttgggtatgttgtgtctttgttctcattggtttcaaagaacatctttatttctgccttcatttcattaggtacccagtagtcattcaggagcaggttgttcagtttccatgtagttgagcagttttgagtgagattcttaatcctgagttctagtttgatttcactgtggtctgagagatagtttgttataatttctgttcttttacatttgctgaggagagctttacttccaagtatgtggtcaattttggaataggtgtggtgtggtgctgaaatgtatattctgttgatttgcagtggagtgttcttgacatggctattaggtctgcttggtgcaaagctgaattcaattcctgggtatcctggttgactttctggctgcttgctctgtttaaagttgacggttgggagtaaccgtctccattatcaagggcgggttcttagctctctttctccgcacttccgcattttctttaagccctgttccttcctgccccgcctcctatactctatcgcgccct

SEQ ID NO: 487084 - DNA, 354 bp, Homo sapiens
acaaaagggcaacgcccatcagatacatccctcaggtgaacaccccactgttactaatgttggcacagaagaaccggtgtgtgcccttcaaacagggcatggagtatcaccgtgccctcaaaacccgaaatgtgcctgttcggctcctgctttatcccaaaagcacccaggcattatcaaaggtgaaggtgaagtcagacagcttcataaattgtgtgctcgggcaacgcacacacttgggcagttaaagccctgccattcggcataagctgaacagcttgtgtgggctctggactccacgaatgcgtggccaaaggaatgtgggcaagggagtcataataaattaggccacag

SEQ ID NO: 487085 - DNA, 242 bp, Homo sapiens
  misc_feature (26)..(26): n is a, c, g, or t
  misc_feature (207)..(207): n is a, c, g, or t
  misc_feature (227)..(227): n is a, c, g, or t
ttaaaaatattcccctgggacttttncttcatcactaacacttgtgattcaaaaggacacctcccctgtactggaagggcccagaggaaattccctggttttggtttttggtttggtttggtttgccttttggtaaaacatttccaaagaggtggcaggtaattctggaattttccaaaaccccctccccaattaaacttttaattnaaaaaaaaatgggtccaccnaaattctattggaaa

SEQ ID NO: 487086 - DNA, 96 bp, Homo sapiens
atatcgtcgacccacgcgtccgattttctggttagaaacaagagtaacacccggacagttcaggcagctgccagcacctcctgggtcccctgcaaa

SEQ ID NO: 487087 - DNA, 165 bp, Homo sapiens
cgctaagacactgcgtacgtttgacagtgtacgcccagtcaactccccactgcactgtccctgagcggtcgcgccggccgcggacacttcgaaacctcagtgacgtgagtggggtggtcggaaccaccagagggacgcggcagcgcgatagaaagctgaagagga

SEQ ID NO: 487088 - DNA, 599 bp, Homo sapiens
gcacgagaggagagtcaaatactgtgaacatcactcacacgaggtggaggaaacctgtgatatagctagagaatatacacacggttgtgtttcatatagagtgcagaaaccaaaccatgcttgtgtgaaccttaaatatgaaaggtggttctcaaggtcccctttggcctttggtgctgtcatatgaaatcttacaaggaaggatgaagaaaagcctggggggagggtcttctcggaaatgaagtgggtttttttggtattaaatataacgtggctgtgggtacaggtacttaacgaatgtgtagaagaaggtcttaaggcattagaggcctatataaaaggcaggggaggttctcttctaacctaaattaatattggtcaagggtattttttggttctaaattaagactttaatggctttaaacagtgggtctcataatttacatatcattcatttgatgcccttttacacagaaactctttagaggttataaaccatctatgtaaaggagccacatggtatgtgttcacacagctactcttaaatataaatgtgagataagaaatatatatgtgcacaattttggcatggtagcacc

SEQ ID NO: 487089 - DNA, 270 bp, Homo sapiens
agtcgagaagtggaggcggtgacattgtagatgctgcagtgaaagcgacagagccacggaaggccgagactccaccatgttggtgatctgcacatacagcaaaatcactcgcactctgcctcatcttatctctagaaggtattttaccacactgtgtcccttctttagtagggaatgtctttgggccaaaagataatgaatagttctggaccatgactggctagaggcccaagttaggatacgagtcaggagagaggggtagtcctctag

SEQ ID NO: 487090 - DNA, 205 bp, Homo sapiens
agccgatccttataagacgacagaaggggagaagacgacagatatggggattgcccacaggccagcatcactgcaaacgagatgcacattgtgactgggatcagcgctgtagagggggttaatgtgcagcgttttcagaacaggctgcacaaggatgtggcaggaaagatgggtgatagggttgctaggggttgctcccacaaac

SEQ ID NO: 487091 - DNA, 456 bp, Homo sapiens
ctcctgcctcaggtgatcctcccactcagcctcccaaagtggtgagattacaggtgtgaagcaatgtgcccagctccataattcacattttaaaaggaactttctttgaggagggaatctatttacttctatgtgtctttttgagacggagtcttgctctgtcgcccaggtcgggatgcagtggcgtgatctcggctcactgcaagctgcgcctcccgggctcacaccattctcccgcctcagcctcccgagcagctgggaccgcaggcgcccacgaccacgcccgcctaattttttgtatctttagcagagacggggtctcaccgtgttagccaggatggtcttgatctccgggcctagtgatccacctgcatcgggctcccgaagtgctgggattataggcatgagccactgcgcccagcctctatttacttctatactcccaagacccagtgc

SEQ ID NO: 487092 - DNA, 314 bp, Homo sapiens
tctgtccactccctcgatggcttccgacacccaggcctctgggaccgctacatggcaccctccgcgctgcctcctgcccctccatcatgactcaggcgcctccccaacctccgcccacgctcaccataaacttgctctgagtttggagactcgcccctcctctcggggagcaagtggggggcctccagatctgcctgtgtctctctctgagcacctggtgtccgtgtacaaggatggatgtgtacagtggctccttgggaactgagacatatctcagggaatggtctctgtgctcagcccatccaccagaagag

SEQ ID NO: 487093 - DNA, 410 bp, Homo sapiens
ttgcaacccatcgcgaacaccagattaaaagacctccagcaatccaggattctagtatactcatctcggacggcggtatgtaagatgtgattggattaaagaagacagacaacaagtgcattaataaggaacaacattctgaatactcacgagtagtaatctggcacacttacccctaggccagaggacacagggcaaccacacaggaaagggataccaggacagagtccagggagtttggcttataccacaaaaggagtaagggcagtttaatccagggtatgcgaaaactaggtctatgacataaacttgacttccaaaaatacctcagcctttaaaaggtccccaataccaacaaatcaacaaagtagtcaagatgacagccacggtcagggacagatgaacagtca

SEQ ID NO: 487094 - DNA, 192 bp, Homo sapiens
acaatacaaattgggactctttcccagcctgagcgtaataaacggagtgatctacgcgttctctggaggtgacactgcatttaaaactactaaatattagtgaaaattgattgattcagatttgcatttcaactgaacactaagaactgctacccgaagtaagtctttgtcgacgcggccgcgaatttagta

SEQ ID NO: 487095 - DNA, 335 bp, Homo sapiens
ggtcgacgatgaatacacatctgtgaaatagtcgtaaatgaaacaaagaaaaacgtctttgaaacttttcaactattttgtattacatccatatataataagacctcatatggaacatttgtacagaacatattagggagaaatttattgccatgacctagaatgcaaatctgtcagtctgactcaaaaaaacttataccctatgaccctgatctctgggaatgcatgtaggagtattttggcttccagaagtaaaatactctagggtagcactgtccaatagaaatataatgtggggcacatatgtaacttgaaattttccagtagtcacattc

SEQ ID NO: 487096 - DNA, 159 bp, Homo sapiens
tcgtcggctgcggtgtctatgctgcgttggagacagccgagcctggcaaccaggctgtatcacttcgtctgatgacacagctgtgttcactggagatgcctgtcgatcgtggtgtggcgacgacttcagcatgctgtgccagacttgtacactcggtca

SEQ ID NO: 487097 - DNA, 376 bp, Homo sapiens
tctcagctctggcactggcaccccaggttggtccccgtctgcagaggcttggctttcgagccattgggtgtctctcctttggctctgtgcggcttgctcttgtcagccatgctttcagggtaggctctgagcaatctggcgaacagccctggctgctccaaaaccaaaaagctggttcctctggaggatgggcgagtctgtggagcagccacccattgctgtcccaagctcactcaggaatttacacccgtctggtttcttgatgtgtgctgggtcttttcctctgttccctactcccccccacggcagagtataggctttctaagatgctgcgatcccgttctgctgcccgtaataaaaatgctttcagactctg

SEQ ID NO: 487098 - DNA, 949 bp, Homo sapiens
tggggttttttgggtttttttcccaacatttgggttatcttaaataacatacacaggggttcccaccccatattcataacaaagagtttattcataaagagggtttctaaaaataacattttttttcttttgtggggtgtgtgaaagagctaggagaagagtgtcccaggtggggaagagggtgggttgggaggggggagggaggggcgtaagaaaaggggaaaccgcgggtcttctcccgcgacagtctcgtgaacccccacaaatctccccctcctcctcacacgcgtgggccccacaaacaacaaccccctctacatctatacgagaaatggagagaccaagcaacaggctgcgagcacgagaaactctcgtggagcgcccgtgggcgaacagaaaatctctctgcgtgaggttacacgtgcacatatatatgtgtgtctcacaccactctaataagagcgtgcaggcgtctcccgatgcacccacattagcgggggcggggccaacgcaacaaacacacggggcccgcagaaaacacaccaccgaggggaacgggggcgcactaaggcgggaaaaaagaacgcgaaacacagcacacacacacacacaaaccccccccctttatcgccccgctttaaatccccggggaacccttcccacaagagggtctccacaacccaaaaaccacacaacaccctgtgggagtacggcgtgaaaaacaaggggcctggatagcgtggcaccacaagaaggaagagcagaaaatgggtagcaaacacgctaaagaaggaggacaaacacagaaacccaccccccgcgcagaacccccccaaaggtggggccaacaccccacggggagcgtccggcacacaccagacatccacaacaacaacataataacaaaaaatcacgaggggaaagaccacagaaggacctgggaaagagt

SEQ ID NO: 487099 - DNA, 945 bp, Homo sapiens
  misc_feature (87)..(87): n is a, c, g, or t
  misc_feature (142)..(143): n is a, c, g, or t
  misc_feature (154)..(154): n is a, c, g, or t
  misc_feature (196)..(196): n is a, c, g, or t
  misc_feature (204)..(204): n is a, c, g, or t
  misc_feature (214)..(214): n is a, c, g, or t
  misc_feature (217)..(218): n is a, c, g, or t
  misc_feature (222)..(223): n is a, c, g, or t
  misc_feature (228)..(228): n is a, c, g, or t
  misc_feature (238)..(239): n is a, c, g, or t
  misc_feature (303)..(303): n is a, c, g, or t
  misc_feature (310)..(310): n is a, c, g, or t
  misc_feature (316)..(316): n is a, c, g, or t
  misc_feature (325)..(325): n is a, c, g, or t
  misc_feature (348)..(348): n is a, c, g, or t
  misc_feature (357)..(357): n is a, c, g, or t
  misc_feature (389)..(389): n is a, c, g, or t
  misc_feature (391)..(391): n is a, c, g, or t
  misc_feature (400)..(400): n is a, c, g, or t
  misc_feature (417)..(417): n is a, c, g, or t
  misc_feature (433)..(433): n is a, c, g, or t
  misc_feature (440)..(440): n is a, c, g, or t
  misc_feature (452)..(452): n is a, c, g, or t
  misc_feature (454)..(454): n is a, c, g, or t
  misc_feature (456)..(457): n is a, c, g, or t
  misc_feature (460)..(461): n is a, c, g, or t
  misc_feature (463)..(465): n is a, c, g, or t
  misc_feature (467)..(468): n is a, c, g, or t
  misc_feature (470)..(471): n is a, c, g, or t
  misc_feature (474)..(474): n is a, c, g, or t
  misc_feature (476)..(478): n is a, c, g, or t
  misc_feature (481)..(481): n is a, c, g, or t
  misc_feature (684)..(684): n is a, c, g, or t
  misc_feature (690)..(690): n is a, c, g, or t
  misc_feature (795)..(795): n is a, c, g, or t
  misc_feature (801)..(801): n is a, c, g, or t
  misc_feature (804)..(806): n is a, c, g, or t
  misc_feature (813)..(817): n is a, c, g, or t
  misc_feature (827)..(827): n is a, c, g, or t
  misc_feature (833)..(833): n is a, c, g, or t
  misc_feature (839)..(839): n is a, c, g, or t
  misc_feature (877)..(877): n is a, c, g, or t
  misc_feature (931)..(931): n is a, c, g, or t
gagctccgggcttaccaggttttccgggactccgtgggatccgcggcttacacggcttgccaggcaccaagggctttccaggatccncaggttctgcacatccacggagacccaggcttcccaggccctcctgcggcgaaanncgtgacccacngcacgcagcgccaccacccttccaccgccctcgctgcgcgcnctcccacnacccccaacncgnncccnncgcgncctccagggnnacgaggcccacctgggaccccaggacttcagggcgttcccaggcatcacccccccttccccccnccccccncccccnccctcacanaccgccccccccccccctcattngccctcccnccttcccccccgcccccccccccccccccctncnccccctctncctccccagccaacccngcccccccggcccccncccaccnccccccaccccncncnnccnncnnncnncnnccncnnnccnccggcgccccaggcgcaggcctgggtgtgttttggtctcccaggcagaaaaagggcccagggggtgaaccaaggcttcatgggggaacactggacccaccggggcggtgggcgacagaggccccaagggacccaagggagacccaggattccctggtgcccccgggactgtgggagccccgggattgcaggaatccccagaanattgcngtccaaccagggacagtgggtcccaggggaggcgaggccccctggggcaccgggggagatggggcccagggccccccggagaaccaggttttcgtggggctccanggaaanctnnncccaccnnnnnccccgcgtcnctcctntccccngcttccggggagatgaaggaccataggcaccaggggcngattggccaagaaggtgcacaggcggtccaggggagcccggcctgccgggtatncaggccgcacgtca

SEQ ID NO: 487100 - DNA, 363 bp, Homo sapiens
ggtcaggcacgcgctgtagtcccagctactcaggaggctgaggcaggagaatcacgtgaacccgggaggcagaggttgcagtgagtcaagatcacgccactgcatcccagcctgggaaacagcgagactctgtctcaaaaaaaaaaaaagagggggtggatggccaggtttaattttgggcgggagatggaggagatccggttttaatgggagcttggtaaatggagccggggacgggtttattacaaggacttttactttttaaaattttaccttagtatttattttactcattaaaacaggctactttacgggtacccaggtgggtcaggtccatactcgtggagggctccaggggcctgg

SEQ ID NO: 487101 - DNA, 317 bp, Homo sapiens
ctcttctccctgacaccaaccaacatctacaagcatgaacaccacccagaaaaatatggcctcatcaaatgaactatataagacaacagggaataatcctggagaaagagatatatgacctttcagacagagaattcaaaatagccatgttgaggaaactcaaggaaattcaagataacacagagaaataattcagaattctatctgcataaatttaacaacaaagattcagcgaaccaagtcagaaatcctacgagttagagaaatgcaatggcacatattgaacgaaaggatcagagatctcttaagtaacagaa

SEQ ID NO: 487102 - DNA, 164 bp, Homo sapiens
tatatatcctcttctagaggagtccgtgttctgtaatcgagtaacaccccggatcaagcctcaccaccgtcttgctacagacttatatgaccgccgatcttcagacaagaccctgtatgaacagcgacaaagttatgcgcaatttacccactggtgaagaccgt

SEQ ID NO: 487103 - DNA, 192 bp, Homo sapiens
tccaggctgaccattgacaggcgggagtcgagaccaggctggacaatggcaaaacccgtctctaccaaaaatataaaaatagctgggtgtggtggtgtgcagctgtaatcccagctacaaggtaggctgaggcatgagaattgcttgaacctgggaggcagacactgcagtgaaccgacgttgtgccactgc

SEQ ID NO: 487104 - DNA, 631 bp, Homo sapiens
ctttgccccgatgatgtggctttgaagaactttgcccatactttcttcacccatctcatgaggagagggaacactgctgagaaactgatgaagctgccgagacccacgaggtggccgaatcttccttcaggatatccaggaacccgactgtgatgactgggagagacgggcttgtaatagccatgggagtggtgccattaccatttgggaaaaaaatagtggaatccagtcacttactgggaactgccaccaaactggcccactgcaccaaaaatgacacccccatttgtggtgacattccattgagcaccaccttacctgaatgagccggtgaaagccctccaagaattgggtgaccccagtgacccacttgcgccagatgggagcgcccgaatctggcttggccggaatatctctttgaccagcacaccctgggagaccagtgataatgaaagctaagcctcgggctaatttcccccataaccctggggtgactttcctggtcaccaacaggccagtgcaagcatgttggggtttcctttaccttttctataagttgtacccaaacataccccttaagattctttgatttgtacccttcccttccaaataaagaaatttggtaccccca

SEQ ID NO: 487105 - DNA, 638 bp, Homo sapiens
gtgaatgccgctgctatggtagggactcgtccacttcgaccgcagctatgtgatccatctcagacacctggataatgcactgggtcctgatgccgggcagacaggcatggacggtgaagccgtcagtgatcccagtcttgtgaaggcgtttctccagctgatcgacgccctcgatgaagaatttggacagctcaacgagtccattctccacatgctgcatctttgcctccctggcatgaatgatcatcagccgcggcattgccttggtagcgacagcctccactatgcaggagaggttccggtccagtaggtagtaatactgatccttctggctcatcatgggtatcggatacacagtctaggaggtcacgtagaagtattgatcttgggtgcccttgtgattaaagcgtgtctctcacttagcttgaaagacaatgtcattcgccatgatcgcgcctgcattgctatagaggttcttaagcaagtcaacgatcatgcctctagctccaatcgcaatctcaccagcgtttagccgcatgaggatgccagagttgccaaagttggtagcaacagtgtgcatcagggtgatggtcatccaggtgctcgacacggagtcgtgcaggttagccgaccgttcg

SEQ ID NO: 487106 - DNA, 253 bp, Homo sapiens
aacgtgcacagaaggacttttcctttgatgttcatgtgtgccactgggatattcattcaggtgaataccggtttgtaattcattatctgaacctggaacaaaactcagttttgcctgtcaacataaagtacctttccctctcaggttttgccttctctagaaatgatatgcaggtatatttatgtccaccatgtcacttgtgccctttgctctatccatctttcctaggtcttggcttccaagatatccagaa

SEQ ID NO: 487107 - DNA, 743 bp, Homo sapiens
  misc_feature (740)..(740): n is a, c, g, or t
gcaccgggaagggcgggggggctgcttttccccagtgtttaaaaggggttctttccaagccatttagtgggtaacgccaggttttccaattcagacgttgtaaactccgcccattaatgtctatattccccctttagggggatttgccaagtgtgcccggatatggcccgcacgcattagctttcccagtttagacttccctggggcgagccggcggacaagctattagtggtattggcatttcccgggggtttagtttttttttattttttacaaatatactggagaatcatgcaatgctgccagcattggatgcaatccggggccacaagtctgcacactcctttgctactggtcctgtaatggcagaacctttcatctcgcctttattgttcactatgactcctgcattatcttcaaaataaagaaacacgccatcttttctacggtatgactttcgttgtcgaatgaccactgctggatgtaccttttttctgagctctggtttgcctttcttgactgtggccatcaccatgtcacccacaccagcagcgggaagtctgttcagccgtcccttgatccccttcacggagatgatatacaggtttttggctcctgtgttgtcagcacaattgattacagctcctaccggaagacccaaggaaatccggaatttcgcaccagaggacccaccacgtcctcgcttcgacatcttgaacgccggaaaaaagaaaaaaggnccc

SEQ ID NO: 487108 - DNA, 450 bp, Homo sapiens
ccactgggacatgcaaagacatgaacgtcatcacatggagattttgcttccaggaaatggagaaagatattcatgattttgagtttcagtggaaagaagatgaaagaaatagccatgaaggaccccatgacagaaatcaaacagttgacgggtagtacaaaccgacatgatcaaaggcatgctggaaacaagcctattaaagatcagcttggatcaagctttcattcgcatctgcctgaactccacatgtttcagaccgaagggaaaattggtaatcaagttgagaagtctatcaacagtgcttcgttggtttcaacatcccaaagaatttcttgtaggcctaaaacccacatttctaagaactatgggaataatttcctgaattcttcattactcacacaaaaagcaggaagtacacatgagagaaaaatctttccagtgtggagagag

SEQ ID NO: 487109 - DNA, 381 bp, Homo sapiens
aggtactattatttctggttttataataagaaaatttttgtttaatcaaatggggcctttcaaccaaataacatttcaggggtttagtttttttttaaaaggttttgttaccttaaagcaagtaccttttgttgtggctttttttaaaaaaaccgggcctaaaatggttaaaaatgtaatattttctaaaatccggttttggggtaatgttgccgggttttactttattgcatcttttttggttaattgtatttaagccttgtgcaatcacttgggaaaaattttaaatttttaacattggggttttaatacattttaagccctttgtttttaaatttcttttgttcccggggttttaaaaataaattttggccaaattta

SEQ ID NO: 487110 - DNA, 783 bp, Homo sapiens
  misc_feature (491)..(491): n is a, c, g, or t
taacaggcttcgcctgtgcttcctgttcctcttttaccaaggacccgccaacatgggccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcaggttatgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaantaacatctgggacatcacacacatacactaaataactaaactacctgttttcggtaccgcctcagactccatggaaaagttttcgacacattttcgttgtgagcccgactgcccccggatagggttagtctacctggctatacgtattttcccgtagaaatctcgggactgataacagtgccggggcttcctgcaccctaataatatagccccgtggtcaacgaaagctttctgaatacaccaccatggggatcatggaggcgaatgagggtctgtcgagggctcaagcaga

SEQ ID NO: 487111 - DNA, 1099 bp, Homo sapiens
  misc_feature (639)..(639): n is a, c, g, or t
  misc_feature (642)..(642): n is a, c, g, or t
cctgatgtcgccacgatttcccgctcggccgtgggtggtgaagcttgtagcctcgctccatgaggatctttcatgaggtatcggtcaggtcccggcccagcccggtcccaacgcccggatggctgggggagggcgtagccctcgtagatgggccccctgtgggtgaccccctctcccgagtccctgaccatgccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcaggttatgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaattctgggacnacnatacataatagatagaaacgaggaaccccgcgggcatctcaagtcgaggcggcgggcaaaaatggcgtgtgagtagagatgtggaccacttgggccaatgagcggagttgccctggaaccgcaagagttacctttggtcccacagtgggtgaaatctggccggagctcccataatgaggagagtcggtataaaatgcggcgataaaagcccgagggttcaccccggcgtgttagtgagaccggcgggaaaaccggccacttgtgagggagggtaatacccaccggcgtgaacccaatcagaccaaatagtccattggaccgcgcccggggatttcacagactttcagttaacaaacgatgcaagccctgggcttttgaaaacaacgccatgctgtgtgcccactgcacagacacatctcaatcccagcttcgtacgacgccgagaagggtgtatacc

SEQ ID NO: 487112 - DNA, 590 bp, Homo sapiens
  misc_feature (587)..(587): n is a, c, g, or t
ctggcaggcaagggcggggatatcagatgaataaaggacgaaagaaaagaaaggaagaaagatgggaggggtggatagatttattcaattttgttttgtaaaaagatgcattttttattcaagtgttattggggacagataaaaagctggaggtatttttttctatccgggctctcagtgttgcacactcctttgctactggtcctgtaatggcagaacctttcatctcgcctttattgttcactatgactcctgcattatcttcaaaataaagaaacacgccatcttttctacggtatgactttcgttgtcgaatgaccactgctggatgtaccttttttctgagctctggtttgcctttcttgactgtggccatcaccatgtcacccacaccagcagcgggaagtctgttcagccgtcccttgatccccttcacggagatgatatacaggtttttggctcctgtgttgtcagcacaattgattacagctcctaccggaagacccaaggaaatccggaatttcgcaccagaggacccaccacgtcctcgcttcgacatcttgaacgccggaaaaaagaaaaaaggnccc

SEQ ID NO: 487113 - DNA, 744 bp, Homo sapiens
gccccacaggctgctgccaccggctgctgctgctgctagctctgctgctcgctgccagcccaggaggcgccttggcgcggtgcccaggctgcgggcaatgggtgcaggcgggttgtccatgggggctgcgtggaggaggaggatggggggtcgccagccgagggctgcgcggaagctgagggctgtctcaggagggaggggcaggagtgcggggtctacacccctaactgcgccccagactgcagtgccatccgcccaaggacgacgaggcgccttttgcgggcgctgctgctcgcgcgaagccggctgctctcgggccgcggccgccttgtgtttggcggaagggaatctcttagggaaagttaaaccccaagcagggctattgcccgcccacgggatgtggaacctgcagaggaccaacagaggactccaggcgagctctaccacgccctcccagcccaattctgcggggtgtccaagacactgagatgggcccatgccgtagacattctggacctcaggtgctgcagcaaactccagacctgaggtctaccgcagggggctcaaaacagtctacgttgcccgaattggtgaccatcgaggcgttctaccggaaggccggcagtgcgcgctcctcccaaggggcagcggccgagggtccctgctggtgttgtgcatccggattggcgaggtcccctggcagggttcctccagattggccatggaagctcctacccttgcgca

SEQ ID NO: 487114 - DNA, 937 bp, Homo sapiens
  misc_feature (127)..(127): n is a, c, g, or t
  misc_feature (203)..(203): n is a, c, g, or t
  misc_feature (205)..(205): n is a, c, g, or t
  misc_feature (213)..(213): n is a, c, g, or t
  misc_feature (216)..(216): n is a, c, g, or t
  misc_feature (222)..(222): n is a, c, g, or t
  misc_feature (249)..(250): n is a, c, g, or t
  misc_feature (293)..(295): n is a, c, g, or t
ggtaggtgttttggctcgaggcctgcatcctccacaatcgtcccccatctgcagcttcccgcggtcctcagcccacagagaggccctgggccgggaaggcgcagagccctgtcaggctggagcgcancgggacggcggattccgcattaagcccggcgcccggcactgtttagccgggccctctccggctcagcgcagccggngntccccaancanaccggncggggctcggcgccgcactcttcccannaaggttgcgctggctcgtgagtgatcctgtcctctccacccgnnngggccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcaggttatgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaatctgggacaacagccttagaaacacaagaaagagaaactgggaggcctatattgcgggggcgggaaagaggggttggagaagatgggcctaaccggtggtgtatcctggttgtcgctgacgcagaggtttgctgtgtactagatggggcagaatctggccgggtccctatagtggaggtctgcatgaattacaataaacgag

SEQ ID NO: 487115 - DNA, 2062 bp, Homo sapiens
  misc_feature (695)..(695): n is a, c, g, or t
  misc_feature (701)..(701): n is a, c, g, or t
  misc_feature (1602)..(1602): n is a, c, g, or t
  misc_feature (1605)..(1605): n is a, c, g, or t
agctgtgtgtgatatctcttcatggcgtcaagtttatatctcttggtggtgaacatttcttccggtggacgatgccttggggatgtcttctccctgccggtcacgagtatagtagcgaatcacacgtgttgccccaccctagttgtgttatctagacaggtgtgctacccactggcaccgttgagagagtcatgccttatgattgcccgccatggctgccacagttttggagaacagggtcagttcggctccagccaattgcaagccgtgcgtacttccaggaggaagctaccatggtataccagtcatggacagtatctactaatgacttgtgggactcaaaacccagataatacttttgagcccaaaattgtaaatacagcaattgggagatgctgtaaagtctgcaactcacacgaacagcaaggattgctttaaaacacaaatgcccagagtttccattttcagaaaagtgatggtcagggtatgtctaaaacatctgtagagcctgggtgggcagatcacttgagatcaggagtttgagtcgtttggcaaacatggtgaaaccctgtctccaccaaaaatacaaaactagccaggcatgacggcaggtgcctgcaatcccagctacttaggaggctgaggcaggagaatcgcctgaaacctggaagtgaacagggagacaagcactgcanacaaanactttttaatggctttagtttttttttattttttacaaatatactggagaatcatgcaatgctgccagcattggatgcaatccggggccacaagtctgcacactcctttgctactggtcctgtaatggcagaacctttcatctcgcctttattgttcactatgactcctgcattatcttcaaaataaagaaacacgccatcttttctacggtatgactttcgttgtcgaatgaccactgctggatgtaccttttttctgagctctggtttgcctttcttgactgtggccatcaccatgtcacccacaccagcagcgggaagtctgttcagccgtcccttgatccccttcacggagatgatatacaggtttttggctcctgtgttgtcagcacaattgattacagctcctaccggaagacccaaggaaatccggaatttcgcaccagaggacccaccacgtcctcgcttcgacatctaagaaggcggcccgggtcatcatagaaaagtactacacgcgcctgggcaacgacttccacacgaacaagcgcgtgtgcgaggagatcgccattatccccagcaaaaagctccgcaacaagatagcaggttatgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaattctgggacnacnatacataatagatagaaacgaggaaccccgcgggcatctcaagtcgaggcggcgggcaaaaatggcgtgtgagtagagatgtggaccacttgggccaatgagcggagttgccctggaaccgcaagagttacctttggtcccacagtgggtgaaatctggccggagctcccataatgaggagagtcggtataaaatgcggcgataaaagcccgagggttcaccccggcgtgttagtgagaccggcgggaaaaccggccacttgtgagggagggtaatacccaccggcgtgaacccaatcagaccaaatagtccattggaccgcgcccggggatttcacagactttcagttaacaaacgatgcaagccctgggcttttgaaaacaacgccatgctgtgtgcccactgcacagacacatctcaatcccagcttcgtacgacgccgagaagggtgtatacc

SEQ ID NO: 487116 - DNA, 1546 bp, Homo sapiens
  misc_feature (1086)..(1086): n is a, c, g, or t
  misc_feature (1089)..(1089): n is a, c, g, or t
gccaaattgggttaagccagagtcccaataaaggagttgtaattcgaaggccaagaattgttaatgaatccaccataggggtaattgccaaagttagacgaaaaaagggttaaaaagcaatagggccaaattcaaagttgcattttccaaatcggccatcaaggtttaaaactgtttggaaagactgattatttagggtttagtttttttttattttttacaaatatactggagaatcatgcaatgctgccagcattggatgcaatccggggccacaagtctgcacactcctttgctactggtcctgtaatggcagaacctttcatctcgcctttattgttcactatgactcctgcattatcttcaaaataaagaaacacgccatcttttctacggtatgactttcgttgtcgaatgaccactgctggatgtaccttttttctgagctctggtttgcctttcttgactgtggccatcaccatgtcacccacaccagcagcgggaagtctgttcagccgtcccttgatccccttcacggagatgatatacaggtttttggctcctgtgttgtcagcacaattgattacagctcctaccggaagacccaaggaaatccggaatttcgcaccagaggacccaccacgtcctcgcttcgacatctaagaaggcggcccgggtcatcatagaaaagtactacacgcgcctgggcaacgacttccacacgaacaagcgcgtgtgcgaggagatcgccattatccccagcaaaaagctccgcaacaagatagcaggttatgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaattctgggacnacnatacataatagatagaaacgaggaaccccgcgggcatctcaagtcgaggcggcgggcaaaaatggcgtgtgagtagagatgtggaccacttgggccaatgagcggagttgccctggaaccgcaagagttacctttggtcccacagtgggtgaaatctggccggagctcccataatgaggagagtcggtataaaatgcggcgataaaagcccgagggttcaccccggcgtgttagtgagaccggcgggaaaaccggccacttgtgagggagggtaatacccaccggcgtgaacccaatcagaccaaatagtccattggaccgcgcccggggatttcacagactttcagttaacaaacgatgcaagccctgggcttttgaaaacaacgccatgctgtgtgcccactgcacagacacatctcaatcccagcttcgtacgacgccgagaagggtgtatacc

SEQ ID NO: 487117 - DNA, 1599 bp, Homo sapiens
  misc_feature (1139)..(1139): n is a, c, g, or t
  misc_feature (1142)..(1142): n is a, c, g, or t
gcaccgggaagggcgggggggctgcttttccccagtgtttaaaaggggttctttccaagccatttagtgggtaacgccaggttttccaattcagacgttgtaaactccgcccattaatgtctatattccccctttagggggatttgccaagtgtgcccggatatggcccgcacgcattagctttcccagtttagacttccctggggcgagccggcggacaagctattagtggtattggcatttcccgggggtttagtttttttttattttttacaaatatactggagaatcatgcaatgctgccagcattggatgcaatccggggccacaagtctgcacactcctttgctactggtcctgtaatggcagaacctttcatctcgcctttattgttcactatgactcctgcattatcttcaaaataaagaaacacgccatcttttctacggtatgactttcgttgtcgaatgaccactgctggatgtaccttttttctgagctctggtttgcctttcttgactgtggccatcaccatgtcacccacaccagcagcgggaagtctgttcagccgtcccttgatccccttcacggagatgatatacaggtttttggctcctgtgttgtcagcacaattgattacagctcctaccggaagacccaaggaaatccggaatttcgcaccagaggacccaccacgtcctcgcttcgacatctaagaaggcggcccgggtcatcatagaaaagtactacacgcgcctgggcaacgacttccacacgaacaagcgcgtgtgcgaggagatcgccattatccccagcaaaaagctccgcaacaagatagcaggttatgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaattctgggacnacnatacataatagatagaaacgaggaaccccgcgggcatctcaagtcgaggcggcgggcaaaaatggcgtgtgagtagagatgtggaccacttgggccaatgagcggagttgccctggaaccgcaagagttacctttggtcccacagtgggtgaaatctggccggagctcccataatgaggagagtcggtataaaatgcggcgataaaagcccgagggttcaccccggcgtgttagtgagaccggcgggaaaaccggccacttgtgagggagggtaatacccaccggcgtgaacccaatcagaccaaatagtccattggaccgcgcccggggatttcacagactttcagttaacaaacgatgcaagccctgggcttttgaaaacaacgccatgctgtgtgcccactgcacagacacatctcaatcccagcttcgtacgacgccgagaagggtgtatacc

SEQ ID NO: 487118 - DNA, 217 bp, Homo sapiens
gatcttagagtagcagactaatattccaagcagtgtgacacgctgcattcctttaaagcacatgatgtcaattgttcaagtagttttctggttttaagagacaataacaatattgaacaagctttaatgatggcttctccccatccacatgtttttgtaccttagagacacttggagttgatgtacatcacccactccaactctcttatcttataga

SEQ ID NO: 487119 - DNA, 338 bp, Homo sapiens
ttttttttttcgaggcagagtcttgctctgtcacccagggtggagtgcagtagcatgatctcagctcactgcaacctccgcctcccaggttcaagcgattcttctgcctcagcctcctgagtagatgggactacaggagagtgccaccatgcctggctaatttttgtatttttggtagagatgaggtttcaccatattggccaggctggtctcgaactcctgacctcgtgatcaacccaccttggcctcccaaagtgctgggattacaggcatgagcaccatgcctggagtaatattttaaatttctttaatgacacaccaccatacaaaagcgtcga

SEQ ID NO: 487120 - DNA, 1472 bp, Homo sapiens
  misc_feature (695)..(695): n is a, c, g, or t
  misc_feature (701)..(701): n is a, c, g, or t
agctgtgtgtgatatctcttcatggcgtcaagtttatatctcttggtggtgaacatttcttccggtggacgatgccttggggatgtcttctccctgccggtcacgagtatagtagcgaatcacacgtgttgccccaccctagttgtgttatctagacaggtgtgctacccactggcaccgttgagagagtcatgccttatgattgcccgccatggctgccacagttttggagaacagggtcagttcggctccagccaattgcaagccgtgcgtacttccaggaggaagctaccatggtataccagtcatggacagtatctactaatgacttgtgggactcaaaacccagataatacttttgagcccaaaattgtaaatacagcaattgggagatgctgtaaagtctgcaactcacacgaacagcaaggattgctttaaaacacaaatgcccagagtttccattttcagaaaagtgatggtcagggtatgtctaaaacatctgtagagcctgggtgggcagatcacttgagatcaggagtttgagtcgtttggcaaacatggtgaaaccctgtctccaccaaaaatacaaaactagccaggcatgacggcaggtgcctgcaatcccagctacttaggaggctgaggcaggagaatcgcctgaaacctggaagtgaacagggagacaagcactgcanacaaanactttttaatggctttagtttttttttattttttacaaatatactggagaatcatgcaatgctgccagcattggatgcaatccggggccacaagtctgcacactcctttgctactggtcctgtaatggcagaacctttcatctcgcctttattgttcactatgactcctgcattatcttcaaaataaagaaacacgccatcttttctacggtatgactttcgttgtcgaatgaccactgctggatgtaccttttttctgagctctggtttgcctttcttgactgtggccatcaccatgtcacccacaccagcagcgggaagtctgttcagccgtcccttgatccccttcacggagatgatatacaggtttttggctcctgtgttgtcagcacaattgattacagctcctaccggaagacccaaggaaatccggaatttcgcaccagaggacccaccacgtcctcgcttcgacatctggccaaattcttgagcccggggatccattgtctagaggggccgcacccgcggggaagctcagttttgtccctttaatgagggtaatttcaggctggcggaacatggcataagtggtcctgtgggaaatggtatcccgtaccaattcaacaacatacgagccggaggataaagtgtaaagcctgggggcctatgggggggccaacctcaataaatgggtgggccaattggcgctttcacaggggaaacctgggtgccaagtgatatatgtaacggccaacccccgggaaaggcggg

SEQ ID NO: 487121 - DNA, 453 bp, Homo sapiens
  misc_feature (10)..(10): n is a, c, g, or t
  misc_feature (28)..(28): n is a, c, g, or t
  misc_feature (40)..(40): n is a, c, g, or t
  misc_feature (81)..(81): n is a, c, g, or t
  misc_feature (100)..(101): n is a, c, g, or t
  misc_feature (107)..(107): n is a, c, g, or t
  misc_feature (202)..(202): n is a, c, g, or t
  misc_feature (227)..(227): n is a, c, g, or t
  misc_feature (230)..(230): n is a, c, g, or t
tcccctgggnctcctcccctccccaaangccccgtcaagncctgaaaactcgccctccccccccgtgacctcctgcccctncggggctcgccaaaggccnnctggtncactccgtccatccattttgccccccggagaccgtcctttcctttgtgcccttgatgttgaagagcgccctctcttttgaagcaaacaagcattnctatatgcaaccagagtagaggggnacngctcagcaggtgtgacccagggttctctgaatctgttattgtttttgcttctggaaagttcatttggggtttacaacaactaggatgtgttgggtgagatgtttcagatctggagaaatgagcaggtgtcgggaaatgtgtgacttaaccgtggtgagggctggaaatccaaactcaccaccatgatctgtgaaataaagcccttagcagtgtgaaaaaaaaa

SEQ ID NO: 487122 - DNA, 924 bp, Homo sapiens
  misc_feature (44)..(44): n is a, c, g, or t
  misc_feature (82)..(82): n is a, c, g, or t
  misc_feature (85)..(85): n is a, c, g, or t
  misc_feature (95)..(95): n is a, c, g, or t
  misc_feature (106)..(106): n is a, c, g, or t
  misc_feature (137)..(137): n is a, c, g, or t
  misc_feature (144)..(146): n is a, c, g, or t
  misc_feature (174)..(174): n is a, c, g, or t
  misc_feature (202)..(202): n is a, c, g, or t
  misc_feature (208)..(208): n is a, c, g, or t
  misc_feature (210)..(210): n is a, c, g, or t
  misc_feature (212)..(212): n is a, c, g, or t
  misc_feature (214)..(214): n is a, c, g, or t
  misc_feature (216)..(216): n is a, c, g, or t
  misc_feature (218)..(218): n is a, c, g, or t
  misc_feature (220)..(220): n is a, c, g, or t
  misc_feature (225)..(225): n is a, c, g, or t
  misc_feature (310)..(310): n is a, c, g, or t
  misc_feature (392)..(392): n is a, c, g, or t
  misc_feature (396)..(396): n is a, c, g, or t
  misc_feature (470)..(470): n is a, c, g, or t
  misc_feature (534)..(534): n is a, c, g, or t
  misc_feature (570)..(570): n is a, c, g, or t
  misc_feature (581)..(581): n is a, c, g, or t
  misc_feature (585)..(585): n is a, c, g, or t
  misc_feature (591)..(591): n is a, c, g, or t
  misc_feature (611)..(611): n is a, c, g, or t
  misc_feature (632)..(632): n is a, c, g, or t
  misc_feature (641)..(642): n is a, c, g, or t
  misc_feature (647)..(647): n is a, c, g, or t
  misc_feature (649)..(649): n is a, c, g, or t
  misc_feature (658)..(658): n is a, c, g, or t
  misc_feature (660)..(660): n is a, c, g, or t
  misc_feature (682)..(683): n is a, c, g, or t
  misc_feature (685)..(685): n is a, c, g, or t
  misc_feature (692)..(692): n is a, c, g, or t
  misc_feature (703)..(703): n is a, c, g, or t
  misc_feature (707)..(707): n is a, c, g, or t
  misc_feature (719)..(719): n is a, c, g, or t
  misc_feature (789)..(789): n is a, c, g, or t
  misc_feature (818)..(818): n is a, c, g, or t
  misc_feature (840)..(840): n is a, c, g, or t
  misc_feature (846)..(846): n is a, c, g, or t
  misc_feature (848)..(848): n is a, c, g, or t
  misc_feature (872)..(872): n is a, c, g, or t
cttactataatatgaactgaggcccagaaggaaatcccttagtntttttttgatttaacgacagtgtcttgtgatgtggaanttntctcagtctntcatctttgcnaaactgttgcttagtattctggttttttttnttttttnnntttttatttacaaacttctttgggtgtnaggatgtgctgccacaaggccaaaaatnacattntntntntntntnctctnctctctaccattctcctcagtgccaggtggggacagattccacccactgggcctgggaggaagaaaagcaccttggccactagtnagggaggagtcacagccagcaagaagagagagacctaagtagacaagagtagtttcaatgggaagaagcagggccaccagtnaganaaccaggagactccttctgaaaggcttccacctgggaggaaagatggcagcagtgccatgaggaggccagatcnctcctcctcaatcctctgcgccgggccctcccagagtcacttcttcagggcacccaggctcttnagggtctcttgggcatgggtcagctgctgctgcagnatctgagcggngtgntctaantgaaaggacgatttagagtngaccatgcatcttctccaccntggctcggnngccangngtgaagtanancgcccgccccgcccggtccccnnangaggccngacagcggccngtgntgtcaaaggacnagttggcgatacactcgccatggacccgctcaaagcactcctccttctcgccccgccgggtattgtaganatgaatactactgccactggccaaggccnagacctgggcgttggggggagncggccncncggcacggcgcggcacccgcggcntcttcaaagcggcctgtctttagcaagtaggggtctgcttcttcttgtattc

SEQ ID NO: 487123 - DNA, 1206 bp, Homo sapiens
  misc_feature (695)..(695): n is a, c, g, or t
  misc_feature (701)..(701): n is a, c, g, or t
  misc_feature (1203)..(1203): n is a, c, g, or t
agctgtgtgtgatatctcttcatggcgtcaagtttatatctcttggtggtgaacatttcttccggtggacgatgccttggggatgtcttctccctgccggtcacgagtatagtagcgaatcacacgtgttgccccaccctagttgtgttatctagacaggtgtgctacccactggcaccgttgagagagtcatgccttatgattgcccgccatggctgccacagttttggagaacagggtcagttcggctccagccaattgcaagccgtgcgtacttccaggaggaagctaccatggtataccagtcatggacagtatctactaatgacttgtgggactcaaaacccagataatacttttgagcccaaaattgtaaatacagcaattgggagatgctgtaaagtctgcaactcacacgaacagcaaggattgctttaaaacacaaatgcccagagtttccattttcagaaaagtgatggtcagggtatgtctaaaacatctgtagagcctgggtgggcagatcacttgagatcaggagtttgagtcgtttggcaaacatggtgaaaccctgtctccaccaaaaatacaaaactagccaggcatgacggcaggtgcctgcaatcccagctacttaggaggctgaggcaggagaatcgcctgaaacctggaagtgaacagggagacaagcactgcanacaaanactttttaatggctttagtttttttttattttttacaaatatactggagaatcatgcaatgctgccagcattggatgcaatccggggccacaagtctgcacactcctttgctactggtcctgtaatggcagaacctttcatctcgcctttattgttcactatgactcctgcattatcttcaaaataaagaaacacgccatcttttctacggtatgactttcgttgtcgaatgaccactgctggatgtaccttttttctgagctctggtttgcctttcttgactgtggccatcaccatgtcacccacaccagcagcgggaagtctgttcagccgtcccttgatccccttcacggagatgatatacaggtttttggctcctgtgttgtcagcacaattgattacagctcctaccggaagacccaaggaaatccggaatttcgcaccagaggacccaccacgtcctcgcttcgacatcttgaacgccggaaaaaagaaaaaaggnccc

SEQ ID NO: 487124 - DNA, 431 bp, Homo sapiens
cttgtggcggttcatgcctgttatcctagcactttgggaggctgaggcagctggatcatctgaggtcaagagtttgagaccagcctgatcaacatggcgaaaccccgtctctactacatacaaattagccggtcatgctggcagatgcctgtaatcccagctacttgcgaggctgaggcaggagaattgcttgaatccagcaggtagaggctgcagtgagccgtgactgcaccattgtacttcagcccgttcgacagagcgagactctgtcctcacccatccctctatccccatcgttctcattcttcaacatcaacagctgccggcaacaccgccacgatcgtcttcccaactgctgctccccgtctcctgtttttcctcccacacacatcccaccacaccgcctcactctccctatcacgtattccccc

SEQ ID NO: 487125 - DNA, 590 bp, Homo sapiens
  misc_feature (234)..(234): n is a, c, g, or t
cctggggtgatctagaggacccccagtccaaatccggggtaccagggtgacttctacatccaggatcccatctacggggagtacaggtatccctacctcacaagccaacaactattactccctcatcggggggcatcaggggttcattacctatgatgacagacctcacctcagggtacacagtctccagcaggtcggcaaggccaacaagggtcattccttcatctcccacgntccagaatacagaaacctcaagtctggttagcagtgagtgtcggctaccacgtcccaggggaggaccaattttcacaagtacggagaacactccaacagggtccctccggacaagctttccagggacacattcattttcctctgccagggtcgggcagcgagggtagggaccactcacacccagagtatctcctcacccccagccatcaccagtacactccacacaagagcggaatccaccccatcacctacaagcaccaggtcattcacaacatttacaaagagggaaacaccttcatccggggtagctagaattacaggcatgcaccagcaaacccgctaattttcggtatctc

SEQ ID NO: 487126 - DNA, 262 bp, Homo sapiens
aatctagcttgcaagccgtaagggagaatcgtgtgacggcatgcgatgacttcttcttctgtttcaaacggaagaatgttacgattggtgcgaatacttcttcacatacaaccttcatttgcggggttacgtccgttaataccgtcggttgaagcaacgttccttgccgctgtccgcctgtgagtaagcgagctccttgagaaacggcttcttgtatccatgcttccgcccggcacgctgcttctaatgtaatcatcggacc

SEQ ID NO: 487127 - DNA, 1267 bp, Homo sapiens
ccgtacactctggaccacaccccggcactggggactctgcacggtcccttccagccctaagataccccaccgcaggaaacgcccctggacctcaactcccaaaaactcacgcgaaaggcggcaagtcccacaacaccggaggaccacccttcacgtctgccgccttatgaactcgcatacacactgcgttgcgcggcggccctcatatacccggaaccctagacgccatccccggaaagaaggggaacattggagcctagtgtcatggtaaaccacatcgctccatgtaccacccgcgtgagctatcctcttcacgatgttgcaaccgcctccgtaagtaacgtgacggtattgccctacacaaggacccacaagatggatgaaactgtctagctacaaccaaaaagttcccgcggataaatgagggatcaacgagaccacaattacttcaaccccaatggatcgtcaagttggttacaaccaaccacatgtcaggcgtagcgataaagcgtactagtagcgcggacgtctttgggcctcctgtaagcacctccatagctcgaatacgtttacacacatgacaggtcctttcggcaaaggacgtctgtaccaaagcatcgtcaggcaagtgtcatacaagagtgactatgagacacgtgcccaagtctcctggcctgtttgagacaccacctgtggggccatgtgctctcgaagagagacgtctgattcgacgaccaggcaagcaaagaagtcaagtcttggccaagaaagcctaggatcacgcgaaccacacgtcaggaacttaggcccacacaccatggaatcaggcctctgcagacacggccaggcatacgctgaccacagacaaggcgcacagcttggcctgctggccgtccagccgagtggcaatcgtaagtcaggcccgcgatcgtgtactcaaggatgaagcaagagatcgatgactggactgatccggctaacttccaccatgccccgacgtctctctatccttgctgtcgtatccgatagatcccttagcccgttgcacgacccgaaaacaggtcgccaacaaatggctttcatcacgtaatatgcgtaggcattctcggtggacttgtcactttgtattctagtggatgtctgctattaagtgttcatctattagtagtgctatacattgtataagactgtcctctttgaagatattgaaaatttaaggttcacgtatgaatatcaattttgaatttttaatggtgtttatgattac

SEQ ID NO: 487128 - DNA, 891 bp, Homo sapiens
  misc_feature (1)..(1): n is a, c, g, or t
naccttgtgcccgccgcatgctctgctcagcacacatgaatgctttgggccccgcacctgttcgggggccgcccatgtgtggcgcccggcgtccctttgtgggacctcgcggggggccccctttttagtctggcgtatacatctcggccgccgggatctttcatgccgccccctggccccagagggagaagtgtaagatgttggtcggcaccccgcggagtgtttgtatcgacacagtgggtactcgcccgcccgagtcgagcgtcgacgtgggccaccacatttctcgctcgcacttctgtgccaggccgcgccgcgctaatctttttgtctctcggcgcgcctccgcgtgcgtctgtatctccacttgaatagtgctgctgagtgcgagcgcgagtaatacagactgtgccccacatagcctgtgctgtaagagaacacaacatctaaatgtaagtttcatagccgaccccccatattcaacgggccacgcctgctggtgtggcccgccacgcccctccgtaacatcccgcagccaccttttgggaggagttgtcacagagcgggggggagttaatacctaacgcgcaccgcggaggtttttacagaaacctcccgctctggcgcaactcagtgctcttgtgtacccccttctttgtcggtgtagctcgcaccgaagtttacgtgagcactcccttgcgcagcactcctgtattccccaccattcatcgcgcggctgtggcccagcagtatgctaggtggaacccgccgggggcgcagcagtttccgcccggtggcccccaggttggtcccctcagccactgccccccctggggtggtaccgaggtgcaggtgccgccgttttctaaaaacccccaccacccacatgac

SEQ ID NO: 487129 - DNA, 1015 bp, Homo sapiens
gaagagacctgtgtatggcaggcgtcacgctcgatttcaattgtgtactgggttcattgcgatgctctcgaggatgttgccctacgagtcatcgaacgctccgtaccttgcgttcgcccccttaccctgacagatccgtgtgtcctcatgggaatgacgcaggaggacaagtcatcgactggcctgagatatctatttgcgatatcaccttgttactgggaccagaaatcaggtcatggatatccagctggttcatcactgccttgtttgtgcctcgcgacaaagtcccaataatactattcacttaagagtattttatggtcgactcaagacatggtcgtagattcattggtcagtaagagataaggattttacgaatagtctagcacagatcctcgaaggagcaatctacttcgcgagatctccataagatccaatcgatggtgtcgcatacagtataggtacagatcattacggtttggtaaggcggtcattgagggtcactgaaagtttgacattaaagccacacgtacaatgttcagaacccaagctacagccccgcctatagtgctatctcttgataaaggtttgcgaaagcgttgacctgaggagcgtttcgcctaggagccttacagagatttggctccttgcgtgtgagagattgtagccctgtgagtctccttggggtggcctgcctattcgcctcggctgtgtcatggattctggtcgaccttgccatgatcaccaagatcctcggtagacaagctgagcgagtaccgagtaccatgagacgagcccggcggcctgagagatgcgagcgacgtaccacttggtgcagtccaaggcgttatggccggggcgcgcaccggaacacctgaaacgtccgtggaccaacgcggccccgcggcggagcgcattcgagcacccggcacaggaacgcgaccgggacaaccaggtacacctaacgtcgcgggccccccaatgtaccccccgggggccggacaggggcccccca

SEQ ID NO: 487130 - DNA, 1572 bp, Homo sapiens
  misc_feature (771)..(771): n is a, c, g, or t
  misc_feature (960)..(960): n is a, c, g, or t
  misc_feature (1194)..(1194): n is a, c, g, or t
cgtggtggctgtggtgcgggcgcgcgttgggagagcgacggtcggtggttgtgtgggtagatggagtcggtcggtgcgtgtgcggtgggcgtggtagtggtgtgtggtgcgctggggtgcatgggatggttgttgtttgtgctgcgcgtggtgctgggtcgctggcgtggtgtttctgcggcgggccgttgtgtgcgtggtgcgccgacaagcggtgggggggggaacgtggcttgtgttgccacggagcgcgtgggttgtgagtggagcccccccgtttgtgccgccccgcggggctgttgttgacgccgcggtggtagtttgtgcgggaaaagtctcggggggcgtgggtgcgccgccgccatgtggaagtaagagggggccgttgtccgtgtgtagagggattgtttgtgaaacccgtgggaggggggttgtgtgtccccccagaaaatgtgtgtcccacgcgcgccgacgggaaagggaggatgaaagagccgcccgctgtgttgagtgacgccgattcatgggtcgtgtgaagttgggggtagaaacacattagggggccaggcgatgtgggcaccggtaagtgaaagaggtgtggcccgcttgtaaagttgttgagtcgaaatgtggtgggcctttctgtcacccccctgggaaagggtgtgcgcacccagcgggatgttgaccttctttaagataggcatggcgcatgtgtgtggaaaaaatttttaagggggatgtggaggaccttcgcgtgtgtgttggaanctcgggaggccgcctttggagcaaatgtgtataagagtgtgggggatatgtgtgtgtgaactcttatgtggatatgctccactgtggccaaatgtgggaggatacccccaggcacccaagcacacatacgccaattttaggtttttgcgtggaaagaaggttttaggaacatcccaacgcctcttctgngggcgtgtgccagaggacattgtgccgctcatatgttgctgttgatatatccgaacaaccatgctcgaatgaaaagtgtgttgtaatatgtaaggccctttccttatgaaagtgtgcacagagatatctccacagatatatataaaacgcacacatatgtgtgaccacggtgtataatctgtatatgtgaatatatatgccactctgtgtgcacatgtatatcgtctgtgaagngcgcgcgagatatacacacatgtgttataaacactaccaccaggcttatacaagagtgagattatattcacaaaccctctttctcttgggagaaactctttgtaagaattgtgaattatttctataatggagaggagatttcgtattatcccacaaataccacacatacaaggtgagaaatgaaagagaatagttggtgttataaataccggccattgagaacccatcccatcttccaataaccaccataataatatttttcattcctctgctattcgtgtactctcctcgccataattaaaatttgtaaagatctttcttccttgatggtttatccaatagtcactcatttgccctaataaaaaacatttccagata

SEQ ID NO: 487131 - DNA, 382 bp, Homo sapiens
tcaaattggatacatgctggtttagggattgtcaattacctcatcaaatattttgtagtctgattacagctgtacagaaaataagggaataattcaaacttggagcactggctttggcctgggtgggagtatcatttttcaacctgtggaataagcagtagcagaaacatttataaaaatggatgtggtgtttacgttcttgagtgatcaacgttttgtagttttcgttgagggaaaaatgagtggttggcatgaaataaaaacaaaagtactttaaattaaggatttgcagtttttttgctgtttggtttgcagtcatcctagaacctgggtgacctcacagtttcacgtcgacgcgaccgcgaatttagtagtagtaggc

SEQ ID NO: 487132 - DNA, 1350 bp, Homo sapiens
gcgaccggacggagggccgggaggtgcggggtctgcgtgatgcgagctgcgcctctcggcaaagatttcgcgctgcccatcctcgggtcctttcatcagtaatctggtagttggatcacgtctgccaagtcggcagtgaagaattaacggaaacgacaacggagacgctcggttctctcccgcttgtgctcacttgcggcctcctctttcccttcgcctccggccgccggtgcaaacctgacgcttatacacatcggcgacctggacgttgtaacgttaccccgatggcgaacggaggagcctcgctagagcaccctgtatacttttgaccgtgtcttacggataccggggcagagcacttgttgtaggttgaatagctagtctcgtgcgtgggtgcgtctgctgggggcccggtggtgccgcgggtcttccggcgggggacggccccgcccatttcgtggcctgtcgcgctgttgtgcccgtaagtgcctttgggctagtcctacgccttgttcttcctgcgctttgctgctgtggcaggctgggtgcccctgtggaagtgcgtttgttggaactcctgcgcccacgtgcgccactcctttggctcttccagttgctaccctcctgcgggctcctcgggcgcctggtcagccccttgtggggagcgtcatctgggtcactgggctaagttgcggagcgcaggcacgcccgactagtctgtacgggagtaccgcgggggacgtcccgtcgtggctcttcacactgtgagcagccgtggttttgatggcgcgtctctgtgttcggcatggcctgttggtgcgtgtgccttggctgcctgttgcgtgtgtctgagctcgtttttcgtttccgctccgccgttgctctcccgccctgttctccccagtcttcgccgagtgtctcgtgtgtgctctgtgggcgtgccgttcgtgcacggccccattccttctgggcgcccgtgctcggctgtgggggccgcccatttttcatccgaagttgtgcgtcaaccaccgcgcgaggcctcccacccagatccaggcgagtgcacagcgatttggggcatctccgcgccggaaccgcggctcgcactctccaatcggtcgatttcgccaccgtatctcctatgcgatgtcaaccgcacggcgtcctggattccggtccgccgaagtgcccggagtcgacacagattcttcgggtcgaccgcacaatgtccttcgtcgccgcatccccacactcttgctcgcacgcgcgaccgacatgtggtccggcatcgcctgcgaccgacggtcagtcgtctactgatcgtccgattcgctcctcagcaagtcggag

SEQ ID NO: 487133 - DNA, 151 bp, Homo sapiens
ccacatttcaggttcaggcaacatcagcaggcatcatacatttctgtgtaccactccattttgccaggtactcactggcaggtctgcagcaacctttaaacatgcgtgtcgcgtcacggggcatcctctcaaagtcgcaactgctcaggca

SEQ ID NO: 487134 - DNA, 133 bp, Homo sapiens
  misc_feature (18)..(18): n is a, c, g, or t
  misc_feature (98)..(98): n is a, c, g, or t
ctcgtgcacccacccctncttaggcaacctggtggtcccttgctcccgggaggcaccatggtgatgccgaggttagtgcggacacccgatcggcatancgcactacagcccagaaggggtgggtggagagcgg

SEQ ID NO: 487135 - DNA, 269 bp, Homo sapiens
  misc_feature (16)..(16): n is a, c, g, or t
  misc_feature (41)..(41): n is a, c, g, or t
  misc_feature (56)..(56): n is a, c, g, or t
  misc_feature (75)..(75): n is a, c, g, or t
  misc_feature (83)..(84): n is a, c, g, or t
  misc_feature (100)..(100): n is a, c, g, or t
  misc_feature (118)..(119): n is a, c, g, or t
  misc_feature (131)..(131): n is a, c, g, or t
  misc_feature (135)..(138): n is a, c, g, or t
  misc_feature (141)..(143): n is a, c, g, or t
  misc_feature (145)..(145): n is a, c, g, or t
  misc_feature (176)..(176): n is a, c, g, or t
  misc_feature (221)..(223): n is a, c, g, or t
  misc_feature (225)..(225): n is a, c, g, or t
  misc_feature (227)..(227): n is a, c, g, or t
  misc_feature (237)..(237): n is a, c, g, or t
  misc_feature (245)..(245): n is a, c, g, or t
  misc_feature (251)..(252): n is a, c, g, or t
  misc_feature (261)..(261): n is a, c, g, or t
agagtttgtgcggaancgatataagtactttacagcaaganggtatagttatgttncctggactggtttttacanttttaaanngagttcgagctgtcanttttgtactaattataanngtggcacataantcannnngannnanttgagatgatttgtcctcccaaagtatacangtttattttatggtataaagtgttctctctggaaatgtttttaannnangncttagcttcnctttcganataaanntattaaaanattgaaat

SEQ ID NO: 487136 - DNA, 933 bp, Homo sapiens
ggctagtacagcctgtgtggtcaatcggcactgaggaaagggctatctgctcccttcgccaaattatcccacaacaactgtcatgctctggagagccccgccgcgaactctttttttggtcgacgtctgcatcatcagctcgtggcagaggcgaggcaggcgtgcggtgtgtggtgtgctgctggtggtgtgcgtgctggctgtgtgtgctggttactactgcccactggctgtggtgtctacctgcctgccctgcctgcctgacgctgcccttactgtggcttgcatgagcttgctgtggctacattccccactgcttgtgtgctgtgcataacgctgctaattgagtgcatgctgtctgcctggtgcagctgtgtgtgctgggttgtgctgtggggtgtcttagtgtccctggtggctgcactgtgctactgtggccctcggcccgatagacctgtgggctatgactgctgcccctggtcttgcctgtgctgtgctgctgcagcaacctctggggtgcttggccctgttcccctggctgcatgccccctggggtgctgctggtttcgattctccctgccctgagctagcctcctgtgctctggccggatgctgggccccgggcaaaggaggctgagcccatcgacttcgccgacgccccccccacagctaggcttgcggagaaagcggcgagggggctcagcaggggtcgacgaggaggggcggcacgcgttcgacctcggggcggggaggggagcctctcccccggccccttcccgagagcagcaaagcctcagccggagcaagggttccctgtgggcattcccaaagggtgaaaacgcggccgcaactggcgcatggcaaagagtggtcgggacaatgcgtgcccctaaatgaacgacaaaccctgggctgaaaagggtcaggcaatgc

SEQ ID NO: 487137 - DNA, 653 bp, Homo sapiens
ctagagtgtaccctggagtcatgttcacgggtataggacactttagtgtatacgttaatggatcatcaatttgtctcactacctacaaatggaattgcatcgtgtttccatgctgagtagtgaaacagtgacaaagctaatcataataacctacatcaaaagagaactaagctaacactgctcactttcttttgaacaggcaaaatataaatatatgcactctagaatgcacaatggtttagtcactaaaaaatgcaaatgggatcttgaagaatgtatgcaaatccagggtgcagtgaagatgagctgagatgctgtgcaactgtgtaagggttcctggcactgcagtctcttggccactagctgaatctggacatggaaggtttaagctaatgccaagtggagatgcagaaaatgctaagtagacttaggggctgtgcacaggaactaaaaggcaggaaacgtactaaatattactgagagcatccaccccaggaaggactttaccttccaggagctccaaactggcaccacccctagtgctcacatggctgactttatcctccgtggtccatttggcacagcaagtggcagtgtctccaccacctatgatggtgatgcagcccctagaagtggcttcaacacctcatcat

SEQ ID NO: 487138 - DNA, 80 bp, Homo sapiens
gccgtgacgcagcccttgttaccccaggctattactaaacggtggtggtcgtttgatcttaatctaatatgacatcacca

SEQ ID NO: 487139 - DNA, 165 bp, Homo sapiens
  misc_feature (124)..(124): n is a, c, g, or t
acctagcaggatccccccccaaaccagttgtggatgcaattctaggagtattgatcaacatacaaataacgtataatatgccgctggtctctacattgattcaatgcggatatgagactattanaggtactgggagatattatatcctttatcttctctcagttg

SEQ ID NO: 487140 - DNA, 466 bp, Homo sapiens
  misc_feature (152)..(152): n is a, c, g, or t
  misc_feature (183)..(183): n is a, c, g, or t
  misc_feature (230)..(230): n is a, c, g, or t
  misc_feature (238)..(238): n is a, c, g, or t
ctgtggagcgggcaggaactctagccacctttctctgttacctgcagctgattggcaaaggtcctatggagctcccagaagcctcagctaggaaaatgagccctcacttcagcctgtcatctagcaacgtggggcagctgccatagctgacntgcatgcacaaggctgacatcatgggcatcntacccacccatgccatgatgagcccattcacgtttgtccatcttccntgcctccntggctctgccttaatctcctggactccggaggactgagcccccaccggagctggctggggcttgggtcagggtgaggaataaaaggagcgaggaatcaatgtttttaacacagctggctgtctgtgagatgaaatgaagaataccaccctttggcatctctgcgtacctccaaagtccagtgcaccagcagattttactttatgaataaatgacacaaaacagaaaaa

SEQ ID NO: 487141 - DNA, 401 bp, Homo sapiens
  misc_feature (179)..(179): n is a, c, g, or t
  misc_feature (199)..(199): n is a, c, g, or t
gtatgaagttgcaattgggaacttggagataggtagcgattctcaaccggggcccaccgagaaggcaggcctaggagtaagctgcccccaaggtgatcttagcaatgtttctgtttagctgcttcctaaagccttgcccacccagcatgtcctcacgtgcacacctcccctgcccagtntacacccaccctatgctgcntgagcttcagaccccaccccacccctatgcccactatgtgtgcacaagtgactcacccctaggacagccctatgtacatagccagttttgtaatctcagaagccctgcccttcccctccacacacaggggttaaagccgtgtgccctcccagtggctgggatggtgacagtgacatccacagtaaacagatgaaatgtgaaa

SEQ ID NO: 487142 - DNA, 367 bp, Homo sapiens
  misc_feature (12)..(12): n is a, c, g, or t
  misc_feature (20)..(20): n is a, c, g, or t
  misc_feature (53)..(53): n is a, c, g, or t
  misc_feature (98)..(98): n is a, c, g, or t
  misc_feature (107)..(107): n is a, c, g, or t
  misc_feature (114)..(114): n is a, c, g, or t
  misc_feature (156)..(156): n is a, c, g, or t
  misc_feature (161)..(161): n is a, c, g, or t
  misc_feature (199)..(199): n is a, c, g, or t
  misc_feature (306)..(306): n is a, c, g, or t
  misc_feature (314)..(314): n is a, c, g, or t
ataaatataatnaaaaattnccagaggctagcacttggattctaacacgtatnctattgtattatccattagttctgtaatatttaattttagattcncttattctngtaattngcaaagcacaaggtctgtataacagtgtcatgtagagttttntaganagcttcaacctgagttctgcgttataaagcctggaganagctaagcttagaacataacttgctgaggtataattatctttttgtagcaggaatttatgtgccagaggtgagagtctttctggtactgattttttgagaccaaggntaaaaggntcgttttgtaagacatgccatggcaatggctgagttgggggacagtttccgcc

SEQ ID NO: 487143 - DNA, 1743 bp, Homo sapiens
agcaaatatgtcatcagtagagcccgggtttagtcaggcacgaggaagacattttccccgcacaactgctaaagctccagagacacgagcgtgtgtggcagcaagagccgccagttcgggaccaccgcagctggggtggcagcggcgcaggaggggtcgcggggagggagtggtgagcgcaggcggcaggggtctgggaaagacgaagtcgctatttgctgtctgagcgcgctcgcagctcctggaagtgttgccgcctctcggtttcgctctcgctcgctgcgctcctagaaggggcggccgcctccaggactgaccagggccaagtggcgctcggcgggcactacatggcggagggtgaagggtacttcgccatgtctgaggacgagctggcctgcagcccctacatccccctaggcggcgacttcggcggcggcgacttcggcggcggcgacttcggcggcggcgacttcggcggcggcgacttcggcggtggcggcagcttcggtgggcattgcttggactattgcgaaagccctacggcgcactgcaatgtgctgaactgggagcaagtgcagcggctggacggcatcctgagcgagaccattccgattcacgggcgcggcaacttccccacgctcgagctgcagccgagcctgatcgtgaaggtggtgcggcggcgcctggccgagaagcgcattggcgtccgcgacgtgcgcctcaacggctcggcagccagccatgtcctgcaccaggacagcggcctgggctacaaggacctggacctcatcttctgcgccgacctgcgcggggaaggggagtttcagactgtgaaggacgtcgtgctggactgcctgttggacttcttacccgagggggtgaacaaagagaagatcacaccactcacgctcaaggaagcttatgtgcagaaaatggttaaagtgtgcaatgactctgaccgatggagtcttatatccctgtcaaacaacagtggcaaaaatgtggaactgaaatttgtggattccctccggaggcagtttgaattcagtgtagattcttttcaaatcaaattagactctcttctgctcttttatgaatgttcagagaacccaatgactgagacatttcaccccacaataatcggggagagcgtctatggcgatttccaggaagcctttgatcacctttgtaacaagatcattgccaccaggaacccagaggaaatccgagggggaggcctgcttaagtactgcaacctcttggtgaggggctttaggcccgcctctgatgaaatcaaggcccttcaaaggtacatgtgttccaggtttttcatcgacttctcagacattggagagcagcagagaaaactggagtcctatttgcagaaccactttgtgggattggaagaccgcaagtatgagtatctcatgacccttcatggagtggtaaatgagagcacagtgtgcctgatgggacatgaaagaagacagactttaaaccttatcaccatgctggctatccgggtgttagctgaccaaaatgtcattcctaatgtggctaatgtcacttgctattaccagccagccccctatgtagcagatgccaactttagcaattactacattgcacaggttcagccagtattcacgtgccagcaacagacctactccacttggctaccctgcaattaagaatcatttaaaaatgtcctgtggggaagccatttcagacaagacaggagag

SEQ ID NO: 487144 - DNA, 1300 bp, Homo sapiens
ggcgtgcaggtgccagtgcagggcgcgagtgatcctgctgatcgatggcggtggcagcgggaggacacccgctccggtgcgaccggccgggggcgccctttcgcgccccagtggctgcgtgccgctggtgctacggggatgcctgcgggcggaccatgaagggcggaagccccaagggaaggggcctggccctcaccgccccagatcggggcgattaaaaaggcaaggagaagcaagcagggaaaagaaaagagaagggtaaaaaacagaaaagcggagacgaacaaaaggggaacccaagagcagatgcacggtgaggcacaataaacgagggaaaaacaacaagaacggaccagcagcgaacagagggcgagaaaagcgcaaagagcgaaaagccgagacacagagaagcaaaagaaaggagaaggacaagagacgaaacgaacacacaagggagacacgagcagacacaaacataaccgaggaagaagaaacgcaaaacaagacgacagggaaagaaaagggaaaaaccaaccagaggagaggaaaccgaacaaaaagagaaaaaagaagcaaggagagagcccgcgaagaaagagcagggaggagaccaccacgcgagagacgcaccgcaacaggaatagaacagcagaacgaaacaccaacaaccaaagcacccaccgaacgcgcaaaggcagacaaccagccaaacacgacgacgccacacacgacacacaccacacacaaagaggacaagcagcagaaccgagaaccaagaaagaaaacagaaaggcaacgacaggacgcgaagaacaccagaagaaggaaaaaaaacagaaaaaacaaccaaggcagagaccaaacagaagaagacaacagaccacacaaaagagagaaccaacacacacacacaacagaagggacggagggcaaaagaaggaagaaaagaggggagaacaagagaggaggcaaacagacgaggaagacacgagaaaagaaaaagggacaagcaagcaagaaagagagaagaaaaccggagagaccaaacagaaggggagaacgagaaagagacagagaaaagagagcgagcgaagaccagcgacacagaagaggcaaacaggaagagagaagaaaagagacagaaagagaaaacgcgccaacgaaggcagcaagaaacagagggacgggcagcaggagaagagagacgaggaggaaaaccagcacgccaccgcagcaacgcagcggacggcaaacaacacgaaacgcaaagcacgaaaaaaacacaaccgacaacaagaga

SEQ ID NO: 487145 - DNA, 1798 bp, Homo sapiens
agcaaatatgtcatcagtagagcccgggtttagtcaggcacgaggaagacattttccccgcacaactgctaaagctccagagacacgagcgtgtgtggcagcaagagccgccagttcgggaccaccgcagctggggtggcagcggcgcaggaggggtcgcggggagggagtggtgagcgcaggcggcaggggtctgggaaagacgaagtcgctatttgctgtctgagcgcgctcgcagctcctggaagtgttgccgcctctcggtttcgctctcgctcgctgcgctcctagaaggggcggccgcctccaggtgacacagacgggactctcgcttgcgctttccagatgcatcagagatacttttggactgaccagggccaagtggcgctcggcgggcactacatggcggagggtgaagggtacttcgccatgtctgaggacgagctggcctgcagcccctacatccccctaggcggcgacttcggcggcggcgacttcggcggcggcgacttcggcggcggcgacttcggcggcggcgacttcggcggtggcggcagcttcggtgggcattgcttggactattgcgaaagccctacggcgcactgcaatgtgctgaactgggagcaagtgcagcggctggacggcatcctgagcgagaccattccgattcacgggcgcggcaacttccccacgctcgagctgcagccgagcctgatcgtgaaggtggtgcggcggcgcctggccgagaagcgcattggcgtccgcgacgtgcgcctcaacggctcggcagccagccatgtcctgcaccaggacagcggcctgggctacaaggacctggacctcatcttctgcgccgacctgcgcggggaaggggagtttcagactgtgaaggacgtcgtgctggactgcctgttggacttcttacccgagggggtgaacaaagagaagatcacaccactcacgctcaaggaagcttatgtgcagaaaatggttaaagtgtgcaatgactctgaccgatggagtcttatatccctgtcaaacaacagtggcaaaaatgtggaactgaaatttgtggattccctccggaggcagtttgaattcagtgtagattcttttcaaatcaaattagactctcttctgctcttttatgaatgttcagagaacccaatgactgagacatttcaccccacaataatcggggagagcgtctatggcgatttccaggaagcctttgatcacctttgtaacaagatcattgccaccaggaacccagaggaaatccgagggggaggcctgcttaagtactgcaacctcttggtgaggggctttaggcccgcctctgatgaaatcaaggcccttcaaaggtacatgtgttccaggtttttcatcgacttctcagacattggagagcagcagagaaaactggagtcctatttgcagaaccactttgtgggattggaagaccgcaagtatgagtatctcatgacccttcatggagtggtaaatgagagcacagtgtgcctgatgggacatgaaagaagacagactttaaaccttatcaccatgctggctatccgggtgttagctgaccaaaatgtcattcctaatgtggctaatgtcacttgctattaccagccagccccctatgtagcagatgccaactttagcaattactacattgcacaggttcagccagtattcacgtgccagcaacagacctactccacttggctaccctgcaattaagaatcatttaaaaatgtcctgtggggaagccatttcagacaagacaggagag

SEQ ID NO: 487146 - DNA, 396 bp, Homo sapiens
gttaagctgcaggaaactacttctctgagataaacatgcccccatagacaacataatccgggcatggtatgattccgaaattcgtgtccttcttgggcagaactgattgtagtcccacttcagtttgaatctgcgtgggcgctcactatcattgcttctgggacatcagaacatgcctgggctgtggtagatggaggtgccatcccagcattcatatctctgtagggatctccccatgctcacatcagtgaacaagctgtctgggctctaggatacattgcaagtgatggctcagtgttccgagactaggttattaagtacggtgcagttgacccactgttggctctccttgcagttcctgatatgtcatctttagcatgtggctacttacgtaat

SEQ ID NO: 487147 - DNA, 1689 bp, Homo sapiens
  misc_feature (1689)..(1689): n is a, c, g, or t
gactgtgcccagcactgaggcccaaggcgcttcgaccgttaccatcacgagtgccgccgagcaatgtcatgacgaatctgtactctacaatagtcgccgatcagtcaggcctggatgccgtggtggactgcaaggcctctgtgacacttgcttgatcatatgatgattgccgtggccatgatgcggtctacggcggagcaggtactcggacctccagaggcatgtggagagggcgcccaggggtcgtcatggacatggcatggacatgtgagtcgttggactaacggtcgatacctcaatatgaaggaaccgtcggttaatccatggggttgactagacggatgcatgatggataccatagcatagcaaccaatcataacattccgatactcatgagcatcaattgctggcatgtgcctgccccaagtatggcaccaaaggagtggccaagtctccgagatgatatttgcaccatgaagagggaaggaagtaaacaaaggacacggaacagtacggtcaccaatgcatgtagatgtccgtttggattcgcaagagactcattgtagcatttacatacgtggcacagagagtaacccacattcaaaaacaatgaacatcgtggggacacgaaaccgcaggaaagaacggcaaatcatacaacaccaacaatcacaatcccattcaccgcacaaactcgaagagatatacccaggagaagacacattttcatgcaagacaagcgtggcagttacagcaagagaagaataaatacttgtagggaaaggaccacaacacgaagcaaaggaaaggatgccaacaaagcacgcatcgataacaagacattgaaatgggggccacaaggagggaaagtaccgtcacaacgagaatggaccatggaccacgatccacaaatagagtccaaagtaggcaacttcccaggaacaacacacaaggaaagcgacaagagaaatgaacacaacacgaaccataaaagtcgagcgatgaaccacagagagcaagctaaccccataccagtaaggaaatgggccacactacaaagagaggggacccaagcacaccagctagagttgaaccagcagatagggcccagagaaccaaagagacataagcaagagacgcgaaacaaagcagaagagcatacacgagagtagacaacaaagggacgaaacggagccataaagcaccaccaagagccagaagaacaacaaagacaaacgacaaagagccgaaacacacgaaacgaagcagcgaaccaatatagaacacccatacaaacaagacacgaatagacaagcacagacaaaacgagaaaagccaactagacagagacacacaacaggagataagacaccgaaagaagaaagagacacacaacaaggaacaaagacgatagacaagaaaagagaagcaacagaggacaggagaagaagacgacgaggagcgaaaacaaggcagacaatgaacgaagagagcacgagaaccaagaaaacaggaagagagcagcaagaccaacagaaaagacaaaatagcacgagagaacaagataaagagagaagcaacgagagcaacaagagacagaacaacagagaacaggaaaagcaaaagagacaagagagagagaagaaaagagaatagtgcagctaacgagaaaaacagcagacggagaan

SEQ ID NO: 487148 - DNA, 605 bp, Homo sapiens
agcgggcgttgacggtgacggcggctttgtgtgtgggcggaccccggaggcctgagcggcaccgtgcccccagctcccctgtggggccccggggcccccagaaacctggcaggacggagccagacggggcgggcaccatgaacaacgttacaggcaagagcctgcggcggaggaagccacgcctatcgtgcccgagggcggtcgcgcccggaccagtggcagggcagacgaggacgcggttgcggaagggcacgtgcaggctacccggtcagggtacctgggtcacgtggaggtagaaggagtcgccggggaactgcgaacgtgtgtgaacgcatgcgggtgaaccgagaggctgaaagggctgactggggggcccgaacaggtgcccgtgaaagtcgtgtcgcttgctgagaggctgctcagtccacgacctagggggcgtccgacgatgggtggaaccgacaggaaatccagaggaagtctctcgtgaggtcgaaccaggaaacccaggtcgacaataacggggtcttttcgcgtctttgcggtggcctccctggacccggcaatgaccccttggggaggccaacggggcgttttcctttccc

SEQ ID NO: 487149 - DNA, 1001 bp, Homo sapiens
ggtcacacctgatgagccacccgctggtgcccagagccccgagacctggcttcctaccctgccccccaggaggtgcctggtccctgtgaccatgaagaccgtcctgcgacgcgtgtcagtatatggcggccgaggtaccgtggggtcctacccagcttggtgtctggaacggaacctcgcccacctagctacgcgcatggccaggccctgggaggccatggtagccgcgtcaaggcccccgatggggagacccaagtccaatgacggaggtggacctgttcgtctccaccagagaggatcagaggtcttgacagcggactcccaggaggccattgatggaccactgccctgacataccatctcctacacatgccgactagtcggctgcgtgcatggtgctgagtggcgcggcggcggctggcacggaggccggaccccaggaccacggacagccgcctctacaagatgctctgccacgtattctacgcaggaggacgcccagctcatcgcccaggccattggccaggccttcgccgaccgactacaagccagttcctacgggaaagcaggtattgacccccagccaggtgggcgtgcacccgagacccaggcgcctgccactccataatggggacctggaccacttctccaacagtgacaactgccgggaggtgcacctcgagaagacggcgaggggagggcctgggcgtggcccttagtggagtcggagctggggctcacatgatgcccacaaggccgtaatccgacaagacttgtgacggggagctgataagagcacaggggggccctcagcatggaggaccgacttgaacgcattcaacgggaccagcctggtgtgggctgccccgtggtagggatccagggcggttccgtagacaaatacgagacgtaggaaactcaggatgtcagtgcctccgttaccaccagcatatcacggcccacgacggaaaagttggtatggtagagacgataatgagcac

SEQ ID NO: 487150 - DNA, 601 bp, Homo sapiens
  misc_feature (330)..(330): n is a, c, g, or t
cctggctcttaacttaggaggaaaatgcaaattaagatcgcaatcagatacctctagaatggctaaaactcccagggtctcagccacccagtggctcaccttccaggtcccagtgcagggagacctctcaggaaagcatctctggtgccatttccttgtcactgctaatgagcaaactgctagtaacgtcttagagaaaacaggcccaagctaagaagaggcattctctaaaacatattacctaattgtttcactggagcggagacgggggagggagggaacattatgaaataaaagcctggaaagcccacatatttttagaagcaaatngcacataaaagtacatgatcgtcaatgatttaaatgactgaaatgtcacactgacattcatgaccaaacatgctgatggaatttatgaatgcacaactgtacctcaagccaccgggattcgtttctggccttcctgcctcaggtgatttctacacctttgtttgctgctgccttgtactgggattcactcatttcacaaaaaagcaaactaaggttaagagaatgtcagtggttttgcagagatgctgcaatcaattgcacagaaagcagt

SEQ ID NO: 487151 - DNA, 837 bp, Homo sapiens
tcaccaatttatttccatgtccctttatttgtaaattacccatttttcaaaagtgcccctgaaaaaattaaaaaaaattaagggaccccttcaaaaaagggtctcccgtggattggggagggaggacttatattttggaaccctcttgttggggagaaggaaattgttatctacgggatcagtggacgtgccatttttggctaattgattctcagaccaccgtgagggctgtggcagatttcaggattgaacgcgttttcgggagcctccatccaaaacttttcccataagggagttcccagggtgcccatcatcacattgaaactacgcgggtggagatagatatcatcggaacagagagattacatgaagatctcaggaaggcacacataaacgcggtgtcatttgacaaagggggccttgggcacaaggtttgaccaggtaaatccctatgtaataacaggcgtcgggcctctataatgctctatcatgagcacaaccaggaggaggtcacactatgatatgggcggtccgactccaaaaaaaacgtacagccaggttcggcgtagttaaaataagctgtacgccgatgggaaaacaaatacattatacgattgggatgttttaataaagtggcagattatgtacagaaattattatttcggcaacgtgttaaagtgctatccagactctccaaaaagaagaggagataaaaattttagcatcaattgtaaacactttgggaaaagagaactttcatggggaacatattgttaggggcccccccggatcgggggaaaaaaaaatatgtgggcctgataacaagaaggaaaccag

SEQ ID NO: 487152 - DNA, 304 bp, Homo sapiens
gtttcaaaagccaaataaccccttatggaattcaactcagggtttgaggacttcctggctggtcctatggccctcaaccccagggattacaaattgcaaatttaatgggtcatttgggatcaaagggtcaattatgaggcccctagaatttttcaattatacgaatatgttctttgggttttgctggggcccagccagggttacctttttttttatggggggttttgattttttcccccagaaatgggttttatttgagggacccaggtcttaggtttcccaataaagaaaaaaaatttcccta

SEQ ID NO: 487153 - DNA, 461 bp, Homo sapiens
  misc_feature (370)..(370): n is a, c, g, or t
atgagaatgtccctggatgatgatgtgtcaacaaaagttgggaataactgtggtaacaggaaatattacactacaactgttctctagaaatctccaccatccccatccttcctcagcaaatgaaggtgggtgctttggatcctttctctgttcttagaaaggggaatggatgcttcgtatagagagctatgattcagacgcccatcagagtgccaagctccatgctgacaggcacatttggctacattcaacaaccctatatgagatacataaacggcacatgccattttcttctcctttgaaacgagtctccaacgcaaaggctttcacttttcattctctattttaactttaaataccaatgaacccnctggtgaaacctctcctctacaacattcactcagacagtgatcacgccaaccgcaccacatctaaaaattacaaaggagaactttgtacca

SEQ ID NO: 487154 - DNA, 379 bp, Homo sapiens
cgtgagaggatgcttcccacattattcagcttctgaaacgggttacttgacccacagatgtgaagctagaggcgtgaaggagactgatgtggtttctcctcagtttctctgtgtggcaccaggtggcagcagaggtcagcaaggcaaacccgagcccagggatgcggggtgtgggcaggtacatcctctcttgagctacagcagatgaactctgttcggtgtcatggttgttgtttagtttgctattttgtctccaacttggtgcttcatcaggacacgcttcggatcacaattcccagtgctgaagacaaggccaaactcttggatgtgtgctttgattagtgcctgtgacgcagcttcaggaggtcctgagaacgtg

SEQ ID NO: 487155 - DNA, 923 bp, Homo sapiens
aatcccagcacttgggaggctgaggcgggtggatcacctgaggtcagttcgagaccagcctggccaacatagtgaaaccccatctctactaaaaatacaaaaattagccgggtgtggcaggagaaatgcttaaacccaggagtcagaggttgcagtgagccaagatagcaccactgcactccagcctgggtgacagagcgagactatgtctggaaaaaaaaaaaaaaaaaaaggaccaaaatggaagcgagggaataaattttttccccggcaaggggaacccaaaggcaggcgggagtgctatacttttttttccttttccttctcctttgttttttttttacccaccaatccgtcgcatatttaaaggggaggcagccatctcctcaccgagaaaagaggcacctctgggtttcacccccgggacggggttcgaccgcccggcggaagggggctccccacgttggtgcactttttttctgcccccatatttttagtgtgcccccggattgtggtggcgcaaactttttttagcgtcggggggagacgcactcccattcttcctacacgttggggggtgtccgccccctactttacggggggagggcctatttcttgagaatcaccaggaaaccccggtgaactgggtgttgcccgttggcgtaagagactacaggatcttttcatccgaaggacacagaaaactagtttttcatagacacgggaatttaacggggggccgtttacccacatccaataggaattacacctcgacttgggcccaggatacgtaatataaggggtttgcggcaacaggcatataggcgtgccggtgagtgaccatctgtgggaacccaatggggaccgctgtacaacacagcgccgtcggggcgacagcggcgcttcgatgaggcatccgttgt

SEQ ID NO: 487156 - DNA, 278 bp, Homo sapiens
gatctgtttctgtactgtagtttgctttctagaattttattatctatctatattgagacagagtatcactcttgtaggccaggatagagtgtagtggtgcgatctcagttcactacaagctctgcctccctggttcagactcctgcctcagccttcaaagtagctaggattacaggcgcccaccaccacacccagctaattttttgtatatttagtagagatggggtatcaccatgttggccaggctggtctcgaactcctgacctcaggggatccac

SEQ ID NO: 487157 - DNA, 146 bp, Homo sapiens
tggctccctaatgaggtggtgtctccccgttgacccacaccaggatgtcttattgtcattgtgccagataccgcgggcgtcgggccagtcgcgggccatgcccgggccagcagcaggggcgacacgggctttgtcgaacgcggaag

SEQ ID NO: 487158 - DNA, 205 bp, Homo sapiens
cttcctgctctgcctcacaaggtgctgagaatacaggtgcatgataccacgcccgtctaattctgcgtatttttactagagacagggtcttggtgaaggaggttgaagatgagaggtatggttttgagtagtcctcctatttttcgaatatcttgttcattgttaatgttgtgtctgatagacccggagcacattaatagtatgg

SEQ ID NO: 487159 - DNA, 268 bp, Homo sapiens
ttttttccccccggggggggggggttcctttaaccaagtttgggcccttgcccccccccctgggcccccaaggggggatttttttttcaaaaaaaaaaaaagaaattccgccccccccttaaggtccgtgggtctttgttttttcccaggaaaggcgttttaagccccctccttccccggttgggggggggcttttccaaattttttggcccagggtttttaaaaaccctttcccttttttggggccataaaatttttttgaggccca

SEQ ID NO: 487160 - DNA, 344 bp, Homo sapiens
  misc_feature (1)..(1): n is a, c, g, or t
  misc_feature (20)..(20): n is a, c, g, or t
  misc_feature (79)..(79): n is a, c, g, or t
  misc_feature (86)..(86): n is a, c, g, or t
  misc_feature (89)..(89): n is a, c, g, or t
  misc_feature (116)..(116): n is a, c, g, or t
  misc_feature (141)..(141): n is a, c, g, or t
  misc_feature (168)..(168): n is a, c, g, or t
  misc_feature (171)..(173): n is a, c, g, or t
  misc_feature (194)..(194): n is a, c, g, or t
  misc_feature (197)..(197): n is a, c, g, or t
  misc_feature (209)..(209): n is a, c, g, or t
  misc_feature (213)..(213): n is a, c, g, or t
nagcacgaggtagagcagantaagccccgtcccaaacacagatgggaccatgaactccggacacagcttcaccagaccncctcggnctncttccatggcgccggagtggcttgggncggcccaggagcttccccagggctnccaccgtccatggcggtgcgggggganccnnntcttcctgtccttcaccacgnggngtgcccaccccntggngggtcttggggttctggaagaagcagccccctactaggcggaaatgggaggccaccatgcagaatctcaaacgaccgcttggcctcctacctggggaagtttcgcgccctggggggggccaccatgaagct

SEQ ID NO: 487161 - DNA, 142 bp, Homo sapiens
ggacggcagtgcacctagacattctgatagtctgctctagagtactccccggagtctcactatcagcaacacgtatggacagtaaactcatcaggaagatatcggcgacattgtggacttggtcttcagtgagcgtagaaga

SEQ ID NO: 487162 - DNA, 135 bp, Homo sapiens
tgtctcaggttataaggataactgtttatcaaattaacatctcttaaacagtctctgagaagtactttacctgaaagacagtatgagaacagtattccagtaacagtttaaaagcagttacccaaaatctgatta

SEQ ID NO: 487163 - DNA, 277 bp, Homo sapiens
aattaattaccactaacacttcaatatcccccacattctccctcatcaatctcaattacttccactactcaaacacgtagctatattatacaaaccacacctcacacagaaacacatcttgaaaacttctcttttaaaatccaacaaactatttagtgccttctaatgtttcttctattgttatgttcgacctatttttctattatataatattccatgtatttacattttccttttataactaaacaaatcttaaacccacttaaaaactcccttg

SEQ ID NO: 487164 - DNA, 571 bp, Homo sapiens
attcgcggccgcgtcgacactggccttcgatatgaatctcgccttcgtcgtactcttcgagaaaggccatgctccgcagcagggtgcttttgcccgagccggaagggccgatcaggcacaccacttcggaatgccggacctgcaggtcgatccccttgagtacacgcagggcgccgaagctcttgccgacattgtgcaggcgcaccatgggttgcgagtcgccggggagttgttcggaggtcttcatggggtcaccttgtttcgggacaatgggtggcagggggcgttgttggatagtcattgcggctgcctgctcataaagcggccgacccgggtctccaggaccatgcccaggcgtgaacagaactccaccagcagcagatagccgatacacagcaccagcagggtttcgacgaaagcgaaggtttgcgagccgataccggtcatgaccatggtcagctccgggatggtgatgatcgacagcaccgcggtttccttgcacaggatggtcaccaggttgaccagcgccggcaggatgatcaccagcatttgcggaacttggttgcgcagg

SEQ ID NO: 487165 - DNA, 432 bp, Homo sapiens
cacctttggaaagtgccaggtgcgaatgattgccaggacggtcgatagtcagttcaagttcgccggtaaagggcgcaaaaggcgcgggcaggcgcacagattgcgtcgcgccgactggtccagcagtcggatcggcgggaggacttcagcacctgcactgtcctacaaggtgccgtactgcggttgatcgatagctagacagtcgcagttagcgggctatctggctcggcggcggggtgcgtaccggctagtacacggtcggcgatgctctcgacctgcttgtgcccgtcgtccttaaaccaggcgcctttgtcgcgcatggtggaggcagcattcaggcggtagatccgcgggcgcttggcgtacagctgttgttcgtgggccagttcggcttccaggctggaaatttcactggagagtcgcgagctatca

SEQ ID NO: 487166 - DNA, 129 bp, Homo sapiens
aatagtggacaactcttggctcactgagcctctggctccggttcgggcaattctcccacctcagcctcccgagtagctgtgattgcagggcgattctggaggccccctggtgtgtgatggtgcactcca

SEQ ID NO: 487167 - DNA, 111 bp, Homo sapiens
ctagaggatccttgatgttatcccaacacagaaacattccaagctgtgataaactctctcaccctaaaaccaataaaaactcttagtccataggagcaagcactcctaacc

SEQ ID NO: 487168 - DNA, 149 bp, Homo sapiens
  misc_feature (128)..(128): n is a, c, g, or t
gatccgatgcggaggcggagctgaaagttcaaatgtcctggagcagctgacagaagacgggggtatcaacagtaacctctacttcctactcacacagagagaagcccatgtttcctaccagcgagagntgccgcattttacttgaagca

SEQ ID NO: 487169 - DNA, 115 bp, Homo sapiens
gagttagagtaatgacatgttaccatggcgtagatatcttgcgtctattgaagaggagagagatcgaggaaaccagaaatatcacaagccccactgctaaattatgacgtagctt

SEQ ID NO: 487170 - DNA, 609 bp, Homo sapiens
caaatagaaatgggttgaacataaaggacacatgttatgtgtgggtgaagcaatgtagggccttctatatagaagcgttcacactatcacaaaacaatcgcccatgaacatgattggatgatgaaaataaaacaaatgtcttgagacattctacatggatgcgcaattcattactttccctttcgcaagaccagcacttgacgccatacacatagtgcccttcacgaaaaataaatactagcctcatcgtcagtgtaccattctattacactttttaaaacatggcaaagagcacatgtgcatgattacaaaaacaagggaaaggtttagtgttaacctagaacttccgcactgatttgtgacatgaaacaaaaaaattgcatcctgtgaattgggaccaaatggtatctcgcttactaaaaaagcgtcacttgaatatatggaggctctcgattggcaatacaagacaggactgtattcacgtattcggtaacacatcactgctcatactaactgcagacaggatgaatgatgacattatcttaccagccacagtgaggcaaactaaatgtgctatggatatggagcaaccatatgtgaggtattaca

SEQ ID NO: 487171 - DNA, 1044 bp, Homo sapiens
tggactgggacgacagccctcactagggggctatttataaccatacaaggcaggaggctatagcgtgcgtgtgttcgactctgtgggggccagtttaatataaactgtgccacacaacacagctgtgagcctccacacagccacatgtgaggatgtggggacagccattctccttggggttctcgtgaatataccgtattcaaggtgtgacgcaggtgaatttcaatctcaagcgcttgtgtgtccatctccaggcaccgctcttgtgcgcaaaaacaaccagtgtgtgcttttgtggctgtgctgtgagaacgcttgtatacgctttttcaaaacggttcacacatattctcaagtggtactcggtcgaagtgtttttaaaattagacactttacgagggagaggggtggccacacagagcaagaggcccgagaggtcccttcgttaagccaccgaagagctccgaggtataggaagtgcgtgaccccggcccaggggggtggctgtgggggggtctagaggaactcacgagggcctcgcgacacccataagcgagagggccgcggagggccacgagagagggctctccgaggggggcccacccgcacgggaggcgcagagacgagagatccaaagggcacaacaacaaaggagggtaaacacgagcgcaagaggcgacccagagagagggggcggcacccgggaaacaacactatgtgcgagaccaagaggagtactcccagaaaaaccaaataaaggagaacaaaagcccccaaaagacaggcacaggagaaagggtcccagaaaaaaagggggagacgaaaaagcgaaaaaaaaatgaggcaaacagcaaccccccgggagggggaagtgtgcacccagagaagaggaaaagcaagagcgcagaaaggaggaacagagagcagtaaaagagacaggtagtacgaaaacaagagcaacagaaaggaaaaggggaaaccgaaccatgaaaacaggtacgaagagaagacacccgcagagggatcaccaaagagagacccggt

SEQ ID NO: 487172 - DNA, 116 bp, Homo sapiens
tgtcagactagcccctgtgtcaacggtggggtctgcaatgaccgagtcaatggcttcagactgacacctgacctcctcgtggcttcagcgagctccacgtgtcagctgtgacgtgg

SEQ ID NO: 487173 - DNA, 141 bp, Homo sapiens
aagacagtgtctagccgtaatatctgggggataatgctgcgcctgtgcagcatcttacaagatgctacctgtctccagtggcgttgctagatccacggaggtaggaaactgcatctctcagacatccgtccccatggaagc

SEQ ID NO: 487174 - DNA, 775 bp, Homo sapiens
ctctaccggccgagggctgagacgacgccctcagtcgcgacgggggcgggaacggggacgcggtcgagagagttcgccggtcatcagagactcgaacgagggagcccatccgggaagcgtgcccgttcctataggctagggtggacgggggatagtccgcgcgagagatttcatgaaacagtaacgtgagctttcgacgagggacataccatctggtgcgcgtgacaggaaggcctagggcaagccgtgacctgcggtgggtctagtactgaaggatagccaagcgtggtggtgcctcatccacgcgtacagcaggagttcagcgagtcatggccccaacaggacatcccacgttggggtcgcgcggcagtacagggggagcaggagcacggctgtcaaggtgtcaaggccaggttgtggagtggcgtcgtagctagctgagggatgtctgtacatgatacgtctcgggttctactcgtgtgaggtggtcccgtgggtcaggaccactgggtctactagagtactgctggccagtttgttgcgtctaagtcaggtgccactcttgatcaccgtcagggattgccgtgctaacaaaggtggcctgtacgatgagatcttcaaagtgagtgtgatggacatgatggcctccagggaagtggggattggctatagtatgacagcagaggggatggggtgaataacattctttggggttttcaatggaattgcatggtttcctggtggttgtttatggcttgtgttggggggtcttgtt

SEQ ID NO: 487175 - DNA, 133 bp, Homo sapiens
catcctatcagagacacccccctctatgaggcgctccaatagcaccccccactacgacatgatctctcgtctctacgcgcaccctccccctgcacatatggtattggtcactcctccccgcctccttcttcct

SEQ ID NO: 487176 - DNA, 384 bp, Homo sapiens
  misc_feature (120)..(120): n is a, c, g, or t
ctcctttgtctgggggagagtatttcagttaggaagtttgttggaattcagaggcaaacaatgtctatcagtccttggattataatttcacttctgtgatcctcaagagtttctcttttntctttgctttcttgtcctctgttcttttggcactgtgtagccaccttagagaaagaatgttttgtattttcttctttttgactgttttctcatagtccctggtcttcagaatgaacagaaacgattccaactggaagaactgagaaagtttggggcccagtttaaggtgagagaagagtgagctgggatattagcagggtaaaggggttgggagtggttcgtagatgaggcaaaggactagataggagtcaaagagatgagatc

SEQ ID NO: 487177 - DNA, 230 bp, Homo sapiens
gtgctggagaggttcagattttcccctgatctgtaagcatgtgtttagaggggaaatggtgggtgcatccgggcctaaagatgacgtacatggatgactgaatcactgcgcctggcactcactgtgtacagggatacacattagtagctatgttgtgtcatttcttgtgacatggaatagagtgagggtccatgttgcctatggggccagctgcagagttatccgggctc

SEQ ID NO: 487178 - DNA, 108 bp, Homo sapiens
agactgcctggggatcaaatggagaatgttaggaaataattcatgcagcaagactagattgatagagagagatttgccaacgtggaggtatctctagcctcatctgga

SEQ ID NO: 487179 - DNA, 213 bp, Homo sapiens
  misc_feature (108)..(108): n is a, c, g, or t
tgctgactgcttaggtggtggttgctgaaggttgggtgacagtggtaattcagtgattttggttttgtttggtttctttaagagacaggtctcattctgtcactcagngtggagtgcagtggtacgatcatagttcactgcagccttgacttcccgggctcaagcaatccttctgcctcagtctttccagtagctaggaatatcaagaatcgg

SEQ ID NO: 487180 - DNA, 803 bp, Homo sapiens
ggagccttaatggatggttttcatagtagaatgaataaaggtatttgctctatgtataagtagttttaacggaaagtattaaagaattgagggtggaattcttagaaccaaagttattcttaataagaaatcaccacatgcttggaaaaaacaaaaaaaaaaaaaaaaaaaaaaaaaaaaaaaaaaaaaaaaaaacacccgagcagcggccgagtatactatggctgggggggcgggagaaaagaagagagagaagaagagagcggcagcgcgaggggaccaggggccacgccgcacaagctagggagaacagggagcgaaccacggagggggcgcaccacacaaaaaggggcaggacaaaaaacatacaagcgccaacgaaccgggacatcccgccgagaatattgtgccctccagcacgcgaccaacaagaacagaagaaaaaaacaaagaaagaacaaaaaagaagaaagacaagaaaaacgacaaaacaaggaccaaaaaagagagagcgcacgaagcgagcaaggaagaaggcaccgcccgccgagagcgaaggcagagagcaggcccgccggcaagaaggcgaacagaaacagagagccacgaggacgcgaaccaaggacacaagaaagccaaagacgcggaaaggcaaagggaagccaaaaaaaacagaacacaccgaaaagcgagagcagggagagacgaaaaacaaatgagaaacaaaagaaaaagagaggacagacaaaaacaaaaaagagggaacaaaacgaaacacacaacggaagccggcagaaggagcc

SEQ ID NO: 487181 - DNA, 128 bp, Homo sapiens
tgaatctaagttgaagacagataatgttgagtacctaactgtataactttacatgtatttattttacacagttgatccttgggtatgatttagcagtctaagtttgaattgtctctataagtatgtta

SEQ ID NO: 487182 - DNA, 411 bp, Homo sapiens
cagagtccaaacagtgctcagagtccaaacagtgcccagagtccaaacagtgctcatagtccaaacagtgcccatattcctaacagtgcccagagtccaaacagtgcccagagtccaaacagtgcccagagtccaaacagtgcccagagcccaaacagtgcccagagtccatatagtgcctagagtccaaacagtgcccagagttcatacagtgcccatagtccaaacagtgcccagagtccaaacagtgcccagagtccaaacagtgcccatagtccaaacagtgcgcagagtccaaacagtgcccagagtccaaacagtgcccagagtccaaacagtgcccatagtcctaacagtgctcggagttcaaacagtgcccagagtccaaacatgtgcccatagaattacccg

SEQ ID NO: 487183 - DNA, 134 bp, Homo sapiens
attccttgccaaggagtttgaaatttatactatagaaataactttaggatgaggtagagttaaagaggtaaagcacatgttccacaacccaggaaagtatttttaagaaagattggatttcctacccttagaga

SEQ ID NO: 487184 - DNA, 440 bp, Homo sapiens
ctaactgtgtgcacagaggtcgcccagtgctaggcttcccgtcctgcccatatggagcactgcgcatacctcttagtagacacaggctacagatcagggctggccagagcagagatagatgggggtaagcagacttatttgtgtgaatcaaaaacagaggacccttacaggaaactcatgccttggtttggagaaagcccacgtttccaccaacataatattgggaacgctaaggaaacacggaaaaaagagtgtgccttccccaccctcatatagctcagaaaccaaggcagaggcttgatatgaagtccaattaaagagattagacgagatgagaggggagtacagaaggcctagtggacgcgccctccatgtaagggtaggaaaaggcaatagatgatgttgataaacacggacaggttgaaggcgatgctgcccca

SEQ ID NO: 487185 - DNA, 169 bp, Homo sapiens
ccgactttctagagtagtaaccacatcttcctactaattttcatgttaaaaacactataggaaagacagatttacttttaggtataaaatgtcctgaatttgcaaattttatagtgcttatgagaatttatatgggcttttatatcgcttgataaggttgtctgtgccc

SEQ ID NO: 487186 - DNA, 931 bp, Homo sapiens
  misc_feature (14)..(14): n is a, c, g, or t
  misc_feature (50)..(50): n is a, c, g, or t
  misc_feature (68)..(68): n is a, c, g, or t
  misc_feature (82)..(82): n is a, c, g, or t
  misc_feature (107)..(107): n is a, c, g, or t
  misc_feature (127)..(127): n is a, c, g, or t
  misc_feature (132)..(132): n is a, c, g, or t
  misc_feature (143)..(143): n is a, c, g, or t
  misc_feature (176)..(176): n is a, c, g, or t
  misc_feature (194)..(194): n is a, c, g, or t
  misc_feature (208)..(208): n is a, c, g, or t
  misc_feature (212)..(212): n is a, c, g, or t
  misc_feature (222)..(222): n is a, c, g, or t
  misc_feature (226)..(226): n is a, c, g, or t
  misc_feature (230)..(230): n is a, c, g, or t
  misc_feature (247)..(247): n is a, c, g, or t
  misc_feature (257)..(257): n is a, c, g, or t
  misc_feature (263)..(263): n is a, c, g, or t
  misc_feature (270)..(270): n is a, c, g, or t
  misc_feature (273)..(273): n is a, c, g, or t
  misc_feature (281)..(281): n is a, c, g, or t
  misc_feature (290)..(290): n is a, c, g, or t
  misc_feature (292)..(292): n is a, c, g, or t
  misc_feature (308)..(308): n is a, c, g, or t
  misc_feature (311)..(311): n is a, c, g, or t
  misc_feature (332)..(332): n is a, c, g, or t
  misc_feature (348)..(348): n is a, c, g, or t
  misc_feature (350)..(350): n is a, c, g, or t
  misc_feature (353)..(353): n is a, c, g, or t
  misc_feature (359)..(359): n is a, c, g, or t
  misc_feature (365)..(365): n is a, c, g, or t
  misc_feature (374)..(374): n is a, c, g, or t
  misc_feature (376)..(378): n is a, c, g, or t
  misc_feature (386)..(386): n is a, c, g, or t
  misc_feature (401)..(401): n is a, c, g, or t
  misc_feature (413)..(413): n is a, c, g, or t
  misc_feature (443)..(443): n is a, c, g, or t
  misc_feature (455)..(455): n is a, c, g, or t
  misc_feature (490)..(490): n is a, c, g, or t
  misc_feature (526)..(526): n is a, c, g, or t
  misc_feature (552)..(552): n is a, c, g, or t
  misc_feature (556)..(556): n is a, c, g, or t
  misc_feature (566)..(566): n is a, c, g, or t
  misc_feature (575)..(575): n is a, c, g, or t
  misc_feature (589)..(589): n is a, c, g, or t
  misc_feature (635)..(635): n is a, c, g, or t
  misc_feature (658)..(658): n is a, c, g, or t
  misc_feature (696)..(696): n is a, c, g, or t
  misc_feature (772)..(772): n is a, c, g, or t
  misc_feature (832)..(832): n is a, c, g, or t
  misc_feature (858)..(858): n is a, c, g, or t
  misc_feature (909)..(909): n is a, c, g, or t
tcacggtgcgaganacgatgtccgacctgccggaggtgcggaatggagcntcggcactggagatctcntacaacggggagcntcagtcctggttccagaggcagctncggggcgcacagtaccagcncatcntcagggaccanatctgtaaggacatgagtacattggtggctgcncgcatgcggcaaatcccnttggccccagggtnagantggcgcgatntgcncaanatcgaggtgcggctctnagacggcacnatggcnaggaagntgnggtatacncaccatganangaagaacggccgcagnagntctggggccctccgtggggtntgctcctgcgtggaancnggnaaagcntgcgancccgcagcnannnagtacaanaccctcatcccctgntgcctacaccanaccgggaaccgcacaaccactgggatggantctatggaaggntcgagtgggaaggcttcttcagcacaaccgtaacnaaccccgagcccatgggcaagcagggccgcgtgctncacccagagcagcaccgtgtggtgancgtncgggagtatncacactccnagggattacctganacctaccggctcttcggcaacatcctggacaagcaccggcaggggngcaatgccgtgccaacgcccctngccaaagccattagcttggagatcaagctttgtatgtnggccaaagcccgagagagtgccttagctaaaataaaggaggaggaagctgctaaggactagttctgccctcccgtnacccctgtttctggcaccaggaatccccaacatgcactgatgttgtgtttttaacatgtnaatctgtccgttcacatgtgtggtanatggtgtttgtggcttggctgacatgaagctgttgtgtgaggtcgcttatnactaatgattagtgatcaattg

SEQ ID NO: 487187 - DNA, 250 bp, Homo sapiens
agccagcccggtgggcacgcaccgtgtcctggctgtatctttctttcttttttttaatttttttgagacagaatctcactctgtcacccaggctagagtgcagcggtgtgatctcagctcactgcaacctccgcctcctgggttcaagtgattctcatgtctcggcctcccaagcagctggggtcacaagcatgtgctaccacacctggctaacttttgtattttcagtggagacggtgcgttggcccaa

SEQ ID NO: 487188 - DNA, 358 bp, Homo sapiens
gaaaagatccaaaataaatccttgcctatcagctactagcgcctagcactcgcttctcacagtaagtccctgcgacctgcaacgccagcatccctagggtacttgttagaaatgcatatcctcaggccccaccccaaacctactgactcagaaactctgagggtctagcccaccaattgttttaacaagccctccagatggttctgttgctggctaaagctctaagaactactggcttatagcatgggctataaaccagactgccaccattgggttgtaaggaccgtttaattgattcaatccacatagcttaactagccaatcatagctgtctgcagagccaaccacactccagcat

SEQ ID NO: 487189 - DNA, 292 bp, Homo sapiens
agtcggttttgctatgtaggccaggctggtctcgaactcctgtcctcaagtgatccacctgttcttggcctcccaaagtgctgggattacaagcatgagccctccacgcctggcctagatcattcttataacatttttcttttgggaagacaggttctcactctattgcccaggctgtagtgcggtggtgcaatcatggctcactgcagccttgacctcccaagctcaagcaatcctcccacctcagcatcccaagtagctgagaccacagcatatgccagcacacgcgact

SEQ ID NO: 487190 - DNA, 466 bp, Homo sapiens
  misc_feature (70)..(70): n is a, c, g, or t
  misc_feature (124)..(124): n is a, c, g, or t
  misc_feature (253)..(253): n is a, c, g, or t
tagggagggggccggctctctccccaggtgttgccggttgagggttgaatctggtttccccccaaggatnccataaacccccttttttcctccgtttgggggggcgggtcccccaacttcctgnccctccttccctttttgcccttaagggggtttcgcccacaaagggggcccgcctttggtttttgttaatgccttactcaggcaggcccccttttcgggtggggggcccccggtttttaacccccaaccnggggcccccccgggagggggtgggggggttcccccccccccccagggggggcccccaattattttttcctggttttcttttggccacccggctgagccctgtttccccggccccttgttcccttgtggctggcccaaccccccccccttgggctgttccccccccccttgggctgttttttggggggttaccaagcttttttccctcctttca

SEQ ID NO: 487191 - DNA, 439 bp, Homo sapiens
  misc_feature (264)..(264): n is a, c, g, or t
  misc_feature (290)..(290): n is a, c, g, or t
  misc_feature (373)..(373): n is a, c, g, or t
  misc_feature (417)..(417): n is a, c, g, or t
  misc_feature (426)..(426): n is a, c, g, or t
tttcaccatgttggccgggctgggtttgaactcctgacctcaagtaatccacccacctcggcctcccaaagtgctgagattacagacatgagccacccatgcctggcccagaggtttgttttgttaagaaagctacaaataaataaaagtctaacattaggtatatctcctaatgctatccctccccccctcccccgaccccacaacaggccccggtgtgtgatgttccccttcctgtgtccaagtgttctcgttgttcaattnccacctatgagtgagaacatgcggtntttggttttttgtccttgcgatagtttgctgaggaatgatgggtttccagcttcatccatgtccctacaaaaggacatggaantcattcattttttatgggctggcataggtatttccatgggtgtnatatggtgnccacatttttctt

SEQ ID NO: 487192 - DNA, 556 bp, Homo sapiens
gtgctgtaaaagaacattaagccttgttccacaaaaagaaatggtgtaaagcttggccttgtctaacgtggtacgaatgacctgtcactagtaatatactggtatgttctacatttgtatttaagattgaatctcttatgtatagggtgataaccttccccagaaacaagagtgattgcgattgtttgctagaaacttctttaaagtgcgcacatttggcagtacaaatgagtctgagtgtaatagcgccagagatttatatagtagttagaagtgtctaaaatggtaagaatgtgccagctgtgtcaagttacgagtggcgttatggtttgttcatagtgattcaaatgaacttcctattttagatagtaaatgtgatttaatagtatacttgccattttgagcctcgactgcaaaattagtgcagaggagaaaacaatttgtaagtgtaatcttgatttgacctcatatacgtgtaccattccataaaactctaaacttttgtaccagatgatagatacaggtaccgaagatatcaccttaagattgtataagg

SEQ ID NO: 487193 - DNA, 223 bp, Homo sapiens
agagtatccccctgcaggtatagtaagagggagatacacataagattctgagatgggttctgggagtgcactcagtaagcctcagtgggcgaccaaggatgagtaggatcaactctaaatgatccatcggagaggaagacaagcctcaggtggactgtgtctgaaggtctagactgggggaatgtgacaccgaccttgtcagtgataccgagctcgaaattcg

SEQ ID NO: 487194 - DNA, 575 bp, Homo sapiens
  misc_feature (547)..(547): n is a, c, g, or t
agttcgagacgagcctagcaaatgtggcaaaaccccatctctacaaaaaaatacaaaaatcagccaggcatggtggcatgtgcctgtattcccagccactcgggaggctgaggcatgagaatcacttgaatctgggaggtagaggttacagtgagccgagatcgcgccactgcactccagcctgggtgacagagtgagattctgtctcaaaaataataataataataataataataatagtaattaataccaattctacacaagttcttttgaaaaataaaagagaggactgggcacagtggctcacacctgtaatcccagcactttgggaggccgaggcaggcagatcacctgatgtcaggagtttgggaccagcctggcctacatggtaaatccttgtctctattaaaaataccaaaaattagctgggtgtggtggctcatgcctgtaatcccagctactgaggaggctgagggaggagaatcacttgaacccgggaggcagaggtttcagtaagtcaagatcatgccactgtactccagcctgngttaacagaagcaagactcccgtcttcc

SEQ ID NO: 487195 - DNA, 374 bp, Homo sapiens
ccgacccactcctgagagcagagctggcacgcagtccatgaccccgcagcttctcctggccctatgtcctctgggccagctgcccgccctgcagtggaaggaaagggcccccagcgagctactgacactgccccgggtgcaagtgcgcgacgccgtcctcgagtacccgatcgccgtggattgctcctggaccctgcccgccgtgctccaaactccacccagccccgatgtccttcattgccacgtacaggctccggcccaatgcgctgcccggggccacagctggccctgcctgcagccacgacacgcccgccacaccgctccaccagctgcaccatcacgcgactgctacccaaaggccctcgcttttcctg

SEQ ID NO: 487196 - DNA, 344 bp, Homo sapiens
cctttaagaatctagaaaaaaagagctgagattgttgggatttggggagcgcagtggctccgaaagatctgtaatgccagtgctttgggatgccaaggcaggagaatcgcttaagaccaggagtttgagatcagtctgggttacatagcgagaccctaaccatagaaaaaaaaaaattcagctgggtgcagtggctcatgcctgtaaccccagcactttgggaggctgaggcgggcggatcacctgaggtcgggagttcgaaaccagcctgaccaacatagagaaaccccgtctccactaaaaatataaaactagccaggcatgcgccaccatacctggtcgac

SEQ ID NO: 487197 - DNA, 338 bp, Homo sapiens
aagtggcactcttgagcagtacatggggcggtggggtatgcagtgacatactcctctatgaagtcacggaggagatgcttctatgtcctcccaagtctttttcacgtggccggcacaatgggatacagttccgacgtggtgtgacatagtgaagcatagccatcatcaaagtcaatgagaaacctggagcttgttattgacgtttggtgtctcagctacaattgccagcatagagccatgacctgattcccatctttgtatttggcgaccacccgactgaccacatacagcttgtcagcaggagggttggaatcataggcaatatggctccccgacaa

SEQ ID NO: 487198 - DNA, 372 bp, Homo sapiens
tctatcgtatctagctgcagtcagatcgaaatcaccgtctgtcttagctgctgaccacacgtcatcatctctgatggaagcagacccttaggaaagcaagggccattggtgaatgggaccactagtaccattctccacaggggcatgagatcggagcagactgcagctggggaataagtcagatcaaatgtgacttacatcatgacattcctttgtaacctaccagtctaagccttaaactccagctgacttttcaaggttctcttatctccccaacacttccaccttgatccctccagatagctgggttcactatgtgctatgtctccatcccagaatgacttccacctcccatctgcccatctacattta

SEQ ID NO: 487199 - DNA, 387 bp, Homo sapiens
catggtggctcacgcctgtaattccagcaccttgggaggccgaggcaggtggatcacctgaggtcaggagattcgagaccatcctggccaggacggtgaaaccccatctctactaacaatacacccaccagataacacgggcatggttggctacgagcctgctagtcccagctactcggcgacggctgaggccacgggaatagcttgaccctgggaggcggacgggtcgcaagtgagccgagatcgcaccactgccacctccacgccaggacaacacgagcaacgacataccaatatccaaccacacaacacccccccaaccacaacacgcgcccacaacacaccacacacaggcgacgccacagaacacacagcagcaacaaaaca

SEQ ID NO: 487200 - DNA, 197 bp, Homo sapiens
tgacctagtccgggagtggtcctggaaaggtatcatgctcttggtcttcattagtcacatgggcacctctagcatgtgcggtcagtacgtctgccacatcaatgagagaaggcagatgggtgatctacaatgaccagaaggtgtgtgtctccggagaagcctgtccatggacctgggctacatctacttctaccaga

SEQ ID NO: 487201 - DNA, 174 bp, Homo sapiens
agtatctcatgatcccctatactcaagctacacccatagaccaaacctacaccaaaatccatttacactatacatattcatacggagtaaatctaactttctatcccacaacacttatctcgagactatccaggaatgccccgtacgttactctggactaccccgaatgcatac

SEQ ID NO: 487202 - DNA, 342 bp, Homo sapiens
accgggtgcacacaggaataccccagttctcatctcctcaccctgggctgcgtcaatagactccagagtaacccaaaccacaccctgctgcccagattcctaaatgacacgtgaaaggccgttatgacttggcttcctcatgccctatgcacggctgggctccagccaaggatcctccttcatcaacccccatattagctacgatccttcatgctaatgtatcgctcagagctcaaaagactttgaagggcctgtgccttcgctatcgagcgcttaagttctttgccctccgcgtacttttgacaaatagtgggcatcaaccatgttccaggaactacccta

SEQ ID NO: 487203 - DNA, 154 bp, Homo sapiens
gtatccggcagctatcggttcatgtgtccttcatatttgactgtggttcacagtattgcgttgtcagactaagaaagctaaacgaaccaaatggttagttttgcttggagactggccttattaatgggccgctttcctaaccaggaattattaa

SEQ ID NO: 487204 - DNA, 500 bp, Homo sapiens
aacttaaatgcatatttactaggtaaaagaaaccaatctgaaaaggctgcatactctgattccagctatatgatattctggaaaaggcaaaactgcggaaacaatagaaaggtcagtggttgccaggggttgtgggcagagggaggagttttaggacagtgaaactattctgtatgatactgtcatgttggacatatttgtccaaacccatagaatgtacaacactaagaatgaatgctaaaatcagtccctggactttgggtgataatgatgtgtcaacctaggttcattgatggtaacaaatggaccactctggtgggggatgttgacagttggggaaaggagtacttgggaattctgtactttctgctcaatttttctgtgaacctaaacctgcttcttttttaaaagtctagtaaaaacttattggaggtaaagaaatcaattaggaatctattgcaatcataaaccaaaatgttctgatagagccatattatcaa

SEQ ID NO: 487205 - DNA, 125 bp, Homo sapiens
aaaaacaaagatacaagtaagagcatgtaaacataataacaatattagctacactatcatcgaatagtcgagaggtgtatgaccgagtatagatagaaactaagaggggatcctactagagtaca

SEQ ID NO: 487206 - DNA, 329 bp, Homo sapiens
  misc_feature (135)..(135): n is a, c, g, or t
ctttgagccccttgatgccgtggaaataggcagggatgtcttcataactcaggacgcatctcttcacctgtgcttgatgctgtacccagaatcaccctcgagagaaagaagtagttctgcatcttctcctgatantgaaatgactggctttatcccatgaagctccattcaatggagaatgcagcgtctggtgtcttcatccatggacttatgagatgggtcatgggactccctacgaggcacagcctagtctggttcctctcctggagatgaaagattatacctagaacgccatctagaagggataagcgaatgtgattcttccccat

SEQ ID NO: 487207 - DNA, 740 bp, Homo sapiens
  misc_feature (36)..(36): n is a, c, g, or t
  misc_feature (79)..(79): n is a, c, g, or t
  misc_feature (221)..(221): n is a, c, g, or t
  misc_feature (244)..(244): n is a, c, g, or t
agatagcagatgactggtaggaagatgaggcaagtntgcggtccattgtcatggatagtggagacaacactgggccagnaagtggtaagacctgaatccaagactcagctctgccacttgctaaatgggactttgaataaaccatttctctgcacttaagttccttaccaacaaaacgagggaagtggcctacatgcctagatatcaacatttcatgtcangtagagatctagcatcacaagantccaagtcatcctctgttgcctttaagaaattagaattcaaggaatcagaattgaagtgaatctgactacactaagcctatcacttgtgacagccatgggaagatatcattggttgctgaggagcagaaataagcagagacctattgtgttaggttatcattcatttcagacaaaaagcagatcagcaagttttcatattgcactattttcaatggctggagcatcaacattttacaacaagaaaaaaattaaaattcttcaacatttggaaaagaagtgttagtaaaacttttcacatccattcaccatccggaaaagcaaggttttacagtgaggcctgatgatgtctagagtcaccatgcatcttggaaaatgacctcctatttatttcttctacaggacaccatggtgttcacctttctacaactttacacttgctgaggacatattgtggaaaattaagagaaatatatatggatggccaaggctgtaaaa

SEQ ID NO: 487208 - DNA, 597 bp, Homo sapiens
  misc_feature (36)..(36): n is a, c, g, or t
  misc_feature (79)..(79): n is a, c, g, or t
  misc_feature (221)..(221): n is a, c, g, or t
  misc_feature (244)..(244): n is a, c, g, or t
agatagcagatgactggtaggaagatgaggcaagtntgcggtccattgtcatggatagtggagacaacactgggccagnaagtggtaagacctgaatccaagactcagctctgccacttgctaaatgggactttgaataaaccatttctctgcacttaagttccttaccaacaaaacgagggaagtggcctacatgcctagatatcaacatttcatgtcangtagagatctagcatcacaagantccaagtcatcctctgttgcctttaagacaaaaagcagatcagcaagttttcatattgcactattttcaatggctggagcatcaacattttacaacaagaaaaaaattaaaattcttcaacatttggaaaagaagtgttagtaaaacttttcacatccattcaccatccggaaaagcaaggttttacagtgaggcctgatgatgtctagagtcaccatgcatcttggaaaatgacctcctatttatttcttctacaggacaccatggtgttcacctttctacaactttacacttgctgaggacatattgtggaaaattaagagaaatatatatggatggccaaggctgtaaaa

SEQ ID NO: 487209 - DNA, 101 bp, Homo sapiens
cttctagctcggtaccccgtcatcataactttcgggaacaactgcagaggcaaccataggaagctctcctgagtgcttcactgctcggaaggtccacaact

SEQ ID NO: 487210 - DNA, 147 bp, Homo sapiens
gaaggcgcacgatgtgcgcgtcctaacgttttcacgtgtagaacgggggtgtggctctcggagttttggggaaagaataaaggagatgggcctgtctctgatgtgggaaagggctactggtacgggctccatgtacgtgactagagc

SEQ ID NO: 487211 - DNA, 380 bp, Homo sapiens
gaggccagccgaaccccttggacttgcgaaggggaggtcgtattagttcgaggtttaactttagaaacgcgggagggccccttggccctatttttaatagcggaagacgcaaccattattataataaaccccttcaccaatacattcttcctaggaacaacatatgaggcactttcccctgaattttacacaacatattttgtcaccaagaccctatttttaacctcccggtttttatgaattggaacggcataccccggattcgggtaggaccaattcatacacctcctatgaaaaaacttcctaccactcaccctagcattatttatatgatatgtttccatacccattacaatttccggcattccccctcaaaccta

SEQ ID NO: 487212 - DNA, 311 bp, Homo sapiens
  misc_feature (26)..(26): n is a, c, g, or t
  misc_feature (62)..(62): n is a, c, g, or t
  misc_feature (154)..(154): n is a, c, g, or t
  misc_feature (157)..(157): n is a, c, g, or t
  misc_feature (310)..(310): n is a, c, g, or t
tcgtcccaacaacttaaaggaggctnaacacctgttgcacgcctgctcatggcagcgcttgnagaaatgactgggggagtccagcgaggtcggggacgcagcggtctccaggctccagaaacctccttagccttttgtggtaactttggtccgncgncggggggccggtgagcaggaactggagggaggcggtggggaaaccgtggatccgtccggctgagggtgcgtggatcagactgggctgagcaggcaagtcatcgtcgggtcacagcgaggcgacccaggagcgaacttccagggcagcctcccnt

SEQ ID NO: 487213 - DNA, 175 bp, Homo sapiens
aaagtcccccccattggcttcaagtaaatatacggtaccagacccagtttagaaggctacacggttaccacgtgagcttataattttcactcagtctacaaacggcttcttggaatccgggcaatgaatttcataaaaatcccttccggttacatataagggggggtaccgagct

SEQ ID NO: 487214 - DNA, 1223 bp, Homo sapiens
aacgattctacagcccaaccacagctcattgtacacatcccctcctgctagtgcattgactgactttaacacctacttttttacctgttcttttgacgggacacactcggacacacgtttaaacaacactgactggtacacacgacagacctactacaccccctggtcggagggcacacgacgacgacacttaatcatgtacgacggtctgtgttctacgaccactacgcacacaaccttaccttttactaccattttgacgggactggcttttgacacacctacttacggcacacttctactttaactttacacttataactcaacactgggtgtacccttgctctcgtgacacacaccaacctctggcaggtttcctcacgaacgggctaacaaccctacgacgttacccactaatgacttccacgcaacatccccaccgcctaccccactaataagtctactacttatgctctccctcacgtaggcttgccccgtacacggacagaaacgaccccaaaacgcttggggtcgggtatacacacaccaccaccacgaacactcgttgtatatctcctaagggagggctaggacacggtaccccaaacagtcacacggttgttgacgccacgggactttgtcgtttcttcatcttgagttgaccctcctcagtgacggaaccaacattcttatccctcttggccctatgggactacagccttattccgcgatgggtttaccgactacggggcacacattcctttctatgcatcggtcaatctgggtgggacttatgcgacatgacacggcacctctcaccctccccttctggtgggccattaaccttcccttgtggaaggtcgtcgcttggttatatcactagtatactacccaccaattatgtataaacccccttctctgacattctcaagatgcacgccagctcacagagtacacacttcttttaatgccctttggtcccggcccctaccccccaccccaaggctgacaccactcccaactgttcataacactgggggacatcataacttactactggattacaaaatcacctctggtaaattttcccacaacaacgacgaagagccaccctttacattgcatggcaggcttctggagcgacttctgtccagccctacatccatcaaggaatggggggatcccatcgttcgcaaaaccatcaccaacctgcccaaagacag

SEQ ID NO: 487215 - DNA, 504 bp, Homo sapiens
  misc_feature (245)..(245): n is a, c, g, or t
tctcaaggcaacaagggcacgcccacaccctgggaaacagagcatgggccaggtaaatggccaccctggagatccgtaactgcattagcaaattataaaggatagaggtacttacaaattagctgtttttttccgctttaaaaaagagtatctccatctctctcctctccaaagctttctaatcatagaaataattacagaatcacttgggtaaaagaaactcaaagaagcattcgactgacatngactcagatttaaactgggtgtgatgtgtgaaggtaagcaagggatgctggtttaccttttggaggacacgcttctgtaaatacggtaaagaacgtggggaagaaaggcaattgggggagcatagtttccagtggttcacaggctaccagaaggattcagacagcaaacacctacacctaagataatttcctgcttctattttaggagagggtctctgcctgggttttggcgcttactccgagttaatgagtacagacc

SEQ ID NO: 487216 - DNA, 500 bp, Homo sapiens
ccactgctttctcttgatccgcttttttatcctccggttctatttattctggccgcatcgctgtttatttttatatttattaagcagtaagcaacagagttgggggagatgacctaaaatggttttctttgtggaataatattttttaaaaaatcaaataactggtatcactttaagttgcctgaggctgttactgctcccggagaggaatttaacctttcatggacatgcccaactcggtaggcggcgaactctttctctccccctttcccttgaacgcgtttattaactgggagggggggggaattctattctgaaactccttcaaaccctcttttttttctcacgttgttacctccattttcgtgctctgagttgcgggaaagaaattaatctatattctctttgttcccttttaagcgcccaccgggggtgttttgcccccctccccacaccacgccccggtttggggctttcgttgctcctcttagaacgacttt

SEQ ID NO: 487217 - DNA, 182 bp, Homo sapiens
tatgcctctggatatcattgacctgagctcaggcttgaatagggctttatcccctccatcggctataatttgcccgggaagtgtctaggaccagtccacatttggcccatcatgaagttttccaaatatacccaagagtccactatgggatcctagaaattcaacagacatgtgtcttgctt

SEQ ID NO: 487218 - DNA, 431 bp, Homo sapiens
tacctctatttgccctctctgtagtgcaccaataatttcacctcgtgcatcattactagttacctatggttaaacacgcgtacacgtatttggtttagatcacttaaacatatgagatgacatcatatatactgatttgcactggtatactccccctcatgcaatagtatatgggccatcatttcatatcagcacatatgagagcaacctcattttggtctccaatggttgcacagatttacattgcctggatgtatcaaattatttaaccaggaacatttcacttctagtctttcactgttaaacaatgctggggaaaaaaaaaaccccttctatatgtgtcactggacacataagcgagagtactcttaaatacacctagaatatgaagtgcgaggtccaaaaatatgtgccctttcctattaagtaaa

SEQ ID NO: 487219 - DNA, 162 bp, Homo sapiens
agctttggggcttctgactgcagatcttctgagtgtgctgctataccagtggatcctgtgccaggagcctgccaagttttcctcagtgaggccttttgatggattggttgaggaacaattctggctggaggtggaagaggatacctctaaacttctcaagga

SEQ ID NO: 487220 - DNA, 334 bp, Homo sapiens
  misc_feature (54)..(54): n is a, c, g, or t
atccttatgtgggagaaagtttcaaatatccctgtcaaagatcgagacggggcngtggtggttcacgcctataatcccagcactttgggaggctgaggcgggcggatcacttgaggtcaggagttcgaaaccaccctgaccaacatggtgaaacctcgtctctaccaaaattatataaaattagctgggcgttgtggcgggtgcctgtgatcccagctactcaggaggctgaggcaggaaaatcgcttgaacccgggaggcagaggttgcagtgagccgagatcacgccactgcactccagcctggaaaggaggggaaagggaaaggaaagggg

SEQ ID NO: 487221 - DNA, 664 bp, Homo sapiens
ggtgctgcccgagtttgcccgaaatggccctgaatgattgtgagcttgagcccagtgtgccaccattgatgccacccagggacctctgggaccctttggagcctggcggggggtgccatctggcccccttccaagccccgtgtgtgcgtggactctctctgctggggtctcgggcgcaaaccaaagccaaggtgtgtgttaacagatgcccccaatgaaatgtggcttgtgcccgggcctgtccccttggttattggcgccggggaacctggttcttggtggtgatcctgggtcctacattctgggggacggttttcccaaccttcccaaagggcctaattaaccaaagattggtgtgttaccaggggggcccaatctcgattgctatctgtgggaccctttctctgtgtgtttggtgccccccccctttcaaaagattttccaacgtccaaaaatatccaccgggggtggggctacctttgaatgtttaagatggaagcataacgcagtcgtcctcacacgtgcacatacatagattacgacatccgtactcaacgattcatctacccacgtgttgactgtagggcgggcgcgtgcattcggagggtcgccccctactctggacgaaaatgagaccgctgttctcacgtagacgcacaccgtt

SEQ ID NO: 487222 - DNA, 864 bp, Homo sapiens
tggttggagctaaaatatgaacctttttgctcagtggtgtccagttgactagatcatagcagagcttactatgctgatagggtgtagtctgagctgtctaggatgtacatacatggaaaacagtttcttgctttagaactagaccgcatgtttgaatgccattgtctggcactttactggcttgtgattctgtttccttgtttataaagtaggagtaataatgcctatcattggaaagtgatgtttgggatttacaatgagcatgtcctctgtttgtttcccatgatcttataatagagactcaggtgcgagctattgtacctttattggttactactgaattgttacatgctcttaattcctgcattcggtgacaagcactggaccaagatcttgcgaggcacttcagaactattctcacgtgctgtcatgctatggtcttgtactcggaaatcatgtctgtgaaacttgaacatcaggctttagatatcgttgatcatacattcatagtaccatgtatgcttaacgtttatacgaatacacaaatcaacaattaacccaaaatattaatagctgacatatctccatatttcccggaaataagtgattcagatacgtaaaatcagcattagaccgaaaatgttaatacctgactctatttcccagtgttgcacaggtacgtaacccgttttctcgtatgcgtccgtctgtgcaattaaccagtgctacaggactgtcttctaaggccattccacgtcgattgcttaatgaaggtctaaataaggactacttggctgatccatctaattgaccattggcgcctgaatttgtcgctacaaatcgtcgttcatacaaactttcata

SEQ ID NO: 487223 - DNA, 521 bp, Homo sapiens
tcggagcaagcggggatcaccaccaaactcacctatttcattcaatttcttcccagtctttctcaggtctttacccccagcccccggggactctccggtcggtcccagctactctaccaccaagcccagattgcagggggactcagcctcctacactcgggaatcacctacagactcacaaacctcacgggggtcctccctggtctccctcaggtcttggccctcagcccacagtatctctttcagctactctgaatacttttctagattccagcgggagtcagttccgggcacccacgacacaccaccaaggtcacccatatcacggactcaggtattcaccccgcagccctcagggactcttcggtctctctcagctattctccaaccatctccagatatcagcgggagtcaacttcccacacccaggagttaccggagaaactcacagaacttacgggcaccctcccccatatcactgactcaggtgatcaccccgcaggctcaaggactctcctgtc

SEQ ID NO: 487224 - DNA, 507 bp, Homo sapiens
  misc_feature (420)..(420): n is a, c, g, or t
aatctctaaaatacattgtcccactgtctgcgctttctctgcctcccagaggaagagaaaggctaaggcttacgttctacaaagttcctaccttatatggaactcagagatggtcttctttggcaggcacctccaaaccatagatctgcggggtaggtagagagatcctgagtgtgttgtttttattattactactaatgatgaagacagacgttgccattttattgatgtgtagcagggctaggcacagggctataagcctgatatgtttcatcttgctcatcagcacagcaatactaagaaggaggaactattgcgaccgactgggcgacatgtccgaagtcccacagctaggaagtagcagggagaaagaaaccgacaatgaagacacagggcttccgataatccatgctatactgnctccttccagaaatttaactggttccatccaagttatggaatgcttttttatgattgtggttgctgttaaatcagtcaagactgcag

SEQ ID NO: 487225 - DNA, 1121 bp, Homo sapiens
gcccagcctgcatattaatcctgtgtgttagaatcccacccaggtgttagagccactcagcaggcctggctgccttgggtctcggcaaagggcctctggggtgctccggcctttgcgatggacacaggcagccttgagacaatgtgcctgccctggaggccctgtgccctccacaccgctggcatcaggctcccactgcccctcccacccagactggccctcggatggctgagtgtgtgggcacctgatagtgctctctgccccaggccaagctggagaggcatgaacccctagaaagtgtggccccaaccaaagacctggctcatgccttccctgaccccatttacccaggaaggcagtgccctgcagtaggcagtgacctaggccttgagccggttgccaacccaagctgctcagggatgctgccaggtggtccccaagaaagacagcacctgatgcagtgtccccatggtgagcataggtcagccaatggagctgaggagcggcatggtgctgacggttccctgcggggccgacgagtgtttgtcagctccccgaagtagacctccgcagacgacgagccctagaaaggccatcaaccggggccttgacatggcaccagaccatatgtaccatatggtccctttcaaacgcacaccaatacatgttacgtggttcaaacctgagacaggcaccccagtgatgtgggcaacggatgcaattcccggtaaatcagggaatgtacaggcagaaatgtgctggtatacagtgtaggacatcccaagggtctcccatggtgggacaacgcaaacctgccattccatgggaggtccatccttggccaggtaagccaagacacagagctactcccgtggggacagcgaagtgctgcgaccgcccgcgtcatggggagggaagagaaggctaggagcagcagaacactaacccagggtaaacagttgcagaaggcactgaaaatgaaggaactcaaagcagccccagcgacaacacggagaactagcagacggggtgccacggagtacaatctaagacaggcaataatgaggaaaaggagatagtcgtggtcagaagatgttgtgtatctgaacggccaccagtga

SEQ ID NO: 487226 - DNA, 100 bp, Homo sapiens
gagcctaaccctagaaaaaagttgtggttccctgattttgtcttgagcaggcaccatccctgtccccttgcttgcgggtagaattggcacagggttaagg

SEQ ID NO: 487227 - DNA, 1898 bp, Homo sapiens
  misc_feature (1704)..(1704): n is a, c, g, or t
gcacacgcccctcctcgtggccggaggacccgccccctccttatgactccgagaatctctcctcccatcgcccggcccgccattctcatggaattaggggaggcgatgcgagacagggtggcaacagcacagcagccatcctgacgccccatcaccattcacacatgagaggaggatgagggacagcacaccacaatatttatccaccggagacgctagaggacacacgtccaccatccgcctaggggggaccccacacaccacactatcgaatgccgaccaatgcctttacaatgcatttcatgcggagacgcgacgagcggagacatgagatcacacagcagaacaaagacccagaaaacaaccattatcggcaccacgcaacacacgaggacccaacaacacacacggaagagccgcacacagcctgctatccgcaaggccgacatccccatatgggaggccacgacatcaccatatatggaaatacacagagaagcaagagccccccatacgcgacctccccacaatcctaccccaacagcccacaaaacacgcgagcacagagttcggcaaataccaatacaaacacatgcagacgacacgaaacacccaaacccacgagacacaagaagagaaaacgagaaaacacgagaggaccactagacaacaaccgaacgaataaccgccacaaaacggcgcacaaataagacacaccacaatataaatcgacgagaatacttgacccagaggaccaattccgcagtcacaaacacccacacgacaaggtacgaccacaaaagcagatacctaacacagacgccaccagaccaactgacaaacatagaacacagtaacagtacacacagaaccaactaaaaacaactacataaaacggatacgccgccaatcaaacataccacactcaccccaactaacacgagagcgacacaatatagagcacagacagaggataacaaaaaggaaacacacactacacactacgtgcgacacacaaagcatccacagacaagacaacaacaacaagccacaagagagcgcaagaccaaccaccccacaaccatcaacacaacaaccacaacaccaaccgacaaacacgaaccgacacaaacgcaacaccacaacacaaacacaaaacaaagaacaacaacataaaactaacgcaattcaaactagatacaacattataacacaccaaaccaccaccgacaccaccaatatccaacacgaacccacaccacacactacaacataacaacacagacaaaaccaacaaaccacacccatcaactcacaaccaaccacaagtaacaaatacacacaccacaactcacccaatacataaacacacaagaacaccaacacacaacaacaacaccaaatataccacaatacctccacaacaaacacacaataacaacatccacatatattcacaaacaacagaaacataatcaaccatcacgcaaaacatccacccaacacaactatctacacatttactcacaacccatcacgacgtccaacacaaacgtacaccagcagacagcagacacatccatcacaggcgcgaccagacgcgtacgcacagaatcgcacactccagccccgaaggcgcagaacaccacagacgctcaacaacagaacgacagaggtcgtcgacggcccacatcgaagccagcncatgatcacacccaacaggacgcgacaacgcctaacacaactacacgaacgacaaagccagacgccaagtccagacaccactcactgtcggcaactcatagacagacaacagagacggacccaagccagacagctggcacgagaccaccacgagacacaaacacacacgaaccactcacagcagcccaccgaaa

SEQ ID NO: 487228 - DNA, 206 bp, Homo sapiens
atccagcctgtatctcaactcctggtctcaagcaatctacctgcctcagctctcaaagtgctgggattataggtgtgacgcaccgtatgcagctgggcagtggtatttagaaccaagaagcggcgtggcagacttcaaaaatctcatatggagtcagactaatggcccagccagttcagcaagtggcaattcacttaaggccattt

SEQ ID NO: 487229 - DNA, 832 bp, Homo sapiens
attacatcatctgccataagacgtcttctactcaatcagatttatagactgtattacattcagaggttgataaatgacgactctgtataatttgaccgtgaggtgagtgtctaaaatgtctagtatgcatgagtctaaaattagagatccttatctatatatcaaaagttttatcctgaagtttcaggatccacgtcttccttaataaactgtgtaaatggaaagcgagctttatgagacatttaacacaatgttgctgctgctttgttacttaaaaagaaagttgccaagagagacttcttagggaaaatatttgggtttttatttccaaaactgtggtgaaatatgtgtttgtgccattttaaaacaagtctcaggttattaccactctgcgcattaaatattgtatgcctgcatttttaaaaattctgtgcatgtcttttatggagtacattctattttgttttcagataccctacaaccaatttttttagtaatcttttagaattgaaaattatcataaatgatcgagaataatcatcacattagttaagatggtatatgtggaagtagtttaaaacaatcttgtgcaattttacagtaacgactcaaaagtccctttcaggtgtgccttggttcagctaaatattgtgaccagcaatgacaaccttgcgagttatttcttcacaatattattgctatgaattatgggcacacagaaccgggttggaggataagcgtcttgatgtaaatttaatatactctaaggaaaattggggggcaaaacaagcttacatattttctgcgcctttaaaagtggctgaccatggtc

SEQ ID NO: 487230 - DNA, 910 bp, Homo sapiens
  misc_feature (144)..(144): n is a, c, g, or t
  misc_feature (153)..(153): n is a, c, g, or t
  misc_feature (171)..(171): n is a, c, g, or t
  misc_feature (271)..(271): n is a, c, g, or t
  misc_feature (307)..(307): n is a, c, g, or t
  misc_feature (322)..(322): n is a, c, g, or t
  misc_feature (358)..(358): n is a, c, g, or t
  misc_feature (380)..(380): n is a, c, g, or t
  misc_feature (448)..(448): n is a, c, g, or t
  misc_feature (542)..(542): n is a, c, g, or t
  misc_feature (564)..(564): n is a, c, g, or t
  misc_feature (581)..(581): n is a, c, g, or t
  misc_feature (692)..(692): n is a, c, g, or t
  misc_feature (701)..(701): n is a, c, g, or t
  misc_feature (705)..(706): n is a, c, g, or t
  misc_feature (711)..(711): n is a, c, g, or t
  misc_feature (715)..(715): n is a, c, g, or t
  misc_feature (720)..(720): n is a, c, g, or t
  misc_feature (729)..(729): n is a, c, g, or t
  misc_feature (732)..(732): n is a, c, g, or t
  misc_feature (741)..(741): n is a, c, g, or t
  misc_feature (754)..(754): n is a, c, g, or t
  misc_feature (759)..(759): n is a, c, g, or t
  misc_feature (764)..(764): n is a, c, g, or t
  misc_feature (770)..(771): n is a, c, g, or t
  misc_feature (782)..(782): n is a, c, g, or t
  misc_feature (788)..(788): n is a, c, g, or t
  misc_feature (796)..(796): n is a, c, g, or t
  misc_feature (798)..(798): n is a, c, g, or t
  misc_feature (832)..(832): n is a, c, g, or t
  misc_feature (837)..(837): n is a, c, g, or t
gcttacctcaagtaatctgcccacctcagcctcccagagtgctgggattacagagacaggactccagcctgggtaacagaggaagaccttctctctttaaaaaaaaaaaaaaagtgtggaggcacagtgggggctatttcactngtccactanaagtcttaagacacggtngcagtcttcaagattagctctccggacagtctactatcctcaggttcatctggggaccattagtggagctggaatggtgagaccaacatccgtgacaccnggactctttcaggttctgaagttggtctttcttatnattcaggtcgatctnggagaaagagggaccaaagtcactttttagaggctngggtccaaattgggtgggagtngcaccatcaagcttttatcacaaattccttaatgaatcctatatggatggttaaaacccgaatgcagntagaacagaaagtgaggggctctaagcagatgaatacactccagtgtgctcgtacgtttaccagaccgaaggcattcgggttctatagaggatnaactgctcgtatgctggaattnccgaaatataatctgtnggctatttatgaagagtttaaacgaagttatcttgaaagaagctccattaaggctctttctgcaaatggggactgagaaaaaattcccaccaaggttttttgtggacttanggcagctgntgcnncttcnaaangggtnggctcctgnatntgttatccnccacaaagtcaanggacnaggcncgggannagggcccagtncagttntttgtccnanggggccctgggtccggagaggtacctgctttaanaggangttgccgttttcggcatcccaatcgcctgggtgtacttaagagtggtctttgaaaacacgcaaaaggcgaaag

SEQ ID NO: 487231 - DNA, 153 bp, Homo sapiens
gaatcaactgtcaactgtctacaaataactgattttaaaacaaagtcaacatttaaaaacattttaacttgtgaaaaaacaaagaattttttttaattgtggcacaatacagacaatataaaatttaccggcaggacgcagaacgcgcctaat

SEQ ID NO: 487232 - DNA, 799 bp, Homo sapiens
gcccgacggacaccctccgggccccggcagacacaaccgtgacagggtgcccgtaggaccgtcaacaaatagctgtccgcgcgggccccactaacatcgtacccactcaggtacgcacgggggcctcaccactaacagggaaaaaccgctgtgtcacaaaaacgcccgggaaagacagtgtgacaccggcgcctccccccgccctcatagaggatgccctccacctccgcgatccaccccgggaagagttttggtggcccccacgcggcgacaagcacggaaccaccccttggcgacaacacgcacacctccgcgggggcccccaccccccatggcaccgggataacgcctgtggttccgccaaccccacgttttttttttgtttgtgcgggcccctcccgcagttctcccctttccaaaggcgccactccggggttctcctggactcgccgctcgccagtgatccctccttaggcgtgccccctccacgcacgccttccggggtgtctctcttgtctgtgcccccgccacccgctgccgccgtgtgtctttcagttgtggcagtactgctccgcctcccgccccccgcagaagaagtcccgcctcgcgcccactcctctcgcccgcctaaagacaccccgggctggcgcgcgtgcgagcgagggcccgccggacagccgagcgtggcccgccgcaccaccgctcttctcgtagggtacacatacagagacgagcgtaagtgctccctcccgaaggaaaaagaaaggaagggccacaacgccccaacaatgtccgaaac

SEQ ID NO: 487233 - DNA, 303 bp, Homo sapiens
taggccgcactcttggcaatggttgattcctgactcccaactgctgaaatatacccatgggtaatacacggcgctctgaagacccagagaagacattactaatgatgtgacttcaggagccacagaagatccttaccagcttccctcaaagcagtccttatcctctttctatcttcactccgatcatcatctattgtcacactatccagctaagcagagattcctggaggctgacttgtatcttcagactcacagagcgaattcagctcttctgaatcacgacccacccaggctctttcattc

SEQ ID NO: 487234 - DNA, 354 bp, Homo sapiens
tctagaggatcccaatcagtttaacagactgagtaagagtacaaaagaggcatagttggagtttcgcccagcagggagtgggggattagcaggagactggtattgggcatgatgtctaaaatgtatagcgaaggaagacagaattaaaggtgactaacagagatcaaagtagaggatttagggactgagtacccctgtggtaaaaaaaaaaaaaaaggcaacacagggcacaaatacggagtgagagaagggaagcggggatcacagtaaaaggcttaattataaaatattagataaatcacttctatgccaggagcccttcctggtgtaaccggatggggtaccggagctcga

SEQ ID NO: 487235 - DNA, 147 bp, Homo sapiens
aatattcccgtgagcaaagctgtagatgaaaatatgataggcataggcagaagcaggaagcggcagaagcaggaagcacaggagcccttttaagtatcttttgttacgcttttcaccccacccccaagtcctggtagaagcaggaag

SEQ ID NO: 487236 - DNA, 309 bp, Homo sapiens
gcctgggggacaacggcgagacttcctctcaaaaaaaaccaaaaccaaaaccaaaacctgctttgttcttctgtcatcctgaccccacccctttctgggctactcttgacatccacagtcatatacacatgggagaggccacagagcctcgaatgccatacctaggattcatcatactctagataaaaagtttgcacacagagatggtgaattctgaaccctctaagactgcgaagtttatgcctgtctggctttcatgggtttcttaaagatgtccaaacacacaataaaagtaaataaacactgtta

SEQ ID NO: 487237 - DNA, 1112 bp, Homo sapiens
ggggtttggggtgctgtttccatacaacatggtttatttccgattcctcagaagatcctgtatatatgaataacctcagggtaatgttaatttcctgtcccccatgtcaaaatggtcaccctaagccttttttttggtttatgttattattttggggaacagcggtgcctacactctgtgttcgagtcgcacggcgtggatggtgcagaggacatgtggatctgtgactgcaggggcaggggtagacatctgcgtggggcgtcaagggtacacacgtatccaaagatagtcgtgaaaccactggtgttgtgcccgattcaacagccgggccagattcatagttgaagggaacaaaagtggggtgtgctccgaggtggggtcctcaagactccgtgagacgtcaagcaagggtgccacgcctgggcttaccacaaaggggcggggatataaaggcggtttaaaaaccacagtggggcaagggcgaaaggtatagccttctggcggcatgtttaagagagagtgtagtgtattattagattaaaaattatgtgtgcgcaagtcagagtgggggggctgtataaacctcttgcgtgggcgaaagggggaaaagttccgagaaagcgcgtggtatttttagagcgcttcaccatagagacttatcaacgacacaactccccgtgaaaaactgggcgcgtgtagcccaaaaatgaggtaaatctctcaaaatgggggggggcacacccccataaggtggcgcctgtaataacgctgttctgtgggcgcaaacggggaaaaagaggaaggggcaccaaaaacctgactaaccaacctttaaggcacggggggggccaaccaaccgctgtgggaacaaccaggaagcgtctacgagacaccccctttaacacagacaccccgccaaggaaaaaaagagaccacccggtgtggggcgcccccactcaccgtcagcttcaggagagggggacccaacgtggacgcgaggtatacgcaccccaaactggggcctcctggcggcgggcaacatatcaaccgtcgacacaaggggagaaaacaggccccgcggatgacacagtggcgccacaaggtagaacaac

SEQ ID NO: 487238 - DNA, 179 bp, Homo sapiens
  misc_feature (19)..(19): n is a, c, g, or t
  misc_feature (47)..(47): n is a, c, g, or t
  misc_feature (49)..(49): n is a, c, g, or t
  misc_feature (73)..(73): n is a, c, g, or t
cgttaagaggaagcaaganaacgtttagaagaagagaagcgtgcttntnaagaagcaaggcggcaaatggtanatgaagatgaggaaaaccaagacacagcaaaaatttttaaagggtaccgccctggtaaactcaaactcagtttagaagaaatggaaaggcaaaggagagaatatga

SEQ ID NO: 487239 - DNA, 170 bp, Homo sapiens
acaaaaaaaaaaggatgggcgagctggggggtcagggaaagatacctggattcttttaggaatcaaagcggggtaaataccctgtggggatgactaatggctgggtctggccctcattggatcctaagtaaataataggtctcaaaagggaaatatgtagggatgctccg

SEQ ID NO: 487240 - DNA, 282 bp, Homo sapiens
  misc_feature (68)..(68): n is a, c, g, or t
atagcattagattgttgttctgccagaagaaccctgcaagctgcttccacctccgggccttgtgcggnctcttccctcgtcatgcagttcttccctctgacttttgaccaaacccccctctcacccatcatctccgtgggtcacctcttggggacacttccccagagtctttctcccttaggcctcctcatctgtctctcatttatgggcttttctcatttgttatcccaatttttggctctgtgaggggtttttctctgagggggtggaattaatcttcat

SEQ ID NO: 487241 - DNA, 137 bp, Homo sapiens
  misc_feature (38)..(38): n is a, c, g, or t
  misc_feature (46)..(46): n is a, c, g, or t
cttatgagacagatcacgtctgcgaggttgctcagacncctccagntgcggcaggttgtctgggtgcgctgtggtgctccgcaggtgcagggtctgcagggccgtcatcgctgggagctgccggagctgtgcatgca

SEQ ID NO: 487242 - DNA, 213 bp, Homo sapiens
attggactacgcggactacgggagctggaggctggggcctggttacttgtgttgacgtgcagagcctctctctggggggctgcagctcatcttgggggagagctggactcagcatgccccgtagatgcaaaagccacatccacatctcactcctcccggtgcttaatgcggcactccctgacagcgcttcctccgccaccggatctcccacta

SEQ ID NO: 487243 - DNA, 400 bp, Homo sapiens
ggcacgaggcacagcacagaatcgtcgggaccagactcgtgtcaggccacatgcagacttctcagagcaaacgccgaccaaggagaaactcactatcatgagaattgcagtgatttgcttttgcctctctaggcattacctgtgccataccagttaaacaggctgattctggaagttctgagggacccatcttagaagcagaatcttctagacccacagaatgctgtgtgctctgaagaaaccaatgactttaaacaagagaccctttcaagtgagtgcaacggccatgaccacatggatgatatggatgatgaagatgatgatgaccatgtggacaggcaggacttcatatgactctaacgactctgatgatgtatatgacactgatgtctcaccgtct

SEQ ID NO: 487244 - DNA, 149 bp, Homo sapiens
cgatgaggaattgatcccgcggctgagaactggtataaacatgagtgtaggtagaatgtatttaccagtaccaacagggaaattatttaagttattacatgtactgtattgggacacttgaggagaactcgtttagttcatacaagctt

SEQ ID NO: 487245 - DNA, 148 bp, Homo sapiens
aaggggggggggggggcccccccccttgggggttttttctttctttccccccccccctggggggttttttttgggttttttttttaaaaggccttttaaggtcccctttttggcccccccaaaaaaggggggggggggggttttggga

SEQ ID NO: 487246 - DNA, 170 bp, Homo sapiens
gaccaggcagaagatttcactcaagtcagcactaccaggctgcacaaagaggcgggcctgcacagaactctacactaggcagcacataaagaatggagcagtagactctgtcgcatctttgttcccagcaaaggctacatgttacctcgttcaattgataataaaccttt

SEQ ID NO: 487247 - DNA, 430 bp, Homo sapiens
cctcctctaccagaccatttaccacactgctagccaggcataaaactaaaatagtgaatctccgccatacccctgatataaaaacttccagtgattccctacagccaatggggcaaaggccagtcatacagcattacacacataggccctctccaatctacatatcctgctgctttcccacttcccaacgcccctgaacctataagctccattacaactatctcaagaaaatgacaataccccacctactacagcgtggtacatgctgcttctagaaacatagctccttgatacttctccatatagagtagaggcaactagcacgctcttagaagactcaactacaaaacgccagtcttcccagaccaacccccacagtccaaattaattcgaagcacccatgagcagtttgtgcaggagggttgcaacg

SEQ ID NO: 487248 - DNA, 322 bp, Homo sapiens
ggtctcactttccctccaaactccccgcgcggcaggtagtgaacccgggcttggcgaggtgcccggagctccctatttggctcgctccctgcacccagaggtggagaactctcccactcttggcaggtttgtgtccctcttagcttgatgaccctgaggcccttaactctgtgtacagttgtacatgtgatttgctccacttgccgtaccctactaatgtgtgttacagaaagaagaaaacaaaggccgactaatgctgagtagttgcccaccattcacacagcgtcagatctgtgagagactcagagcttagccagccagg

SEQ ID NO: 487249 - DNA, 175 bp, Homo sapiens
ccctgtgctacttaagccgctcgcaaggatggccctctacttgaggggtgaaagaaacctcatcgttacaggccatggtactgtggcgctccgtgaaattagacgtactcagaagtccactgaacttctgattcgcgatcgttcccttccagcgtctgtgtgctgagaaattgac

SEQ ID NO: 487250 - DNA, 949 bp, Homo sapiens
cggtcaccagggattaactagggttagctgtttaacacattatctgtattatagtagtggattatttatttacaagtggggggtaattcagcagtcaggactctaagctttaatagttggaattggaggaaatctcgcttttattcatttagctggcaactgggctttatgggagacctcggggtgctgggctttcaaggaagcctatgagagtgccaaaatcacacctttagaagagcacctgggctctaataggggatgcatgagcaaacagggagattggaaggggtttaaacattaatttagaagtggtgaaaaaaatatcaattcatatctttcaaggtactaacccctcaaaaaagcccacacattacaaaatagtggtgagtggtgataccacttgggtctttaaggtctttaagtaactggaagttaagcacgagaaaaaaaaatcacttcagggaaatttcagtaagaaacccaaattctaaaaatgggtggcagatgagctaaaaaaaaaaaataaaaaagaggccacaaaataacctgttacatagagaggctaaagcgttgtgggaaatgcgggaagtatagggtatcccaggtgtaatttaggggaacattttagggccttcagggaaattttaagggcaattctaagcgcgacatccaacttaaggcgggcccaatccacaagaggggccccatacccaagggcagggaaccgcgggggaacacccacggtgggtcccaatacggaactgcacacgatccctaagagcacacatggtcccctaacagggcgcccaaaaagctgtgctacaacaccagggttaaacccgcgaaccgggggcacacaagacactgcgcgcccaaaacgcgggaaataccgcccaacacacatttgtacacacccgcacacaacagggcaccgcaccaccaacgccga

SEQ ID NO: 487251 - DNA, 325 bp, Homo sapiens
tactaatcgagccggtaccacgatctgggagagtgctgaattgagcaagctgagatgaggtataggaggtcgaagttactgtttctttgctgtcttctgtccctggtggttaattggttatccctgaatgagccagattaccgctctgggaggtgtcagctgatccatggagtgcagggtctgcaaactatctcaagcactgatgttaagttttacagtagtgatgttatctccagaagcaatttgtggaggttcagactcttgcagtttctgacccctaaaccttaatttctaatcttgtagctaatttgttaggtctacctgg

SEQ ID NO: 487252 - DNA, 259 bp, Homo sapiens
agcgctgtggggaggctgttgaaaggcgtagccactgtttatcaccaacattcattgtcccctgcgaggcgtgagaattagactgacgggtgctatgccgggtgtttaactgaaggtgaaacacttgaccagcccttggaggagctcacaaccacataggacacatttggacttggtccaccccgagagtgactttgtacaaagaaatgactgagcgctggaataactaaatgcaattaaaatgcgtctttcagtccca

SEQ ID NO: 487253 - DNA, 956 bp, Homo sapiens
gctccatgctttctttctctgtcgttgtgacacacacacacacacacacacacacacacacacacaccacagttagtgacatcaggggccccagtcccgagatatgacagattggacaccactcacggtcataatgtgtgtctaatgtgtggttgagaaatcatgaagtgtatatgtactgtgtgtacccagagaaagggagatagttcacattatagaaggaaccgtgagaagtgatctcacagagatgtgtcatagtgtgtgcacaccctaagagagggggcggcccctagacaccatctctgcgtgacggcgatcttgatcatcaaccagtagtgtgcgtctcaccacatgtgtctctctgtgcgcggctgcatcactatatgaatctactaggtgaatttgcgccaatatctcgtgcgtgccgttgattaagaggtgtatgaactatcaggtatattcgtgctataacatatactgacgtgcgtactagtagataatagcagctgaactataaaaaaagagtatcatctattagtgctcatcatattgtgctaaagtggagaggcatgactatcatcggttttggcaccagcacagtcagtagcagaagtggagaaaaaaaaatatataggcggagtattttgattaagaaagcgaagtcgtcgctgtattcacaaaccaacttaagcataaaacacagagccacagggcccaacacaccgtagcaaggacacacggcacaactcacccggcaacaacgcgggatcgacacgagacaaacaccgacaaacaccaaaactaaaacgagaccacacaaaggaacaacacatactaaacaacaaaatacatacagacaccaaaccaacacacccaacaccccaccaccccacgccaaacccaactgagaaaatgaaaacaacacaaacaacaaacacccacagcgaagggcaacg

SEQ ID NO: 487254 - DNA, 111 bp, Homo sapiens
aatggacggcctcctctcactcttgcctccagacatggaaggtgatcccatgtgacagctggggtgcactgtgcggcggccgcatgtgagggccgccattggattctcctc

SEQ ID NO: 487255 - DNA, 528 bp, Homo sapiens
ttcagagtatctgagtactggagttgggctttatatgattctctgtgtagttcctcttcattttcagcaggaaactgcttctccttaataaattgataactgtttatgcttttctctcggactgattgccggtgtgtgatcatgaatgctttcagttatgtgaataataaaagaatataagaagaaaagtgaggggccggagaagtggctcagtcagtaaaggtttgctgtgcaagcctgaggtcctgagttcagatccccaacagccacataaaaagcggggcatgacctgagacgcagagctggggaggcagagacaggaggattccccagcttgctgccctgacagtctggctgagtcactgagcacctggttcaggtagagagcaatagaggaagatgtagaacataaatctctggcctcaacaggcaagcacatgtgcatacacccgtttgcacacacatacaaataccaggtacacttgcatgcatgaccgtacaccgaacaaaacaaaaacaacaaatttg

SEQ ID NO: 487256 - DNA, 1203 bp, Homo sapiens
  misc_feature (283)..(283): n is a, c, g, or t
tgtgtagtggttttgttgtgcatgttgtatttagtgattgttttatattttgagtagtgatggctgtttgtttctgttttgtagtggttgtgttttttttttgttatgtatattgactgtttgtgtgtgtgtatttagtgagttttatgtagggttgagtgagtctatttattagttgttagttttgtttttttttgtgtttttttgttttgttcgtttgttggtttttttttttgtttgcttttttgttggtgtggttttgtttttgtgttatttttttttnagcagacgcgacagcgcgaggaggacgccgaggaaagagaggagaggctccccggaggggacacagacataggcgtctggcaaccaaagtgtgctcgcgacagcgaggggcccagaacagtggggcaccacacgcgcgaaaccttatgtcgcgcccccatccgcacccccatggcgccacagccgtgggtttgccgggccccacggccgtttcagccctttgccggtacaccgcgccccccactcagcgcagatgatcgctctatctttgccggcccctgggcttctctgcacgatggtccccggaagtagattctccgccctgcgtacatgtacacggtcacatacacgggggcagaatcactttcccaaagaagactctgttttacgaaggggattcactacagggacttagagcaccagtctcttttcggccctttaaatgagagttccccccagttgacccaaagttggacacgcacaccatttttcaggggcatgcccaattgcgtaaagtgaggctcgcctgcatagctaatcctggttaaagaccaacttcttccaaagcaaccacgtgcttgtttcctatcgggctccctgcggggcatttttcttccactaccaagtccagcttgggctctccaagccctgcgcctgttacccccggatgcccccagggcctgggccagttgctgtggcgaccaggaagagctaatcttcagagagctccagactctctaatgatgctgaaggacgccaaggctgagtccagaaacacacttaagagaaaaggattggcccgggcgccggtggctcacgcctgtaatccccagccctttgggaggccgaggcgggtggatcatgaggtccggagatcgagaccctcctggctaaaccaggtgaaaccccgtctttactata

SEQ ID NO: 487257 - DNA, 105 bp, Homo sapiens
cacataattagtacagcacatactagtacgcacataactagcacgcacactactagtgaaccactatcacgaaaaaaactctacctctctatactaatctcccta

SEQ ID NO: 487258 - DNA, 1632 bp, Homo sapiens
tacagataaacttttaaattggattaattattttcattttcaagaactctttttggaaattcgccactggttacgtgtcactattcaacagccaagaggcaataagaaaagtttaaacacccaaaaattatctcgtgcactatgacaccacgtgtgcacgaggaaacgcgcgtgcttgtgctaaaggttaacattatcagtgtgtcttcccaagagaaacaatgtgattatttattagagagaagattaatttcatctctttaaccattgttgcaagggaccaaatttgtgtaatttcaaagggcttggaaagaaattattattatttcaggtgccgtgtctttctataaacacgtttatattttaacacatctttacaatctacagcgatatttattctcttcatatataaacaacaaaattccgcgagaaggtgccttaaccttccaagggggtctcacatattacccatatatgtgttccattgaacagagtctgtgcacaaagaaagagccctgtgcaccaagagtgttccgtggaattgtatacacgagttttttgcacaccaccctctattaaagccgtggggacactatcatttctacgtgaaatctccaacacacacaccaaacaacaacacacacacacaacacctactcacacaacaacacaatataactaaaaacaatatatatatatatacacacaatactcacaacatcacaccaccctccatcccctttatcactaactatcaacctagaaactactacccaatatcataacaatacaaacttactatctctacattccacacacactctcatcgctcctttcccatcttatctcaactcttcactccttctccctaccacatgcgccccgccaatcttctacatctgacgcactctcgcatctggctctcctggcacgccattgagcgccagtgtgcactcacaggacatatggcgtctcatatatattctatccatactcacgtgtctcggcgtgcacattaaaacacataatagacttatgaaggaagcaaaacaaccctcgtgttgttgcttacttcttatatcgtagcgacgacaacccactcattcatgtaatacgcgaccacgcctataatcacacacaagaaaacgtacagcatacagacagcaaagcatcgagcagtacgctcgctgtactagaggtgcggcgccgaatcacctacatcaacaacacgatgcataagacatgctgatctttactgactgtgatggactcagcacacgcacagcgttgacacagcagcggcggccgcacaaccgaacgatccgcagcgcgcctaacggtacattcattgcgagcacacaatatatacgcagcggagcggaaacgcgagtagatcgatcagaacgaggcggaacaacgagggaggaggaacgccagcacagcgagaaggcgcagcgcagcgagcgcggcagaggacgtgaggaggggaactgaaaccacacgatgctggcgaggatcagcggcacgcgagcgtagtcggcaagacagttccgactgaccagtgagtcgaagcgcgagagccacgagagatgagcacagataaacggacgaggacacgcaagcatgcctata

SEQ ID NO: 487259 - DNA, 815 bp, Homo sapiens
  misc_feature (43)..(43): n is a, c, g, or t
  misc_feature (64)..(64): n is a, c, g, or t
  misc_feature (66)..(66): n is a, c, g, or t
  misc_feature (79)..(79): n is a, c, g, or t
  misc_feature (91)..(91): n is a, c, g, or t
  misc_feature (99)..(99): n is a, c, g, or t
  misc_feature (126)..(126): n is a, c, g, or t
  misc_feature (143)..(143): n is a, c, g, or t
  misc_feature (154)..(155): n is a, c, g, or t
  misc_feature (161)..(161): n is a, c, g, or t
  misc_feature (175)..(175): n is a, c, g, or t
  misc_feature (181)..(181): n is a, c, g, or t
  misc_feature (202)..(202): n is a, c, g, or t
  misc_feature (211)..(211): n is a, c, g, or t
  misc_feature (215)..(215): n is a, c, g, or t
  misc_feature (283)..(283): n is a, c, g, or t
  misc_feature (289)..(289): n is a, c, g, or t
  misc_feature (292)..(292): n is a, c, g, or t
  misc_feature (298)..(298): n is a, c, g, or t
  misc_feature (307)..(307): n is a, c, g, or t
atgcgctacccggccggccgctggataccgcggccggctgcgncccggccgccctttcccgccntntttgccctgcccngttatgccgcgnccgccccngcgggcttctcggcgcgagggctcttncggaccctgcgccctangaactggggtnnccgccnctgaccgcggccgnggcggngggcgcggcggcccgccgccnctcggcggntggngccccagacgcagaggcggggctggcccctggggagctgcagcagctggcccaggggccggaggacgngctggnggntctgcngctctcagnggacgactgaggcagcccatctggggggcctgtaggggctgccgggctggtggccagtgtttccacctccctggcagtcaggcctagaggctggcgtctgtgcagttgggggaggcagtagacacgggacaggctttattatttatttttcagcatgaaagaccaaacgtatcgagagctgggctgggctgggctggtgtggctgctgaagccccacagctgtgggctgctgaagtcagctccgcgggggagctgaccctgacgtcagcagaccgagaccagtcccagttccagggggaggcctgcaggcccctggccccttccaccacctctgccctccgtctgcagacctcgtccatctgcaccaggctctgccttcactcccccaagtctttggaaatttgttcttttcctttgaagtcacattttcttttaaaattttttgttttgcatccgaaaccgaaagaaataaagcggtgggaggcagggccattgtgttgagtggtgg

SEQ ID NO: 487260 - DNA, 86 bp, Homo sapiens
gaatttgctggtgcagtacaactaggcttaatagggacatgcctctgcactccagcgtggcaacagaacgagactccatcgcaaaa

SEQ ID NO: 487261 - DNA, 249 bp, Homo sapiens
agctcgaagagatgatatttgtgaagttactggtacataactggggctcaaaaaatggtaacttgattctccccaggatccccctgacttctctccccaactctgctcccatcaccagttgcataagtcaattctatctggtattcctctgagcattacaccacttgcggaaatgctatctagtgaaatcatcatttcatcatctgagaacttgagagtctatgtggaggaatagcatttccagagatg

SEQ ID NO: 487262 - DNA, 1194 bp, Homo sapiens
  misc_feature (43)..(43): n is a, c, g, or t
  misc_feature (64)..(64): n is a, c, g, or t
  misc_feature (66)..(66): n is a, c, g, or t
  misc_feature (79)..(79): n is a, c, g, or t
  misc_feature (91)..(91): n is a, c, g, or t
  misc_feature (99)..(99): n is a, c, g, or t
  misc_feature (126)..(126): n is a, c, g, or t
  misc_feature (143)..(143): n is a, c, g, or t
  misc_feature (154)..(155): n is a, c, g, or t
  misc_feature (161)..(161): n is a, c, g, or t
  misc_feature (175)..(175): n is a, c, g, or t
  misc_feature (181)..(181): n is a, c, g, or t
  misc_feature (202)..(202): n is a, c, g, or t
  misc_feature (211)..(211): n is a, c, g, or t
  misc_feature (215)..(215): n is a, c, g, or t
  misc_feature (283)..(283): n is a, c, g, or t
  misc_feature (289)..(289): n is a, c, g, or t
  misc_feature (292)..(292): n is a, c, g, or t
  misc_feature (298)..(298): n is a, c, g, or t
  misc_feature (307)..(307): n is a, c, g, or t
atgcgctacccggccggccgctggataccgcggccggctgcgncccggccgccctttcccgccntntttgccctgcccngttatgccgcgnccgccccngcgggcttctcggcgcgagggctcttncggaccctgcgccctangaactggggtnnccgccnctgaccgcggccgnggcggngggcgcggcggcccgccgccnctcggcggntggngccccagacgcagaggcggggctggcccctggggagctgcagcagctggcccaggggccggaggacgngctggnggntctgcngctctcagnggacgactgaggcagcccatctggggggcctgtaggggctgccgggctggtggccagtgtttccacctccctggcagtcaggcctagaggctggcgtctgtgcagttgggggaggcagtagacacgggacaggctttattatttatttttcagcatgaaagaccaaacgtatcgagagctgggctgggctgggctggtgtggctgctgaagccccacagctgtgggctgctgaagtcagctccgcgggggagctgaccctgacgtcagcagaccgagaccagtcccagttccagggggaggcctgcaggcccctggccccttccaccacctctgccctccgtctgcagacctcgtccatctgcaccaggctctgccttcactcccccaagtctttggaaatttgttcttttcctttgaagtcacattttcttttaaaattttttgttttgcatccgaaaccgaaagaaataaagcggtgggaggcagggccattgtgttgagtggtgggaaggttgccgtcctggctgcaggacgcctctcggaaagagatgttcacgtcccagtgggtgtggactcttctcttcatgatacggatgtgcggaccatcctcctgcttcaagcctgccgccgccacaggtggggccactcccgtcgctgtcaccatcgctggcagagaagctgggagttcgctccttcttcaggttccgggcggcaggcagggcgactgtcctcttgtctgccagccgcaccggttcaccggggaggatattcggcagcccgggcagtcgcagatcggaggatgcacctgcaggatccccttggacataagcgtcttcagacttttcccttccgagcggagggagcggcccgcgagccccaagcgctg

SEQ ID NO: 487263 - DNA, 977 bp, Homo sapiens
ctgctcctcactggaggagcagcttccttctgggactggacagacttgctccgctcccagcggcctgacctagaaaccagagcaaacagtagaccgaaacgaggtgaaacccgatcgggccagcggcgagctcaaaatcagacttcaatagaaggaacagacgggggagcaacaccatggccgcgtgaggaggaggctgatggaactagaagcgtcgctcgcggcgcaagcaacaagagctagcatgcccttctacgagcacgcgcacgacgggcgcaccagaaactagccaccggccatgacggtagccgagcagggcgaaggccaggcacttacgagcctcggaatacactcgatctacccctgtctctaaggagcaggtgcaagacgtcagagacacggcatagcgcgacacggaccgccggacactgacgagcgcaccagccacagacttgcccgaagagacgacagccgtcccaacagactgaaagtcacgagcacctggaatacgaccgaggacaaacagaaaccaaacacaacgcagataacacaacaacaacactacccaatacaaaataaattaccaaacaaaatgcaataacaaaacataaataacaccaaacaatcaaaaaacaacaaataccaaaacagtaggaacacacacaagaaaagagaagcaagacagaacaaacaaaaccacacaaaagcgaccacaacaactaaagttacaaacacaaaaagcaaacaaataaacaatagagaaagcagccaaacacaacagaacagcacccaaaatacaaacacaacgcacaaaacaaaactaatgaaagcaaaccaagcgtagaacacatacatgacgactagaaaaaaacaacaaaagacataaataaaacctagaaaacaacacaaagtaagaaaagacacaaaacaacacacaaacacaaaaaaaaagaacagagacaaaaccactcagagat

SEQ ID NO: 487264 - DNA, 202 bp, Homo sapiens
cattcctcctcctccttctcctctgcacccagtgcacctccagccagctttttttccccgacactgcacccagaccttcacccggacagtttgaagccagaggcccgggagcccccaccacagaaaatgtcagaggaggtcagggcggagccacaggaggaggaagaggaggaattcgcccaggaggaggagaaatccgccc

SEQ ID NO: 487265 - DNA, 1332 bp, Homo sapiens
  misc_feature (43)..(43): n is a, c, g, or t
  misc_feature (64)..(64): n is a, c, g, or t
  misc_feature (66)..(66): n is a, c, g, or t
  misc_feature (79)..(79): n is a, c, g, or t
  misc_feature (91)..(91): n is a, c, g, or t
  misc_feature (99)..(99): n is a, c, g, or t
  misc_feature (126)..(126): n is a, c, g, or t
  misc_feature (143)..(143): n is a, c, g, or t
  misc_feature (154)..(155): n is a, c, g, or t
  misc_feature (161)..(161): n is a, c, g, or t
  misc_feature (175)..(175): n is a, c, g, or t
  misc_feature (181)..(181): n is a, c, g, or t
  misc_feature (202)..(202): n is a, c, g, or t
  misc_feature (211)..(211): n is a, c, g, or t
  misc_feature (215)..(215): n is a, c, g, or t
  misc_feature (283)..(283): n is a, c, g, or t
  misc_feature (289)..(289): n is a, c, g, or t
  misc_feature (292)..(292): n is a, c, g, or t
  misc_feature (298)..(298): n is a, c, g, or t
  misc_feature (307)..(307): n is a, c, g, or t
  misc_feature (951)..(951): n is a, c, g, or t
  misc_feature (963)..(963): n is a, c, g, or t
  misc_feature (972)..(972): n is a, c, g, or t
  misc_feature (990)..(990): n is a, c, g, or t
  misc_feature (1087)..(1087): n is a, c, g, or t
  misc_feature (1141)..(1141): n is a, c, g, or t
  misc_feature (1166)..(1166): n is a, c, g, or t
  misc_feature (1168)..(1168): n is a, c, g, or t
atgcgctacccggccggccgctggataccgcggccggctgcgncccggccgccctttcccgccntntttgccctgcccngttatgccgcgnccgccccngcgggcttctcggcgcgagggctcttncggaccctgcgccctangaactggggtnnccgccnctgaccgcggccgnggcggngggcgcggcggcccgccgccnctcggcggntggngccccagacgcagaggcggggctggcccctggggagctgcagcagctggcccaggggccggaggacgngctggnggntctgcngctctcagnggacgactgaggcagcccatctggggggcctgtaggggctgccgggctggtggccagtgtttccacctccctggcagtcaggcctagaggctggcgtctgtgcagttgggggaggcagtagacacgggacaggctttattatttatttttcagcatgaaagaccaaacgtatcgagagctgggctgggctgggctggtgtggctgctgaagccccacagctgtgggctgctgaagtcagctccgcgggggagctgaccctgacgtcagcagaccgagaccagtcccagttccagggggaggcctgcaggcccctggccccttccaccacctctgccctccgtctgcagacctcgtccatctgcaccaggctctgccttcactcccccaagtctttggaaatttgttcttttcctttgaagtcacattttcttttaaaattttttgttttgcatccgaaaccgaaagaaataaagcggtgggaggcagggccattgtgttgagtggtggctcctggagatttgtgtggccccacccctacccccggcaacctcaacacagaggctgggaagggtcgggggcccctggaagtagagccaaggtcccattctcctgcttgggtgaagtttgaccggcaagggcgtgnccccctccatanggggacgtngccgtcgtgggggacaanggctgctctcctgtgccgagttctcgctccggggcccgcagggttggtggctgcagtggcagagccacggggaagctggccacgtagaaaactcggnccaggcgcctggccacctgggcccggatcttgagggcgggcccagcttcagccnccatgttggtcagcaggtgctcctncngtcagcagtggcaggatctccccgaatcggagtcccctggctctcctgaagaaccccgagttgtaagtacttaaagcagccagaacaggaccacccacgaagcatgcagcacgtcatccaagggtacacttagagaacttctacggggctggggcctcctgcgc

SEQ ID NO: 487266 - DNA, 441 bp, Homo sapiens
gtgtgcctgtagtcccagctacttaggaggctgaggtgggagaattgcttgaacctgggaggcggaggttgcagtgagccaaaattacgccactgcactccagcctgggcaacagagcgagacagtctcaaaaacaacaacaacaacaaaaaccctattccttgcctttgtaggagtcaaaataaatgaacttcttttttctttttttttattattatactttaagttctggggtacacgtgcagaatgtgcaggtttgttacataggtatgcacgtgccatggtggtttgctgcacccatcaacctgtcacctacattaggtatttcccctaatgttatccctcccctagccctccatcccctgacaggccctggtgtgtgatgttcccctccctatgtccatgtgttctcattgctccaaaataaatgaatttacacaa

SEQ ID NO: 487267 - DNA, 123 bp, Homo sapiens
ctagaggatcctttcaggcagcagagcactgagaaaaaggaggttgaagtctgcataactgtcataacctctgcttctcctgctctgtaacaaaaccacaagcagtgaagagtcatggtcttg

SEQ ID NO: 487268 - DNA, 1105 bp, Homo sapiens
agcggggcagtcgctcaagcgaccgcggcggtagacacgagcggcggcggcggatcccagagggcggcgagaaatgcgggaaacgtgcgcgcgggcttgtggcctgcacgcgggtatggcgtccgagtggtgcagtgctgggcggtagggtgggcatgtgccgttggggtccttagtgcagccagtggctgtggccgtctccggacccgggcctcagtgcaatcgtgcattcgggcgaggctgcatttcggcgtgtcatggctcaataggcagctggcgtctcgtggccggttgcttgaggaagcgttggcgtgctagacgggccggagtgaaatctgccggcttgactaggagcgagaactgacgagtgactctcactgtggattccctcgactctggggaccctacgcttaggattattcttggaggcaggttacttacagttcttgtactagaaagggcttgtcgtacgagagaatgtgcccctcgcaggtaaagtaattacctcccacaatggggttcaggtcccacggggttgaatgctccggtatcaagtccttgggacgtgccatgcgcgatggtgaaggccccaaaggatggatggttctatggctcctcgcctaatcgggtgtaaacagaatgtcactgcgtaggatgcccatgaggtttctgtaggatccctcacaaggtagccccttctcttcttatataacctgtggcgccaacatcctccttgctgaattgtagtctcagcttctcgggctggaaagacgtcaaggggaaatcccgcgggatcgagaggtaatctgcatgcttgataaacggaatgtttcagttctatacacctgcgaaagaaaggcaagggaagcaccctaacttccgggcgaggaggtaagcccgatggacgtgggtgggaccttgcttggtgaaacgccagtgtggacctggcgaccaaatcgagggcgctagggttttatataggacgcccggggaaacgtttaggtgggcctgactaggatacctgaaccaaggggttgctccttagcaaatcgttatttttcgcccggagaaacaccttgagtgccctaacgggaggtcccaaagg

SEQ ID NO: 487269 - DNA, 139 bp, Homo sapiens
tgaaggcagtgagcaaaccatgttcgtttagggctcagcagccaagtacagaccaagagggtaaaaattcacacacacgcgcacacacacacacacacacacacacacatatacacatatactccttctacataaccta

SEQ ID NO: 487270 - DNA, 1506 bp, Homo sapiens
  misc_feature (23)..(23): n is a, c, g, or t
  misc_feature (346)..(346): n is a, c, g, or t
  misc_feature (433)..(433): n is a, c, g, or t
  misc_feature (1182)..(1182): n is a, c, g, or t
cccaagccctcctggtgtgggangctctcgtgggaggcggtgggtgccagacatcaccaccacctccttctattgcgggggggtccgaccctgcttcgactgtggcggggggcctcgctgcgctggaacgaacccagccgtgttatggcagcttctcgggggtgctttcgataagggagaagttgctgtctctccagagcagggtttgtacacagaccaccgccgtctttgttagaaactgtgtggtccaccaagaccgtcttttttgaggccgttgtttgttaatgtaaaaaaagtgtgtattgtaacgtcgggtgaaataatagggcagaattctgctgctgtngttgtgatggggccacgttgtagggggggtcctccgcccccccagcagaggcccgcccttgtgtgatgtagagctgcgtctgtgtcnggcgcctcattttgggggcgcttattttaaactattgggggggtttctgaacccgcaggaaatgggcccctggccctattgtgtggcccaccacccccattgtgcaaagagctgtaggggctcccccccagagttttaggggcacctcgtccttcgtggaaagagccccttgttggctctttttgaaaccacactatggtgttaaaggagcacatttgtctcccgggacaccccacataggggtccttctctctctgcggggttttccgacacataagtgtttacacacagagacatccccgccccttcggggggcccgaaagagggtctcaagaaagactttgcgcctttctttgggggggagaacactcgtggggtctcataggggaacgagagggagagagtgcgccacagcccccacagagactctctgtgccataagccgcgtgttctagacacgcccacaaagagtgttctgtgtggccacatgttcgctacacacaagcccacacgcctcttgctgggctcgggtgtattttccctacttcgcctcttggggataattgtcgcacccataatttctggggagggcacacagtgtcttccataatgtggggagagccaccttgttcttctgtgacacacaggggataaagctttgggggggtatttcacacagggagacgcctcgtataaggtgcgcgcctcccttcttttgtcttgttctctctcacaatcttatatgcaanagcgcggcgtctctgtgcccgccgagatctacatctctccctggagaatgcacacagagagggcggcgcctctcttccacagcggcgcttgggccggggagaggggaccacactccacgttcttctagcactgggcctcgagggtatatggggtaatgtgacacatcgtggagggccacgggtaaaggtgaaatggggaaggactgggagggaactggtcgttgccctttggaagcttggtgaagagagagggtgggcctagggcattggcgagtgccacatttgcgcaggtttggaaatttccccactaaatccttttgttta

SEQ ID NO: 487271 - DNA, 1247 bp, Homo sapiens
aagcatcgcctgacaacctcagctacacctgccggtccaacctgtgactgccagatcgaccagcaccacccgggaaccatgtgccagtactgcctgtctcaatgaagtgcttcctgggtgtggcatgaggaagtgaggctggtgcagctgctgtgcctgcatccctgcactcgctgccttgggtgcctgtggcctgcctcctcgggcagcccccctgtgtgctctgtgctgctggctgtgcagttggctgagctggtgtgtgagacctccttcccgtgtggcatgcctggtgtccgaacttgatctgctgcagctagcgtgcgctgctagatgccactaaccctttgctgtgctgtgcactggtgaacaggctattctgtgcgcaagtggtggttggctgtgcttgctgtgctgtgtgactgcggtgttgcttgtgtgccattctgaccaagccgtttgtgcggatgccttgggcatggggcgcgggctttgctctttacaggcacactggttggacgttggggcgcgaccacaggcggccctttctatccccgaggattgcctgggtgggcctgaaccaggtaggctgctaggtagcggcacttgagcttggaggcagagcctacttcagttgcttagaaaccggcgggtggcaccggcggggcacggcttgccacccgtgaagcaccacacgtggcgccggattacacattggcacggtcagaccggggagccgtattcacagcgtgccagatgtccactattgggcccgcctgaaggctgcaggcccctgatggggcgtgtctcaagtgcggaacaccaggtgatgccggctgacgctttacccaaggtagtcgaacttgtttgtgaccacaacgccgttgtggtcaccgcccattgcacaggggtagcgaaactccggtgcacatggacagtaagtggcgcttgagcctctagcggggccaatacgggtcgtgctcagttcaagagagccgcggaaacgggccctggctgtgtgccatcgtacaagaaagcccgggcacagaacgcggattgaagaaggccctgccaatgcgaagaaaagtgtgcgcagggctggagcacctcaacacgaaaggtaatgttttgccgagggcagtgacagacaagcccaggtcacccaatgccacagaggacaggcaaaacccggggcggagcagatgatatgtatttaggtgtcaccctagggccgcttgcggacagcaggg

SEQ ID NO: 487272 - DNA, 746 bp, Homo sapiens
  misc_feature (406)..(406): n is a, c, g, or t
agcggcttgccaaaatggcagcctccagtcgcgcacaagtgttatctcgtgtaccggggcgatgctgagagagagcaagcgttccagcgcctacgattacagaacatatgctgtcaggaggataacgagatggcttcagtagcaaaatgaaatatgtagaaggatacctgttacaaattcgaacgcctagtggataaagcgaagagagagcttggagtaattcgtcgagcaggtccacattggccaactgtattcaatctgatcaagctagatcatggcagaatcagagacgattgcctcgagcgatctaggcaaagtccgtgggaaccagcgcaccgagtggcggccaggacctacttcagcatccactctcgtgatttgagctgggggctcccaaagacgcagnctgttacaagtagacctatcttgcgctggctgatccgtggtggagagcgtgagtataaggcaaggtgcagcattgtgcatgtctgtgtgcagggcgttagtgaaagaaggaactgctgatcgtatcctagggtatcaaggtgtcagaatggagagactggagttcgtctcagaagtagtgctgtgatgttaccacggtctcccctgcaccccattcctaccttgtagctcatgaccatggtgtatagcatttctacacttcggtatcttggtccttggcaactacaaacgaatgatctccccggaccacacgagaaacacaaagcttcttccgaccgccg

SEQ ID NO: 487273 - DNA, 143 bp, Homo sapiens
ccatagaaagaaggaaaatatttattccaaaagagggcagaaagaagaaattcatcctgaaagaatagtttggtgcgattctgttaagatggctcttccctctgaacgtgctctcctactgaccacccttcggtggtcttctc

SEQ ID NO: 487274 - DNA, 205 bp, Homo sapiens
tgatagagtgaatgagccaccatatgatgatatgaggtaaaatatagtagagggagtatagggctgtgactagtatgttgagtcctgtaagtaggaaagtgatatttgatcaggagaacgtggttactagcacagagagttctcccagataggttaatagtagaggggtaaggcagacggttagacgaggcttgctacgaagtca

SEQ ID NO: 487275 - DNA, 173 bp, Homo sapiens
gcacggtaataattgtattaatagtagagacggttgtaatagcatgttcagccagcctggtctcaaactcttgacctcgtggtgatctgcccacctcggcctcccaaagtgttgggattacaggcgtgagccatcgtgcctggccagattggtagtttgcaagtattttctcc

SEQ ID NO: 487276 - DNA, 449 bp, Homo sapiens
gcaaactcttgctcttccttgaaggcttcttcctccaccacctcctccaggaagccctccctcctcagcccagctggaggagatcgctccatctttcctgccgctcccactcctagctttgggtctcaccaggggtgcctggtggtgcagccgtgagcagagctctgttcccacaagccgggccgagctcccaaggccatggctaccacagctctcttgccgctggccaagttggtcagccctagggcgagggttccagtgccttgatccaacccccagctggttcggtggcagaggaggacaagggtcacaagcacacacacaatcctgagcctgggattcctctctgaaaaagggggtggtgctgaggccacaaaagcagctgccagagcctttttgaaggggttgagctctgggcctggtctgggtcctgggtctggggaggacct

SEQ ID NO: 487277 - DNA, 229 bp, Homo sapiens
ggtcctacttttcacagggtattaagacctgaaatgcagaggttttcagatggttcttgtccaggatggaatacatggttatttcctgaaatcttcgttgcattattttccctcacactggtagataatcagaaagattaccacacctccatgcataggatgctgggttattaatctggggaagaaattttttctctcccttttatttgcttaaatccagaggtagata

SEQ ID NO: 487278 - DNA, 283 bp, Homo sapiens
  misc_feature (147)..(147): n is a, c, g, or t
agagatccccccgcggtagtagctgaaggaatttgaggggaagactttagctgtcacgtcaccaaatgaaggccgtgaaacttccagaggatgaagaagagaaaaagaagcaggagagagaaaaaaacaaagttgcgagaacctctngcaaacatcatagaaagacatacttggagaaacaaagttgaaataggtgagttgtgtcaacacctggtctggtgacgatctccattgctggtattggtcacagagcacattatggctgggacatgcaaagcatggc

SEQ ID NO: 487279 - DNA, 343 bp, Homo sapiens
cgatctaatgaccaggaggagggacacttatgaacacattccaagtaacaaggcctggagtgccattggctgtggactgttcaggcagggaagaacaagaccactcttgtattcggggcaactaaggaaagaatcactgacttgatggatgcacactgcactccagcctgggggacagagtgagacttcgtctcgaaaaaaaaaaaaaaaagttgacaggatggccagacccaagtgggcgtattgagtggtggtgctaggattggaacccaagcgtgattaaaaccctatgcaggccctttcctctatattgtactgcctccttaacaaaggaagattgatt

SEQ ID NO: 487280 - DNA, 427 bp, Homo sapiens
gctccggttcacaacaccgaggagctatcgcctccattgcatgaacaggcaggcaagctacaaagcctagaccttacatccgctgccgaaatgacctgtagaaacacccccagggacctcctgtaccgagactgaatgtggcgggacaaactgcagaactgacgaaggagagaggaagtgtggagagcctggctagtgaggactaggttactagttgcacacaacgcctggacaaaagccatggacttgagactcaacagatgtcctgagtgccctggctgaagtaggacacagatctccaagatggtctctgcagcaaaactgaggacagatgaggcaaaacaaagtgctgaagccaatcctgtagacgacaaatgctaccaaaggaaaactgggccacgagcaatgaggagctgagcaatcttat

SEQ ID NO: 487281 - DNA, 274 bp, Homo sapiens
atcgatctattgtgatatatatctctctattcaagtaacagaccgtgtaaacagtaccatggtggtttgttgcacctatcaacccatcacctagtgttaagcccacatgcattaactatttttcctaatgctctccctcccccgactccacctcccgacaggccccaatgtgtgctgttcccctccctttgtctgtgtgttctcattgttcagctcccactcataagtgagaacatgcggtgtatggttttctattcctgtgttacgtctaggt

SEQ ID NO: 487282 - DNA, 128 bp, Homo sapiens
tgctattcattacaatctatcagatttctttatataaaagacattagaacatgagaagacagataattattatgttgagggtttcgatgagggtttcgagacagggtttcgatgaagggtttcgatga

SEQ ID NO: 487283 - DNA, 347 bp, Homo sapiens
  misc_feature (71)..(71): n is a, c, g, or t
  misc_feature (85)..(85): n is a, c, g, or t
cgtctgctccttggtaggctaatcactgctctctctgagttgtatgctttccaaaaatcagttgtatttgnccgggcatgggtgntcacgcctgttgtcccagcactttgggaggctgaggtgggcagatcacttgaggacagtccaagaccagcctgccaacatgatgaaaccccatctccactaaaaatacaaaagttagctgggcatggtattgggcccctgtagtcccggctactcaggaggctgaggcgggagaattgtttgagcctaggaggcgggggctgcagtaagccaagactgtgctgctgcactcctgcctgggcaacagagcaagactccatctc

SEQ ID NO: 487284 - DNA, 119 bp, Homo sapiens
ataccaagagattgatcatatacgggtagagctgtggaaatcttgaagtttattctatttgtagtgtgtttaggttcttcttcttcttcttctttgattttgtttttttttgtattttt

SEQ ID NO: 487285 - DNA, 164 bp, Homo sapiens
ggttagtggctcactgtctagtaatcccagtttctttggtgctagctgcaggctgaatcgattgcttgagctcaggattcttgagatccagcctgggcgatacagcaagattccattgcaaaacataaacaaagacacagatttttaagttaaggatcccctag

SEQ ID NO: 487286 - DNA, 280 bp, Homo sapiens
tgatagtcttggttctgtctttgtaaacagaaccacatcgtaaggctctggctctggtgtcgataactcagatatgtgtggtgctcattggccctgaagtgtgggaagccttggttctggtgctcagaactcttgtgacttcctcttccgcttctcccaactctgaggcccagggactgggaatcagtggcctgtgttgggtttggacccggccctgccacggctggcagcctgaccttgaacacatttcctaacgtagctgagtttcggttttctcttc

SEQ ID NO: 487287 - DNA, 789 bp, Homo sapiens
gcggctgagcgcagagaagggccgcctggaccgcaccctcacgggggctgagctggagctggcagaggcgcagaggcagatccagcagctggaggtgtccacactgaagggccagctgcagcaggagcttcgaaggagctcagcacccttctccccaccctccggccccccagagaaatgagctcctgctggcatctggagaacacccctgatgcctgggacaggggaggacccttcattttggacagccccaccacccccagagacccggatcccattgggggacatcaagctggggatgggactgaggaggacgcatctgcgtggacagtgactgaggaccgggtactccagctccaggcctggcagaggcttcccagcaacaccttgacaggtccagccacccctcttcataggagtgagccacaggctaagatcatttaaagttccatcacttgagaggctgagccgtagccacggatgggggagagccctggatctcgtggtcagcccttggagcatgggatcgacgggaaacgacggagggggaacagtgcccagggcaggggtacacgaggccccaggcccatgaacttcggctacccagagaatctcatcgcgacgttagtctacagagccaatgtgatcgggaaaattcctacagcagtggctcaggagtcccaggtactatgactaccattcataacaacggtaacatggtacagaaacgtggtatatgggagatacaaaaccactgatgtacaacgacaatacagcaaaaacgagcgc

SEQ ID NO: 487288 - DNA, 235 bp, Homo sapiens
ccgccacgacacccagctaacttcttgtgtttttagtagagatgggtttcaccacgttggccaggctggtctcaaactcctgacctcagtgatccacctgcctcagcctcccagagtgctgggattacaagcatgagccaccgcacccggtctatcatatatcctaatcagcatatcaacattagtaatatgcatgatgcataccatctagatttattaatagatgatactcact

SEQ ID NO: 487289 - DNA, 312 bp, Homo sapiens
tatgcacacctagggtcagttctgcaggtggtaagccatttaccaagatagtgtaggtaaagaagggcagatttattagagaaatgtgaagatatgttgcagtgggcagctcagcagagaaggggctacctgcaaagaggcaagggctggaggaaagttttatagggtcctgctgaagggtgctacgtgtggaatgaggtcattgtgcccgcaggttgtttgtgattagctgtctctaacaattgttcatacaataattgttcattattgttctcaacttggggctctccccaacctggggacccttcctta

SEQ ID NO: 487290 - DNA, 448 bp, Homo sapiens
cgccagcagcatcagagcataagagcgtgcgtcaccgttcaatcatgccagctgacagcgacctagacatgtgagcaaagtctgtctggctgacgtgtaacctgtcgaagagatagcgcgacgcatgagtcatgtgagagtggaatgtggcgcgagctgctgagcgcgtccggtcagctgtcacagtgtcaggggatgactcgcccgagcgcagtgttccactatcatttcttgtgccgccgttggacggctccgaagggtgcaaccaggttgcccttaccggtggtcgcgctcgtcggggcccgcgccggtgtgtcgcaggctgaccaaccgctgaagtagcggcgttcagcgcatcagttcgggcgaagcgagcgttcgcttacttgttggggtgacttgtgccgcccctagggtgcgtcgccgcggttcagtcgggctgtgtctg

SEQ ID NO: 487291 - DNA, 1127 bp, Homo sapiens
actgtggcattcagccaggccccagtgttaatcgcgtgtttctcctcccccgactggccactggatgggagcaggggctgaagagtctgggcagggctgctagggtgagtagacagaacaggatgagggtcaccgctatttggtttccatcacatgccggcatggatcccatgaaggacccagtcagctgcatgatgaacgctcaggctcatggtcaatcagtcatacaagcgcgagtcgggggacggacgaacagacgcgcattaacactgatggcactgtcgaggcaggccccatgtcctcgtctgtggcgaggctctcgtgtctcgacgatgcccgcgagcaagggccctgtggagccgacgtacacctgcttcggccttctcggcagcctcgtcagcacgcttccctagaaactcggtgacgcaccggctcgaggctcgtctgcgcatctccacgatcccccggcgccgagaacgggcgcacgtacactgcccgcgctcgcattgagcacccgcaatgccaggtaccgacgtgcggcgcgccaccaagcccgccccgtcgaccatcccgtgcaccggcgtgccaccacaaggcccgcgcactccgacagcccagtaccgaccagccccgcgggaaaaccacccgccccgtggccacagcgcgcacattcgatccgcctcacgcgacgaccacagatggcacagctcgccgcaacagcgggccgacgagccaggaagcctccagcccgtcccacggcaggacgcgcagcaccctgtcacagcctcgcctgcacgcccctcacgccaaggccgctgaccggatcgtccgcagtacaccgcgaagccggacccgcacacgtgccacgcacgaccggcccgcgccccagacggaatgacgccacgagactcaagcggcgcgaggagacgatacccccgatcccgtcccccccactggcacgccccctagaggcccagcccgcacgcaccagcacaccacaacccgtgccggcactcgacgcaccgacgcgcacgcgacacagcgcgcagcgacgccgcacaagcgtccgcacgcgccacggtatcgccggacacaccacactgcgagcgccaacacgacgcacgcca

SEQ ID NO: 487292 - DNA, 715 bp, Homo sapiens
gcatatttgccggcgggcgcggtggctcacgcgtgtaatcccagcacttgggaggccgaggcgggtggatcacgaggtcaggagatcgagaccagcctggccaaaaaggtgaaaccccgtctctactaaaaatacaaaaaaaaattagccaggcatggtggcgggcgcctgaagtcccagctactccggagactgaggcaggagaatggcgtgaacccagcaggcggagtttgcagtgagccgagatcgcgtcactgcactccagcctgggtgacagagcgagactcagtctcaaaaaaaaaaaaagatgccggtttggccaaattgaagtagccttctggtcactgggggcttctggtgctgaaggcggctagggggtggggtgggagatgctgcctgagtacaaaacatgctgtaccgcgcacggtctggtgtcacttagatgaactggtgcctccgagtcttcctgtgtccagtcgttaaggtcaccgagttagtccatgtaataggcataggaaaggagctggcccacaataagcggctcatggaaggctcattatttgaggtacagaaggagattttccgaggttaaatccggttcttcctctgggtgggttttcctaccactgtgattccttcgtggtggctagataatgttctgatccaccattttccatgtctagcacgtagttgcatgaggggcagctttttgaag

SEQ ID NO: 487293 - DNA, 755 bp, Homo sapiens
  misc_feature (195)..(195): n is a, c, g, or t
  misc_feature (200)..(200): n is a, c, g, or t
gaagaagtcagaggaataattatcagataaacctctttctctctgatcaccctcctttctccttctggatagccttccacctggccaaactcagcccataacactcaaaagagcgaaggagatcgattcaagatcttctttgggcagctagagtccaacgtgattagtagaattgttggtgaactgaatcttggnatagnggctagtagcatgatgcaatcatctccatcgatgagaaacctcatgggtccatctgtcattgtctactaactagaaatagatagttgactaggcataactctttgtcaagaccaaattgtattagtagctagtggtgtggggcaacaaatattcattctgcaatgatttgaatgaggaagatggatgagcaatatatggatgaatacaacggtctagttctgactgtgaaagtgagagagtgatgggacaatagccagaagagatgtatggcgcaattatatggcgttgttcccgttatagataagatcttatgatgtctataaatatccaatctatattacagctgattgacgcaaccatgaatcgcatctctaaaagggtagacgctaggcatacaggaagtacttattctgtgttacccgctgattagcatgggttccccatgtgcgtgaagatatggtcctctgcctagcagggtttgccattacctctttatctgtgtgttggtctttcacttatcccctgtttctgtgttttgtggtgggccccgtctc

SEQ ID NO: 487294 - DNA, 2332 bp, Homo sapiens
gtagtggtagcggctgctgtggtgaaggaggaggagcagagcggacgctggtaccaaggcctgatcatggatgaggaatacgatgtgattgtgctggggacaggtcttaccgaatgcatcctgtctggcatcatgtctgtgaatggaaagaaggtgctgcacatggaccgaaacccctactatgggggtgagagctcttccatcacacccctggaggagctatataagcgctttcagatactggaagggccccctgaatcaatgggccggggccgagactggaatgttgacttgatccccaaattcctcatggccaatggtcagctggtaaagatgctactatatacagaagtgactcgatatctggacttcaaggtggtagagggcagctttgtatataaggggggcaagatctacaaagtgccatccaccgagactgaggccttggcttctaatctgatgggcatgtttgaaaaacgacgcttccgaaaatttttggtgtttgtggcaaactttgatgagaatgaccccaaaacctttgagggtgttgatccccagaacaccagcatgcgtgatgtctaccggaagtttgacctgggtcaagatgtcatagatttcactggccatgccttggcgctctaccgcactgatgactacctggatcagccctgtcttgagactattaaccgcatcaagttgtacagcgagtccctggcccggtatggcaagagcccctatttatacccactgtatggcctgggtgagctgccccagggctttgccagattgagtgccatctatgggggaacatacatgctgaacaaaccagtggatgacatcatcatggaaaatggcaaggtggtgggtgtcaaatctgagggagaggtggcccgctgcaagcagctgatctgtgatcccagttacatcccagaccgtgtgcaaaaggctggccaggttattcgcatcatctgtatcctcagccaccccatcaagaataccaatgatgccaattcctgccaaattatcatccctcagaaccaggtcaacaggaagtcagacatctatgtgtgcatgatctcctatgcgcacaacgtggccgcacagggcaaatacatcgccattgccagcaccactgtagagactgcagaaccagaaaaggaagttgagcctgcattggagctgttggaacccattgaccagaagtttgtggctatcagtgatttatatgagcccattgatgatggttcagagagtcaggtgttctgttcctgctcctatgatgctaccacacactttgagacaacctgcaatgacatcaaagatatctacaaacgcatggctggttctgcctttgattttgagaacatgaagcgcaaacagaatgatgtctttggagaagctgatcagtgattgctgactcccctcctccagcccctgttcccctctccccaacttgtatgtccttctctagggcaggggagatggtatggctaggcatccttgtttccagcatcttctgcttcccctaccacattccaaatcacccaccttattgattttattcactgaccatatccttaaccttagggatggtttgggagatgggagttggatagtatcctctttcttggtctgtccttgttctagggaaagagaactttgtgtgtgtgtgtgtgtgtgtgtgtgtgtgtgtgcgcgcgcgcgtgcgtgtgtgtacgtgtgtgtacgtacgtgtgtgtgcgtgtgtacatgtgtgtgcatgtgtgtgtgcatcgtgcacccccaattttgctgtttgggaaggagtggaggaaaagctgacccccacccccactgctcttagtcccaaatgtagtggcctttggagatacccatctcctcccccaactcttaggtgttggagagaagggaccctcccagcacaaaattgcattcctcctcctcctcctcctccttataatttattctaatttattaactttggagtaattgtctgagccctcagcctttctgtgcagcctagggctgtagagtgagctgccctggcctctcccagtgctggcaaagcctgggatgggagaagatttaggtgtgaccccctctggaggttgatctgttttgaatttcttttgtgttgtgttcactgagaaaaagtaatgtgagcaaagcagaaggaggtaggaaagtggatccaaaccccagtgtaccctgccccatgccttttcctttagtggtgggaaacccttaccttgcaaagtgaatgtgtccccttccccaagctctagtatatttcacagaaaacaaaaacctcccaataaaactattgaaactt

SEQ ID NO: 487295 - DNA, 293 bp, Homo sapiens
ccggtcaggcccagctcgtacaccgcgcgctggccgcaggagctgtcgccgtagacgtagccgacgtaggcttgctccacctggtcgtaggggatgccggcgtcggccagggccttctgcccggcttcgcgcgccatctcgtaatactcggcgctggcgccgggcttggcgaacttggtcatgcccacgccgatcacattcactcggttcttcatctcgcgctcctcgtcatttcgattcggtcagatcagcttgctgaacacggacagcccgtgcgccaggcgcacatcgcc

SEQ ID NO: 487296 - DNA, 98 bp, Homo sapiens
tggttcttagaaaatctgagacacgtgaggccagacaagcaggccggggctggtgggatggggtgcgtcagggggccggtctgcacgcagctcttgcg

SEQ ID NO: 487297 - DNA, 400 bp, Homo sapiens
tatccatatcacccgtgttatggtcttctcaaagtaaggctgtcttttattcctggttacgcaatgagaaaagcccctaatcctaacaaagccccttagcagcttctgaaattttagcttctctcagaagtgaagatattttagttttaacttgaattacctataaattcatttccataatgtataacaaatctccttgagagcacagatctgtcttatgcagccttctacttactaccagtagtatccagtacagtgtcttctacacaccagacgatcacgactgatggttcaagtgtataacaagaaaaccattttaccaaattatgttgctagaccaaccaagaactcaaacaaaagcagaaatgaaaaaggcgaatttacaactgacactaacaga

SEQ ID NO: 487298 - DNA, 475 bp, Homo sapiens
gatacaattcactcgtacccacaccactgagtcaaagcaggaatcaaaagagaaattagaaaatgttttgaactgaataacaaaaatactacataatttgtgagatgcagctaatataatgcctacacaaaaatttaaaactataaatgtatatattaaaaaaggtccaaaaatcaatgacataaagatctaacctaagacgctagaaaaatttagtcactgccgtgtattacagctaaaaaagggaagctagaaaaagatgactaagttaaaacgaagtgaaaagaagaaaatagtaacaattaaaaagagaaagaaataaaatccaagtaacagcaaaaattaacgaagtctaaaaatggattctttaaaaatatcaacaaagttgataaaacagaacaattaggaaaaaagagaaaacaaattatccataacagaggtagaagatggaccaccccctacaattcttatagac

SEQ ID NO: 487299 - DNA, 494 bp, Homo sapiens
  misc_feature (11)..(11): n is a, c, g, or t
  misc_feature (80)..(81): n is a, c, g, or t
  misc_feature (369)..(369): n is a, c, g, or t
  misc_feature (374)..(374): n is a, c, g, or t
  misc_feature (383)..(384): n is a, c, g, or t
  misc_feature (481)..(481): n is a, c, g, or t
tggtaacaganactcttgacttgttcatcatgactatgtatcctagaatagactcaacactcaagaaactatcacccatnnagaacattttccaactgtggctcaaaacagagactgagatttgacaacaaaagaaggatcagacagatgtgatgttgctggttttgaagactcaagaagagccatgagccaaggaatgagtgcaacacctaaaagctgaaaacggcaaggagccggattctccccggagcctccagaaatgatcacagccctactgactcctaaatttagctcacgaagacctttgttagatgtctgatgttcacaattacatgaaaacaaatttgtgtttgctaagccaccaagagnacagnaatttgttnnatcagcagtgaaaaccaatagatttatcttactttatttttacagcttgtgatataatttaccatttctttcttgaattgatctcccatatttattntatatttccatag

SEQ ID NO: 487300 - DNA, 961 bp, Homo sapiens
cccagctcatgggggacaccgttgatccgtcacatcgccctggctgggcgtttgaatgaaagcgcttcgtacccaggcagcactatgtgtacatgttcctggtgaaatggtaggacctgtcgagagaaggtggatcataccggagctgtcagcgagatctacgagttccactagatagccttaagacagatgatgttcccctattgagagcgacgggggcgtatcaagtccaggagaacaggatcatcccaccattctcctgagtttccctaagtggatttgacgaggcatgtcgggccaagtgcgagtaaccgtgcagggctaccacgttaacgcgagtgtactgcagggacgcgtcattgatgctcgtgtgcctacccaaggaatctcgccctgtgtgatctccacactcgtctcctacgatcgtgtcttgcagaggatgacgcctcgtgatgaaccatccaagtttgcacccacggagcaaaccaggaccaagaacagccagtacgacatagcttgatgctccacagatggcgaagagtacgcgctgaccagagcatcaaccgagccccgagtcatctctgcagaacggtaccagcgccaattcgccaacgtacgcatgaaggacctcgaggctccggacatggctctggtccacgggggcgacgtggaaggcaggatcgtaaggacgatacgaggcgaggaggcgggtcaaggaaccttccacaaacgtgtacggggggctacccatgtgcccgctgtggtggcctcagcggaattcccagcgaggcctacaaagccccgcctggtccaaaggacttcgagggacaaggctatggcccccttggggaaggaggaacttcccggggatactggatagagggggggccttacagtgtgccttcgcgctagactggtggggtacagccctttcatgtcgttaaggtggtaggacacactg

SEQ ID NO: 487301 - DNA, 482 bp, Homo sapiens
  misc_feature (357)..(357): n is a, c, g, or t
  misc_feature (362)..(362): n is a, c, g, or t
  misc_feature (371)..(372): n is a, c, g, or t
  misc_feature (469)..(469): n is a, c, g, or t
tttttttttaggagatgatctggtttattcaagtaagttctatctaattacatgaaaccttcaaattgcagaacattttccaactgtggctcaaaacagagactgagatttgacaacaaaagaaggatcagacagatgtgatgttgctggttttgaagactcaagaagagccatgagccaaggaatgagtgcaacacctaaaagctgaaaacggcaaggagccggattctccccggagcctccagaaatgatcacagccctactgactcctaaatttagctcacgaagacctttgttagatgtctgatgttcacaattacatgaaaacaaatttgtgtttgctaagccaccaagagnacagnaatttgttnnatcagcagtgaaaaccaatagatttatcttactttatttttacagcttgtgatataatttaccatttctttcttgaattgatctcccatatttattntatatttccatag

SEQ ID NO: 487302 - DNA, 405 bp, Homo sapiens
atatattaggtacataaaatatgaaagtacatcaaatatagattatatactgtacatataatatcaatgtacccgaaatatatattttatactctacatgaaatatcaaagttcaaaaccatatattatatactgtgcataaaatatcaaagtacccaaggtatatattctatactgtacaaaaaatatcaaagtacccaaagcatgtattatatactgtacataaaatatgaaattacatcaaatatatattttattctgtacataaaatatcaaagtacaccagatatatattctatagtgtacataaaatatcaaagtacccaaactatacattatatactgtacataaaatgtgaaattacatcaaatatatattatattaggtacataaaatatgaaaag

SEQ ID NO: 487303 - DNA, 190 bp, Homo sapiens
acatatgtgtgtacgcgtaacgcctgtatgtgcgactgcctcagacatgcacgtgaaaggaggaggcttctgtgtaaatgcactttcttcctcccctctttctccataagaccccaggcagaggtgggtgcctccccatcccctactttgtcactattggtttcactataaaatcatgtcatgtatctgt

SEQ ID NO: 487304 - DNA, 869 bp, Homo sapiens
  misc_feature (30)..(30): n is a, c, g, or t
  misc_feature (123)..(123): n is a, c, g, or t
  misc_feature (125)..(125): n is a, c, g, or t
  misc_feature (127)..(127): n is a, c, g, or t
  misc_feature (129)..(129): n is a, c, g, or t
  misc_feature (131)..(131): n is a, c, g, or t
  misc_feature (134)..(134): n is a, c, g, or t
  misc_feature (139)..(140): n is a, c, g, or t
  misc_feature (174)..(174): n is a, c, g, or t
  misc_feature (177)..(177): n is a, c, g, or t
  misc_feature (200)..(200): n is a, c, g, or t
  misc_feature (207)..(207): n is a, c, g, or t
  misc_feature (209)..(209): n is a, c, g, or t
  misc_feature (212)..(212): n is a, c, g, or t
  misc_feature (233)..(233): n is a, c, g, or t
  misc_feature (236)..(236): n is a, c, g, or t
  misc_feature (239)..(239): n is a, c, g, or t
  misc_feature (307)..(307): n is a, c, g, or t
  misc_feature (375)..(375): n is a, c, g, or t
  misc_feature (558)..(558): n is a, c, g, or t
  misc_feature (567)..(567): n is a, c, g, or t
  misc_feature (569)..(569): n is a, c, g, or t
  misc_feature (638)..(638): n is a, c, g, or t
  misc_feature (656)..(656): n is a, c, g, or t
  misc_feature (701)..(701): n is a, c, g, or t
  misc_feature (713)..(713): n is a, c, g, or t
  misc_feature (785)..(785): n is a, c, g, or t
  misc_feature (845)..(845): n is a, c, g, or t
aaatgtataagaatgtaaatatgaattttntatgataaaatgtttcattcattataacaaatttccaataatcctgttaattatatttctaaattttcccgcgcggagagtgtgcgtgaagcngngnangngantgggnngtgagagcgtgtgagtgcgacgcttaagtatgtnaanaagcgtgtgtggaggtggcaagngattgangngtncgagaagtctggagccaagangtngangtgggataagagaattctctgctccccacctctaagttgccagcgctccgtagagcggagcctgtggngcaacctgctcagatacatcaaacatggagagagcacgtgaaagtagaattataaagaagatcatgtncatgttaacattattataaccctacattttgtgcataaagtgtaagtgtataagcatatcaatattaaaaagcaagcaagcagaatttggaattcatccaatccaaatgcggcatcttcaaacctccatgatgctgcttacatgtttcgatcccacttaactatcttgggctgtgacaaagtnacatggttnanacggcagggatactcatctttttcagtgggggtgaattcagtgtagtacaagagatagaaagaccagtncttgctgaaagacaagtntgaatgctccactttttcaattctctctccattcttcagtaagtnaacttcaatgtnggatggatgaaacccagacacatagcaattcaggaaatttgactttccattctctgctggatgacgtgagtnaacctgaatctttggagtacgctggatagcctccaggccagaaagagagagtagcgcgancacagctaaggccacggagcgaga

SEQ ID NO: 487305 - DNA, 112 bp, Homo sapiens
gtcggaccacatgattgtccacgctccttttcttctccccttaggagcggcaccgctcacatcatgtgctgtctgctctgatcagattttaaactattccaataaagctgga

SEQ ID NO: 487306 - DNA, 322 bp, Homo sapiens
  misc_feature (5)..(5): n is a, c, g, or t
gcggnaccctggagtctatcggcgtcgcaccggggagaagcgcggagtagcccgaagtctggtgaacaaaaatcccaagcgaagggtggtcggggcaccctgatggcctgatgcgcccggaaccgacaaaaatggttaggggaatcggatataggcacggggcgtatgcgagggccagagacacgtacgagtccccagacacacgccggcctgggaggtcgagtttcctcccaggccggtttacgtcaggcacgcttgtcgagtggtacgtaatctcgcttgtcagacccggtgaagatctgacgcggacgccaaatcttgt

SEQ ID NO: 487307 - DNA, 278 bp, Homo sapiens
ttgattagataatagttactggattgaacattgtttgtaggtgtatatattgtacattgaaattgctcgagggcaataggttatgtgattaggagtagggttcaggatgagtgggaagcagaaagagaggaagtaaagtttaattatgcctttttgggttgaggtgcatgcatggcaggtggcagcatttggtgctgtgcaaattgtttcaggtcaatcagcttttctcagtcaggttcaggtctcaggataccagtagggcagagggtcaccgagct

SEQ ID NO: 487308 - DNA, 705 bp, Homo sapiens
  misc_feature (27)..(28): n is a, c, g, or t
  misc_feature (68)..(68): n is a, c, g, or t
  misc_feature (241)..(241): n is a, c, g, or t
  misc_feature (258)..(259): n is a, c, g, or t
  misc_feature (267)..(267): n is a, c, g, or t
  misc_feature (464)..(464): n is a, c, g, or t
  misc_feature (690)..(690): n is a, c, g, or t
tttttttttcttttatttaaaaaaatnncccccctcttcgggcgggggagggagaaaaaaaaataaanttttttttttttttaaggggggggggggggggggggcgccccctctctttcttttttttgtgggggcgccccccccccccgcgcgcgatttattttctcttcttttccccccccccccctttattttttttttaaaaaaaaaaaaaaaaaaattctttcctttttataatatnaaatatataaaaaaaannaggggggngtttggggggcctcgcccaacaaaaaaaaaaaaaaataataatttttttttgttgttgtagaccaacacccccacccaccgggggcgggggggtgggtttttcccccccccccaaaaaaatatttccccccctcttttttttaaaaaaaaaagggggggggggcctttttaaattttttttataaaaaaccctcttntttttgtgggggggaataaaaaatgcccccccccccccaaaagattttttccccgggttccccccaacaaaaaaagagaaaagggggggacaccccccccaaataaaaagggcggggaaaaaaatttttcttttccccccccgggggggaataattttttttgggcccggggttccaattttctttgcccataacctttatttggggaaaaggttttggttaaggnttttctgtactaaag

SEQ ID NO: 487309 - DNA, 276 bp, Homo sapiens
  misc_feature (86)..(86): n is a, c, g, or t
  misc_feature (133)..(133): n is a, c, g, or t
ctttcatctaagtgagtcagactctttcatttcaaatagaggctgaactggtttggaagcccaattcttaataaataatgtatatnctgtaaaatacagacttagtagtcccagatggagctgtagaattttntagctcagagcctatagacatttttaatctctgcattcctttgggaaattccctaggtggctaaaagttccctcttctgaatgttggtacatttgtttacagttttgtctaggtgaacaaaatcttttatttcccaatagagg

SEQ ID NO: 487310 - DNA, 252 bp, Homo sapiens
cagatcagatgtcatgcccaggcattaggagattggttttctgtctgtggtgaatagcttggctacagagaaggtagacaatatttaattaggttgttttacccaaatattgtcattttgtgtttgtgattgaagagttactttttggggtccatgtatgttttttctttcattgtttaaaaaatttattgaagtagagttgatgcacaacgtgaccatcttaatcctggggcccacgcctgctgggccgga

SEQ ID NO: 487311 - DNA, 355 bp, Homo sapiens
  misc_feature (140)..(140): n is a, c, g, or t
cgctatgtggggcccacggtccgagacaccaacactgcaaccatgcgcagtgtggagcagtccacccaccaacagccagaagaggtagaaagagggcgtggagagtggatattatagagagatgaacgaggacaatgcanatgcccacacgaggccatatgcccagtcagtagccaacatactgcaagcatggtagaatctgggcgtatgcacagtgtaggcaagcgaagtaagataaaggatgagactccccagccagtagctcgaagcaggtgccaaatggcttgtgccccattcaggggtggccctccccggaataataagttgtcaagacggtctatcatacccaatggga

SEQ ID NO: 487312 - DNA, 185 bp, Homo sapiens
ggcatgcaatccttttcaaaacaagctatgacctttatgacacgcaggcaagatgaattaaacatgaatcaacgtatttacaacagttatcacggcaagatgagacatccacaagtaggaacttctcagtaggatgacaatacttagttggatttaggagaggaatgagatctctgaaggacaaa

SEQ ID NO: 487313 - DNA, 466 bp, Homo sapiens
cagtggttgatctaggtagtctacataacttattatagtctattggtattgtcattttatcagttcaaaagatgtatgggaatatctcctttccatgcttcttccttctctgtttgtaattgtcttaaatgtctcttctatatatgcttagagccgtatcagtattataatttttgcttaaaatgtaaaatgtgatttaaagaactcaagaggagaaggaagggcttttgtatttaccattatttttgcttatcttgttctttcttcttttctgatgctccaaggtttcctttttttatagttttttttttttttttttgggtttggaacacttcctttaaccacctttctttcagaataggcctgcgggtgacaattccctttggtctttctccatccaagattgtctggatttcctttccattttggagggatactttggcgggatatgggatcccattggggg

SEQ ID NO: 487314 - DNA, 769 bp, Homo sapiens
ggggcatccgggtgctacagaccggacccccaggagcaagagaatgtgcagtatgctgggcttgactttgacgcaatcctgctgcagactggcagccctccaagtataagacccaagtgcccatggtggtcatgccccacggggggccccattcatcctttagtcacatgcctggatgctgttcccaggccatgcgttcgcgaagatggtgctttgcaggtacgtacgtagtgaagctatcgtggcgtccacgggctttggcctaggacagcatcctctccctcccaggcaatgtgggccatcaggatgtgacggatgtccagtctcgcagtgggaacaggctgctccaggaggaacactgttgatgcaagccatgtggcccttatggcgtggttcccatggtggctatcatttccgtgccacttgatgggtcaggacccagagacctacagggcctgcgtggcccggaagcccgtgatcaaagatcggctccatgttgggctccactgacatccctgactggtgcgtggtggaggctggcgttgccttgtcagcagtgacgtgcctgccatgaccgtcagcgtgtgggctgagatgctggacaagatcgcccatcagatacatccctcaggtgaagacgaccacgtgttactgatgtagggccaggaggaccggcgtgtgcccttcaaggcaggggcatggagtattaccgtgccctcaagacccggaatgtgcctgtacggctgctgctctattccaaaagcaccag

SEQ ID NO: 487315 - DNA, 244 bp, Homo sapiens
catagtgaaactccgtctctactataaatacaaaaattagccaggcatggtggtgtgtgcctgtagtcccagctactcgagaggctgaggcaagagaatcactcgaatccaggaggcggaggttgcagtgagccaagatcacactgctgcactccaggctggtgacagagcaagactccttctcagataaaaaaaaaagaaacacaattaaaaatacccacagaatttccaacaatttagaaga

SEQ ID NO: 487316 - DNA, 406 bp, Homo sapiens
cctttagagtttaagaacatggattttaaatgtgagacataccccgaattcaaattgccaaattcactgtagaatatcactgtaactttgggcaagttatccaacattctctgcaccttagtttcctcacgctgtaaactatggaatacttaccataccattacattggattactagtacacatatgattataacgttaccttgtataagacgcttaacaacatggttatacttgctcttattattaaacatatatcaactatttctgaaatggtctgtatcttatacgtgttacgtagttgggttatttattccttttagtgacacatagacataacggtgcatttaaaattcgatggagtacgattcactgatatagtgatactatgttaaaagtgcatggtca

SEQ ID NO: 487317 - DNA, 273 bp, Homo sapiens
atagtttcgtgtttatatagttggttttcttttttgtttgtttggttatttttgacggcaggttctcactttgtcacccaggctggagggcagtggtgcaaaaaccacccactgaggcctcgacctctcgggctcaggtgttcctgtcactttagcctcccaagcagctgggactacaggccatgccatcacacacagctaattttttgtattttttactagagacagagttttgccatgttgcccaggctggtcttgaactcctggacacaa

SEQ ID NO: 487318 - DNA, 133 bp, Homo sapiens
agatagaggaagcgaatcacttgaggtgaggagttcaagaccagcctgggcaacacagaaagaccccacatccactaaaacaaacaaacaaataaaagttttcagaaccactgaagctcctaaaagaaggcca

SEQ ID NO: 487319 - DNA, 776 bp, Homo sapiens
tgcagaaatgaggctgaggcacgctgactagagaagctggcccgcgtcaacgagaaccgtgtgcacggcaagattgcctctcgcaacggagttcgaccggactcatctgcggtagatcggtagggccgcctacctcaacgagtcctggagagctcgccatggacgttggctcatgcgttctcgaagtagggaaagctgtggaaccctgatccaagggctacaagccccctagtagccaggaacacagtaggcggcgtgcatgggtacagctgagcctagaccgaggggcagtggcctgcctactcggggtgcccctcagcttcgagccccagacaagtgtgtgctacggagcatctttgttgcttcacggacagcagctactcttcccttcacgtgtctcaggtgccgatgagggcgcgagcgtgccgagccttccactgagcatcagatgacaagcccgagggcaatgagccaaccggggggtcctcgcgttcatgctcacacagtgctatggggatggtgggctccaggttcagctctggtagggggcttgtctctgtgggtccacatcctgtcctgcaggcaggtcttggttgtctgagcccatgggggcccctcacttgtcctcctcagacagcaaaggccagggcagggacggaggacagggttcccttaaccacgaaccaactcgggttaccctgtgcgtgattgactagatatttgtcaacaaaaaaaacccgggcaatgcgggcggaacgctaaggagctcgccctca

SEQ ID NO: 487320 - DNA, 288 bp, Homo sapiens
gggagacgaccttgaagaaataactaaatactactagattgccaatctatgggtgttctcttttattggtaatggggaccattttagaattagctagagagatgaggtggacaagcatggatgaagtgcatcaccacataatagatggtttcttgggcatttccttttctatctgaccggtatgaactatcttttcgatgtacagcctagtgttggttgccagtgagtagtataataccgtaagtgacggcccttcctaagtacgggcctgactataacttcgccttt

SEQ ID NO: 487321 - DNA, 677 bp, Homo sapiens
ggtggggtctccagagaaactcaaaccagtgggatagaaagtccaacggatgaccatgtacagatggaccaagctggaaacaggtgtccataaatgcatcagtctgagcagctatagacacctgtttccagtcaggtggggtctccagagaaactcaaaccagtgggatagaaagtccaacggatgaccatgtacagatggaccaagctggaatgtgcggagacatttttgagagtgttcattcatcatataatgttgctacaggtaacattataagcaacagtttagtagcagagacagtaactcatagtttgttacctcagaatgagcctaagactttaaatcaagatattgagaaatctgcaccaattataaatttcagtgcacagaatagtatgcttccttcacagaacatgacagataatcagacccaaaccatagatttattaagtgatttggaaaacatcttgtcaagtaatctgcctgcccagacattggatcatcgtagtcttttgtctgacacaaatcctggacctgacacccagctcccatctggcccagcccagaaccccggaatcgattttgatatcgaagagttcttttcggcctcaaatatccagactcaaactgaagagagtgaacttagcaccatgaccaccgagccagtcttggagtca

SEQ ID NO: 487322 - DNA, 112 bp, Homo sapiens
tatatgagttggagggtggtgattagtcggttgttgatgagatatttggaggtggggatcaatagagggggaaatagaatgatcagtactgcccaactcatatcaatacatt

SEQ ID NO: 487323 - DNA, 682 bp, Homo sapiens
gcccgcagttcctcccagccacaagctgtagcactgcgccatcccctccaacgggtcagcttatgcccacccccgagttctaccggcgccgcctgggttcccattcccagcaacagctcctgcagccagttccgagtgccccggggaagcccattcccccacccccccaggtcctcccccaggctgacccgggtcattggtgggcccgcttctttttcgggaagtcccaccctcccgttcatggcaccacggtgttggagtccccagagcactcgggacctcccccggcctccagcagcatgaccgcctgtggcctggctcgggacgccccgagggagcagcccggcggtcagtccagcacaccagccctgggcccccgtcctgacctgagcggttaccaccagccccaggccttcggaggcgctagtccaccagagcccctcctccgcccctcctcccccctcgcgcatccctctgcccccctccccacctcccaccccccccccctgttaactgaggcggctgccagcaaacagacacttctgcatcaaccacagcaggacaacccaaaacccgtgagagccccgctttttaccgcccggccccagcactcgtagctttcctgacacctggaactgtgcacctggcaccaagcgggaaattaactcccagcagcccagta

SEQ ID NO: 487324 - DNA, 1823 bp, Homo sapiens
  misc_feature (1)..(1): n is a, c, g, or t
  misc_feature (233)..(233): n is a, c, g, or t
  misc_feature (1395)..(1395): n is a, c, g, or t
ntttttgttgttgtgtttcgctgtctctggtggttggctgtggcgtctgactttgtgatgtctattgtgtttggtttgttgttcgttatgtgatgtgtgtcgtagtctggctggcttgctttctgtcgtgttgtcttctgtctctgttttgttgttttcggttcgttcgttcgggtctagtgttgttgcatataatagccgtgggtgtttgtactacagacacgtggtttggngcagccatcgtatgattgttgcaggaggtctcagcatggttgttggctccatactagccgtcggctgtttgttttattctggcgcgccgcccatgatctcatttgtcctcgtgttcttatagggttgtcaggtgtcgtctggtgtgcgtcgcaattttccggcactcaggtgagacacccagtacacggggccacaccattggttgttgggggggtggacctcacggggagcccattgtggccgagaccagagtgcgtggtgtgttccgccagacgttgtatgtccgtgcgtgagtcgggcgcctcctatggtggtggtgtttcctccgcgttgggtgacgttgtcgctgtcgatagtcccgccggggtgtcccataggtgccgtcagttggctgaacccccgcctgatttgctggggagaagggggtttttcgcggagttccatccgcaacgagggtgtctcccttctctggtgggtcgccgacagcagtcgttcgtgtgggccggacgcagaagctactgagggtcctcccttggattttgtatgggggggttaatatgttctcgtccgtgtgtatgtgatgggctcctctccgtagaagtggtagcggcgtttcctcacagggcgcttctctgggcggtcatcaatgagatgtccccaatcgagtgggcagcccctcttgtgaagtggagggccggtggcgtcggcaccgagcaaattgattaggggttctttcttggtgaagaggggataagttcctcgcctcctccgagcccgcaagcttgtgtaagtttgtggtgtgtgcacgacccgcagggcggtcacgcgccccacatttgcacgtgttcttggggaagacgcactttgggttggtcccccacctgtgtagttgtaggcgcaccccaggagtgtctgttgccgctgttccacgggggaccacttacaactattctggggggaacaacttgcatcacacacgacgcgttttggacccccaagtgtggagaaattgtgaagctttgtggtaatacacgcacacgttgtgcgctataagaaatatttatgagcgcctcttgaggcgctgtgtattggcgccatagtgtgcgctctcaaaggtgacactctctgtctcgcagaacacgcgttctgtacacacaagtnggggcgtctatcacagaactgttcacttcacagtcacgtcacgtcgtcccgaaggtcacacgaggttcgcacactaagagtcttcgtggcttcacttctggcacggcctctccttctgtgagactccccctctttcttctttctcgtgccctcccttgccccggaggccggcacactgcactgttctctggacacccctcccctgagcaccccttctggttgtgggcgttggaccaccgagcgccttatgcccgggaaaggctggttctcccccacgcctataacccccacgcccctccactgtctattgctccctctgtgttatgaattggctgaaggatgtttttgtgccagctgacattttttgacccctgttcaccttgttcaccatcccctgtagaaaaattaagatgccccggaggaggttg

SEQ ID NO: 487325 - DNA, 930 bp, Homo sapiens
tttttgtcttctgtttctcttttcgtgtgtgtatttttcgtgttgtgatgtttggtgttttcattgcattcatctggttgtatttgttttttgctttagttgctaagttgggttgttgcgtgatgatattttcatgtattgcggtttttcgcctcgagttgtgctgcgggcgctcgatgtgtgtctttttttgtttttttgtgggttgggtgtgtggcctgtctctgcttcggtcttctctgcgtggttgtgtttgtgcgctggtgggttggtttgcgtctcgatgggggtgccgtcgtttgtggacgtcgtcttccatgcttttgtggtgtcgccgtgcgttgtggtaatcagttggtttcctgctcgtatcacgcccgtgtttgtgggggggtaaagcggcttgttcgcccgcctatacgggcgcgggttaacggccgtgccccccctgattcctcggttatcggctcccctatattgggcgcgcttattcttctcgcacatccgggataagcgtcctggggtggccgccgcaatgctcactggtggccgcgcggggaaccgccgcgcgccaataatattcttcggtgttggcactaccctctattatcgcagtgtattccacttgccgcggtctcgcggatacaatatttctcgcgggatttctcgccccctttccgcccccgcggggtataaaatcttgctgacaagcacctgtctctaatagtaaattgctaactgcgttttcccccttatgggaccacaccctcgttctccgataaatatgtcccacctttttctttgttgtggaaaaagaggaattctcccgttgagatttttaaccacactttctgtaagggccctgtggtgaaataaacccttttttgttaaattaaacccgaaataaaaaaaaattaaaccccaatttga

SEQ ID NO: 487326 - DNA, 473 bp, Homo sapiens
  misc_feature (170)..(170): n is a, c, g, or t
  misc_feature (196)..(196): n is a, c, g, or t
  misc_feature (285)..(285): n is a, c, g, or t
  misc_feature (337)..(337): n is a, c, g, or t
  misc_feature (378)..(380): n is a, c, g, or t
  misc_feature (399)..(399): n is a, c, g, or t
  misc_feature (420)..(420): n is a, c, g, or t
  misc_feature (429)..(429): n is a, c, g, or t
  misc_feature (444)..(444): n is a, c, g, or t
gaattcggcacgaggggacatttagaatatatttgtgtacatattatatgtatgtatatttcaaagtaccacactgaaaattagacatttattaaccaaatttaacgtggtatttaaaggtaatatttttaatatgatacattacatattgtgaatgtatactaaaaaancattttaaatgttaaaattataattncagattcatataaccacaactgtgatatatcctaactataaccagttgttgaggggtatactaggaagcagaatgaaaccacatttttnggtttgattaatatgcacttattgactccccactcattgttatggttaattnaaggttattattctggtctccttgttaattttggtttacannnatttttgattatccctggngttaggccggtttactttttnccagtaccnggttaactccctaanagctttttaaaccttattaccaaattggg

SEQ ID NO: 487327 - DNA, 264 bp, Homo sapiens
tgagatgtttgatataatgataaggcaattacgaagtttgaagagaatgcaggatgaggcgtggagatgtctgaatgtcaaagtcagtccagaaaagggaacacgtggtggaaagcaagacaagagaacagtacgacttaatataagtggaggagtggttgatggggctcgggaaacagaaattgtgggtgactctagtagtgaggaggaaagggacacacatccacaggccgatccacaggcaccattgcttcccttgtcgac

SEQ ID NO: 487328 - DNA, 650 bp, Homo sapiens
  misc_feature (48)..(48): n is a, c, g, or t
  misc_feature (61)..(61): n is a, c, g, or t
  misc_feature (66)..(66): n is a, c, g, or t
  misc_feature (68)..(68): n is a, c, g, or t
  misc_feature (79)..(79): n is a, c, g, or t
  misc_feature (84)..(84): n is a, c, g, or t
  misc_feature (93)..(94): n is a, c, g, or t
  misc_feature (98)..(99): n is a, c, g, or t
  misc_feature (107)..(107): n is a, c, g, or t
  misc_feature (122)..(122): n is a, c, g, or t
  misc_feature (125)..(125): n is a, c, g, or t
  misc_feature (153)..(153): n is a, c, g, or t
  misc_feature (156)..(156): n is a, c, g, or t
  misc_feature (203)..(203): n is a, c, g, or t
  misc_feature (207)..(207): n is a, c, g, or t
  misc_feature (251)..(251): n is a, c, g, or t
  misc_feature (255)..(255): n is a, c, g, or t
  misc_feature (263)..(263): n is a, c, g, or t
  misc_feature (300)..(300): n is a, c, g, or t
  misc_feature (317)..(317): n is a, c, g, or t
  misc_feature (401)..(401): n is a, c, g, or t
  misc_feature (413)..(413): n is a, c, g, or t
  misc_feature (416)..(416): n is a, c, g, or t
  misc_feature (421)..(422): n is a, c, g, or t
  misc_feature (441)..(441): n is a, c, g, or t
  misc_feature (457)..(457): n is a, c, g, or t
  misc_feature (503)..(504): n is a, c, g, or t
  misc_feature (506)..(506): n is a, c, g, or t
  misc_feature (508)..(508): n is a, c, g, or t
  misc_feature (512)..(512): n is a, c, g, or t
  misc_feature (643)..(643): n is a, c, g, or t
tggggagatcttgggggacaaggtgtggcaaaagctcccaggtaaccnctgttcttcaganttgantnttttgtttttnagttnttgagggtnngatnncctccgcncgctgctggctttcncancagccaggccgtggtggccccagcaggntcngcatccctacttttggacaggagctccgaaagcaagggctgcttgantgtncagagcctgaggcccaagaacaggtagcagggctcccttctttncttntgcaggcncctggagacctccagggcttctggggcctagcttgcncctcacgaggccacgtnttttgctttttttaaagcggaactcccaggggtctgtggctggcttctctctttctctcacgttgttgaaggcctgaattcctnagggtcctgtcnttncctgnncctcgtcttgaagggagcnaggcattcagcagggnaacagttggctaataaatagagggcaggtaccagcaggagtcactnnanantgtnacggtaataaatacacgagccgggtgcggggtctctctcctccaaggggtgggttacctccgggggaaagcatcgccgcacaggtggcagtctgtgggtctctgcttctctctcctcctcttccccctgcncttgggt

SEQ ID NO: 487329 - DNA, 330 bp, Homo sapiens
caggtcaacatgctatacttgggtatgatgtacatgtggcgaatgtaagacggacatgtagatattgcatacatctttggcaaaagtgtgttgagctgtgaaggctatgactactctgaagaccagtatgctactaagaggttcttgtggcttggagtataattgagattatacagaagctatggcctgcagaaactgaacgagtctggatagctaggacgcgctttgcctctttctctgatttcttattactacagtggtcctcggcggattccgtttaacatgagtggattgattaccatcgtggtactccttgggatcgcctttgta

SEQ ID NO: 487330 - DNA, 272 bp, Homo sapiens
ctcagttttataattaatcgcactgctcagcccccagtttatcagctggcacggatagttcatcatttcctgcagtcacaaatacccggtgccccatgtgcttttgcaatctgaattgcagcaacaccgatgccggaagtcccgccctgaaccagcaaagtttgtcccggtgcaagtcctgcacgatcaaacacattactccagacagtgaaataagtttccggcagcgatgccgcctcaagcaaactcaaaccatcaggtatccgcagaca

SEQ ID NO: 487331 - DNA, 201 bp, Homo sapiens
  misc_feature (8)..(8): n is a, c, g, or t
acggttantaacagcctggaatatgatggcctaaatgcagagaaaaccgctccttggctgaatagataagtaaaggcagaaaagattatatcgtcatacctaccattggggaataagcataaccctgagattctatactactagatgagaacattcatctgcatatagccacaaaaattttaatgcaaattgcaagctacc

SEQ ID NO: 487332 - DNA, 104 bp, Homo sapiens
  misc_feature (7)..(7): n is a, c, g, or t
aacaggnccaaaatcctcaaacctttgacattgattaacgggagggaaggtgtttcattttacttggcaattgggaaatgggaatttagaccattatgaggggg

SEQ ID NO: 487333 - DNA, 160 bp, Homo sapiens
cctacgactatcggcatggggctgtagcagccagagatatgggcagaggttgttagatagggatagacagaaaaaggcaatttaaatatcttgtcccatatctgttttagcccatttcctagttctgaggctaaactctttttaaaaaattggctttgct

SEQ ID NO: 487334 - DNA, 428 bp, Homo sapiens
  misc_feature (416)..(416): n is a, c, g, or t
  misc_feature (422)..(422): n is a, c, g, or t
taagtcatttggtgccatttttccaacaggacagtgtctctgtgtcaaattttggtaattcttgaaacatttcaaaccttttcattattataatatctgttatagtgatctgtgatcagtgatcttagaggtaactattgtaattgtttttggggccacgaaccgtacccatatgaaaggataaactgaattgataaatgctgtgtgttctgagtgctccactgactgtcccttccctgcctctttctctctcctgggggtctccctattttatgagacacaacaatattggaacttaagccagttaataaccctgcagtgggccggtaagtgttcaagtggaaagggaaaagtaggcatgtcttctcactttaaaatcataaggcaaggaatggaggctagtgagggaaggcgtnttcagnaggcca

SEQ ID NO: 487335 - DNA, 749 bp, Homo sapiens
ggcgggcgcagtggctcacgcctgtaatcccagcacttttgggaagccaaagtgggtggatcacttacggtcaggagttcaagaccagcctggccaaatatggtgaaaccctgtctctactaaaaatcaaaaaagtagccgggtgtggtggtgcacacctgtaatcccagctactcgggaggctgaggcaggagaattgcttgaacctgggagatggagattgcagtgagctgagatcgtaccactgcactgcgagtctgggtgacaaagcaagactctgtctcaaaaaaacaaaaaacaaacaaacttttgtgaaattgaaattgcaatatgtctgctacttgtggcttgggcttggaccagtttatctaataagcaaggcaggttcttgtgtgctatggtaataagccttcttaacaaggctaagcttccctcataagaactgtggtgttctctttatatacaagggtaggggaaggattagggtataaggagtatagcgaatggtaagtgtcctaaaatcaggtatccaagggtttagtagggggcaaagggtaaactttcggcacatatccctggtaggaaagcggacattgtatttgcctaggtacgcagggcacaagggtggttaagggctacccttgatcaaacactcgacttcgaactttttataacattttctcgctccttatatctctttttcccggaaatcagtttggtggctaataaagaagtgcacccagtggagc

SEQ ID NO: 487336 - DNA, 442 bp, Homo sapiens
cactgtatgtagagctaataaatataaggacagattcacaaggctcaaataaaaaacaataataacacacacagagaacattaactaaaggagaagggactcaaacaacacggacggcgggagaagagaggcatgtacacctgctccacttaaacattcttttagacttacaaatatcatcttcaggaatacaaatattgcaaagcttagcacggttggcacatggcctcctgcagcaatcacagcaacaaatgtgcttcgcataaatcctgtgctttagtgaaaagagaactaataacgacctccaatttcagtagcaattttatcaacccaaaatataatgtagaagatgaaactaaacaatccatctttcccgcctcccttctctctctcacacacacactcacctttctacatcaagctacatttgggcgtacgggga

SEQ ID NO: 487337 - DNA, 380 bp, Homo sapiens
  misc_feature (33)..(33): n is a, c, g, or t
cctgcaaggggacaggccccttcggttttgtgntggtacgcctcatccctgcacccaagggcactgggattgtttccgcccctgtgccttaaaaactgctcatgatgggtgggatcgatgactggtcaccctcaggccgggggtgccctgcccccctgggcaactttgcccaggcccccttttatgccctttttaagaccttcagctacctgacccccggcctttggaaggaggctggattcccccagtttccctatccggagttccctggcccccttgtccagacccccccccgagtttccgtgcaacgggctccgggtcccgctgtgggttccacctagggtttttattccagaaaaataaagtgaatttagcgtgga

SEQ ID NO: 487338 - DNA, 455 bp, Homo sapiens
caaacggtctgcgttccagggcaatatctttgttaaaaaaaatttggcaatagtgtgcacagaaaaattatatcaaaggtggagcttctctcctttcttaatatggatctgacaagcatttatgtgaaatataagtgaggggaatgaaccaggagtattctttaactgaatgggccatataagagagcacttgaaatctgaagaatgtctatccctaccaagaaaacggagtcaaatggcaattaagtttacctttggttatatggaagcaagagtcatgcttctcatcatcaagtgcgtctctttggtagccaataattccatctgtaatcatgacagcaccttaagtattgcctaacgagagcgctcgtgcaaaattcctgcagcgcgggggaaccactagtatatacggcggcccgggaggtttcaagtctcaatgttggagtggggatctt

SEQ ID NO: 487339 - DNA, 1850 bp, Homo sapiens
  misc_feature (706)..(706): n is a, c, g, or t
  misc_feature (710)..(710): n is a, c, g, or t
  misc_feature (716)..(716): n is a, c, g, or t
  misc_feature (732)..(732): n is a, c, g, or t
  misc_feature (778)..(778): n is a, c, g, or t
  misc_feature (782)..(782): n is a, c, g, or t
  misc_feature (791)..(791): n is a, c, g, or t
  misc_feature (1144)..(1144): n is a, c, g, or t
cgttgtcgtgtgttctgtgtgggttcttgcgtgtctgccgccttcgtcgatgccgggcgtcgcttgatccttcgtcgcgttggttgtctttgcttgtttttaccattacgtgttcttgttccaggctgttctctggcctttttgtctgtgactgtaggacgtcgggtcgtccagcgcgcttaccccgctcggttatccttctcatcctccttctgcctgtgtcccggtttgtctgcgtagttggcgttgatcgatcgttgccccccttctctcgttcctcaacaggggtctttgtgggggacctccatgattgtcgtggattgttgcagtgtcagttttgctgcgcctgtggagtgcaccctcgccgtcctggatatcatgggcagctccctgtccggacccttggcgcttgaccggtcctccgcggccccatctccttctctggtcgctgctctgtctctcccttctgccattcagggacgcagcgtgactttcatgcgagttcctcgtgcatccttgtttatgacaaggtgtactcagcacgtcctgtccaggcctgaccagcccaggtttgggagggggcttcctgccccccccacggtgttccagcccctcctctcttccgccccctgagtctcccacccttcccttccccgtagtgacccattcctatctgcttccctgtccgcaggctcctatgaatcgnatgnatgtgnacttcttcatctgtgnaaaatcttttttttttccatttggttctgttgggggcttctgtttngttngcgagagancgatggctccgtggggagtactggggagccctcgcggcaagcagggtgggggggacttgggggcatgccgggccctcactctctcgcctgttctgtgtctcacatgctttttctttcaaaattgggatccttccatgttgagccagccagagaagatagcgagatctaaatctctgccaaaaaaaaaaaaaaaacttaaaatttaaaaacacaaagagcaaaggcagaacttataaaatttatatttattttttttaaaaaggtctctattcttcaccccccagccttccttggaacctggcctctctgaggataaaggcaattcattttctcccaccctcggccctctggtntttcaaaataaccttttacaaagggaaaaaaaaaagtcactctggcttatttctttttttaagtaagagggggacactttcctgggcccaggtgtggtattggcagggacccctttccccaaagaaggccaaaaggccaccagtccttgtacttcatccctccaagggcctcgggctatcaagaattcccgaggggctccggaccgagatcacccaccttccacaggacaggctcgggataggtcttagcattatggttcacaagagggagattagaaacgtcgacaacccaatcgttgcggaacagcgcagaaaaccacttgtttgccaagttaaaacatatataagtggcacgccttcaaaagctgcaccaagttagagttgatgagagaaaacacccccgccggtacggcgaggatgatatgtgaggtatatccccccccgtttgccttcaccctcacccgaaggtcttggaacgccgaaggatatggggcctacatagacatgttggtcaaacaaagcgccggaaaatgtggagactgacagctgcaccaacctgcgggctctcatgctgtaagacacaacataaggcaagcgtgtctacagaccacacaggggagtatcataaccgaggccacccgcgccatatggtgttgggggacaacacggcgtcttgtggaaaaaccacaaaacgagagggacagaa

SEQ ID NO: 487340 - DNA, 507 bp, Homo sapiens
cccagggtacaaaacagccacagaaggccacaggttccctgcctaggaaagccaggcattgtccaaggtttctccccatgtgatagcctgagatgtggcctcgtgggaaaggaaagacctgaccgtcccccagcccgacaccggtaaagggtctgtgatgaggaggattagtaaaagaggaaggaatgccctgttgcagttgagacaagaggaaggcatctgtctcctgcccttccctgggcaatggaatgtctcggtgtaaaacccgattgtatattccatctactgagataggggaaaaccgccttaggcctgaaggtgggacatgcgggcagcaatactgctccttaaggcattgagatgtttacgtgtatatgtatctaaagcacagcacttaattctttacattgtttatgatgcagagacttttgttcacgtgtttacctgctgaccttctctccactattatcctatgatcctgccacatccccctctcccccggggaag

SEQ ID NO: 487341 - DNA, 1765 bp, Homo sapiens
  misc_feature (706)..(706): n is a, c, g, or t
  misc_feature (710)..(710): n is a, c, g, or t
  misc_feature (716)..(716): n is a, c, g, or t
  misc_feature (732)..(732): n is a, c, g, or t
  misc_feature (1059)..(1059): n is a, c, g, or t
cgttgtcgtgtgttctgtgtgggttcttgcgtgtctgccgccttcgtcgatgccgggcgtcgcttgatccttcgtcgcgttggttgtctttgcttgtttttaccattacgtgttcttgttccaggctgttctctggcctttttgtctgtgactgtaggacgtcgggtcgtccagcgcgcttaccccgctcggttatccttctcatcctccttctgcctgtgtcccggtttgtctgcgtagttggcgttgatcgatcgttgccccccttctctcgttcctcaacaggggtctttgtgggggacctccatgattgtcgtggattgttgcagtgtcagttttgctgcgcctgtggagtgcaccctcgccgtcctggatatcatgggcagctccctgtccggacccttggcgcttgaccggtcctccgcggccccatctccttctctggtcgctgctctgtctctcccttctgccattcagggacgcagcgtgactttcatgcgagttcctcgtgcatccttgtttatgacaaggtgtactcagcacgtcctgtccaggcctgaccagcccaggtttgggagggggcttcctgccccccccacggtgttccagcccctcctctcttccgccccctgagtctcccacccttcccttccccgtagtgacccattcctatctgcttccctgtccgcaggctcctatgaatcgnatgnatgtgnacttcttcatctgtgnaaaatcttttttttttccatttggttctgttggggggcatgccgggccctcactctctcgcctgttctgtgtctcacatgctttttctttcaaaattgggatccttccatgttgagccagccagagaagatagcgagatctaaatctctgccaaaaaaaaaaaaaaaacttaaaatttaaaaacacaaagagcaaaggcagaacttataaaatttatatttattttttttaaaaaggtctctattcttcaccccccagccttccttggaacctggcctctctgaggataaaggcaattcattttctcccaccctcggccctctggtntttcaaaataaccttttacaaagggaaaaaaaaaagtcactctggcttatttctttttttaagtaagagggggacactttcctgggcccaggtgtggtattggcagggacccctttccccaaagaaggccaaaaggccaccagtccttgtacttcatccctccaagggcctcgggctatcaagaattcccgaggggctccggaccgagatcacccaccttccacaggacaggctcgggataggtcttagcattatggttcacaagagggagattagaaacgtcgacaacccaatcgttgcggaacagcgcagaaaaccacttgtttgccaagttaaaacatatataagtggcacgccttcaaaagctgcaccaagttagagttgatgagagaaaacacccccgccggtacggcgaggatgatatgtgaggtatatccccccccgtttgccttcaccctcacccgaaggtcttggaacgccgaaggatatggggcctacatagacatgttggtcaaacaaagcgccggaaaatgtggagactgacagctgcaccaacctgcgggctctcatgctgtaagacacaacataaggcaagcgtgtctacagaccacacaggggagtatcataaccgaggccacccgcgccatatggtgttgggggacaacacggcgtcttgtggaaaaaccacaaaacgagagggacagaa

SEQ ID NO: 487342 - DNA, 1082 bp, Homo sapiens
gagatcatgaccccctatgctgtgggagaagcagtgtgactttcgcaggttcgggcaaggagcaaaatgctcaaaggtgaagcattgtagcaagcattcatcctttgtgcagcaagtggcatgcacagcagcgccagtgcacacagcaacatctcgcatggtgccatgtgcattcctcccatctaagatgcacaaagcaggaactcccagtccagcatatgctccagtgaccaatcacgaagaaggagaccagttgtcgacaacgcaggcatgcaaaggcacgggagagcagcagtacttcacatgacagcagcacagtcagcatcgacaacgaaaaacttcctacttccattcaaaacaacaaggagacacggcaacatgggctcctccaaaaaaatattctagcacatcaaacaacatcatacattgtgacaacctaccaaaaatgacaagacataccggaatcaatacagatacacccgttgccaagacacagacaccaactttgacattccactaacaagaagacagcaccaaacacaaaacatcaacaggcaagaataacattccagcactaaacttttcattaccagcaacaacttacattgccaattatatcgaaacgacattgggttacctggggttgcagaagacaatagcaacccctcaggagagttccagataagacaacaagcaaattgaccaaatttagataagagacaccaagaaatataccattacttcacattgaccacccaagaacaataagataaccacaataatgcaacatatgtagaaatacacatacgtaaacctacacacaaatataacacaaagaatcaccataatttgaacacattcatatcaaacacacacacattatacaatcaaccattaaaagacacgtaccacacacatatcaatcagacatggacgaatttcacacacaagaaaacacgaagaacaaaaaccccctatcaacaacagaaacaaaactacacaaaggaaaacaagacagcaacagaattccattaacaacaactatcagaatacacaaaccaaacaaaaaaataaatcactaa

SEQ ID NO: 487343 - DNA, 81 bp, Homo sapiens
  misc_feature (16)..(16): n is a, c, g, or t
  misc_feature (36)..(36): n is a, c, g, or t
  misc_feature (47)..(47): n is a, c, g, or t
ctgctcgcaattcaangcttctaactgatgtacggnggacatggaanataaagctacccagcgctgccctgggcccttgca

SEQ ID NO: 487344 - DNA, 792 bp, Homo sapiens
atagaacatcctctgccttctctgcctcattctgctgtgatggaggtgacaactacagaatccatctcctggagcgtctcacactttggcctctttttggatttgacggatggaagatgttcataggaaatcagaggacagtgggaaaccaaacccagggattttgtaatatttttcccttaattatctcaacactattttgccagttgctgcattcttctacatttataactcctgtttggaagtgcctacctcaaccatcacctttcaactgggttcttataaaatgatccttcctttgacacttctgacctaggattctaaaagttccctgctactgcacctaggtacttgttgatagcttattcctgaacatgcctccttaaatatttgctacattaaatgatctttgctaccttgttaaatttgcaacattaaattcttttgagtatacgttgtcttatgctaatatcttgcctaatacatagactctgccaacatttatcactgagcagttcatgaatggaggtcaatccaaaagatatctattacattgtaatttttgattgaaagagttagcattggaaaaactttaaaatgccccagatatttgcaatgtgttcaaatatttctttaataatatcgaatatatagctattatttggtggtattgtgttaacaggatgaacaatattaatcatatatatactaatcctatcactaacattcttaattacatgtgctacttccttctcgttataaaacatcttcctatgaaatgtataccatatg

SEQ ID NO: 487345 - DNA, 865 bp, Homo sapiens
  misc_feature (865)..(865): n is a, c, g, or t
gcttctgctgcgaggccgcgtgcatcgtagacgaggccatgctcactggggtgagtccgtgccacatgatgaagaggagcccatcagaagacctcagcccagaccgggtgctggacctccaggctgattcccggctgcacgtcatcttcgggggcaccaaggtggtgcagacatccccccagagaaatgccatcacggtgcctgaacgccgggtgacagcgggtgcgtggcctaccgtcctgcggaccggattcaccacatcccagggcaagctgctgcgcaccatcctcttctggcggtcaccgagggtgactgcgaaacagcctggaggaccttcatcttcagtcctcttcctcctggtgtttgccagtcgcgtgctaggctgcctatgtatggattgaaggtaccagcggaccccagccggaaaccgttacgatgctgtttctggagtgctgctcctgatcctcacctcgtgtcgtgcctcctgagctgcccatcgagctgtcccgtggccgtcaacacctccctcatcgctcctggccaagctctacatgtacttgacagagcccttgcggatcccctttgctggccaggtcgaggtgtgctgctttgaccaatgacggggacgtggatccagtgacagctggtggtgcgcggtgtggcgggctgagagacgggaacggaggtgagcccagtgtcggcgtcctgtggaacctagcgggcctggctcgtgccactcgtcatgccgcttgggagccgggcctcgtggtgcctttggaacgcctgtggcggccgtgtttggcctgcccatggatgtgtcccggattccgggggttcccgtttttggggcccttcgttcctctan

SEQ ID NO: 487346 - DNA, 178 bp, Homo sapiens
tagttttacttttgcaacatacgtatgtacctctaagtgaaatgttaataatgtgatgtttctgaattgtatgtaaatggcaaaatgtttactggtgtgactgttcactcatgtgtcttgctatctagttttatgtaaatttgttacaacttattcattcttgatggacccatcatga

SEQ ID NO: 487347 - DNA, 96 bp, Homo sapiens
  misc_feature (52)..(52): n is a, c, g, or t
  misc_feature (74)..(74): n is a, c, g, or t
aagcagagtacgcacgtcaggcccttccacgcccaccccaacactttaaacntactgggcgatggggccgtttngctggcagttcaagataaaaca

SEQ ID NO: 487348 - DNA, 187 bp, Homo sapiens
aattctcctcctctggtatgatgcagaccaatatggggggcctcccatgatgccaatgatgggcctcctcctacctgggatgatgccagtgggacctgctcctggaactgaggccgcccatgggacggcatatgccacatgatgcctgggcccccaagtgatgagaccatcctgcccgatcccatga

SEQ ID NO: 487349 - DNA, 276 bp, Homo sapiens
cgtccccatgcctttgcagcagcatggatgcagttggaggccattcgtaagcgaattaattaacagaaagccaaatactgtgtgttctaacttccaagtgggagctaaacactaagtacatgtggacacagaggggaccaagagacaccaaggcttactcgagggtggaggctgggaggaagttgaggatccaaaaactacctactgggtactatgctcactatctgagtgacaaaatgatttgtgctctaagcctcagcgacacgcaatgtgccc

SEQ ID NO: 487350 - DNA, 159 bp, Homo sapiens
agcacccagcaaataataggcactgtaatatatgcttaatagtaacgtagctatgaatttatgcccacatttaggcggacgggaaaattaacgcccgaatatacccgaaagtcaaatttgtcatctaaacactataggaagttacgttaaaaaatactc

SEQ ID NO: 487351 - DNA, 346 bp, Homo sapiens
ggaaaagcccccaaaacccaaaccccctttccccggggggggggggattaaaaaaaacaaggggccccccaggttttcccccgggaaagggggcagggggggccccccaattaatgtgggttagcccccccaaagggcccccccgggtttcccctttatgtttccgggtcgaaaagggggggggattttgaggggataacaattttccccagggaacagtttttcccaaaaaaaccccaagccaaaaaaaaccccccccaaaagggaacaaaaagggggggccccccccggggggggcccctttaaaaaaaggggaccccccggggggcaggaattggggccggga

SEQ ID NO: 487352 - DNA, 326 bp, Homo sapiens
ctttaagaggctgagatgggaggatccccttgagaacacatttcccactaaaaaaaaattttttttaaatagccaggcatggtggcatatgcctgtggtctcagcaactcaggaggctgaggcaaaaggatcacttaagcccaggaggtagaggctgcagtaggctgtgattgcgcgactgcactccagcctgggcaacagagcaagaccctgtctcaaaaaataaacaaacaaacaaaaaccaacaacaacaaaaaataattaagccaggccaggtgcagtggctcatgcctgtaatcccaacactttgggaggcccgtcgacgc

SEQ ID NO: 487353 - DNA, 240 bp, Homo sapiens
  misc_feature (86)..(86): n is a, c, g, or t
ccgtgctccttaacagctgctgtaactagtctggcctacaatagtgtgatccatgtaggacttctttcatcaattcaaaacccctngaaaacgtttccggtttttttaggtgggtttaagttttctaacttttctgggctctctgccccctgcgttggactgtggaaggggggtttttttgggtttcccccccctgtccctttttgggtttctcttgggggcccttttggtccccccttt

SEQ ID NO: 487354 - DNA, 303 bp, Homo sapiens
ggatgtacaaaatacttacagttatttaaattgcattctgcccagccttatgctgtatggtgaaaccccatctctacaaaaattagcttggcgcacagtggctacacgcccatagtcctagctattcacctatgctgaagtgggaggatcacttgagcccagggaggtcaaggctgcagtgagctgagatcacgccactgcactccagcctgggcaacagagtgagactctgcctcacaaaataaacaaacataaactgcccttcccagctggggacgatggctcatgcctgtgatcccagca

SEQ ID NO: 487355 - DNA, 330 bp, Homo sapiens
gtaatctataaataaaatatagctccatctacaaaggaacagagaaaaaatagttcagttacaatgaagagttctgcttaccgtcctaactgtggagccctggatttaaattagcatgtcaaactaccctcgtcagtctgtggtttagtcccatataacgataaaagagggagcaacaaagaagatatattaggaagtagcatttctaaggccactagatgggaccaccatgtaatatcatcaaagccaagttgcgagtgatgataaaataagaccattcacccacttaccactggagaattgcgaaaacctttgattgcttgagagata

SEQ ID NO: 487356 - DNA, 124 bp, Homo sapiens
ttattagggggtttagaaaataaattcgtagggtttaaacattgaataaaactacaaaaaaagacacacattcaggtagcgaggctctgggggtaactctttcttagttctttggacacatccg

SEQ ID NO: 487357 - DNA, 199 bp, Homo sapiens
cactcgggaaactgctataccggccgcttcgtttatcattcggactgcgctttactcggacgctctctaaaaccaagaaactcacaatgaccagatccctgtcctataccagccagactccagcagcaccccctcctccacgacgtgctccgtgaccctcctcgaccgacgtggtatcctcgtagacgtcgacctcgca

SEQ ID NO: 487358 - DNA, 1124 bp, Homo sapiens
aggtcctctattcctatggctaaacgcagccatggctcgttggtgcccaatgaagcatctagaagctgggtggcagctcgctaaagcattggatgctggataaattgagcggtgtgttagctccatcgtccatccacgcggtcgccgacaagttgagagagtgtctcccgcctcatcattttcctgaggaacagacttaagtatgccctgacaggagatgaagtacagaagattggcatgcagcggtgcattaagatcgatggcaaggtccgaacgtgatataagcgtaccctgctggacttcatggatgtcatcgagctttgacgaagcacgggagcagaatttccgtctgatctatgacaccaagggtcgctatgctgtacatcgtataacacctgaggaggccaagtacaagtgtgcaaagtgagagagatctatgtgggcacaaaaggaatccctcatctggtgactcatgatgcccgggcatccgatacccgatcccctcatcaaggtgaatgataccattcagatagatctgggagacttggcaaagattactgactttcatcaacgttcgacacgtggtaacctgtgtatggtgactggaggtgctaccctaggacgaatggtgtgatcaccaaaagagagaggcaccctggatctttagacgtggttcatgtgaacagatgcgaatgggaaaagcgttggcgatcgagtttccaccatttcaggtatgggcaagtgaaaaccagggatgtgttacccgaggaaggtattcggctaacaattgctgaaaaaacacaaaagatggggccaacaaagccaggggtgcaaaggggcccccggggcggaatggtcgacattagggagggaacatgacacagaaagtggcggcaatcacaggcacaacaaacacacaagagggcgcgacaacagggaacaaccagagggccacaaaagacaccgcgcaattgaaccaaggacccacagaggcgaaataaagacgagcgagcaacaacgaacagcgaacgaacaagccacaagaaaacagttggactgcaaacacataagcaagaacaaaagcaagagcatgtatagcaatgaacaatagagagagaacgaga

SEQ ID NO: 487359 - DNA, 593 bp, Homo sapiens
tacctagctgcaatttgcagctattaaccagcctgttttcctccccgaccccccccagcccttcccagcctctagtaaccacagttctactgtctacttctatgagctcaactcttactagttcccataaatgagtgagaatatatgatctcggtcttaattgtacctcatttatttcacttaatgtcctccagttcatccatgttgctgtgcaatgataggctttcatttcttttcatggctgaatagtattccatggtgtatatatgtcacatttgctttatgcattcatatgttgagggacacttagattgactcctgtatctgggctactgtgaatagtgctataacaaacatgagggtgtaggcatctcttgctcatactgatttcctttcttgggataaattcccagtacatggaatggtaggcagtgtggtagttccatttagaggttctggagaaaccacgatacgtgtgtgccataatgggtatactactgtacattctcaccaagggtatataacaatttcactttgctcgaaaactctacttggtcatttgccggtcttttctatcactaaccataacctcg

SEQ ID NO: 487360 - DNA, 113 bp, Homo sapiens
tctatcccgcagacgtgctgctctttaagggatcctggccttctactcccaggaggtacgagaccggttccagatgaagctttcctggctcaggatgaccacctgcttctggc

SEQ ID NO: 487361 - DNA, 164 bp, Homo sapiens
agcgtctaccagatacgtaatagagtacctggacacgaaactcttctgcccgaggcccatttcttttccaaagctctccctactgggcatattaccttacaggtttttctagcctataccatagtatgctatgtagaggaatacggcgagtgtactaagcaact

SEQ ID NO: 487362 - DNA, 416 bp, Homo sapiens
tgaagcctctagctgttactgcggtggagtctggctctctctttaactctaataatatttggtttatatatctggatactacaatggtgggggcatatatatttaaaggtgttatattctcttgctgagttgacccctttatcattatatgatgacctttgtctcttagtataaatttcgtcttgaaatctggtttgtattaagtgtagctattcctgctctttcttgctttccatttgtatggaatatattttttcgcatccctttattttcagcctacgtgtgcctttatagtgacgtgtatttcttgtaggcaacatattcgctgggtcctgtttttctttacccattcaaccgatctgtcttttgaatggagagtgtagtctgggtacgttcaatgctgttattgataagta

SEQ ID NO: 487363 - DNA, 1705 bp, Homo sapiens
  misc_feature (1372)..(1372): n is a, c, g, or t
cgaagcaggatgtgtgtattcattgccttggttctctctggctagggcggtgtcaccacaacaaatacatcctagtaagtttcctgtggtgtgagactatcgaatgatccatgtgctgtccgaagtagttcagattgtttgtgttggttgattcacacagcaactatctattgtggtgtgctcatatatatgggttgatacaagaagttgtggtgatatactacgagtggtgctggtgcgcacagcatgatgatgtattgcatatgagaggatagagcggggagcgttggtgtgggctgctgttaaatgcatacgattgatagtgtgtcttggtcttggtgttatgtgcacccctctggttatatggcagggttttgtcctccctcggtattggtgtgtggtttgtgtctcctctcgtggtgacgacaggtgtgtgtttgcgtgtggtttggtgctacgtggctcccgtgttatgggtgtggttttttgtggtaagtggagttttgtcgggtgtctgttgtcatctgcgtagtgtttggtggttgtcggtttatcattagcgctgtcttttgtgttgtgtgggtgttggtggtggttttactacatgcgacaggcaacacaactgcggtgggggtgtgtcctctttcgtgaggcgccagctagtattgtttccgccgcgtcccctctatggtagctcgtttttgttctctgggggtgagttccttcctcatgttcgtcgcggggtgtgtccgccccctcttctgtgtggtagtactcgccatcttttgtttgtgtacccacacgtctgtgtcgtgtggtgttgttttgtgatagatacttttcctcgcggagggtgatgcatttcttcatctcgacttctcgctgcgttagcgcctccgctgtcgtgttgtagtagagattaggacacccaccaacgacccgccacctgaagacacagtgtgtgttgtgctccttcgtgtgcgtactctgcttctgtgttgtcatacagcgcttgtatgagtacgccccccttttttcgtcaacagaagagatgagtagttcgtcaattagagtccgccacagcttgtcctcctgtgtggtctccgcaataaaagtggggaggatatctattttcttcaccagcggaggccaaaggagagtggagaatattaggtgtggtacacagttactgccccccagcgtatgtgcgcacatgctacatgtgacacacttgtgccacttcgctctcccgctcacagctttgtgagacatcaagtgacccacacatagacacacagcgggtgtgtctctcacacacacccacacaccctcgtgtgttagacgcgtgaggtgagacacacaccacaccacncgcgtgtgtgtgtgtctcacagcggtttgtctccacacacaccacaccccaggatgttggtgtgcgtgtggatatctcccatactcatacagtgtgtctcagagaacctgcgtgttgggaggttctcccgagaggaccctgtatgtgtgacaacaccacaggacagtgtctctcaccaaagaacaccctcacacctggtctcagattgtttgtgttttcttgtgggagaggaggagatccacccctcccgcgagaaaagaggacacagttttagcccacacgcatctcacccaaatatatatatctcaaattgttttgtgagagaaccccaca

SEQ ID NO: 487364 - DNA, 152 bp, Homo sapiens
aacatgtcgaggctgtcaactgaaataatttgttcattcaactggcagtgaaaatcaatatagatcaagatgcataaagttcagtaactattaaatggagaagcaagcaataagcaacagagaaaattaaatcacggatgctagagggggaa

SEQ ID NO: 487365 - DNA, 103 bp, Homo sapiens
ggatttgctggtgcagtacaactaggcttaatagggacatgtacattatttccaaagtcttaggatgagggaaaaaaaaaggaaagaagatagatgggtttaa

SEQ ID NO: 487366 - DNA, 994 bp, Homo sapiens
  misc_feature (144)..(144): n is a, c, g, or t
  misc_feature (200)..(200): n is a, c, g, or t
  misc_feature (221)..(221): n is a, c, g, or t
  misc_feature (313)..(313): n is a, c, g, or t
  misc_feature (349)..(349): n is a, c, g, or t
  misc_feature (430)..(430): n is a, c, g, or t
  misc_feature (445)..(445): n is a, c, g, or t
  misc_feature (455)..(456): n is a, c, g, or t
  misc_feature (459)..(459): n is a, c, g, or t
  misc_feature (473)..(473): n is a, c, g, or t
  misc_feature (478)..(478): n is a, c, g, or t
  misc_feature (481)..(481): n is a, c, g, or t
  misc_feature (486)..(487): n is a, c, g, or t
  misc_feature (491)..(491): n is a, c, g, or t
  misc_feature (500)..(500): n is a, c, g, or t
  misc_feature (558)..(558): n is a, c, g, or t
  misc_feature (564)..(564): n is a, c, g, or t
  misc_feature (574)..(576): n is a, c, g, or t
  misc_feature (918)..(918): n is a, c, g, or t
  misc_feature (920)..(920): n is a, c, g, or t
  misc_feature (986)..(986): n is a, c, g, or t
cagcgcataacattgatcaaatatttaccattatagtatatgaaataatctattaacgaagaagcccaatacagtactagaacaatccaccagagtcatgcaaattacatgagacataaatgtcacagaaaaaaagtaaaaganaagggaatacatggtttactccagtcatagttcaacttcttaacaaaatgtgagtnttccctttggatatgtctganatgtaagtctgttttttgcactaagacagccttctataatcatgtgataatgaaatcataatgacaaagttcatcttcccacagtttttgcnggccaatctctctaacctcagcctaggtaatttggnggcttgccctcaacatttccttaactagaataaacatagagaaatagaattagtaatactccttttacataaataccaaanatcatggcataacanctccccaaannggnaaggtataagaganatgantgnggggnnagcnaataaaganaagtaggcgagatgtctcagattctccctggggtagatcttctcagggcgataaaganaacgtncttcccaaannncccctttagacagaatctgagatggcttaaaatagctgctccagggcaaagcaatgcctgcttaaccaggaataacatactacttctaagtcctgtatagaggtgctcctgcggcagcgaacagctcgtctaccatctgactaggtaccacaagagtttttgcttttttattttaaagaaaagatctgcccatcacctatatttttatttatctcatgggattttcgtattttcctgggaatgcaggcactctgttcttatcatggctgaaatacggtaggcttaatacttcacaattatatagcacctttcacccaagggcctgttgtttggttttggttnangtgtgttttaatcagcttccagaattgccatgccttcactgtgaagtgggataggcaggtccccanaggtgata

SEQ ID NO: 487367 - DNA, 319 bp, Homo sapiens
tcgtggggtcgtatggatctgtgactgttacactccttcttcttctcatccatggagacacccccaggcccaggccaccaccaagagccacacgaagagcctcaccaagagccacacgaagagccctcaatgagcccacgatgcgccacgcaaagagccacacaacgcgccacaccacgagccggctctttgcgtggcacttggagtggctctttgcgcggctctttgtgccggtatttagccttagatggagtttaccacccgcaacgtgccacaccaggagccccgccacgagccacccaacgagccgggtaccgag

SEQ ID NO: 487368 - DNA, 146 bp, Homo sapiens
atctaccacctgactcatgagggacacccggaacggggcaccctccatactctcccgagactatccaacatggggactggacgtaggctccgctcccccccataccccctccatgatatccagcgccttgtgacacccttttcacc

SEQ ID NO: 487369 - DNA, 314 bp, Homo sapiens
atgtgtggtgttatgtacaacttgtattatttatataaatgtattgaactctctagaaaaatgtaattatttggtattacaaaaaaacaaactacggtactacataaataacaaacttagatattgtattcttatgtgtcttaaaactacatattagtgtaagcatgatatttatcatttgatatcaatttatgctttattatgacacacagggtaattatatgcatgatatctatcatttggtatcaatttttgaagttatatgcatgatttttacattgaaacaccaaattccaatctactaatatgatact

SEQ ID NO: 487370 - DNA, 175 bp, Homo sapiens
ggggctgcttcgtgagggctggccacgcgggcagctgcaacctgtggcatgtacgtctgtgtggcagtgtgggcttctggactgggggctcggcaacgaacccaggaagggggagctgttgagccaaggggacattctggcccctaagtctcaggagcaacattcccttgtaaat

SEQ ID NO: 487371 - DNA, 492 bp, Homo sapiens
atttgactgaggctgcgggtgtttgctgctatgctccggagcttgcaatgccgcttaaggacgagcagaaccactaaggacgctgtgattgatcggtccaaagagaatgagcatagtacccagtgccagacaaatcctggggagcataggctcgaacaggagaagaagtggtccaactggcgcaacgttcgggacaagctcataacttagtcttgttggagaaagctacctatgataaactctgtaaggaagttcccactataaattataacccgcagcgtgtggatctctgagagactgaagattcgaggcgtccctggctcagggtcagccccttcaggagctccttagtaaaggacttatctacactgtgtttcgaaagcgacagagctcaagtaatttacactcgagaaataccaagggtggatgatgctccagctgctggtgaaggagtgcatgaataggtccaaccagctgtacattgggaaaaat

SEQ ID NO: 487372 - DNA, 421 bp, Homo sapiens
tcaggttatgttaacacggagagagatgctaggaaatggaccatggaattagactagtttcaaatgagggctgctgagaaagccacacttctcattggtttcagcactgctctgctttctatgtgaaatacagttcagggcctggggcaacagggtggtgaaagtttaactttgtttgtctgttacattcttggtacttcagtacctgccagagatcctcttgaacacttgtttctttagcactttggagatataaaccactttataaaggcactgttattatttgcctcttacatttccactgagttgggggttaaaagtaatttacttattatcttttctaatttgttactttcaaataccaggactttgttgaagagacttctttttaatgtataaaaattgaatgtttcctaagcaa

SEQ ID NO: 487373 - DNA, 310 bp, Homo sapiens
  misc_feature (87)..(87): n is a, c, g, or t
gaagaaaaatcttaacagtataattgatataaataagaaaaaagacctggtttttaagttaactccaaactgactataagcctagangggaaccataatgggccaaaggtgccagtgaaatactggaaaattatgtcatataaagaataattgaaaaaacagatttattctaaaatagaggaagatgtgtagaggtgggtgattgaaagggtgacacctctgataagttgactaggtcttaaaaagatatctagggccatattatgttgtagtgggctgaatggtggccctcaaaatgatacgtctatgt

SEQ ID NO: 487374 - DNA, 266 bp, Homo sapiens
  misc_feature (35)..(35): n is a, c, g, or t
  misc_feature (185)..(185): n is a, c, g, or t
  misc_feature (191)..(191): n is a, c, g, or t
ctataactaacccactcccactgtgataatgacantagtccattcatgaaggtcaaaccctcatgacctaatcaccgcttaaaggctgctcctcttaatatcagcacagtgtcacttaaatttcatcttgagttttggaggggacattcaaaccatagtactttgttgcaattcaggcaagcttntagttnatgtacccatttatttccaatctcttctttaagggaatacagaactcttttcaattataacccatatgcagctag

SEQ ID NO: 487375 - DNA, 101 bp, Homo sapiens
aagtagtgtgtatagactgcttgatattatccttcatgtctctgagacactataccgttatatttattttttcagcctatttagtatgcagtgtgcttccg

SEQ ID NO: 487376 - DNA, 685 bp, Homo sapiens
  misc_feature (13)..(13): n is a, c, g, or t
  misc_feature (82)..(82): n is a, c, g, or t
  misc_feature (187)..(187): n is a, c, g, or t
  misc_feature (189)..(189): n is a, c, g, or t
  misc_feature (273)..(273): n is a, c, g, or t
  misc_feature (285)..(285): n is a, c, g, or t
  misc_feature (307)..(308): n is a, c, g, or t
  misc_feature (325)..(325): n is a, c, g, or t
  misc_feature (327)..(329): n is a, c, g, or t
  misc_feature (456)..(456): n is a, c, g, or t
  misc_feature (474)..(474): n is a, c, g, or t
  misc_feature (477)..(477): n is a, c, g, or t
  misc_feature (492)..(492): n is a, c, g, or t
  misc_feature (498)..(498): n is a, c, g, or t
  misc_feature (500)..(500): n is a, c, g, or t
  misc_feature (552)..(552): n is a, c, g, or t
  misc_feature (614)..(614): n is a, c, g, or t
  misc_feature (682)..(682): n is a, c, g, or t
gtgtgcgtgcatntgtcatttgctaccaggtgaatgtttcagttctggtttctgtttagtcttcctttggggtcgtgggtgntgcgggagcggaaaaggaggggtccttttagaaagttcaccaggaaaccagctcccctcccaccacgccgggcaggcgcacagccatctttttaaaatccgggcngnttttccctcacacccccaaacaggaactcctcaggatggcctcagaaggctggagtctctccctgtctggcgggacaccctggnggcggtgaaggnccctctggcagggggggggggnnggggggggggggcagtngnnngttttgttttcttcctgtcttctaattaaaaaagacattcctgggtgacaggcacagtgcaggagtgtgagctatcgaaacaacctggtgaagtctcgcaaggcccagcaaacttgtttacattccncagcactagtgacttgcntgnggaagtctgtaagtngtttgngngtcactgtgacggctcccacggttgtttcctttggcaaaccttttaaggaantttctaaccatcgacaaaaagtcggtctgtcaacctgcatgatctcccagagcacttcagcnacatctggtagggtatagggggggaggcaaaagcagcaggtgtgcagcagctggctgacaagctgctntcc

SEQ ID NO: 487377 - DNA, 188 bp, Homo sapiens
tgctgtgtcaggcatggtcatgctgtattcagcactttggaggccagcagaagatgcctgaggtcaggagtcgagacaaactggccaacatgggtgaaaacccatctctactaaaaaaagtccaaaattagcccggcatgatagcatgactggccaggcgtgggtggctcacacctgtaatctcagca

SEQ ID NO: 487378 - DNA, 791 bp, Homo sapiens
cccaacaatttttggggtggaagccccacctttagttttattctgagaagaaaaaaggtttttttttaataagattgttcttggctataatccaccaaaatttaaggttccaaaaaaatctccttttttaagaaaaaggggtaggaaaatatgggaatgttttaaggtcttaggaggtttggcaccctttttcggattctaaggtagctttatatttcggaaagaaagttcccatatggctttcccctacaagaaaagggctagaggcttgacaaatcaaagtgtggagaactttttactccccattcaaattccagaataagtattaagttaacagctatgcgcgtccttaattgacatggtgggtctcaggtagaaactcttcgagccccctttccttgggtgtttggattattaatcttctgggataccatggaccccttgggcttggcatgttggaaaatgttttttccttaaggcaaaacatcttcaaagcccatgtcgtaagccatcggaatctagccatgcattgaagggtcaatacattttggggttagctctgggggagtgggcccctttcattcctgaaaaaacatggatctttggcaaaatagtctttagagcagccactgaggggctgtacccctatctagggctgtggaaggagcagaaaggttcttgactatttccttcctcctgtccacacacatcaaaagtatatttccccccccgagtagtgagtgaataataaacccgcgcgacttggtgcccggtgtttatggaataaagga

SEQ ID NO: 487379 - DNA, 865 bp, Homo sapiens
ggatgaaacagtaatgtgttcttgtcagattttacaagccggcagagagaaaagaagccaaatgccacgagagctgtaacgcctccaaggggtatgatcacaaagcaagcagagaaatagatgtcgtttggacactgcctagtcgggacttgtaagatagagtatataaccttcatttttaagactgtaatgtgtacggtcagcttgctcagatagatctgtgtatgtgggggcccttccttccatttgagatttagtgaatggcattgctggttataacagcaaatgaagagactcttcactccaaaacagaagaagtgtctggtcttttaattctcgtgtacctttgcagacaatttgaatgatggggttaaagctgtacagcccaggacagtggatcctgtctgaggagtaagtgtacaataggatcttatgttaattcagtacaaaccataatcatgtaaatgctcatatactgttaggacataaagagagccctagggtgctctgaatctgtacatgttcttgtgataagaatgcatactgttgatacagaacatgtgaacatgatttattagagaattgggtatcacagggatgcttattaccgtctcattgtcttgttatgtacaagactagattcacatagcgtatccaacattagtgagtaactattcaaccttgccgagcatcaactggacatgacgtaataatacaaatgcaacgccacaacagtaaacaccgaacgggattactgaacaactgaccacaagccaaagccagcaaactcataggtgaacactagccctaaagcccaaagagacaggggaacgacaggaacgacacaacaccaaactacaaaaga

SEQ ID NO: 487380 - DNA, 391 bp, Homo sapiens
cactccggcatggtactcaggctccacatgcctgccacgaacgggggccacgcgacaatgctgccacgcacgggggacacacgacaatgcctgccatgcatagtggccacacaacaatgcctgccacgcgtgggggccacacaacaatgcctgccacgcatgggggacacgcgacgatgcctgccatgcatggggacacgtgacacacacatacacacacgggcctcacaggacatgaatgtttgcaaccccagcacccacccagcacactcaggcacaggctccctgggcgggtcacaacttcacaccttgagctactccgtgtgccaggctcttcacccacgttcccgtccccggtgctagctattgagccacactgtcttctctgtgg

SEQ ID NO: 487381 - DNA, 859 bp, Homo sapiens
caggcttctgagcacatttccttctatcaacaagatgctcgcatcgcgtcacctccctccttggcaccatgagcacctgtaagccagaccagttcacctcctccaggctccatgaagggctcctgcggcatcggagagcggcagtcggggagcggctccagccgcatctcctccgtcctgggccgagacgggtcctgtccgatggcccccagacacctacgggggcggtctgtctgtactcctctcgcttctcctctgggggagtcctgcgggctggggggcggtctatggcgtgtggcttcacgcagcagcagtcagcttcggtagtggcttcgggggacgatactggtggtggccttggctgctggccttcggatggtggcttgggtgctggctttggtggtggttttgctggtggtgatgggcttctggtgggcagtgacgacaggtgaccatgcagaacctcaatgaccgcctggcctcctacctggacaaaggtgcgtgctctggaggaggccaacgccgacctggaagtgaagatccgtgactggtaccagaggcagcggcccagtgagatcaaagactacagtccctacttcaagaccatcgaggacctgaggaacaagatcattgcggccaccattgagaatgcgcagcccattttgcagattgacaatgccaggctggcagccgatgacttcaggaccaagtatgaagcatgaactgggcctgcggcagactggtggaggccgacgtccaatggcctgcgccgggtggttggactgagctgaccctgggcaggatgacctggaaatgccgatcgaaggctgaagaaggaagctggctacctgggggacaa

SEQ ID NO: 487382 - DNA, 390 bp, Homo sapiens
gtgcagaccccactccattcccgctcctggaacacttcgtgcagctgtgcatggagccagtcggccttcagtgccagactgtgagccaagccactggggccatgtgtattactggtgcagggaggcaaggcccacattctccttcagagacaggccctggcgccagagtcttccttgggccggggggaggtcacttcagcccctgaatgcaaccagccctgcattgtctataatggagacccttacccggtgcggtggatcctttctgtctttcctgcgttttagcagtttgagtgcatttgatatttttaggtttgtttttgcattccatcctgttcatcctgcttttgctctttctctccttcattcactaaagacctgtgcaagcca

SEQ ID NO: 487383 - DNA, 330 bp, Homo sapiens
ccccaaaaacccatttggttgtgggagggccccgttttttttggtggtggcccgaatttttttcaaaaatcaattttccgggcccaccagggggcggggcccccttttggccccctccccctttgggtccttttgggccattcccccctggggtcttggtggtttgtccttatagggatattgggccccttcccccgggggcccggggtttgggggttttgccccccatttgggtcccttggccccccgggccgggtttttgggccccccccggggccgggttttggggggtttttcctttttcccttaaatcccctgggcgccttttta

SEQ ID NO: 487384 - DNA, 989 bp, Homo sapiens
ggctgtcactgccatccattggagcccagcaccccctcaaacctaaaaaaaaaaaaaaaaaaaaaaaaaaaaaaaaaaaaaaaaaaaaaaaaaaaaaaaaaaaaaaaaaaaaaaaaaaaaaaaaacatagggggtgggggccggcggcgccccccaaacaaagagatctttccacaaacacaccatgtcggtgggtggcgccgccaggcacccaccggagttataagaacaagagcgggtcgactatagcgtcaccctcataagagaaatgtcgcgcggcgaaaacgacgggggggtggggtgctccccaccaacaaaaaagaaacaccgccgcggcgggggcaacccaaggggggtcattaacaaacacagcacgccgcgatgggggttcagaggaccaatatacagtgtaggggacaacaacaaaaggagagagactctcccaaacgtaaggtcgccatataataatataaaaatatccccccccgcggtccggggcgttggttaaaccaacgacgaacagaaactccaatacaataaacaacagaacatacaaagcaaaaactaaaatcaacaagatacacacacgaacaccgaagacctacaagtacgaatatatatacaagctggaactactacaaacaggcactacaaaacactccacctatcacactctaaactcacattaccactgaaacagaacatgaagaagaaaacataaactatcaacatcaactatacgatatcctatcaaaaacttaactcaatcaaatcccaatacaatatatccaccgacgacacgacactgcgactcacacagaaacacagacaagacaaaatatatatacgatcatcaacattatatacaattatcggaatcatatatacacgcaaacaacaacataacactaaactatcacacacaactaaacaaccaaaaaccctcccacaccaacaaacacaaactaactaaatcaaaaaactaatca

SEQ ID NO: 487385 - DNA, 743 bp, Homo sapiens
  misc_feature (2)..(2): n is a, c, g, or t
  misc_feature (56)..(56): n is a, c, g, or t
  misc_feature (100)..(101): n is a, c, g, or t
  misc_feature (110)..(110): n is a, c, g, or t
  misc_feature (118)..(118): n is a, c, g, or t
  misc_feature (127)..(127): n is a, c, g, or t
  misc_feature (148)..(148): n is a, c, g, or t
  misc_feature (150)..(152): n is a, c, g, or t
  misc_feature (155)..(155): n is a, c, g, or t
  misc_feature (159)..(159): n is a, c, g, or t
  misc_feature (163)..(164): n is a, c, g, or t
  misc_feature (167)..(168): n is a, c, g, or t
  misc_feature (172)..(172): n is a, c, g, or t
  misc_feature (183)..(183): n is a, c, g, or t
  misc_feature (194)..(194): n is a, c, g, or t
  misc_feature (242)..(244): n is a, c, g, or t
  misc_feature (257)..(258): n is a, c, g, or t
  misc_feature (260)..(261): n is a, c, g, or t
  misc_feature (279)..(279): n is a, c, g, or t
  misc_feature (281)..(281): n is a, c, g, or t
  misc_feature (305)..(305): n is a, c, g, or t
  misc_feature (312)..(312): n is a, c, g, or t
  misc_feature (317)..(317): n is a, c, g, or t
  misc_feature (319)..(319): n is a, c, g, or t
  misc_feature (324)..(324): n is a, c, g, or t
  misc_feature (393)..(393): n is a, c, g, or t
  misc_feature (424)..(424): n is a, c, g, or t
  misc_feature (454)..(454): n is a, c, g, or t
  misc_feature (459)..(459): n is a, c, g, or t
  misc_feature (471)..(471): n is a, c, g, or t
  misc_feature (478)..(478): n is a, c, g, or t
  misc_feature (506)..(506): n is a, c, g, or t
  misc_feature (587)..(587): n is a, c, g, or t
  misc_feature (643)..(643): n is a, c, g, or t
  misc_feature (651)..(651): n is a, c, g, or t
  misc_feature (656)..(656): n is a, c, g, or t
  misc_feature (670)..(670): n is a, c, g, or t
  misc_feature (720)..(720): n is a, c, g, or t
anggcagcccggtgcagccctggctttcccctcgctgcgcgcccgcgccccctttncgcgtccgcaaccagaagcccagtgcggcgaccaggagccgganncgcgcccgnaccgctcncgggaacgngaccccggccgcccagagatnannnacnaacnaaannctnntgcncgtcctcttgntcctgctgagnatttaggccacagcacctatggggctgaatgcttcccggcctgcaaannnaaaaaatgagaannanncaaaagaaaaaaaataanangcaagagatgcaaaaaatgagaanagaaagnaatananattanatacaaaaaaaaaaaaaataaaaatggcgtgcctttcacaggacatctgtgggagaaccccggagcagntgcaatttgcaccagactggcatggagacgnggagagctcctgtgaatagagaatgttcgnggccntgcatccctcgngcccccntgttgccaaacaaacggtgaccctgcgntgagccttgtgacgaatggccctctaatgaaatgcctccctggtgccccccgggggtacctcggggaaaagggaactgccnagtaaaaaagcgcacggggccccctggtggtgtatcaaacgggcctcccaccctgnccagccangggtnggccaccctgtcgntgggatgcatgcagagggccggggccctccccatgccctccctgccctgntgcccccccctggcctttctcca

SEQ ID NO: 487386 - DNA, 152 bp, Homo sapiens
tgctgtctcaaaagatatgttagtatataactgatatagtggtttaatgatgggcaaagctgtggggtgtcttagaggctgtggaggagttatcagaaaaaggatagaattccagatgatggaatagtggaaatagtggagacagcatatca

SEQ ID NO: 487387 - DNA, 263 bp, Homo sapiens
cggcacgaggttttggataatttatttaaaatcctctcttaatagactgtgggttgtattaactgcatttaataccagaatattcttacaatgtactgaaaatccagagtgcagggagtatactctctctggtcttcttccccggtgggaaccacctaagtatgtggcctgtcattgttcttcttgatacttgctctcataatttgtttgaaactggctgactttgcctgaaaaaagtaataaatacaaataagcaactttca

SEQ ID NO: 487388 - DNA, 170 bp, Homo sapiens
aagtaagcttgtatgagaggtcatgactttcatgaaggcgttagagctgtttaattgataagcccagagtccaaaatggaaccagctgatctaaaggagtctctggggaggtgtgaatactccctttaggtctttgggacgcaggatttgatatttgaggcacaggcttt

SEQ ID NO: 487389 - DNA, 99 bp, Homo sapiens
agggtggtcaggtacaatgaaaccaaactggcgggatggaagcagattattctgccatttttccaggtctttgagtgcacgtcaaatctggggctgatc

SEQ ID NO: 487390 - DNA, 750 bp, Homo sapiens
  misc_feature (569)..(569): n is a, c, g, or t
gggatgtaaagaaattggaacatttgaaggctgttggtgggaatggtaaaatggtgtaactgctatggaaaacagtataatggttcctcaaatagttgaaaatagcaccaccacagggtctagcaattccacttttgggtttatacccaaaagagttgacagcaaggtctcaaagagatggctgtatatctatgtttatagtgttattcacaatagccaaaaggtggaagcaacccaaatgaactggtaagtaaaatcaagtatatacatacaatggaatattattcagcttttggaaagagagggaaattctgacacatgctaccacatggacgaaacttcaggacatcgtactaagtgaaataaaccagtaacaaaaggctaatatgtatgattctacttatatgaggtacctaaagtagacgaattcacagagaaaaagtagaatggtctttgctaagactgctaggagagggaaatgtggagttatttaattagtatagaatatcactttgggaagatgaataaagttctggagatggatggtagtgatggtggaacagtaatgngaatgtacttactaccattgaactatataattaaaatggttaaatttcatacacatattatcacattatttaaaaaggcccaatgcttaaatgtaggcctaacttacaaaactctttgagtaaactaagggacttattatcttggatttgcgatgaattctttgtatgaccccagcaccgt

SEQ ID NO: 487391 - DNA, 139 bp, Homo sapiens
ttgcagccgtcatgcttgtctctgcccctccctgtttgcggcggtcgtgtctgggaacccccttcgctgtcaggctcccggccagtgactggcagtgtctgcagtcgctccgctgcaacggggaacgtggcggtgagca

SEQ ID NO: 487392 - DNA, 201 bp, Homo sapiens
  misc_feature (72)..(72): n is a, c, g, or t
  misc_feature (88)..(88): n is a, c, g, or t
cataactatgcctgatagctgggcatgagtcaggctcacattcatgaggtgattccccccaggccagaagcncgacatcttcatcgantttgcccgcgccttcaaccaggacagctaccccttcgacgggttggggggcaccctagccatgccttcttccctggggagcaccccatctcccgggacactcactttgacgat

SEQ ID NO: 487393 - DNA, 252 bp, Homo sapiens
cctgtggagaggggtctcatctcctctctcactcagactgcaagggtgagaacatgattcatggggaaataaacacaaggtcctgggctcaaggtgtcctcccacctcagcctgctgagtagctgggaccacaggcacacaacaccatgcctggctaattttttttttttttttttttttttaatttggaaacaagatctcattatgtggcccagggggggtctgagaagctctgtgggctacaggagcaac

SEQ ID NO: 487394 - DNA, 176 bp, Homo sapiens
ttctagaggatcccatcaagcgcgttctgcgtggggtgtgtgcgtcgggtctgcatgatgagccaaaatatcggacgggaaacttcgagagaggatgcagctattagatggtcggattaatctttcggccgtatacccaggtcggacgacgaatgtgcatgctgaatgcgcctctt

SEQ ID NO: 487395 - DNA, 211 bp, Homo sapiens
ctttctcagagatattttagtcaacagaagactttttaggtctggagacaagcgtagacaatgttactaacccagaaaaaggatacacttgggatgatacattcacaggaggagatagagataccggtttctctatagaacagggaagcatagtagactcccctgtgatgttagagtgtggttggcggctatagatcaagagaaggtctgg

SEQ ID NO: 487396 - DNA, 1241 bp, Homo sapiens
gatccgcgccgccgccgaccgccgccgcgccgccgccgcctccgccgcggaggaagacagcgccgcccgcgcaccgccagcgacccacgaccgaagagtccaccgacacaggcctcgggccagcggccaggagctgcctccaaaagagaaaaagaaaaaaaaaaaaaaacaagaaacaaaaaaaaggagaaaaaaaaaaaaagaagaaaaaaaaaaaaaaaaagacagcagcgaaagagcaacgcaagcagcgaagaccgacaagagacgacaaggggccgaggaagaggaacaaggagagacaaggacggaacacgagaaagaacgaaaaaacagcaaacaggaagacagcccacagagaagaggaaacaacacagccgagcagtggagaagcagggaggaagcgcaaccaagaagaccaagagagaaggagaagcgaaatacgaaagaaagagagagaggagaaagagataacgaacaagaagccagagaaacgagaacgcagagatagcaggagagcgagacagacacgacgcagagccagaaaggcacgaacggagacaaccagcaagagcagaagaggaacgccaaagaagagaagagacgagaggaacaacaagaacaacaaagaaacacagaggcagaagcaacacaggacaccagagagagaccaacccaacagcgaaacagacaaagcaagaaacaagcaaggagaagaaacaaaaaagcggacaacacaagagaaaaggaagaggagcgcgaagaagagcgaagaagacaaaaaacaaacaaagaagacgaagagaaaaacgaaaagaaggaagaacaaagacagaaagaagagaagaagaaaaacaagaaagaggggcgcaacagcgagaacagaaaccgagaagaggaaaaagaacagagaagaggccagaagacgcgaaaaaggaacaagaaacgacgcgccaagagaaataaacaagacaagcacaaggcaaaaggagaagaccaaaaagaagagggatcaacagcagaaaagggaggagaaagccagaaagacaaacgacaacagggagcccgagaaaagaagaagagacgtagaagaaagagaagagcgaacgcagaggcggaagagagagagagacagagcaaggcaaagagacaaaacaaccaagccgggacgaagcgcgaagagcatcaggtaagaagccgcacgaaagaaagagcacgaatagacacgacagtaagacacc

SEQ ID NO: 487397 - DNA, 514 bp, Homo sapiens
gcggccgcctactactactactaaattcgcggccgcgtcgacctcctaaagtgctgggattacaggcatgagccaccacatctggcattattattaaattttattgacaatacacatcagtcaagttatggaatgggagatgttataaaaggtgttcccataaggaaagaaactgaaatgcattgatttgactctgccatgacactctaatgaaatcgaggcctgagcccatgcctaggaaaaatggagtttctaggaggcaaacaaaccatgtaggggttgagagtcaggaggcagacacaggggcagatgcccacatttaaacccaaggccatcagggaaacacagatctgagaaatatatacaaggcacaacgtgacagcaagcatcccttactctaaacttttttctaagcttgacccagtcccaatttaaattactatgtatagtacgctatttaattaaattacagattaaattgaggttgtcgagcgccgtcgatttagtagtagta

SEQ ID NO: 487398 - DNA, 686 bp, Homo sapiens
  misc_feature (526)..(526): n is a, c, g, or t
  misc_feature (587)..(587): n is a, c, g, or t
aactcaaagggaataatctacagcaggaggtcaaatgtgccattgaaaagggggttaactaaatggtcctaataattttaatacctataataatgcttttttcttctaggaacttcagttccaatctggactaaaagccattatagaggtccagggtggcctagctatggatatttcaggtgcaagggagttaacctgggggaatcgtgagtctaaaacccgagtgaaaaataggtaagggttaatgcattatccattaatgaattacatataggactatatccagagaacttccgaaatatgtttggggaattaatcttctgacttttcaaaatctatgcttcctattgggaattataaaccgatagagttggaagtgatcataggaaataattctgcctatagcttcttatgagcaggtcagtacctattatgactcagccaggaattttcctgcttttaaggacatccttagacaggatgccctgtgaatcagatggttaatcttctttgggaattccaccangagaggaaatttcactttaggtaacctttccttcttggtggcctcaactggggaaaataanattgataattcatctggcgagaactaccttttaatggtaagaggcctaagctttcatcagattcctttttcaaataaaacctttaggtcctttaatttt

SEQ ID NO: 487399 - DNA, 198 bp, Homo sapiens
gagtcttagacagtgaggagatcttatccacacttacagcagagaggatgttgaccaggcacatgtgagacggttaaaaaatatagcagatggtggtacatctttgccagaactcgagaggctgagatgggaggatccggtccgccccaatgagtcaggttgcaggagcatatgtgtacgcaccagctgacacaagca

SEQ ID NO: 487400 - DNA, 310 bp, Homo sapiens
gacaacccataattgccttaccgtttcctttcaagggtccatattcaattgaaccaaaaactttgtaggcctggcttccaatggagattatatagcttgtggaagtgacaataactctctctacctgtactataaaggactttctcagactttgctaacttttcagtttgatacagtcacagtgttctcgacagagaccgccaggagatgatacagtgagtttgttagtcctgtgtcctggacggccctcccgcgtggggtgtccatgtcctgattgctctaccatcaggtccatcaggtctagattgat

SEQ ID NO: 487401 - DNA, 866 bp, Homo sapiens
  misc_feature (86)..(86): n is a, c, g, or t
  misc_feature (89)..(89): n is a, c, g, or t
  misc_feature (628)..(628): n is a, c, g, or t
agcggggcgggcgctgcccacccggcggagccgagcggcgtgcagaggctacaagtgccgtagctggtgattgggggactttctcnggnaaccgtgccgggagagcgcgcggtgctggagccgcaccgggtggccgaagcagaagactttccggaagctgctgggggatgtctgactagctctcatggagctccactaccttgctaagaagagcaaccaggcagacctctgtgatgccagggactggagttcaagagggctgcctggtgaccaggcagatacagcagccacaagagctgctctctgctgtcagaaacagtgtgcatccaccccaagagcaaccgagatggaagggtctaaacttagttcttctccagcatccccctcctcctctctgcaaaacagtactcttcagccagatgcctttccaccaggacttctccactcagggaacaaccaaataacagcggaacggaaagtctgtaactgctgcagccaggaattagaaacttcttttacctatgtggacaaaaacatcaacttggagcagcggaaccggagctcgccatcagcaaaagggcataatcaccctggggagcttggctgggaaaatccaaatgagtggtcncaagaggctgccatatctttgatatctgaagaggacgcgatgcatcaggttcagaagccacgtcttcacggaagtctatagactatggttcaatcaggccatctggtacttgagtcctgggatcctgctcgtgatcatctcttacatcgttccaacggaaagtgaaggtgagcccaacactgttgcagcccggagactgggccgcctgcgcaacgcaactgcacaccgggggaccctg

SEQ ID NO: 487402 - DNA, 711 bp, Homo sapiens
  misc_feature (318)..(318): n is a, c, g, or t
tcttgtcctccacttctctccggtgtaggtctgtgtttgtgtttgtgggagaagacatctagggcactaattattaatattttgtggcttgtactcacttttcgtttgggagggggatatttttgtctcttaaaaaaattttaaaaggattctgggggtgtccgggcgggtgggcaccttctttttttgtttctggggggtttgtttaccccattttccccatgtttgttgtttgaaacggtgttaatggaatttattgggttggtgcaggcacaacagggcttgggcccaattgggtgtttttttatgggccgctcnagggaatttttgaaagcctttgccccctttattggtttttttaaggccgaaagttgtggccagtgtcccccatcccgtgagggtttggattggattaacaaggttttggccctttttttaaggggggatgcccggccggccgagtttgatttcttttgggggtttagcaagcaaataaaaggccattcatttttttttttgggtgagggggccgcttggcttttgcagggtttttttccccccttttggccggaggttaagggggggaatcaacggtttttcccaaaagatttggggcgggggggttgtttttttgcccccccccctgggctgtttttttgggttttttcttttggaatgttgggcattaaagggggtgttgcccccctttca

SEQ ID NO: 487403 - DNA, 325 bp, Homo sapiens
ctatagttggctgacattatatattctctaccaaattaccagactaaaaaatatgtgactatcgggcttaacaatttcacatttattttctcaaaagaggtttggcttttattacacataatactgaaattttccatcatgttgggcggagaatgcctactttgctattcctgtggcttccttgggcacgcttttaatttccccgcgctttaaccgttcttttcgcagaacacatgatatgcatgagtgtatactctcacaagaccatagggcgaattagataatgcctgcaaatctatctatctctcacacactcacacacaca

SEQ ID NO: 487404 - DNA, 834 bp, Homo sapiens
  misc_feature (746)..(746): n is a, c, g, or t
  misc_feature (762)..(762): n is a, c, g, or t
  misc_feature (781)..(781): n is a, c, g, or t
gtgacggcccgtttgcagccgccggagctactgcaaggcaaaagccggagtggacgtgtcttttgaaactgctgctctttcacttctcaggcgtcaccgagagctcagcacccaggctgaactctgtaccattgtgaagaatggaagctgatgcatctgttgacatgttttccaaagtcctggagcatcagctgcttcagactaccaaatggtggaagaacatttggattctgaaattcaaaaactggatcagatggatgaggatgaattggaacgccttaaagaaaagagactccaggcactaaggaaaagctcaacagcagaaacaagaatggctttctaaaggacatggggaatacagagaaatccctagtgaaagagactttttttcaagaagtcacggagagtgaaacactgtggtttgccatttctacaagagactccacattcaggtgtaaaatactagacagacatctggcaatattgtccaagaaacacctcgagaccaaatttttgaagctgaatgtggaaaaaagcacctttcctttgtgagagactgctatcaaagtcattcccacactagcactgctaaaagatgcgaaaaccacaagattatgtgtggcgtttactgacctagggaaatacagatgacttcaccacagaaactttagaatggagggccggttctctgacattcttaattacgtggaatttatggggccccatttcgaaccaaagaatgtggnccacttccacagtggncagaaacatcgggaaaatnttcgacccgtgtgtaggccacaatggaaaggttcgtgaaaagggggacattat

SEQ ID NO: 487405 - DNA, 999 bp, Homo sapiens
  misc_feature (342)..(342): n is a, c, g, or t
agaagttgcagtgagctgagatcgcgccactgcactccagcctgggtgatagagcaagaccctgtttcaaaaaaaaaaaaaaaaaagagggttttttaaattaagggtagttcctatgattttaattattagcggctggtcaagtagaaggtaagaattacatagcgggggttaattgattttccaaagaatggtaacttgtgaatgggacagtttttcgggatgcttttagacgtgggccttagacgtgagcagacattgaggggatctaaatcgcaagcaaaggttcgggggtgaaggagattattttgtgcctccgagcttgtgtgagggcataaaagnggaccgtaatgaatctcttgagattgctgggagaactttttgttttgcggaaaggggcttacgtgggttgtgtctctttttccatgggcaccgctggaatgtattggctcgctggcgtgcgagcattcatactctggttcccttgatgtccgaggatgtctcattttccttcccaaagtgttttgaagagatcagcggcttttcggccggggcgagacgacgcgtgggcgcattgttgtatctcctcggggccgtgggggtgctttcgggggcctttcaggggttcatcgttccgacgtggggggtatgttctccccttttccacgaggtggggactttctccttttgttggcgcgtgcgcccaacggctgtggttcaattttataaccctcttggcattcggacattcgccctgcagagaggggtttacacgttttttccgcgggacccagcgggcgtgccgttgttgtgaccgcgcagggattggggggtcccttgttggaccactgggtccttaaccaggagggcgggcgtgtagaaccttctccttttgcgggagacaagggctcggctcccccagggctggccccacaggggggggggcctgcagataaggtttatccctcctgcgcccaggcccttgcgtcacaggggctt

SEQ ID NO: 487406 - DNA, 314 bp, Homo sapiens
atgcgctgtgcagcccggacgggtgccaaactgcgcttggcgcgtactttagcgcgcgatgcgtggcaccttaagcagagataccgtatactgcattagtacgccacgactgcttgacgaatgaaaatacttttaccgacttgaacgaacacctacaccagattaagacaagggatttttaaaataagggtgcctacgcatgtaaataaaattaacaggatgcctgcttttgggaaccgtgttaggctaaacgattaaccacgaacgcgccgagcacgagttgaacgtgatggcgaggcatggccgctgacata

SEQ ID NO: 487407 - DNA, 134 bp, Homo sapiens
  misc_feature (22)..(22): n is a, c, g, or t
  misc_feature (27)..(27): n is a, c, g, or t
  misc_feature (32)..(32): n is a, c, g, or t
  misc_feature (52)..(52): n is a, c, g, or t
  misc_feature (85)..(85): n is a, c, g, or t
  misc_feature (108)..(108): n is a, c, g, or t
tatagaaatgatcagttcattncggtnaactntaataaagaatggtatttcnatacaaggcaagaacatttattcattataattntgtggtgattagaaataaacatntgttttaatgccaaatctagtagttg

SEQ ID NO: 487408 - DNA, 739 bp, Homo sapiens
  misc_feature (328)..(328): n is a, c, g, or t
  misc_feature (345)..(345): n is a, c, g, or t
  misc_feature (557)..(557): n is a, c, g, or t
tggggagtggggagaaatgtgcggactagagtggaagataggggcagccgctggggccttgccacgtcccatgacattagggaaccagccattgacagaccttgggtcagaagcagagataagagacatgaataagaacatgatctcccctcaaggagatcctgggcttgttgagggaacagcctaggaaaaggcctatcctcttgagtcctgggctcgaggcaccactgcacattccccaattctctgagcaccaacaaagtctgtgcagaagcatctaggaccactgctcacacaggaccactccaggcttctttctcctccttgngccaatctttcctttgntctcaagatggcacatctgtgccaggctccagcgctcatctcccgggtttggaggggaagcacagtttacctccctacacagcccactctccaggttctgtgacccactgctttagctgtggtctcaacaccttgctttgtccctcacacccctgcccatgctaagggtccagggaaagaatgttgccaggggcaccaaacaagcaattggncctgaatctgatcaaggattactgctaatctcttccttgaggaacatttaatacaggatgccaaaaaagagaaatctttagagaattctctcacaagatcacaccttaggacttgtactcggaacatgcagggccctgacccagggagcagcaggaatagtactcactctgagcccacattg

SEQ ID NO: 487409 - DNA, 193 bp, Homo sapiens
  misc_feature (50)..(50): n is a, c, g, or t
  misc_feature (52)..(52): n is a, c, g, or t
  misc_feature (170)..(170): n is a, c, g, or t
caatgatgtcttggtcaagtgaagaaacaggtgcagagagttgagtcctngncaaggtatgccattagcaaggggttggaccgagagtcaaatgcagactaccgaagcatctgaacaagtcaaagatatggaggcttaatgggagtcagcacttgtggcctcagcatgangggcaaggcgtcggctaactttt

SEQ ID NO: 487410 - DNA, 161 bp, Homo sapiens
ggacgatgtggcgcccctacgtatcatcagtgctgccaaggttggcgctacatgacgtcggaggcccgctgttcgtgctggagaagagcttgccattgacacgcagaattacctggagcagcagctgggcaagcccctcctgcgcatcttcgagcccatcc

SEQ ID NO: 487411 - DNA, 426 bp, Homo sapiens
tagactcaaataaatagactccaaataatagaacattttaatacctccatgtcagataagtataaaaatcctggcaacaaaaacacccaagaaatactggttgaaacatgtttataaaaacttctcaaaatataaaagcgaatgcttatacactgttgatgggaatgtaaattagtacaacctctatggaaaacagtatggagatttctcaaagaactaaaagtagaattaccatttgatgcacgaatcccactactgagtacccaaaggaaaataaatcattatattgaaaagacacccacacttgtatgttaccacagtaaagttcacaataacaacgtcatggaatcgatctaagtgtctatcaagagatgactggataaagaaaatgtggtatataaacaccatggaatatattgcagccat

SEQ ID NO: 487412 - DNA, 162 bp, Homo sapiens
gggtacgcatacatacgtatgcgtgcgcatgtacacattttgcacatgtgtacgtgcacaatgagcggcacatgcagcacgcgcatctcgtctggtggcaaggctcacggcttaaactgtgacggctttcaccgtcaccgtactgtatacctacgtacactg

SEQ ID NO: 487413 - DNA, 219 bp, Homo sapiens
gcaattctcctgcctcagcctcctgagtagctgggattacaggcgcccgccaccactcccagctaatttttgtatttttagtagggacgaggtttcaccatgttggtcaggctgttctgaaactccttacctcaaaatctgacctccttgctctttcatactgctgggtttactggcatgatttagatcatgctctcttatttaaaagtgtgtcgagtg

SEQ ID NO: 487414 - DNA, 736 bp, Homo sapiens
  misc_feature (582)..(582): n is a, c, g, or t
ggttgtagtgttgtggttttcagcctgttgctgctgctgctgtatgctggctaggggaagcgtcgtggggaaggatggtgtgcgaaaaatgtgaaaagaaactgtggtactgtatcactcccagtatacatggaacgatggtgctcaggaataccacagaaagtggtaggcagagaataggctgagatgaatatagtaaagctttgacttcaaaaaaagcgagattttgatccatatgggaagaattagtgctccactctgtagaattgtgtcaaaaagattctgtgacacggcacatccaggttcctcattgactggcacgggctgtgacctagaataaaggcatctgtgcgatgtgtggtgaacacaaggtttaggaaagtacgcaaaaaaggtgaccaagcagaacatctgtcgtagatgtatggatggaatgtctggctttctaaatgatttgacttgctgccttgaaatgtgacaacggccttgatgttcacttagcagaataacctgtctgagagatgcttgagtttaacaccagaggaatttgattgtgtactcatattgctcttcatgtacganataagcaacgggtgtaactaggtcgtattgcggtaaactggttggtttgccctttataagaaatttaaagaactaaagtggggacatttccatgagaatattgctcagttcgtggattgcaggttgatttaacctttatcatttaattgtcccc

SEQ ID NO: 487415 - DNA, 471 bp, Homo sapiens
aagatttcgggctatcttctctagcttagatttcccccccaccccaatggcctgtttccagattccccatccccagtggtgtttccttactccaggcccccagtggaggttttttgcatgaagattccccacaatcttaccaaagaatttaaatatgctctggtttggggtctctttgttaaaccccatcctcaaaaagtgggtaaagcccctacgttggaggatgaggatgtcattccaattgtgaaaaagtgaaccctttcccttttcccatttgccgggggaacccccacagggttccccatggtcaagccccccacccccgttctttttggttttggcagtccctggatcaggatcccggggggggagatggaggccccccaactggaacttcttttgttttcccttggggtccccctgtatgtcgaactgcctaaaaaatttggtaggctggtccgctccctgcca

SEQ ID NO: 487416 - DNA, 224 bp, Homo sapiens
cctcacagacggcccggctaatttttgtatttacagtagagacaggatttctccgtgttggtcaggctggtctccaactcccgatttcaggttatccgcttgccttagcctccctaagtgctcacattgcaggcgttagccgcgaagtccggccagatcctaggtttgtgattacgagattggctaggtcagcttgttgtcttgagcgggcgcaggctgtgagg

SEQ ID NO: 487417 - DNA, 82 bp, Homo sapiens
aggtgatgatctcatcgccatgcttgttgacagtgcgagtctgagttgccgtcagctgcgattgttcctgggctgcttctcg

SEQ ID NO: 487418 - DNA, 398 bp, Homo sapiens
ctgggattatgaatcaggacgagccgtgtgtgttagacaggaacttttaatttttttgagacaggatctttctctgtcgcccaggctggagcacagatggtgccatcatagctcattgcagccttgacctcctgggctcaagcaatcctcctgtctcagtctcccgagtagctgggactacagacgtgtgccaccacacccagctaatttttgtatttttttgttgtaaagacggggttttgccatgttgcccaggcgggtcttgaactcctgggctcaagcaatccgcccacattggcctcccaaagtgctgggattccaggagtgagcccctgcacccagcctagacagcaactgttactaagtggccaaccagacctgcagcaaaggggctgctc

SEQ ID NO: 487419 - DNA, 721 bp, Homo sapiens
  misc_feature (29)..(29): n is a, c, g, or t
  misc_feature (66)..(66): n is a, c, g, or t
  misc_feature (78)..(78): n is a, c, g, or t
  misc_feature (89)..(89): n is a, c, g, or t
  misc_feature (98)..(98): n is a, c, g, or t
  misc_feature (115)..(115): n is a, c, g, or t
  misc_feature (121)..(121): n is a, c, g, or t
  misc_feature (132)..(132): n is a, c, g, or t
  misc_feature (151)..(151): n is a, c, g, or t
  misc_feature (171)..(171): n is a, c, g, or t
  misc_feature (186)..(187): n is a, c, g, or t
  misc_feature (214)..(214): n is a, c, g, or t
  misc_feature (218)..(219): n is a, c, g, or t
  misc_feature (236)..(236): n is a, c, g, or t
  misc_feature (241)..(241): n is a, c, g, or t
  misc_feature (243)..(244): n is a, c, g, or t
  misc_feature (254)..(254): n is a, c, g, or t
  misc_feature (257)..(257): n is a, c, g, or t
  misc_feature (277)..(277): n is a, c, g, or t
  misc_feature (283)..(283): n is a, c, g, or t
  misc_feature (285)..(285): n is a, c, g, or t
  misc_feature (299)..(299): n is a, c, g, or t
  misc_feature (301)..(302): n is a, c, g, or t
  misc_feature (316)..(316): n is a, c, g, or t
  misc_feature (318)..(318): n is a, c, g, or t
  misc_feature (333)..(333): n is a, c, g, or t
  misc_feature (355)..(355): n is a, c, g, or t
  misc_feature (363)..(364): n is a, c, g, or t
  misc_feature (372)..(372): n is a, c, g, or t
  misc_feature (380)..(380): n is a, c, g, or t
  misc_feature (435)..(435): n is a, c, g, or t
  misc_feature (475)..(475): n is a, c, g, or t
  misc_feature (710)..(710): n is a, c, g, or t
cgggatcggatacttcgtcttcggtcgcnatgtttgtgctttggagggcttcctgggcactgtagnaggtctggttanaggatggtcantggccttcntggcctttgagcgctanattgtnatctgtaagcncttcggcaaattccgcttnagctccaagcatgcactganggtggtcctggctanntggaccattggtattggcgtctccatnccanncttctttggctggagcnggttnanncctgagggcntgnagtgttcctgtggccctgantggtanancgtgggcaccaaananngcagcgagtactanangtggttactcttcancttctgcttcattgtgcctctntccctcanntgcttctnctaaaatnagctgctgagggccctgaaagctgttgcagctcagcagcaggagtaagctacganccagaaggctgaacgggaggtgagccgcatggtggttgtnatggtaggatccttctgtgtctgctacgtgccctacgcggccttcgccatgtacatggtcaacaaccgtaaccatgggctggacttacggcttgtcaccattccttcattcttctccaagagtgcttgcatctacaatcccatcatctactgcttcatgaataagcagttccaagcttgcatcatgaagatggtgtgtgggaaggccatgacagatgaatccgacacatgcagcncccagaaaaaa

SEQ ID NO: 487420 - DNA, 415 bp, Homo sapiens
tccagctactctaagactgagcaggagaatggcgtgaaccaggttggtctcaaatgcctggactcaagtgatcctctcgccttggcttcccagagtgctggaattacaggcgttgagccccacaccaaggctaaacacttttaaattgggcaatttttctttttattgttgagtggcaagagttcttttatatattctagatacaagtccctaatcagatctataatttgtaaatagtctctcttattcagcggattggttgtcttttcactttcttgatagtgtcctttgaagcacaaaagtttttaatttttataaagtccagtttattcatttttgttgttgttgttgtttgcacttttggtgtcatatgcaataaagcattgcctaatccaggatacaaatatttacccat

SEQ ID NO: 487421 - DNA, 108 bp, Homo sapiens
  misc_feature (37)..(37): n is a, c, g, or t
tgaggatccaatgcttagtaggcaacctcaaaacaanatgataaccattacacacactaaaggacgaacctgatctcttatactagtataagagatcaggtgcctact

SEQ ID NO: 487422 - DNA, 919 bp, Homo sapiens
tgcgattgagaatatcgctaccttgttcaaatgccatccatgaggcacctgtaggctacccaagagaagccttggatctcgaggtggtacacgtgccatatgtttgagcccaagaggactataattacgtctcggattatgtgcgcgttcccctctgaaattagcctctggcgcccagagatagtaggccctcgacattcgtttgtgtaattaccacggtctggcgggtaaggcctcgcaaaaaggtaggatatctgcctatggtccagtaagaggtcatctatgcactttatcaagagatagacagagagggctcactatcggagatcaatactcatacactagtgccctatggaatgcttgaattcttcttcagcatgcattatggacggtaccgtactaagggaaatggtgttatgagtttccgctcagataggggaactcaaggccccaggtaaggtagctaagtttgaacgaatccgcacttttccccagacattgttgttatcacactctggtcctggggaatattcaaaccccgtttttaaccgactctagatgttctgcggctaagaagtaatcaatgcttcatgttcatggcgtggacagaattgcttacctgtttaccatggacttgctccagagtttaattcgcgaatcgtctccagagtgaggctatttgagtccaggccttgattgaatagccccttcggtttttctcacggccatgtgacaggtgcacgggcacttgtccttaagggcttgtgtccatcctgcattttgccgttgccttgcgatatggcgcagtatcccaaaaatcaattatcaggtgcccggttaccgaccagaaggcaagaattttacgcccacgggggtggaatttgacatgtggacctacacagacaacgaccgtgtacgg

SEQ ID NO: 487423 - DNA, 192 bp, Homo sapiens
agagtagtaatagtacgaacataaaaataaaatatgtaatctatcacaaacagtcctatatgcagaataatagtaatataccctatacataaaaaagcgtactagaagtatataatctaagtagtaaaaaaacaatagtacgtaacactagaaataatactacacaataaaaatacaataaaaatatacaga

SEQ ID NO: 487424 - DNA, 169 bp, Homo sapiens
actgtatttgggaaattgtttaaggcaggatgcttgcttgtgagaggtctcctcttgtgttgactctgagatgccagagtcacgttgcttcgtgacaccaatttgaactggggttcactgttggcaccccatggctgccccaggtcagaaaaggaaaggccaagattcc

SEQ ID NO: 487425 - DNA, 84 bp, Homo sapiens
actgaagacagtgccacttactactgtgccttttcctttccctctactgggggatatattgaggcggacaccgataaactcact

SEQ ID NO: 487426 - DNA, 253 bp, Homo sapiens
agccccggaaaactagccgacggcttctagactggacagggttattttttattttttatatatgaaagtattggggaagtatgtaaattctttatatgaaactatctagttcataaatcatagatttcatattactcagtgcaactgaactgaaagttcagaagagtcattcatattgttccaagtttgtaatggttgtcacatgtcacatctgtcttttcagtaagtgccagagtgttttccactgtttctg

SEQ ID NO: 487427 - DNA, 129 bp, Homo sapiens
tgggtcgaccgtgcttacaggctgtctgtcatcagcattgtgtgcatttcagtattacacatgctagcgatcccattccagtgagttcaccctctaaatcaccacggtcaacccacaagccacggtcaa

SEQ ID NO: 487428 - DNA, 679 bp, Homo sapiens
ccacgaatgtgcgtgaccgtggcgccatcgaagacatcgagcgaccgcggtagcgccaaggaagccacgatcaagcgttgtgaagacaacaactccaccatcgccgcctacctggccggccaggtcgacctgatcgccagtggcaacgtggtcatggtggccatcagcgaacgcaaccccaagcgcgtaccggcactgaaggtgaaactcaaggattcgccggtgtacgtaggcgtgaacaagaacgagccggcgccgttggaaaaggtcaaccagatcctggtcgcggccaaggctgacggtagcctggagaaaaacgccatgcagtggctcaaagaaccgctgcctgccgacctctgacgcggagctcaacgatggcctatcaattcgactttgtgccggtgctggccaataccgacctgctcctgcgtggcgcgctgttcacccttgagctgacggccattggcgccaccctcggtgtggccctgggcactgtcggcgccgtggtacgggcgtggaagatccagccgtttgcgtggctctttggtgtgtatgtcgagttgatccacaacacgccgttcctggtgcaactgttcttcatcttcttcggactgccgtccctgggattgaaaatcaccgaatggcaagccgcgtgctggcgatggtaatcaactggggg

SEQ ID NO: 487429 - DNA, 233 bp, Homo sapiens
cacccctcatgtgtaatggaacttgcgttccgccctacatgcacccatggtggcaatgtgatctgtgcttggaaatcaactgtggttgtaccctgccagtgctgtgcaatgttggatgcatgccccagtgatggggggcactaaggtgtacatatgtgccctgatgtcaaggctccccatgcatggaagggatggctccatgtggtaatgacatgggcttggcatgtgagcat

SEQ ID NO: 487430 - DNA, 220 bp, Homo sapiens
gacgaagccgcttgcgaacaaggcggcgagcatctctacatagaactgtcccacgttgtaggctacgtcgcgcgcgcgcgcgagaaacgtcttcatgctagtaccccttctgtacgttcacgagcttccgatcgtcgctgatcttccacacgtcgaggggcgcgtcctccttgaggacgcccacggcgaaaatttcgaagccttctttggggttggggca

SEQ ID NO: 487431 - DNA, 91 bp, Homo sapiens
agggggggggggggggacccccacccttctgcaccccagctgagcgcccctcgcggctccccacttgttacctgctttataaatatttctt

SEQ ID NO: 487432 - DNA, 352 bp, Homo sapiens
cgtcgcgtcatatatggttcacactgcactgctcgccctcttaagcagaatggctttcccccctgggtgtggtctgctccacgtgttctcctcacggactcctgcctttctgccggccttcctgtcgggtcgtcactgagttggtgattgctgactagttttcccatactgtgcgcttcaagttcaggctcatttcaggtaagccaaggtatatgcagagtgacctcacctgagatgtgcttaaactgagtcaccctgggactacttagtggacactaagtgggtgtgggtgagtcagagcccagtagtagggagcggacgttaatagctgtatacaggtgacatgccttgg

SEQ ID NO: 487433 - DNA, 883 bp, Homo sapiens
  misc_feature (118)..(119): n is a, c, g, or t
  misc_feature (127)..(127): n is a, c, g, or t
  misc_feature (129)..(129): n is a, c, g, or t
aacagcgcagccgcctgagccgagcccgccagaatctcagccaggtccctgaagctgactcagtcagcttcctgcaggagctgctggcactaaggctggccctggaggatgggtgtgnncctgtggncntggacccccgagggagctcagcttcaccaaatcatcccaagctgtccgtgcagtgagagacatgctggccgtggcctgcgtcaacctagtgggagcagctttgagggggcctgggtggcaacgagggatgtggccacatgaagctgtcactcggaagctgatgctgagcccctaagacctcgagagtacgagcctcttggagagtgaagctcccaggcactatttcctcaagtttgcctatattgtggatttggaccgcgacacagtgagacaagttcctgcagctgtttggaaccagaggtgtcaagagggtgctgtgtcctatcaagataccccttgtcggcccaccccgcttcacccattgtgagctaggtgctggggcgagggtgcctggaccgaggcagctacatactgtgaggtgcacgattatctgacgggctggtcagcatgggggtcatggccgacgatttctcccacaagaggcctatgaccggcgggcggcgtggtgccgccgagcccactccgttgctggccttgcgaggtgtcacttggaccgcagctttctcccgtgcttggtttcatggcgctggaggtcccccttgcccagcccttctcggccacgggtggggtctgctggaatacgctgaccgggccttgggcttctatgcttgtaccgggacgggaggatgagcttctggggggggttggggggcgctccgggccccgccggggttggtcccgggcctcccctttc

SEQ ID NO: 487434 - DNA, 109 bp, Homo sapiens
tctcatactccactaagtaggccacatctttcataagctgccagctgatgggctcattccacatactatcttgtgtgttattcttctaagttatactttgagggtttaa

SEQ ID NO: 487435 - DNA, 971 bp, Homo sapiens
tacgggggtcgatgaatccggcccctcgagtctcttcgtagtgagcacctgtacacaatatctaatgacgaagggtttcaccaatatactgtatagacgatgtactattgatgacacactgcaagaagcagctggagaaggacttcaagagcatggaagaagtactgccagtcatccgcatcattgcccacactcagatgcgtctgcgttccatctacagccagaagaaggcacacttgatggagatccaggtgaatggaggcactgtggctgagaagctcgactgggcccgagagcggctggagcagcaggttcctgtgaaccaggtgtttgggcaggatgagatgattgatgtcattggcgtgacaaaaggcaaagggtacaaaggggtaaccagtcgttggcatacaaagaaactgccccgaaagacccatcgaggtttgcgcaaagttgcctgtattggagcctggcaccctgcccgtgtcgctttctctgtggcctcgagctgggaccgacaggctaccatcaccgaacagagattaacaacgcaagatttacaagattggtcaaggctacctcatcaaggatggcaaactgatcaagaacaatgcatctactgactatgacttgtctgacaagagcatcaacccactgggtggctttgtgcattatggtgaggtgaccaatgacttcatcatgctcaaaggctgtgtggtggggaccaagaagcgagtacttactcttcgtaagtccttgctggttcagaccaaacgtcgggccctggagaagattgacctgaagttcattgacaccacctccaaatttggccatggtcgcttccagaccatggaggagaagaaagcatttatgggaccactcaagaaagatcgcattgccaaggaggaaggagcttgattccaggaccactttgtgcagatggtggggtcacaccaataaaatatttctactca

SEQ ID NO: 487436 - DNA, 1141 bp, Homo sapiens
atctacgacgcgaggacgcccgatcaggtggtggtggccctgtatgcgccctgagggattctacatggcctccggagatgtgtctgggaagctgagcgcatctgggtataccgacagccagaagggagcacctgtcgaactaatgagtagccagtcctgtatcgctgggacgatcgatggacattgcgttgtggctgaagacagtgaaggaggatcgtcgcgtggttcgggggaagagtaaggtgcagagacgtattgcgcagtcgagtacttcgctctgggactcagtggactctctcgtgatggagtcggacgatggtaccaaggagctagcaaatcaaagattactcaaagctagcgtgtgacatcaacgcgagagccgggccatatcccggcatggggccatggagaagcatatgagtgcactgcagtcggcatgctttgacgggacgccccattcgaatgtactacgttcgacatattggcgagcaacatggcgctattgtcaacatggtgtagcgatttcctctacctgatgggaagcaggactccggcaccagccagtgcttgatcggccgatgatagtgaccatcctagtgagcggggacagaactgagggaggcaggggtgtggcgccgctggtgcaggaccgcgagggcccatggactggtgcgggatcttacgctaggtatattgggcagtccccgaagaagcagaccatgtaagcctggctgcttgctggaggaacaatggtgaccaagattgggacgtcagcgtgacttctgtgagtggcgacctgccgcgtgggtctctcacggtgttgggccaacagatgggttgcgtattggctacgggcccctgagcaaggggtcgcggcgcggacattgatattgtggccagaacaaccctcgaatggcgtgcggggaagggcccgggaacccggcacggttggccgggtaaaaaggcgaggcgtacttgggtgggacccgcagagacctagttctcggttcaaaagggagaaaattggtgaaagacgacacaggagggataggctaggacggacagtagagcgagagacaccacaggcgggaagaggatcacaagaaacgacagagatatgatgaggacacacacggaggaa

SEQ ID NO: 487437 - DNA, 1007 bp, Homo sapiens
  misc_feature (1007)..(1007): n is a, c, g, or t
cacaatgtgtgatcatcgttcatggtcgcaaccaagaggccactccaatcatcatgggcgatagtgctgtacatcagccttgtggtggcggaatatgatatttcatatgtcgtaccatgcctatatgtccttagatataccacagttgaggatgacattgaattgaaacgtcgacattctagccaaggtgatggtgtagacttaggatctcacattgtctacgctctcttacaattctttgtacacggcaaatttagcatggcttgaatctatctaagggaatagaatggatgctcttagcagtatggagaagatttcccaaagatggtatcacagggcgggttgatataagaaaaggaacgggagtaactagaaggaactgagtggtacgtagagaagctacagaggatgtgcaagatggcaaggactccctacagaatgtcctagtggctttataaacggaacctaaaaggaccatgaaaaaagttctgatgttcggacgtagtgattgaaaggagagaaactgaggtgacagaaatgttgaagacttcaattaccctgaacttataagcgaagacggttgcaacatgtgcattgtgacgagtttgtggagacgattccgggtgaggagaatggattggaagtgaattcgaagggactgttggcggaacatgaaacagacagaaatccctacatatgaacgcggtagctgggaattgacgaactcgagagactgaaggtaaagtagggtcgcatggagggaaacttggcctttttcattccagcacgattcgccactgttccgtaaagaatatgggcaaaactagcttagttgccttggggcaatgttgttcaatggtagagtttttgtcccttcacttgggcaatattccactccccagaagggctctattgtttctgggactggattatggcaagattcgcataaatccggaacttggtagcggcggaaagctataaggggggtaacgtggtggaacactggn

SEQ ID NO: 487438 - DNA, 305 bp, Homo sapiens
  misc_feature (61)..(61): n is a, c, g, or t
ggccgctccggtaacacttacgcattagaattggtgaagtcagagttaaacattcacatgntaatgagtgtgtggaaagacaataaaccataaaaaaataaatataaacaaaaccatttttacccaattttaaaagcaagcttatggtttaaaaccttcaaaaaaaaaaaattgagaaaaaaattctcatagcctctagaacccttttccgattccattactttttctctttggctcttccctgtgaattttgggctcgtaacaatcttttttcccttatacgctttttccaatgtgttattttg

SEQ ID NO: 487439 - DNA, 431 bp, Homo sapiens
cctgcttgggtgtcccagcgggcgccctccatgaagagtccgtggaggtatgcaccttcccttggcgggtgtccataatcttcctttgtttttttggtaacatcagcagtcaagcgcgttttatccaggggccactcattttttcgagccatcgtctgcatgattgcagttaagaaggactgagggttgaagaagccggatagccacacgacagccggaagggtaaggtcttgtgtccaagtatcgagttctcgggcatcgcaggaggaggtcattgaaccactggctaggccataagtagaaggataagccagtttgctccaagtgtctggtaccgtgtcataactcaatgcaaactgctgggcttccacagcaggagataatgccaattcccccttcaaactaaggtccagttgttcaagtgatatacg

SEQ ID NO: 487440 - DNA, 173 bp, Homo sapiens
cagatcagtatacagatctctgtctactgaattcaccgcagctactgagttcactgacaggtgagtgcagtggtacctgtcagaggctgtaggcattgtgacacaggcagttcctcatagtggaaatgacgatgagctccaatgagacacagttgtcacagaacctgatgctc

SEQ ID NO: 487441 - DNA, 926 bp, Homo sapiens
  misc_feature (273)..(273): n is a, c, g, or t
ctcatgatcactatccatccacgattagatgcaactcgaggccccgttctgtttagcgctttatcaccagtagccccccaccactgtgctggtaaacacccttctcacaaaattttgtgtccacccggactctttggcccccgaactttcctatggcccagttttttacgcgccacgtgtgctctgggactccccttgtacatcagcaggggcacaaacaccagacacccatgggttggaccccgaacccatcctgggttgaccagccgacgnccccttctttcagagctacgggcttctagagctttccaggctcttcttcagaggcccttttccacccactgataaaaagggtctctcttccgcgagccctctgttcagcacgcccccgctgggcgcccccccttggggcatcctgaccctttttcaggtattctccagcgcgtgccgcgcaatcgttcgatcgcaatacaacaaggggacacgttggcccccataaggtgtggttacacccggccgcttgagatccaccccgaagctcgtgaatcccccaaaagcgaccacatcgactgttgtcctcccgcaccgatatgtgtggcacgtcgtggtgccttttatcgcccccggctcgggtggggcccccagggcgcaccaaaagctgttctcagattgttgtttcgccgcatgaacacaaccacaggcgtcccatagtcccgccacgacatttcgtgagtgtcttcaaacgggacgccactcttcccaccaggggtgtgagcaaccccccccttgtttccactgttggaacgaaatggcacgccggagtcgcgcggcatacggtgcgcgcggaacagcggtgtcgcataacgcgaattcggcaaggggcgacccccccatccttcgctgtcaacaaccgcccccaaaaaaca

SEQ ID NO: 487442 - DNA, 963 bp, Homo sapiens
  misc_feature (382)..(382): n is a, c, g, or t
tgtcgaggctcgggtttaaatcggccgatgctgttgtgcttgccctggtgcccgagactggaccttctggctgtagctggaacatcatgtggccctatgtctattgtgctgtgctgtggcctgggcctgaactgtcctctgagcctgccctgcatgtgcctccgtgtgtgtcctggggatgtgaagatgacctgagaactgttgtggtgtgtgctgctgaacctgccaccccagtgactgtcccctgaatgactgtcaatgcttgctgtgctgtctgtccacctgtgcctgtgaactgtgtgatgtgctcttgtgatgaactgatgccctgtgccgctcaatgtgtgactgcttgtcttgtgtgtgcctgtgtgatgcctgncagtggtgtgttgctgcctgtgtgttgcatgatgcactgaaccttccctgtcctccctgtgcacaatgaaccctgtgctgcctgccctgattgtgcaatgcccctcctccctgtgtgatgtgtgacttgcctgtctgatgtgtgtgtgaccatgtgcagtgctgtgtgagttggaattgtttgatcgcatgcatggtgatgtgatgtgaatgacaactgaactgattggatgtgctgtgccagctggggcaggcagagccggccgcctcgttctccaagcctgtcttcagtgacagccgcagcctaggacggggcttgaggcgaggctgtgcggtggcgccggggtcctcagtggaggtgccgagtccggcgcgggcgggcggacgccgcgccaccatctccagtcccctggagctcgaaggcacagtgaggccgccacggtcgaccttacccacttttgtcgccaacaacctgcaactcaagatccgtctgagcggggggccctccaccccggtttttgccctttggggccttccaaggcctggacccaccacacgggttcccctgaccgagggtgggga

SEQ ID NO: 487443 - DNA, 605 bp, Homo sapiens
tgaggttaggagttcaagaccagctgggccaacatagtgaaaccgcatctctactaaaagtacaaaaattggccaggcatggtggtgagagcttgtggtcccagctacttgggaggctgaggcagtagagtcgcttgaacccaggaggtggaggttgcagtgagctgagatcgtgccattgcattccagcctgggtgacagaccgagactccgtctcaagaaaaaaaaaaaatagaaaaaatatactcttaagataacaactaaaaatatagtatagtgaatacataaaccagttatatagtcatttattatcgactgctgatgtactatacataattgtgctgtatttcggtgtgactggcagtacagtaccttggtttacaccagcatcaccacaaacatgtaatgtgttgtgcagcaatgttacgctgtctgcgatgtagacttcactgggtaaataggaaattttcactctccatgataatcttatgggaccaccatcatttatgccggtccatcgtctgaccaaaatgtcatgtgtagtgcctgactataaaacctttttctacatttaataatctcagcaagcttagaaccaacaccac

SEQ ID NO: 487444 - DNA, 209 bp, Homo sapiens
  misc_feature (1)..(1): n is a, c, g, or t
ncgttgcgggttggcggtgtaaagatctgggcctcttgtttcatgaataatagaatctcactatgatgtaatatttgtttgaactggagtgctgattattgtaatgcctttaggtgagaaaagccttattatataagtgtatctggggtaactagcttaaatttgacactccagtcaactttttgtccctgacttcagtcctgcattga

SEQ ID NO: 487445 - DNA, 90 bp, Homo sapiens
gctgaggacactgccgtgtattactgtgcgagagacgctgctgtccttccggtaggctgggctgaatacttccaccactggggccagggc

SEQ ID NO: 487446 - DNA, 182 bp, Homo sapiens
ggactacccagtgtatagtgagtgagtttgagaccagactgtgccaacatggagaaacccgtccctactaaaaatataaatcatcagccagtgctgtgtgttgtgtgggttgccttgctaagtcccaagcctactcaggagagtgctgagtgtaaggaagaatatactctgcaacccaagtg

SEQ ID NO: 487447 - DNA, 168 bp, Homo sapiens
tgttccgatgggaggtgtacacactaactctttaagaaactgtccaactgtctgtcagtgtggttgctactagtttacagttcccacccaacaatatatgagacttttcactaatcccatattctctgcaacatttggtgttgtcattttctttttgtttttttgaga

SEQ ID NO: 487448 - DNA, 1615 bp, Homo sapiens
  misc_feature (1615)..(1615): n is a, c, g, or t
aaatgttcgctctatagccctaccatcaaaacccggggagagagaaagaagaggaggacgacgactatgaaggagttggagaactgggctggagtccatggtaatggaggtccagtcgctggactgggcccaagacagacatgtgggtggccatgctgctagtcgagctaggctgtgtgcagtgtgtggaggcaggcatcggatgtggtgcaggcagtgtttcctagtcgcgtatgtcgtacttctcatctcctatagagcatggtcatgggccagcagtagcttgctcaactcatctgccatatgctgtgcgtcctggctaccttgcgtgtaggcatggggctggcgggcgatgggggaggcgaggtcggggatggtggacatcgtgccattgtctgatattatgaagtggttgaaagtttgcgtggtagaagattggagacgtgatattatgtgcgaacactcctacacgaggtttgaagcattcttggaatgatagcagcttgaatgatcccaacgatgcgtgaagtccatctattgggaggaaaggggctctgaacttgccgttgcaatgctttcgtaaaatggacctggaaatatgtaatgcccttccttgtaatcttgggtaaagtgacatgttttggagtgggcctcgcaacaattctgccttttgtagtaacctattgttggcttgggtgactgtggacaggcaaatcgaggttcagtctattttacaagaaacgtcctagtaagggccttatgtctcactatggcccccatttaagccttgttcaatgtaaactggccagttcttggaatttctttggacctttttcccctacctcgaggaaagacggtgggagcgtaatcattggttcctaggtcactctggtttgttagttgggtgcccgtggtggcatgaataacccccaactatcttggtgggccccaaacgtcctcttcaaccagcaccttttggtcattcaccccctggggttctgaactggtgaagagtgtctggtgccaccgtttggcgtttttggcacactgtgcgacatgggggtgacgaaccaccgttggtaggaaacacacacgatgcacgacattggtgtctcgaagactttcacggtatgccaaccacgatatatactggagtttgtcacataaacacataggagcacataaggggacacactcgagtagcccaggagtgccgaaacaacccgggacagtcgaacaaaaccccatcgggtgaaacgaggccgaacaaaatcagaattccacgatgcgagaagagacagcggaggaacacggggcgcataacatagagagctccgaagaagaaaagcagaagagaacagaaaaggagcgggcggcgcccacagaagtccacagcccaggggagaccgcgaagcggacacagcacagccaggcagaaggggccaaaactagagaagcacacgaagcatcagcgacgccggaaaacgaagcaaagagcgacacaagacagcagacgaacagaagacgtcaagagagagagcagcagtcgcagcacacacattcgccgccagcccgacgcacacaagtagaagagcaggaacacacaacgaagcan

SEQ ID NO: 487449 - DNA, 119 bp, Homo sapiens
cagccctgcttcttcctggatacagagaaccagtcagtcattctagtcttctagtccttaaactgatctcgatgacttggaacatagcgattacactgcaagtactggctagacccagg

SEQ ID NO: 487450 - DNA, 1061 bp, Homo sapiens
tgagcggagtggcttcatgcgatcccggtgttggctgtgccgttggtcctgtggtggtcacttagccaagatgcctgaggaaacccagacccaagatcaaccgatggaggaggaggaggttgagacgtacgcctttcaggcagaaattgcccagttgagtgtcattgatcatcaagtactttctactcgaacaaagagatcttactgagagagctcatttcaaattcatcagatgcgttggacaaaatccggtatgaacacgcttgacagatcccagtacattagactctgggaaagagctgcactattacaccttataccgaacaaacaagatcgaactctcactattgtggatactggaattggacactgaacacaggctgactatgatcaataaccttggtactatcgccaagtctgggaccaaagcgttcactggaagctttgcaggcctggctgcagcatactctctatgattggccagttcggctgttcggtccctcattctgcttactatggtctgctgaccacaagtaactgtgatcaccaaacatacacgcatgatgagcagtaccgctctgggcattctcagccagggggatcattcccagctgcacggaccgacaacagggtgaaacctatggcctcgctggaaccaacaggtttatcctaacacctgcaaacgaatcacccaactgactaccttgcgcagtgcaaccgaatgaacttaaacggagcaatctgctgcacctcaaccacttaccttcacctctactctgccactatcccccccttcctccctccacactcgaccaccaacgcgacccggttgcacttcacggcacaggttacgcagcgcctgcacttcaccggcccgaacgcaaccagggaacaacccccgccaacaagcgaactcacggcccactacgcgtgccgcaacgagcttccctccagcacaagcacccgaccaccccgccacccatgctcaccgacctcgcctacaccaccccaccaacacccacccaacacccaccccaacaacacccccacaccccacgcca

SEQ ID NO: 487451 - DNA, 406 bp, Homo sapiens
  misc_feature (319)..(319): n is a, c, g, or t
  misc_feature (371)..(371): n is a, c, g, or t
tcgagtacattgttctcttttggcatcaaaaagctttattccattgggcccaaggctggtgaggatagttaaaaaagctgcctatgggctggagggagaggcttaggcagaagccctattacttggcagggggcccttcagaaagtcgcgtgggctcaaaaggctcttagtcgggctgtgagagtgagcctattcgaagagatacgtcgcccagcccagcctcggtggccacccagccgggggaggtgggtcagggtggtcaccgcatcttctgtgataaaggctctacagctatacgcacaagtcttaaggagacagngtggagctcttccgagggaaatgtcaccgagaacgaagttaggggagctccngcgtgacgggggcaagaacaccacgagggtgcagt

SEQ ID NO: 487452 - DNA, 512 bp, Homo sapiens
  misc_feature (1)..(1): n is a, c, g, or t
  misc_feature (116)..(116): n is a, c, g, or t
  misc_feature (142)..(142): n is a, c, g, or t
  misc_feature (177)..(177): n is a, c, g, or t
  misc_feature (216)..(216): n is a, c, g, or t
  misc_feature (259)..(259): n is a, c, g, or t
  misc_feature (270)..(270): n is a, c, g, or t
  misc_feature (275)..(275): n is a, c, g, or t
  misc_feature (279)..(279): n is a, c, g, or t
  misc_feature (285)..(285): n is a, c, g, or t
  misc_feature (308)..(308): n is a, c, g, or t
  misc_feature (313)..(313): n is a, c, g, or t
  misc_feature (333)..(333): n is a, c, g, or t
  misc_feature (336)..(336): n is a, c, g, or t
  misc_feature (355)..(355): n is a, c, g, or t
  misc_feature (360)..(360): n is a, c, g, or t
  misc_feature (373)..(374): n is a, c, g, or t
  misc_feature (399)..(399): n is a, c, g, or t
  misc_feature (417)..(417): n is a, c, g, or t
  misc_feature (443)..(443): n is a, c, g, or t
  misc_feature (448)..(448): n is a, c, g, or t
  misc_feature (455)..(455): n is a, c, g, or t
  misc_feature (461)..(463): n is a, c, g, or t
  misc_feature (468)..(468): n is a, c, g, or t
  misc_feature (488)..(488): n is a, c, g, or t
  misc_feature (496)..(496): n is a, c, g, or t
  misc_feature (499)..(500): n is a, c, g, or t
  misc_feature (502)..(502): n is a, c, g, or t
nggaaatcccgggatcttgagactttcctaggtggaaaggaaagcaagtctgcagttccttgctaatctgagctacttagagtgtggtctccccaccaactccagttttgtgcccnaagcctcatttctcatgttcagaccncacatcttctaagccgccctgtgtctctgaccccntctcatttgcctagtatctctgcccctgcctcccctaanttagctagggcgtggggccagccacctgccaacccctgccctnccccacggaanggcangganggaaangaagacctgccctcctccaagangcaanggcccacgcatgggcacganggnggtgaaaaaaagaagaaantgttnagcactcccgcannccccccaaccaaccccccgccccangccccctattgcccccanccctccccctgcccctccctgaaatntgtgntctccanccccannnaaacnatattttatttttttttatntataaacnagnngnggcaattaac

SEQ ID NO: 487453 - DNA, 238 bp, Homo sapiens
gagctcctacccatatgtcctgaagcttaggggtgctacaagttgaccactgcagcagtaaagatgactctgaagaatggcgtgggatggatcctttcaaatgcacttgagcagcggtctccaaccacagggccacagtgctggagctggatctaccatgaaagacttgtgaatccaggaagagagactgactgggcaacatgttattcaggtacaaaaagatttggactagagtggt

SEQ ID NO: 487454 - DNA, 1007 bp, Homo sapiens
aaaaagatatcactgcagtaggtgtaagtcttcggacagtcagcatggataacagactgagttggcactctttcctgcccataagcaaagtgttgaacacttcacaaaatattttactgaggcaggcttgacagagctttcagaatatgttcgggaatcagcaaacgcatcggcagctcgtaaggagctcccagaaaggaacttcaagcaacagatgtcccgtgttgcatccaatttaaggcatatacattttcatcatgtcaaggcaggcagcatgcaaacaaaaacaacatcccagcagccagtgtcatcggaaatcagtctggtcaagtgtaatgagccactgtggaatggaacaaaaaagaggagcttgtagcagagcaagccatcaagccacttgaagcaatacagccctctacttgctgcctttactactcaaggtcagtctgagctgactctgttactgaagattcaggagtattgctatgacaacattcatttcatgacagccttccagaaaatagtggtgctttataaataacagctgaagtcctgagcgaggagcccaattttgaagtggtatcaagatgcacatgttgccacaacggggcacgagtgtattcctttgagcaacatgacaacagtagtagacatggctcaaccatgctgaagaagactctgactctgaagctgacggaaggtgattgagtttgagactagaccctcagaaagcaaacaggagtgtagattacactgtcaggttcatgtgtccggtcatagatcttccaaactccctgatcagctgaatagggtcaggaacaataatgacaggacacagaggaagaacggggaacgaaaccagataagaagcaggacaaaacgaggagggagcagagaaaccaccgaaacgacagaaagaccacagggacagcccgagacagaagaagggcaggaaaaagaaaaacgagacacagtcaagcgccaaaaaccagaaaacacacacaact

SEQ ID NO: 487455 - DNA, 120 bp, Homo sapiens
cctataagacggggaaaataatacccccctttcaagattgttgagataactaagtgatataaaacatgtaaaggttaaggtctggccacagtgtagctactcaataaatgataatactac

SEQ ID NO: 487456 - DNA, 1545 bp, Homo sapiens
  misc_feature (1413)..(1413): n is a, c, g, or t
  misc_feature (1545)..(1545): n is a, c, g, or t
gatagggctggctgtctgttgccaataggtcgattgagagcgttcgcggatgagcgggactggcgtcgtgcgtgcgcgaaaccaggcagacatctaatatcgtgcacaagtactaccaccaaataatcggtatgaacagatgctctacaatagcccttgaggccttggctactcagtcctggtccgtgagatgacgctcatatacgactgagattaggcggtaagtttatccatctttcatcgtcgatcccgactcattaacgcaaaggtcacaggatacaggataatggcgtgcctcacctgtagatagactgggtgagtcgaatcatgcctagctgaactgaacacggggccgggacctctttgtggccctgacgtgtacatattcctgatgaagatatttcccatagacgtatctgaggtctctccaatatcatggtgcaacaggttaacttgtctgggatgacaaacaaagctcgtaccatggtacagtgtcacacaagattcacacaatcttggtctaattgtgacactggtagctgttggggtcccaaccggcttgcaattgtacgcattaggcacatagtcgttgggccttatgcctcgtttactaatttgaggttcaatgtggttgcccctaggctttggttcaggcaacacaccgttactctcggggatcgatttcgtgtgccagactacctctaataccattgactgcgtcactcactggggaccttggggtcacttcgccgtcgcgtgccaactagttattacttgttccttagaaactagatcagccccatcgaaaaagtgggatttcctattaggagcatgatccatcctttgtttctgggggcatttagccctgagctctttactttaaccatttcgctcccacagggaatcacacttatatcggataaaatcccatcggtaccataattgaacgaaaagggataggcggagaggtgggctacaagactttggcgcacgcaattcacccgttcgcacatggagactttgcataacttgtgggcaggacatcggggttgtccggactgggcacttcttcataatcgcattcgccttgaatgcacatagaagccctgccacggatggtgttggcattatcataggtccataacaatactggatagaagtgcacataattctggaaggccagcgacccttattgaggcaggttagcttaaccccacatttaccgcatcttacactggttgaccggacatccaaggatttcgagaacctaagaccggaaacgcacagatggtacccgacctaagagggagttccaggcaaacacaatacctgcgacggtcacgcaacagggccccagacgggagcacccacaaaccgaaccaacaagcaggggcaatcggcaaacactcgtcnggttccacaccactccctgtgtaccgacatggcacaccgaaacatgcaccactgcggttggacaatcgaccgacgcacaacactcacgcagtcgcgcactgcaacccccgtggcaacgtacacaggacggan

SEQ ID NO: 487457 - DNA, 587 bp, Homo sapiens
  misc_feature (555)..(555): n is a, c, g, or t
aggctcgggtgtgcgaagagagcaccggggctgaacgggccggtttgctgttcaggttacgtggaaacctccaacgtcacgtggcggaagagctggtcaacatgatccagactcagcgcgcttacgagatcaacagcaaagcggtatcgacctccgatcagatgctgcaaaagctgacgcaactgtaatctgtcattgacgggcccggcttgccgcgcccgtcattctctttcgtgaaacaaaggcgatacccgtggtaaccacatattcgatggcaatcctgccgcggcagggacaacgctggctggcgggaatggtgatgctgacgctaagcggctgcgcctatatcccgcacaaaccgctggtggacggcgcgaccacggcgcagcccgcgccggccagcgcgccgatgccgaacggctcgatcttccagacggtgcagccgatgaactacggctaccagccgctgttcgaagaccgccgtccgcgcaacgtcggcgacaccctgaccatcgtgctgcaggaaaacgtcagcgccagcaaaagctcctccgncaaaggcaggcgcaaagggccagcaagttcgg

SEQ ID NO: 487458 - DNA, 155 bp, Homo sapiens
cagggggccactagtagcattgcaacatcatccgccgtatcaggtgtactcgtaggctcagtagcattaggtggccaattgatttgatggtgagggagggatcgttgacctcgtctgtatatgtaaaggatgcgtagggctaggagggcgatgag

SEQ ID NO: 487459 - DNA, 893 bp, Homo sapiens
  misc_feature (244)..(244): n is a, c, g, or t
tggcgaaagaggaaaattttaatgatagttggtacgttacaaatacccaaaaaactattttctttacaccatttatggtgccagtgaacttttgggtggacagttttcacatataacgtggtaaagtctccgaggcgtgcttcgggttcgttgaccccttacgagaaccgttgccagtgtttagaagccccgagctatttctgcgctcccccgcacgaggtacagaaagcgtggcgtgaactcnttcgtgacagaaaccgcgccagtgttgtggggccccaagtttccccaagcgccaagtgtcagaaagcgtggctcaatcttcgtggcacacgagggttttgggcgcccagttctatcgaggggccgaatttgccctcagagcaaagtggaacttttaagaaagccgcgtgcttcggtggttgccctcgtgggagccaagggagtctgacagaaacgggtgtggtctgtggctcaagagtcttcatagccagggtgagggtttcccaagggctaaaaccgtagaaggtggtctcacagaacctccggggtggacccatggccatgatgtgcagaagcagtggcaaaaaccccgtggggtgtaaacaaacagggctacccggggtcaggctcctgctcggggtcctgaaacccaagggccagcgtgccgtgtatcgcccgtgacctgagtccaggaggcgggtcagacggccacacgaggagtctggaccacgtggtcccacgccttcccagaggaacgccaatcacgacagcatacggctgcagcagaaccgtggaaagtcctcaggaagaggacgcccacgttgcacctccgggcccaaggggctccaggtgaccaggggcacacactgactatatccaggccaaacggc

SEQ ID NO: 487460 - DNA, 226 bp, Homo sapiens
  misc_feature (33)..(33): n is a, c, g, or t
ccccccccccgggggccccccaacacctttttntggtttcccccctggggaaaaaggggaaaaaggggggggggggaaccttaaagggggccaaatcccctgtcccccccgggggggaaaagccccttaaaaaaaaaccaccccccccccccccccctttttggccgggaaaaattttgggggggggaccccaaaaaaaaaaaaaaaaaatcccttttttttccca

SEQ ID NO: 487461 - DNA, 299 bp, Homo sapiens
gccattgcactgcatcctatcaacaagagcgaaactccgtcacaagaaagacagaaagaagaaataaagaaagaaagacagacagaaacacgcaagaaaggaaacgaaagaaaagaaggaaaagacagcagaaagaaagaaagaaagacagaaagaaagcaagacagaaagaaagaaagaaagaaagcaaagaaaagagaaggaagcaatagacaaggaatctggctcttccactgcagaagagggagatttctccaaggtctgtcttcgctgtgaccactgtggctactataccaata

SEQ ID NO: 487462 - DNA, 974 bp, Homo sapiens
ggatttcaaaattataagcataggatttcatatcaggggtgaaagaattatctggcacattaggtattggagggtacacaagaaaagccaaattcacgaagtcttaataacttgttttttaaaccaagaactcaaaggcgcttcatgtccagtgtgtggcccttctgaaacttatggtcatctctcccactcaaacaaggtctttcaaatgtggctaaatggggatgaggaaccgggtaggacttcttggtgtgtgtgcatactttaaagagccaagtagcttcggggaaacagccaggaaaatggtcaagattatattctagaggttatttattggggatttaagaactaataacatcttgagtattataacacaatatcagggggatgtggaaaggtttgcaccactgtcacgtgtacgttgtagcttagtatccataaaggggaaacttagactatagacataactacaaagccagcgcaagcttatgtttacatgaatgtgtagggagaatacactttcacacatagcaagcacatggccctccctgatgtcaggatgcctagtaaggatcctgaattgccctataatttagtagaaatctttttcccttcttcctcttgaaaaagcttccaacatatacgtgatggaatctatcacaactaaaacttggtcccttattacctatgggcagtcacaccaaggcaaaaagcatgaacacagggagagagagagcataacttgctgaaaatcaccacttggaagttcagcagaccacacagagtaaactcgcgagtatagacaacaagcagataagaaaagcaagacaacaaccaacacgaacaaacaacaacagccgacaatgacagaacaacgcaacacacacagaaaaaaagagaaagaaacaaccacagagacacaagatacacaaacacaaaacaagaagcaaacaacaacacacaaaaagcaaact

SEQ ID NO: 487463 - DNA, 204 bp, Homo sapiens
ggtattaaaatccccatatacccataaggtccacctattcatttttaggggaataaaattacaggtcctatgaaattccaattttagcactatggtttttccatgacccataatttatttttaaaaaataaattaaaaggttaaattaataatgcatgtatgtatttctaataattaaaaatgtgttcatcctgaaaaaaaaaa

SEQ ID NO: 487464 - DNA, 357 bp, Homo sapiens
agctctctcgtgtggaggcacgctcaccggtgtctccatgcagccaggcctcctgaggaaggcatcagagcagttccctgagaggacccccaaatggaactatcaggcagattccccaggtatatgctaggcgagattacatgatttcctgcctagttgaagggcttaagaaggcagcatagcaaagcttttaattatagacaaaattaaaaactagccgaggtaaagacgaaaacccagcccaggtcatggccctgcttagcagcgaacccttagacgctttaccgccctagacccagaggggccggagggccgccttattctcaatatgcattttattagccagtcggctcccga

SEQ ID NO: 487465 - DNA, 101 bp, Homo sapiens
ggcgcagtgctgcccagtcctccgatggcgaccatcacgcgcgcctcgcgtgacttggtcaacgcatggcgtgcagccacgccctggtgagctgagttacc

SEQ ID NO: 487466 - DNA, 1218 bp, Homo sapiens
gcctttatgaggagcagtgtctgaattgctgaggagatgtgggaattgcacacgggaaagctgtgtggtttccttttacctttcagctgaccatgaactcctgagcccgaccaattaccacttcctgtcctcaccgaagggaggccgtgggggctctgcaaagggcgcaaggatcactggcatcatctctcagcaaggtgacattattgtgttttgtgaccttggagacctcaggtgtcgctcccttgttgttggttggatgtagggaagcatcccagggagacttcagtgacaatggtttcctcatgacttgagaagacacgaattatattattttaccctttggtggagcccacaagcaagaatgagttggagcaatcttttcatggtgacctctttaaagatattagtgaaggaatctaggttgtattcaggtggacactgggaataaaagcattctaaagcacggatggagaaggacggccacagagacaaggagagaaggcgagagacatgtttgcgtgtggcaagcatcttgagggattggccctggtgacgagttgtacctgacctttcagggggggtggttaaccaggaatgtcttaaaaagcgtgcggggtcctggcacgtggccgggctgtgtttatagggcttacattcaagtgttatgggagttagcatgttaaaaaatgcgctcggtctggcgcactgaggctcggggggcattgacgatgcgggtgagcaggaagatcacaacagtgggaaaacaacaatggggtcacagagaggaccttgcgtctttctcttttttctttctcatctatcatcacgaagttgatacgatcagtgaagagaatgtagcaagagacaaccagaagcataagaggaagacgaatgagaaatggaagagaggacgagaacgagagcgtaagaaagataagagtgattgaagaaatggatgatataggagtgaaacaggacgacagatattagagaatggaaattattaaaggagagatgagatggaaaagaagacaaatggaagaaagagaggataggagagaagatagatatagaagaaggaagaggaaaaagcgatggtgaaagagatggaaagtcgacgaagaagatgagaagaagagtaagagagaaggaggcggaaactagaatagaagagagagagtagaggaggagcggatgtaggaggtggagagaaaa

SEQ ID NO: 487467 - DNA, 401 bp, Homo sapiens
gcagcatatatattaccgcaaggcggaaatagaaattataatcaagcataatatatcaaggactaaacgcctagtaccttctgctgtaatgaattaatccaggaaataactttgcaaggagagccatagctaagacccccgaaaccatacgagctacctaatgaacagctaaaagagcacacccgtctatgtagcagaatagtgggaagatttataggtagaggcgacaaacctaccgagcctgttgagagttggtttgtccataatagaatcttagttcaactttaaatttgcccacagaaccctctaaatccccttgtagatttaactgttagtccaaagaggaacagctctttggacactaggaaaaaaccttgtagagagagtaaaaaatttaacac

SEQ ID NO: 487468 - DNA, 109 bp, Homo sapiens
tgggttaccgtgctgtaacgtccttgttgtcagtgcagaataagttacgctatttagaacaaaggattagtatcaaattttgcgtgaaattgaacaatgccacggtcaa

SEQ ID NO: 487469 - DNA, 240 bp, Homo sapiens
tgaacattctgtgtcccgtgtttattataataatgtttgtgtattcaggctatgaagaattgggcgaaggggcctgcggagtattacgatgttgaatcctgagactagttcggactccccttcggcaaggtcgaacggggtacggccgggcggtgctagtgtggagataaatcatattatggccaagggtcatgatggcaggagtcatcagaggtgttcttgtgtggacacgaatgttca

SEQ ID NO: 487470 - DNA, 331 bp, Homo sapiens
gcaggagcaggcgagggcaggtgtggccaccaccctagccatctaatcacttatacatattcattttaggatagaaagagtggtagagcagagcctgaccctaaaaagaaagccacatttagggctatcacctccaccctggcttccagcttcaagaggcgtaggtcctccaaagacacgagcaccgggggtggacgcggcgctttgcaaaaccaaaaagacacagtgctgccgcgacgcgctattgagagggaggagggccagctgcagctgtgttcccgtcatagggagagctgagactcccggtgcgaatgcgcgtcgcgcgcgcgag

SEQ ID NO: 487471 - DNA, 250 bp, Homo sapiens
tactcggccctcttcagaggtgccccgggctgtgctggcgtgtgcacccaggtgggaggacaaatcccctccatggctgagctcatgaatctgatttacagaaagcccaccctgctccctcacggtcttcagcatggaaagcggctcagctgctgtgtgagttcccacggctcacccttggcatcgttccacggcaggtctcggtcacccacaacagtccccggttctcttcctgctcccagcagctcag

SEQ ID NO: 487472 - DNA, 247 bp, Homo sapiens
gaattagtcgaattagcccatcatagccgatatgtgctacttatcagcaagatgatggatatctcacatcactgatataaacaactagagcacgctgtcaacaaacttaaccaggtacgtttgttggcatggtggcatgtatgcagagtcacagaaggtgaggagagtggcacctgcacattttagtaaatctcttaagtcttgctaactggaaaacagctgtattcacctatccgcttccggtcga

SEQ ID NO: 487473 - DNA, 1013 bp, Homo sapiens
  misc_feature (34)..(34): n is a, c, g, or t
tctagaggatcctcgagtgggtcctgcaggtgtnagcgcagtagcgcacaaaccgggatagtctggattgtactcatggaccgtgatgtcggcactgcatcgactgcactcgccaccgatcgtttccttacatgcaaagcaaatgctcatttctccattctcgacataggcgtcggcgctgcattcggggcatgtcgcgatcggtgacgagtcaccgttcttggcggcataataggcgtcgatctcgtagctcgccgacacgaccatctcagcaagctgccgctgatcgtactcatggccacactggaagcatttggcatcggccgcttcgctctcgatattgtcgcggtcggtctgaccgataagagacgagccacaattggtgcaagacatacgatccagttgcccgatctcaccgggccaattcaggcgcagaaggctgtccatgcagctcttctggaccttattgaaggcattcgtctcttcaaggattgtatcccagacgtccgccaagacgtcttgcggatcttctttcagcgtctccaggaagtcgataaccatcggaaatgaggcggcgatcgcctccttcagcgctccaacgggttcggccaggtgataatgctcaagattgtttcggaatcgttgcagcttttcgatgttcacgtcaggccaggacaagccgaatttcttgaatcggctcttgagctgggcgagatctaccgtcgcatagccgacaacctcatggtcaacgccgccgtcaccatcggggacgggttcgaatttcgcgccgatgatctccatcggatcggcgtcaggggcggcacggacgaggcattccttgcccagtaacagcacgcccgcatagtagttgcgcgccgcactcaacatgcgcgcgtcggaaccctctcggaaatcttcgataccgagcacaatcgaagttaccgcattctcaaatatatccgccatgcccccgccaacaggcaggacccactcggggacctctagagcaccgc

SEQ ID NO: 487474 - DNA, 257 bp, Homo sapiens
gaatctggaagcccacttcctgccccacacggggataccggggcagcaccacactccctagccgccctgcctactgtgggataagaaaacgggctcgactgcctggacctagacccggactcggaacccggggtacttcgtctaccacacaaaaaaccacgtggtaggccagtgtcacgcaccccgggggcatgccggccgcccatcgggggggtggttagccgcgtcacgtgacgggctcagcgtcccagtcacgt

SEQ ID NO: 487475 - DNA, 99 bp, Homo sapiens
ttttccgccccttaaccccggcccccggggggggggggggggctttttgggccccggggcttaatttaacccgcccgggggcccccccgggccccccga

SEQ ID NO: 487476 - DNA, 130 bp, Homo sapiens
agaacgttagaagacatatggcaagtttgtgggcaacataaccagtctgtaaactacttcaaatgacctttatgccaaggataagcgttttcaagcctttgtaaagaagaagatgagcagttcaggtagg

SEQ ID NO: 487477 - DNA, 373 bp, Homo sapiens
cacagcaaccaggtgaccatccacacgctcaacgtgcttcaggttgtgcagacggacggtaccgccattcttcacctgaacgctgtcggctgcggaagtacggcttgccgcaccaccaatgtggaacgtacgcatggtcagctgggtacccggctcaccgatggattgggcagcgataacgccgaccgcctcaccaatgttcacctggtggccacgagccaggtcacggccgtagcacttggcacagatgccatagcgggtttcgcagccgatcggcgaacgcacgatcacttcgtcgatgctgttgagctcgatgaattcaacccacttttcgtctaccagggtgccggcaggaacgatgacgtcctcggta

SEQ ID NO: 487478 - DNA, 225 bp, Homo sapiens
cggagccttacctgcccaagtccagatgcatagcgctccaagttgacactcgtcaaggccacaggatcaaggcacggactccttctatggcggcaggttctcagatgctctgtgtaaatcagccagatctccgtactggtccatcagtaaagatgaatgaccaccgttcacgcttgtccggccgaggacttgtcttgaagctttgttcaaggtatgaaccttcag

SEQ ID NO: 487479 - DNA, 728 bp, Homo sapiens
tatggccttcagctactacgccagcaaaacgctggacagcgatgcgatcccggaaggcacgccggtgaactattacctgctgcacgggagaaaaacaacccctacctgaaggccaccgagtgaaactggcagatcgatccgctgggctttcgctccatcatcacccgctacgccaacgactggcggatgccggtcttcccgatcgaaaacggcatggggtgattgagtcctgggacggcgtgaaccctattgaggacacctaccgcatcgactaccaccgggcgcatatcaatgccatgaaggaggcgatgttcgaggaccggggcagaggtaatcggctacctcggctgggggttaatcgacattctcagctcccaggcgacatgcgtaagcgctacgggtggtctatgtcaacccgggaaaaccacgacctgaaagacctgaagcgcgtgccgaagaagagctacgcgtggttaaaacaggttatccataccaaacggaacgcgagatgtaagcggtaccgctgcgggcgcgttttgtggactgatgtgatggcgaactatccgtatgtctgaaacaaaaaattacaccgcacatgccagtcctttgtgtcgataaattgtgtgggggttctccgggcgcggctgtgtaatccgggtggcacttcgctcctgggcgaagccttcgccacggtgattcccacttttcatcctcccccggggggggga

SEQ ID NO: 487480 - DNA, 425 bp, Homo sapiens
  misc_feature (10)..(10): n is a, c, g, or t
  misc_feature (12)..(12): n is a, c, g, or t
  misc_feature (102)..(102): n is a, c, g, or t
  misc_feature (123)..(123): n is a, c, g, or t
  misc_feature (173)..(173): n is a, c, g, or t
  misc_feature (184)..(184): n is a, c, g, or t
  misc_feature (189)..(189): n is a, c, g, or t
aagctggatncngaatcgcggccgtcgtcgacacggctgcgagagacgacgagggcggtagggttacaggaccttgtagattcagaagaccctgactcatcnttgtggcgtccataattggtnctagcagatggtttccacatttagatccggtttcataacttccgtactgnagtctaaagcngaaantaaggaagcagcttcctgattttaattgtgaatcgagttttaaattgataggagggaacatgtcctaattcttctgtcctgagaagcatgtaatgttaatgttatatcatatgtatatatatatatgcactgtgtatatacatatatattaatactggtatttttacttaatctataaaatgtcgttaaaaagttgtttgtttttttctttttttataaataaactgttgctcgtt

SEQ ID NO: 487481 - DNA, 145 bp, Homo sapiens
tgccagaggaaaaagtacaaatatacagcattgaagtgtgagaatcaaagaagctactgacaataattctggaaaatacagtaaaaattagccaaagagaaggggaagaattgcttttgtattttgacgcatcactagaaatcac

SEQ ID NO: 487482 - DNA, 888 bp, Homo sapiens
  misc_feature (42)..(42): n is a, c, g, or t
  misc_feature (113)..(113): n is a, c, g, or t
  misc_feature (132)..(132): n is a, c, g, or t
  misc_feature (181)..(181): n is a, c, g, or t
  misc_feature (187)..(187): n is a, c, g, or t
  misc_feature (194)..(194): n is a, c, g, or t
  misc_feature (211)..(211): n is a, c, g, or t
  misc_feature (216)..(216): n is a, c, g, or t
  misc_feature (218)..(218): n is a, c, g, or t
  misc_feature (220)..(220): n is a, c, g, or t
  misc_feature (223)..(223): n is a, c, g, or t
  misc_feature (248)..(248): n is a, c, g, or t
  misc_feature (253)..(253): n is a, c, g, or t
  misc_feature (260)..(260): n is a, c, g, or t
  misc_feature (273)..(273): n is a, c, g, or t
  misc_feature (276)..(276): n is a, c, g, or t
  misc_feature (279)..(279): n is a, c, g, or t
  misc_feature (302)..(302): n is a, c, g, or t
  misc_feature (305)..(305): n is a, c, g, or t
  misc_feature (327)..(327): n is a, c, g, or t
  misc_feature (335)..(335): n is a, c, g, or t
  misc_feature (345)..(345): n is a, c, g, or t
  misc_feature (384)..(384): n is a, c, g, or t
  misc_feature (394)..(394): n is a, c, g, or t
  misc_feature (401)..(401): n is a, c, g, or t
  misc_feature (408)..(408): n is a, c, g, or t
  misc_feature (410)..(410): n is a, c, g, or t
  misc_feature (413)..(413): n is a, c, g, or t
  misc_feature (425)..(425): n is a, c, g, or t
  misc_feature (428)..(428): n is a, c, g, or t
  misc_feature (436)..(436): n is a, c, g, or t
  misc_feature (447)..(447): n is a, c, g, or t
  misc_feature (450)..(450): n is a, c, g, or t
  misc_feature (453)..(453): n is a, c, g, or t
  misc_feature (470)..(470): n is a, c, g, or t
  misc_feature (476)..(476): n is a, c, g, or t
  misc_feature (482)..(482): n is a, c, g, or t
  misc_feature (510)..(510): n is a, c, g, or t
  misc_feature (532)..(532): n is a, c, g, or t
  misc_feature (535)..(535): n is a, c, g, or t
  misc_feature (538)..(538): n is a, c, g, or t
  misc_feature (540)..(540): n is a, c, g, or t
  misc_feature (551)..(551): n is a, c, g, or t
  misc_feature (571)..(571): n is a, c, g, or t
  misc_feature (577)..(577): n is a, c, g, or t
  misc_feature (588)..(588): n is a, c, g, or t
  misc_feature (608)..(608): n is a, c, g, or t
  misc_feature (615)..(615): n is a, c, g, or t
  misc_feature (622)..(622): n is a, c, g, or t
tgaatacagcgtagtaatgtaaaatactgtacactgtaaaanatctagaaaactagggcttcaagtcatgttttaaaaaagccattaagcttaattgaaaaaccaagtatagngtacaaaactgcaacaagngccacagtgattccatggcatccagaccccgggtccttcatgcagagcngcagcnggtcagnggaagtatcacattggngtgcngngnggncacaagcatgtctagcctggggggngggtngggggcngcatttgggtccngcngtngcttttattcttgaacttgaacnggnggcagaatatcaagaaccaggnggtatganggattacgcngcaacattcccccctcttctaccccgcccttcaacctcnggctattgtnactttcngggaatngngtngggttcttgtangtntacttgtnaaacactgtcngtngtngggccttacagcttggnctaaangggggngatttctctagctcgctcatgtactacngcctcttatttcactgtgtgcngcngangngccatttagcngaccttctctcaccatcccngcggangtaccccttgnggggatctcacatgtcagtngcttganatattcnggaagatcggcatagtcatctccataggagatgactttaatccccttgtccagcatgttttctcgaagctttttgaactcatctacgtctcctctccgaaccagcatgaaatgttctaggtcagatttatgcttgacagcctccaagaaaagggcctggaaagtggtgtcatccacagtccagccacagcccaggaaaagaaatgacttgttttcgtagagtttctgaatttctctcatgacttcagtgttcctgagcacgttctg

SEQ ID NO: 487483 - DNA, 287 bp, Homo sapiens
gcgacctgaggatccaggcgttgtagtgaggcgtccgttgtcagtggggtcatcttgctgatggcgtctgcagcatcagcacgtcttcacatcgaagccctttttggagttcctcagggagggactcgtagacctcgacggggtccaggccgccggggccgagccgcttcttgcgctcctcctcctcgtactccttcatggccttctcgatgcgcagcttggcacggccccgcacacgctccttgaaggcttccagctcgtcgttgaagccctccatgcactgacaa

SEQ ID NO: 487484 - DNA, 279 bp, Homo sapiens
aggctacggccggagaatcgctttaactggaggtggaggtgcagtgagctgcaggttgtgcccactgcactcccagcctgagcgacaagagcaaaactccaccttaaaagaaaaaaaacagaaaaaaacacaaacaaaactcttgaatttccctgtggataccttttctctggcagccttttacaatgagggctaaatttactccaatactaatatagacctgcagaaccggtcagatattcaattccagtagaaaatttccagaaaaaattatgaatc

SEQ ID NO: 487485 - DNA, 519 bp, Homo sapiens
tgcaagctatggcagcatatatagcaaacactaatagatctgaagagggagatagagtaactgcaactcaataatcgtagggcactttaacatcccactctcagtaatgaagaggtcactcagacagaaaatcaaaaaagaaacatcaaagtgaaactatactgtagcccaaatggacttaactgattttacagaacatttcacccaattgctatagaatacattccatctacacatggaacattctctggaatagagcatatcttaggccaaaaaaacaaggcttaataaattcaaaaaagtagaaactatgtcaagtatcttttctgatcacaatagaataaaactagaaattaataacaacaggtcctggaaacaatagaaatatgaggaaattaaacaacatgtaatttaatgaccaatgagtcaatgaagatactgagaagattattttaaaatgtattgaaacaaatgaaaatggaaacaaaacttaccaaaatctatgggatatggcaaaag

SEQ ID NO: 487486 - DNA, 195 bp, Homo sapiens
caatattgacgtgaggtccgtctggctgtgaaacaatgtaatgtggagccttcgatgccgacggaaatggtgaaggcagactcgaagtactctgaggcttgtagggaggttaaaatagagacccagttgaattgtcctaggcagggcttagattgatttggttggggtagttttctataagagtagtggtgagct

SEQ ID NO: 487487 - DNA, 180 bp, Homo sapiens
cccccccccttttttgggggggggggcccccggggggcttttttcccctttttttgggaaaaccccccccccggggggggggtcccccccccccccccggggggggtgttttttttttccccccccccggggggggggcccccctttttttttttaaaattttaaaacggtttttttcca

SEQ ID NO: 487488 - DNA, 674 bp, Homo sapiens
tggaagttagcgtaaaagtgatttagaaggaaatgtaaatccatatcaaggagtaaaagggccagagttaattcaaaacaagcgcaaaaagtggaaagagtttcaagcggaggtgaagcaaaggaaggaaccagaagggggaagcataagaccaggggttccaggcatcacgacaggtcatggaggtgccatcatcatcgtcgtgaaaaaatgcaagtaggcagaggtcaaataaggtgagcactatgatcgcaaatatacgttatgtatcaagctctacagggcatgaatcacccaagataagggtgaaaatgggggtcataaaccacaaaatttgggagtgcaagtctaggagaagcaagccatgccctgaaaccggtgcagggatggaataatcggagcaaagacaagtaattcaatggccatcccagatgcgatgtccacataagatcatgggtcaatggctactttggacagatgcgaggcaatgagggcatggagcaggatcgcagagaccagtatacgtgacagttggtaatcggcgacgcagtagacgtatatgggacgcagcgtgagtcaacagcaccagtaagtgggcagcagtcacactcagtcgctgactctctctctctatctctctctctctctctctctctctctatctctctctcctc

SEQ ID NO: 487489 - DNA, 106 bp, Homo sapiens
cgatattatggtagcggacggtgaaagtatgccgtgtgtctacgtctattcaccgtaagtgaccataatcatcgctatccacaccggcgtcaaagtatttatgctg

SEQ ID NO: 487490 - DNA, 908 bp, Homo sapiens
tcatttgtgtactcgtcgccgtttgtccggtgtgctagtcgtgtgtggcgcccatgtgcgccgctcgcgcgcgtgtccctagagacactggggtttgtcactgtttcgagagttggttaggcaccccccttctgcgcgcgtttttcgagtggagatgccctctccttcaagattggacgaccctcctggttggaagagattatcctcgttttttgggggatctctttcccctggtattcagggcgaacatcgtccacccggtgggctcgcccaatggtggtataactacgccgtggcgccgaattaggtcgccgtctggtgggcttctcccaccgcgttttccccaggcgggtgccccctttgccccagaggggccacctggttgttcctccgttgtgccaccccacaatcccccttttgtgcgtcagaaggaggagttgttttcacataggcagcgaacggagcgggttgaaattttgatgagggctatggtatctctttgcctgctcgctacccgctgggtgaatcaagaccattagtatgttcccccgcggttagcatggtagagatggcttgtatcaccggtagaatattccgctgtaatatggtagatcctccggtgaaacgacgagctactgcggcaatctttcagagccccccctagcagttagaagttctgggtgccagcgcgcacttgatagcagcatttgccccgccgcgacgaggcttgctcccgctagcacactacccaaaaagcggttggtcttgccagttgcaacaatttcttcacaccggatagtgacaggatttctatactttggccagtctcagaagattctcttgcttgtgatagagagcaggcaataggaccctgtaaggaaacagaaaaaacagaccccacataacaa

SEQ ID NO: 487491 - DNA, 156 bp, Homo sapiens
cgagcacagtgtaggtccacgtggaaggaagcctgaaccccaggtataaggagggggtggtcattagggttctgttccaggtctgccccagacccccatcccagccattgccccaggcagtaacttggcaattcacggtgtgcaccttgcaggctg

SEQ ID NO: 487492 - DNA, 335 bp, Homo sapiens
gcggccgcctactactactaaattagcagccgctcgacgctgaatcaaatgatctgtgggtccgggggcgatggctcatgcctgtgatcccagcactttggaaggccgaggcaggcagattgctggggtcaggagttcaggaccagcctgaccaacatggagaaacccgctttctactgaaaatacaaacttagctgggtgtggtggcacatgcctgtagtcccagctacgtactgaggcaggagaattgcttgaacctgggaggcggaggttgcggtgatccgagattgcaccattgcactccagcctgggcaacaagagcgaggctgtgtgtc

SEQ ID NO: 487493 - DNA, 484 bp, Homo sapiens
ggtatagtctgtggttcctgggccataaacttgtgcagcatgtcactgtactgaatactataactgtagacaattataacacagtggtaaattttcgtgtatctaaacatagaaaagatacagttaaaatatgatataaaagattagaaaataggccaggcatggtggtgtgcacctgtaattccaggtactcaggctgaggtgggaggatcacttgagatcaggagttctaggctgtagtgtgctatgagcacatctatgaataggcactgcgttccagcctgggcaacatagtgaggccccatctcttaaaagggcacacgtgtataggacagctccattataatcttatgggaccactgtaatatgtgtaatccattgttgactggaacatccttatgcagcacatgactgtgtacataacttaaaatttatcatttaaaccatttttaagtgtacaattcggtggtataaagtacattta

SEQ ID NO: 487494 - DNA, 178 bp, Homo sapiens
cagtccgaggatcccaagcttctcacgtccgaaatccgaaggaaaactatcgattcttgtagaaaatggtggacgaattaatttcggggataggaataacgatttgaagggaatattatcgaatgttactatcgataatgtggttgtatcgttgagaagcttgggatcctcaagagcg

SEQ ID NO: 487495 - DNA, 426 bp, Homo sapiens
  misc_feature (197)..(197): n is a, c, g, or t
gagtatcctactaatgctgtaggatcatctatctctctttcatattgcatccttagcaggagaactcacactcccttacttcaggttttgtttgctcattaacacaaactttattggtttatccctggttgtttactgggcccaactatataagtctctgtgcccaggtctttgtcttaaggtctgccttagggaanaccaaacgcagatagctcccagcagtttccattgttaaattcgtttcgtaggatatattcacttgggccaaggactacacccttcttttggtagctgtgtagctgtgtattgcttggcatgttttgtggacctgcactcaataactacttgctgaataactgataggttatgagaaaatttttagtatataccaagaatctaagttataaggtaagttaaattagagga

SEQ ID NO: 487496 - DNA, 669 bp, Homo sapiens
  misc_feature (26)..(26): n is a, c, g, or t
  misc_feature (84)..(84): n is a, c, g, or t
  misc_feature (100)..(100): n is a, c, g, or t
  misc_feature (103)..(103): n is a, c, g, or t
  misc_feature (117)..(117): n is a, c, g, or t
  misc_feature (130)..(130): n is a, c, g, or t
  misc_feature (135)..(135): n is a, c, g, or t
  misc_feature (137)..(139): n is a, c, g, or t
  misc_feature (146)..(146): n is a, c, g, or t
  misc_feature (148)..(148): n is a, c, g, or t
  misc_feature (176)..(176): n is a, c, g, or t
  misc_feature (183)..(183): n is a, c, g, or t
  misc_feature (185)..(185): n is a, c, g, or t
  misc_feature (187)..(187): n is a, c, g, or t
  misc_feature (190)..(190): n is a, c, g, or t
  misc_feature (192)..(192): n is a, c, g, or t
  misc_feature (197)..(198): n is a, c, g, or t
  misc_feature (208)..(208): n is a, c, g, or t
  misc_feature (222)..(222): n is a, c, g, or t
  misc_feature (234)..(234): n is a, c, g, or t
  misc_feature (249)..(249): n is a, c, g, or t
  misc_feature (277)..(277): n is a, c, g, or t
  misc_feature (296)..(296): n is a, c, g, or t
  misc_feature (305)..(305): n is a, c, g, or t
  misc_feature (315)..(316): n is a, c, g, or t
  misc_feature (322)..(322): n is a, c, g, or t
  misc_feature (328)..(328): n is a, c, g, or t
  misc_feature (333)..(333): n is a, c, g, or t
  misc_feature (340)..(340): n is a, c, g, or t
  misc_feature (345)..(345): n is a, c, g, or t
  misc_feature (439)..(439): n is a, c, g, or t
  misc_feature (504)..(504): n is a, c, g, or t
  misc_feature (583)..(583): n is a, c, g, or t
  misc_feature (664)..(664): n is a, c, g, or t
tcacagttttgccccagggtccaggngcgcccggaaggcagggcccccaggcctcttcacctcagcctgggcacctataatctnagggaccctgcccggnggngggggcagctcggnggcacagcctgcngccantnnngccaganantggccggctcagtccataggatgatgtnagtatangntngangnaaagnncgccagatancccgatgcagtgcntgttaagacttnggggggatcaaagtncggccggggtgggcggagatcctcgggnagctgcacagggcatcttntgctcactncattgttttnngaggtntgtgtnaaggngctttgnctggnctgggaggtagaccaaggccaaagctcgtggccagggcctgggcactgagtccccactgaatttggcacaggaagggggcactcccagcctggnccgtcctgcatggggagccaacacaccgggactgcagtgtttcaccttgggggggaggaagcctnggcccaacggctgaacgggacaggccaggctcacccgaggaaggggacgcaggacccacagcccctgtggtcaggcctntgggccacgtggagagaaggttccagaacagtgcttgttgacgagcctctccctacaagtcccttcagcagcaggcccatncctgc

SEQ ID NO: 487497 - DNA, 284 bp, Homo sapiens
tcaccctgcttacactagttgtctctgcactgaacgcttgattaccacgcgctctcactgcgcccgtgcagtgtacacccgtcagacaggtcagcacctctcgggcaggcggaggtccgactgcggtggtgacacctctcccactgtgaccaacaaaccctcatactcaacaagacgcatgcacctctggctataaggatctaggatgctcactggcaatatcttgtactgtatccaattgtcattcatccagctttgcacagaggcagcagcagcatggtagg

SEQ ID NO: 487498 - DNA, 253 bp, Homo sapiens
ctatgattgagctcctttcatgttatatagcttcaagataaagacttcttagaaacaaagagttcattctcactttgttcaatagtaggcttagcgtctcatggtaatcacgtggaaagcagaacttacattagactatacatctatgtcaatcagatgtatagtctgtgctattattggacgtacagactttagaatatattcttaaaaatacaattaacacatccccaactttctattgtgtaaactgatt

SEQ ID NO: 487499 - DNA, 258 bp, Homo sapiens
  misc_feature (70)..(70): n is a, c, g, or t
  misc_feature (238)..(238): n is a, c, g, or t
agactatgccgagaacccggaagggtggtggcgcagtgaggcgagattgtgccactgatacccagcctgnacgacaaggtgagactgctatctcagaaaaaaacaaaacaaaaaacgacaaaaaaaaaaaaaatctctaatttcccaattcataaacggattaaattaaattacttattacaacaaaattggggcggtccctgcaaaatttagtggcaataatccgttctaagatttncaaaattcaacacatgcata

SEQ ID NO: 487500 - DNA, 100 bp, Homo sapiens
  misc_feature (32)..(32): n is a, c, g, or t
aggtaaatctaacagcatactgctcacgatancacagtttctcgatactatgcatatagtccaatatcacagagaatgatacattgaaggactcggggat

SEQ ID NO: 487501 - DNA, 308 bp, Homo sapiens
tgtctctagaggatccaccggaagcacactgcaacatcaaaagtctactcctttaagaaataaaatcctggccaggcacagtggctcacacctatgatcccagcactttgggaggccgaggcaggcggatcacgaggtcaggagtttgagaccatcctggccaacatggtgaaaccctgtctctactaaaaatacacagaaaaattagctgagtgtggcagcatgtgcctgtaatcccagctactcaggaggctgaggcaggagaatcgcttgaatctgggaggcagagatgttgcagtgtgcttccg

SEQ ID NO: 487502 - DNA, 889 bp, Homo sapiens
atttaaacaaggtaaagtatacgtgtatcgtcgtgctaatgtaacagctctctctgtggacataatgatgtttctggattgccgtggggcactcacaaataaatactggagataatggatagaagaaattccgttgaatagtaatatctcagaaagcttgatattattggaatattggatcgtgagggtctgctagaagtagtcgggtgggccgtgagaactaatggaacaattggattgagtctatcgcgaaaatgttggtagggatgcgtctggccattattagcaacatatggtattgaatatatggagatgtacctgtggaggcttgttggtaacacgtgaaggacgggagggataacaatgattctgcagaggactctgatgacctagagaacactatattttttggaaacttgtggcaaaagagtagggtcttgaccgggtctggagcaacagtagcattgatggagggggtcaattctacttgggagaattcccttagtttaactgacatagttggtacgaggggcattagaagaagtcataagggtaatctggacggaagggatcaagggtgcaatttttccctagttgatggtaaccatcttgttggagaggactccattatatttgtaaatttgaagggtgaaattcttcaacttatttaaagggtcatcacttgtcaaattgcgttaatcttccaaaactgtaataatataaataaaaaatttgttggacacaacaatgtgtttggggcgaaaactggttcttagaaaaacatttttttgaaaccactgtttttgtggagcaggggcccacataggttacagcaacttgtgccaaacagtttgcaaagaaaaaggggggggaaaaaggggggaaaagc

SEQ ID NO: 487503 - DNA, 541 bp, Homo sapiens
  misc_feature (482)..(482): n is a, c, g, or t
actgtcagtttaagcaagctgtgagtgtgtgggtttttaaaaacattattatggtataatttacatagcataaaactcgcccactatacgtgtgcaaggcaatgatattttggtaaatttatagagtggtgcagcatcaccacaaccgggttttacgatattccaattacccaaaagttttctggcatcctttagcagccactgttcaccacctccccaagcttcaagaaactactgattcgttgtcctcataattttgtcacatccaatcatttcataaaaatggaattttataataacgaatattagtatttggtgtctttttatcttcatttagcatgtttttatacatgtcaaaatattctgtgctattatggtgtcagtctattttattgctgaataatatctcattgtatggatgtaccaccacatttggtttaccattcatcaagctgctagggatttagactgtgtccagtttnggggtattagaaacaatgctgctatgaccatctgtatgcaagtctttttttctggatat

SEQ ID NO: 487504 - DNA, 728 bp, Homo sapiens
tcccgaaaaactcctggttgtaatgggatttggtattttaatacaatttattgaattttataagcttgtacccaatatttaattagtgtgaaaggaaacaaagaatgcaaggaaaaataatttaatcaacctcagtttgcacaaggtgctcagatttattcaattcgggactccctcctttggtaaggttttggagacaaccctagacctaaacgtgtgtcacagacttctgaatgtttaggcagtgctagtaattccctcgtaatgatctctgtaaataacttctcctattcttatatccctctttctctctgaagattaatgaagttgaaaatggagggtggataaatcacaacaagggtagtgtgatagtataagtatctaagtgcagatgaaagtgtgttatatatatccattcaacaattatgcaagtttagtaattacctcagggttaactaaattacttaaatatgctgtgaacctactctgtccctgggctagaaaaaattataaacaggacttggtagttggggaagccaaatggataatatcctatgtcctaaaagtggggctatacataattcttacgaaatatggatttttaatccccaggatatggtgtccacttcatgataatacgcggatgatgtttgaagtaaatcagttcgcaactatgtacctttgtgctaaataaacatgctttgcttaacacaacaacaacacaacac

SEQ ID NO: 487505 - DNA, 258 bp, Homo sapiens
atacctatgtgcggagttcagtctggtagccacgaggagtggtgaccccattgccaatgcagtggctgacatgttgcgtgagaatcgttcaggcgaaagtgaaatcttatgaaggacaagctgaggaggctgaggactatccatgtgctgaaggcagttcgggaaaatgccacactcactgagctccgtgtagacaatcagcgccagtggcctggtgatgcagtggagatggagatggccaccgtgctagagcagtgt

SEQ ID NO: 487506 - DNA, 693 bp, Homo sapiens
gggcgtggtggctcatgcctgtaatctcagcctcccgagtagctgggattacaggcatgcgccatcatgcctggcacaattattagtgtaataagtagagatggggtttcaccgtgttggccaggctggtttcgaactcctgatccaccacgcctcagtctcccaaagtgctgggattacaggcgtgagccactgtgcccggccagacaccatgaccgggccagcacaccatgcctggacccaaaacatttttacacagaaaacccaaaagtcacgtcacaatttcatcccttggtccacaatcccccaggaaacaacaatcatgtaactctgcatctatggatttacctattctggatatttcatgtaaatggcaatcatataatatggtagcaataagatggctggatttatgaaattagcatgttatccaaggttacatcatgtagtagcatgtgttagtacataaataccacttataatgggtggataatattgccatagaaaaggatataacaagataagataatcaattgaataaagtttgataaaacaatttagaaaggagacagacgtataaacttatttatgaacaaatgatgaccataaatatcatggtatgaagaataggagataaaatatactaacatactaaaagagtaaaatctcggaataagattgaagggcaaatga

SEQ ID NO: 487507 - DNA, 830 bp, Homo sapiens
gttatcctcttcaactctcttggtatgttttacgcggtcgtgtcgctaagtctttgttggttgtttgtgctcttttttgtgttttgttgggtgtggtgtcttgtgttcgtgtttagtgttctgttgtgtgcatctgtcatagttttgcgttgtgtttctttgctttttttgtcatcgtttttagtgtattgggtgggatagtgtaaggtgtggtgttggacgtgtttgttacaggtgatttttgtggcagtttatgtcggttatgggtatgtttatggttgggttttatttagaagtaggtggagtgcgtcttgtgttggtatatgatgattggtggacttgaatgtttgatggccgtcgctgttcccctgcttggtggttcagaggaagtagggcaccagggacgccaccccgggggtgtgtaatgggaacaacgctgtgtgcttttcttctgttgcacagtcccacgggttgtccccacccggctgtggggcgccccacaccgaagtgtttcatcctccgctgtcccgctgtagggcacaacatgacctgtggaggcccacatgcccaagcgtagaccacgcagtctcaacgtgagatctaccaatctccgagtctacacttcgatgttgcgggccccagacttgggggccccagaaaactgtcctgatatccgatgagtactgccccccaagttatagcctttgcccggatggccaccacccctggtgccgccactgggtgtgcctccccccccacctggggtgtttttttgaaacaaattattttttgtttttttcaaataaaggtttaagccaacccccgtgtta

SEQ ID NO: 487508 - DNA, 111 bp, Homo sapiens
  misc_feature (111)..(111): n is a, c, g, or t
ggttttgccttagcgccggctcggggttaaaaaggccgcagagggaggcacttaggacccaagtttcttcaccatgggattgtggtccatttggtcaaggaccccttgggn

SEQ ID NO: 487509 - DNA, 305 bp, Homo sapiens
  misc_feature (99)..(99): n is a, c, g, or t
  misc_feature (101)..(101): n is a, c, g, or t
ttgggagtttagagtaaatagtaaagtattagagttgtttcttgacgaaaagagttgctggaattgagaacagaaatagtggcattgcatgcccagcantntcgggcccttacccagacagacaggaagatcggaactgaggttgctggcctcaaaaccatgcctgagtcacacaagcttgataatattaaatatttagcagggtctatatttacgtgcctaacagtagctctgggatcttatcgcctgtggatctaataaagtgtctatttaaaaaagaaaaaaaaacagaactagaatttttt

SEQ ID NO: 487510 - DNA, 107 bp, Homo sapiens
tacaccagcactcatccatcgccccattgcatcactcttccaatccagcccaccatcagcccctcgtcagtccaccagcctattctccatcccaacacccccgtgca

SEQ ID NO: 487511 - DNA, 1500 bp, Homo sapiens
aagaggagatgtgcgccgcgtgttgtgttctcaagcaacccgatatcctccttgcctcgctccacaaatagacacgctagtggagtggtggtgtcccccccctcctccgctcgcgcctcccctattttatactacacacatgtcctttgttatggaccctcccctccaaacataagggtggttacataaacgaagaggtgtcgtctctctgcacgaggcgggttgtacacaatacgagacaaaacaccgcattgtctgtgatatcattttttttcttagatggaacaccttggtgcgtttgtatcactcacgtcgttggctcagatggtcgggtcctctctgccggtaaaaaacaacgcacggggtgatcaccttgatgaataagaggcgttttttatgggcggagagaatctttgcggtgcttcgccgctggatatgagggagatatcgcttccgcagaccccccccccccccttctcgttgggggagaagaagacgccccgcctttcttgttaggaaggagagggtgtgttgcgtcaccaacgaggggttctctcgaaagtaacatgtgttaataaaaaagagagctctttgttttgtcgggttctcccccacagcagtaagatatggcccgtcttactgccgcctctatatataatgtttggtgttgtgaaaaataacaccacaaacaatataacgaccctcgtcttatatgggggtgagatggtataaataaaaaaatgtgggggcgaccatcttctctattaaaatcatctccggcgtgtccttctggcgcgttctgttcttctgcggagagagatcataatagggaaggacacaatataatagggcactatgtgggagaaatatatacccccgacagagggggcacaacactagtgagaagcggtgtgaggagacacatatatatatgtgtgtttgagaatagtgtgtatagtgagacacggagatatatataagacatcatatatgagatatcacaatccactgtatagacacacacaactcgcgcgcgtgtgtataagaataaagagagagtgggtgtgcgccacccctctataaatgatatataaccaccctctcttatgagagagagtgtcacatacacacactctatatataaaatatatattggagaaaaattatttgtgggagatttaactctcgtgtggtttctcccacaaaagagtaaagagaaaacactctcatatctcctttagaaagaggggaaaaacatattttgttttttcttggtttctcgccacatttttctccctttggtcctggttttacattagatttagatatgccccttctcttccacaaaatctcaccgtggttaaaagaataaacccaatcccacccccacatttccatcccccagagaggggcttggtgggggaacataaaacttttttgcataaaagcaggaaggatttgaggcaggtgaagatgggacaaagaagactagaaacatta

SEQ ID NO: 487512 - DNA, 305 bp, Homo sapiens
gcttagccgagcagatacttgccatgatacaggcgaggacactgaggcacagggtcgtgaaagaacttgcctaggattgcatgctcagagagcgacagagacattagcttgacacagtcagctgatactgtagttcatgcttttgaccatgcagtatgctgctatttactatgttgaatgccttctccagtatggcttgtgagtaagacaggtctaggatcaaactccatctctactacctgctaaccagtcacttaggcaagttatttcaactctctaatcctaggtctacatctgttaaatga

SEQ ID NO: 487513 - DNA, 258 bp, Homo sapiens
caagtttatagacagtggtcgaggagcaacaactcgagctcggcggtgcccgagaagatgaaatttcagtggatccgagtgaagcgcacccacgtgcccaagggctggatcaagggcaatgccaatgacattggcatggattacgactatgccctcctggaactcaaaaaaccccacaagagaaagttcatgaagattggggtgagcccacccggcagctgattgacgagagggctcaccccaagcttcatgaactta

SEQ ID NO: 487514 - DNA, 230 bp, Homo sapiens
acagaggcagcgatatacattataaatacatatactgcttgtagtataccgtcacaagaagcaagttcagtatcttcaccagaaaattacaccagttgcaacacaggagatagagaactgacaaacagacaatagggtaaatagccatagtgaataatataacagctgagagattgggggaagaaaaagtcttaatgataagattgacagagactggttggggataaagc

SEQ ID NO: 487515 - DNA, 325 bp, Homo sapiens
  misc_feature (109)..(109): n is a, c, g, or t
  misc_feature (132)..(132): n is a, c, g, or t
  misc_feature (181)..(181): n is a, c, g, or t
tacaggaccccggcctaaaaagcatcgcaaggagtgcgggaaccgctgctgtcctttagcaacagcaagaaaaccaggaggtctagagaaatcaagtgcaggagctggngagctgaagagaaaatgggcagngaacgaaggggcttacttttctgaggcataacaaggacacagagaaagngctgaaacaacgggaagaaggtttgaggaaaatctacactgaccaataaatgaagaaataaactagaaagaggaaagcaaaatcagaggaagaaaagggaagaaataaatacaaaataaaaatgatgaaaaaaaaaaaatataa

SEQ ID NO: 487516 - DNA, 116 bp, Homo sapiens
cgaaagcactgcaagtagtggactgaactgtgcctaatggagaagacccacgtgctagagggatgaggggatatccatggagtacctgttcccataccccatattgtggtcacagc

SEQ ID NO: 487517 - DNA, 391 bp, Homo sapiens
  misc_feature (25)..(25): n is a, c, g, or t
  misc_feature (171)..(171): n is a, c, g, or t
  misc_feature (186)..(186): n is a, c, g, or t
  misc_feature (204)..(204): n is a, c, g, or t
  misc_feature (216)..(216): n is a, c, g, or t
  misc_feature (227)..(227): n is a, c, g, or t
  misc_feature (237)..(237): n is a, c, g, or t
  misc_feature (239)..(239): n is a, c, g, or t
  misc_feature (241)..(242): n is a, c, g, or t
  misc_feature (253)..(253): n is a, c, g, or t
  misc_feature (270)..(270): n is a, c, g, or t
  misc_feature (309)..(309): n is a, c, g, or t
  misc_feature (314)..(314): n is a, c, g, or t
  misc_feature (342)..(342): n is a, c, g, or t
  misc_feature (370)..(370): n is a, c, g, or t
  misc_feature (388)..(388): n is a, c, g, or t
acctccctgtgggctgtcctgagcnctgtggggttcctgggatggaatcagtgcatcataaagggcattctttaagcagagaaggggccaggccaccccattcaggaactgctgcgggaataaagtgctaacttgcccccaggctgtctatgggagaccctgggcccagtntgggatgtacagggntctgggaagggggcagtnctggcggcagancccggcctgcnggggcacttngntnngaagaggggtntcgtagcgggagaggcngggaggggctgcacaggccgtggagctggttgctgtggncatcngtatggctgcttgttcaggaagcggganaacatggtgaaggcagcgaggggcttgncggtgggaaccatgtggncgg

SEQ ID NO: 487518 - DNA, 907 bp, Homo sapiens
tccccgtgatcttgacaggctggaattttctaatcctggtagtcctattcatctcaagagatcctgtgcttctgggtttccctgcagggagagaatgtgcctacctgcatttccctgaagtgcttgttgttcgctacccagattcccaaatatcgtcaagcctcccctgttgtgccagcctgcgcctctcatttagagaggagtgtgatgccgctatccatttgcagtctttgtgcacatcaaaacaaacaaacagagacccaaacacaccccagcaggcttatgtcagagaattagctcccatgctggcgcagccagacgaattcagataagaatagcttaaaataaatcctcgcaggcaaactggtcacaggccagggctgtgggataacttctggctacaaccacattctgtacacatgttctgttatcctaaaagattttattttacattttttaagggagccagaggtaaaagggaagcaaattaaaattgccttctcctcactgaagcctgaggtagatgaggaggtattggttaagaactcagacagcatggttgaacattcaagagcacctgtttatgattattttttgctccagtaaatgaaatttgatcttccactgctagaggcttctcattcctagagaaattaaccacatgcagtcagtggagtgggagttctctctaagtcaagcctggggggtcccggccctgtagaatattgggtgctcctcttattaactgtaaggatacctatgaaacccttgtacctgtgggcgcgtacacacctaaacgcgtggggggccacccgcgatttcgacggagaacctcttcctgggctaacacggaggtaacagggttatgtattacaagcactactctccggagcagtcacataggagg

SEQ ID NO: 487519 - DNA, 698 bp, Homo sapiens
tcggtggtgtcatcccagcaactgagccaagggggacgccggggtccccctcaggtacacaggagcccagtggtgcctctgggtcctggagaagcgtgccccgtgcgccatgcctgggcctgagaaggggggccctggacctggagaagccgcccctgtcgcccatgcctgggctctgagaagggtggccctggacctgggcctgtctgtcccaggagggcgagggtggcacacagcatgtggctgcgggtggccatcgggcggtgcgtgtgcctcttctgggctgtagactgccttatgagccccacgagcccttgttgcaagcggctgacgagctcatgtcccggtctctcgtacttccagaagaaggcccttggtagctactaaggcctaccttcccgtggttgatgtggggggacgaggcttgagcgtcccggccgggagcactgtgatagcctcaactggtggctggtgcgggggcagctctcgaggacaaacccgggggctaactcactgttgcggggccgcggtacctgggagccctttcacacctccgcgtgagctcctggacaccctgggaccgccaaaggtgtccgaaacaacccttctcagtaccttcgagggtgggcctctgagagtgaggatgaagacctccttgagcagagctggaacttgcagacagggacgggcagccgggc

SEQ ID NO: 487520 - DNA, 173 bp, Homo sapiens
  misc_feature (53)..(53): n is a, c, g, or t
  misc_feature (55)..(55): n is a, c, g, or t
  misc_feature (119)..(119): n is a, c, g, or t
  misc_feature (135)..(135): n is a, c, g, or t
  misc_feature (164)..(164): n is a, c, g, or t
ggcactggaggtcgcgagcacgttgctagtgggcgcggctggcggggcggggngnaagggggctagcgtccggctgagccgcgggttcctgcacgcggacccacgctttgtcgggctgntctgctgagtgacacngccgtgcatccgaggagctgtggtcagcntgacggcgg

SEQ ID NO: 487521 - DNA, 892 bp, Homo sapiens
tgacggatacccggcgctcgtaccccaccccggacggccgcccatagccagccctccgctcacctcttcaccgcacccttgggactgccccagatggccctccgtccgtccgctccagcgccgcgctaggtctcagccgcccgaccggacgaccgtcgtcgtcacttagatcttgccggccagtgacagaccgctgtccatgctcgacatggctgttcctgccacgtatatctagccacccaaggaccttcaggtaggtgccggccagttcgagaccgacccataaatcatcgctggaagctcgtacgccctccatacgttctagcctgtccattgttcttacctaacttgttgatccggggcagtgatttgtgtgctgtgaacccaacctttagtccacaaatagctttcttcagccatattcgtcgagtgcacggagaggtggaagcatgccttgtacgcacacatctgaatgaacgccttgcataaaagccaagcagattgggtggcctagatctgtccttcacgactaatcagagggaagacccaggtatcttgctagattcgagcttgtgagaagcacgtccggtgtcctcgcaagtagcaaagtggcgaaggtcgctagccattattacgcattttcgtgtagcctggcaaattggttgcaaactccagtttcaactcatcttgggatgatctcgcacaaacttggccacgtgacaaaaaaatgaacccccatttgtgttgacctttcattgatgacacagttatctgaattgaccaggtgaaaagccatccaaagaattgtgtgaccacgtgacccaatttgtccaagaatggaacgcccaatcttgttggggaatattccttgcccagaacccggaaaagtgta

SEQ ID NO: 487522 - DNA, 363 bp, Homo sapiens
actctgataaacacgtctgtcatgatgagtcttcatgaactgtcctcccaagatatatgtgtatctttccttcctgagtttatgtaatcagatcatcagtgcaccgctcataattaacagtgcttcaacacttccagataaagtgtgggaattaaacaagaatgcatcaatcaacataaaatcaagacctgcgcaacgcaacgatggtaatttatctattgttaatgtccaactgcagattacttcagctatcaggtaaaagcataaaacaagtagacacccatgatatacatatctacacaccactagtttaatggactcactatgcaataggttcttcatatgcccttaactggggagaga

SEQ ID NO: 487523 - DNA, 139 bp, Homo sapiens
  misc_feature (62)..(62): n is a, c, g, or t
  misc_feature (68)..(68): n is a, c, g, or t
agaatatcgacccatgctgtcttcagtgatggttcacagttaccatacaaatgttagaaagnaacagncaaaaagtagggcatgattttctccatgtaatccagtgagaaaacaagccatgaccattgttggttgggag

SEQ ID NO: 487524 - DNA, 762 bp, Homo sapiens
aaagaggacacgaacaatcgaagaacaatacatgctcatgggcaggaagaatcaatatcgtgaaaaaggccatattgcccaaggctaatttataagactcaagtaccatccccatcaagctaccaatgactttcttcacagacattggaaagaactactttaaagttcactagtggaaccaaaaaagagcccacagtcaccaagtcaatcctaagccaataagaacaaagctggaggcatcatgctacctgacttcaaagctatactacaatggctacatgtaaccaaaacagcatggtactggtaccaaaacagagatatagaccatatggaacgagagacagagccctcagaaataatgccgcagtagtctacagaccgatctgatctgttgaacaagacctgaacaaagaacgaagcaactgggcgaaatggattccgctattgtagataaagtggtgctgggaaaagctggctagccagtagtgtagaaagctaaaactggatcccttccttacagccttatacaagagattcaattcaagatggcattgaaagactgtacatgttagacctaaaaccatacaaaaccctagaagaaaatctaggcagataccattcaggacacttggcatggtgcaagggactacatgtctaaaaacaccaaagagcaatggtcaacaaaaatgccatagaattgacaaatgggatctaattgaaactaaacgagctcctgcaagcagcaaagagaaacctaacatc

SEQ ID NO: 487525 - DNA, 924 bp, Homo sapiens
tttttgtttttgttttaattggtctttttttttttaaatccaaaggccccttaatcgggcccgggtcccatgattagccgtgaccaggggaaaaggggaaaggaaccacccggcacaggggagggtgtatatctccaaaaattcccatttatacacagaatctaaaccaagacaatcgcaacaggagtccctaattggcggtgttaagaatgttggcgcactcatgggagaaggggggatggcaccacgtgtggcggagacatgcggcggattgttcgtcaaaaaaaatatacagggtcccccacacaatctgggggtcggctgggggggacactgtggctcttgtcttcaggcccaagaggaatatcaaaatgtatcaaacagcatgttcggggcaagagtgccagaacacctgtcaagggatggggaggggagcaaggaaaatccgagggggtggggggggtccttgtttgggcaatctggggtgtcgagcgggtattggccctacccctctggttgggggatgccccccagcccctacgcgggttttggcgtgggaaggtgtgcgcagcttgaaaccccccagggtgcccgttgtgtgggggtctgccagttgctcccagggagggtgggtccacaaagtgggctcacaatggggcttggcgccctcccgcggggtatatttggccgtgcacttgcccccccccaagtcttctttcttgccaggggtctgcacgccggacctttggcactcccttcggtagctcgtctttcgcctatgccctctcatggttggacccccggtgcaagtccttatcagagggcggacctggagggcgtggacaaaccacattggcctcttaggggcaacactggcgcccgacgataaaccagagatccctcttgcctcgggcccaaggcgca

SEQ ID NO: 487526 - DNA, 368 bp, Homo sapiens
ctaccgccaccaacatctaaggactgtcatccatgtgcaagcagaccggggacttgaccaatgacgcacacagcgagacctaggaccatgaccgctttcagctgtctgaagcatgtgcatatcagggcagctgatttcacagaagcatgccagcaagtatggacaattgctgtgaccttagactgagatacgccactgtggttacgtgcacttatacttggacttcatgccatgcagaacctactcttccacatacccttcctgacatatcgtctgtgctatatactggagcactgacgaacctgtgccagtaatgcatgagacacgtctagactgaccatgagactgagccgcatgtgcataggctt

SEQ ID NO: 487527 - DNA, 226 bp, Homo sapiens
gatctagaggatctccaaacaccgcatctccacctcctgggtcaagggattctttgcctcggcttctgagcagctggaattacaggcgtgtgtcaccaagtccagctaagttttgtgatttagtagagatggggttttgccatgttggccaggccagtcttgaactcttgacctcaagtgatctgcccgccttgcgctcccaaagtgctggaattatgggcatgag

SEQ ID NO: 487528 - DNA, 119 bp, Homo sapiens
acctatactgtatgcggcatcaaggaagcgcctcggacatgtcaccctatgtgcggtaaaacagctgcccacgccatccctaaactctacagtttggactctgaccagaaggatcagct

SEQ ID NO: 487529 - DNA, 380 bp, Homo sapiens
  misc_feature (15)..(15): n is a, c, g, or t
  misc_feature (19)..(19): n is a, c, g, or t
  misc_feature (97)..(98): n is a, c, g, or t
  misc_feature (211)..(211): n is a, c, g, or t
  misc_feature (327)..(327): n is a, c, g, or t
caaaaaaaaaaagangggngggggccaggcacagtggttcatacctgtaatcccagcactttgggaggctgaggcagaaggttcgcttgaggtcagnngttcgagaccagcctgggcaacatagtgagacccccatctttgcaaaaaaatttttaaaaaattatctgggtgtcatggcatgtgcctatggtcccagctacgtgggaggctnaggtggaaagatctcttgaggctgggaggtcaaggatgcagagagccagcctggcctatagagtgagaccctgtctcttaaaaaaaaatggggtgtggtggtgtacacttgtagtncccagctcctgggagaggctgaggcaggtggtttcactggagcccagtagttt

SEQ ID NO: 487530 - DNA, 665 bp, Homo sapiens
ggggcgcggctgagaatggctgttactacgagggctatgtgggtgatgtgaagaggtatgcaatgagcgattttaggtctgtggtcgtgagagatggagcttgtataaggacggcgacaacaagagacaaagaagcaagacgccacgaagaagaaggagagtagggcagaggccacatgcgagagaaaagcaaaggcagaaacgaggcagcaagcatagaaaaggaacaaaaaagagaaaaacaggaaaaaaacagaaacaaaaaacgccgaaaacagaaaaaagaaagcacacgaggaaaaaaggagacacagacacagagagaagagaacaaagaacaaacgaaaaagcaccgggcacaacaaaaggaaagactaatgagaacgagacaggggagaaccgaacaatcagaagccagacacaacagagcagaaaaagggacaaaaagacaaaaaaaagaggcaaagacacaaacaagacaaaaacgagaagaaaagaaaggccacagaaagagaggcagaaggagacaaagctgcgaagaagaagaaaaaaaaacgaatacaagcaagaaaaagaaagcaacgcacgagagtcccaacatcatacaaggaacacagcgcgagaagaccgagcacaacaaaagccaaagagctaaagaacaaaaa

SEQ ID NO: 487531 - DNA, 105 bp, Homo sapiens
agcagatagccaaacaggtcatgtggtcctggtaccccaggattcccaaaggctcaatatctctaaccagctggtgctttccgaggcagccagtgcccctatggg

SEQ ID NO: 487532 - DNA, 91 bp, Homo sapiens
catggatttgctggtgcagtacaactaggcttaatagggacatgtgcttaatacatcccttactcaaggcaagcccagtcccatagtcaga

SEQ ID NO: 487533 - DNA, 1021 bp, Homo sapiens
gtcagcgcgatgcccaaggccaaggtgcaaaacccggaggcagaagtatggttacacgtgtcaaccgaaagcgtctgaatccggaatgctcgacggaagtgcagcgcctgcggatctgaatggtgagggggctgtggtgttccggagtggccagtgggcctcgtgcctgggacgggtccgcgagatgactggatcctgcgatgtctactctttgcctggtagcttcccacatcctgacatgccgtgggaccaccgctaaaatcggtacggcagaacctggcccgagatgggggttggcctgtggaccccaacagggcggtgccccctctgtacagagaaaggtactgacatggcagggtctcggtccttgtcttctttactcttcccccgccatactgacctaggtgtcagaacgtggtactagcccattccttccctcaggcccttccgagtttatcgacctcccacacagtcatgaacgctcaactgaccgttgagcaaggggtctctttacgaccttcgtcacactccctccccagtcacacattccccatacccctctactcagttcttttaaactctgacaattaaccccattaagcattctcaacggtatttttccttaacttatctttttctacccttaactttcctaattagtactccctaagagttgggcgatcttaaacttacaccttatcttggttattcaatcatccttggcctgaggcttccctaggcttacctgaactgcagatctccttatctcgggcgttcaagctaatattcctccgactttaaggcggtccccaaaaattagcctggggcaaattataaatgctgttgttggcaaaccccattgcccgtgggtggaatatggacgggttacagagtagtcaggaggtgtatctagcatatgtagtttggcgcaagcgtgcgtacataatcgtgaacaggcgtgggcccccgtgatgtgctctaagaagtacttacactgatcccatgatccaataaaaacatt

SEQ ID NO: 487534 - DNA, 155 bp, Homo sapiens
  misc_feature (128)..(128): n is a, c, g, or t
aaaattagcagcttaaagacgtacactaacctttggttggttactcctggggccagtttctgtaaggtcagcggtccagacacagctcagatgggttccctgtctccttttctctgaaggtgcagtcncaccaaacaaaaaaaccctttaaaaac

SEQ ID NO: 487535 - DNA, 868 bp, Homo sapiens
atgctggacactaactggcgcgcgtagtcccttacattcttgccactcgttcccgggtccatgtctgccccctgtccgctctgggggtcctataccgtggtcaccaggtctccggaacctctttgtcccggccgcgagtccacggaacacgttccctccggggttctaccacccctgggggcaccccccgcatttgtccggggccgattttttcccgcggttttgcgttcttctccagtagcgcgtccaggtatgttctttatctgggccacataaaccacccagaggggagtttgcccacctggcagcccataagtgacgcttcttagcctttcctctcgcagcctcccgtttggagaacaacccatgtcggccgttgttgctgggtcttctccaaactgggcttttgatgcagggcctccacacagtgtcaccacccggggtggggtgcccctccagtggccggggcacatagtggtacaccccgcacaccatgtgcacgcaacagggcttgcccctgcggcggcgtttaaatcatcgcccagactctttggggtccaactagttatcggagggccctgaattgtgcgccgcgtggccaggagcctccctttcacccacggggattaccgagagcccctttgcttacccgagaagggccacacaccctctggggcatattatcgcttttatccccgggccccccacactgcctagtgcgcgccccccactcctgtgatactggcgaggctcagctcaactgttccccccccgcgagtgccaccccgctgctgtcccgacccagcgaggccccccagggccccccccggccaacccctaaccccgcgcgccttttccccaaaataac

SEQ ID NO: 487536 - DNA, 512 bp, Homo sapiens
gagccttcaccatcttgttctaaactgccccaataaagccactaagaagtcatttataaaagaacacaggaaatatttcaggaacatagagaactgggagtggcaaacaagatttaaatcagatcagagtcatacatacaccaatttttttgctagggttctcaagcagctgtcatgtttcttgttagtgagtgtccttaactattatttaatatatttgctgatcataagtagagtagatgaatagtaaacatttaattctgacatttgcagtagatatagccacatctttcaacatttttagttttccgtatatttggttttccatatatttctgagaatgtaacacatttgtgcatttgtttgcttgatgacaatactttcagagtttttccataagaaagtctctgtagcaaatcaagcaaaaacagaaaattaaagagaagggaagtgaatccctctctcctcatattgtttaatttccatgaactgcctggatttactattttagg

SEQ ID NO: 487537 - DNA, 524 bp, Homo sapiens
agtcggttctaccatactctagtacatgatgctaataatacagcactaggcttattgggtaccatgtgtgtaagagattcaaaggcattttccaaagagaattcaatcctccccacctcccaagcaagtatagtggcaaaccctaaagtcatcaggaaacttaagagcatattccatccctcttgctctatattctgacgacatgtccagtcttccagataaaggcactctgcaatcagaactagatgtttgagtcatgcttctgttttttggagtgtagaggtattgaccaccttagatccaactcatgaaacagattaagttttcacacagtccaaaaataattgatatgcttaatgagaacttatttcacttaaaatttctaccagcatgaaaccctctgtaatatgcccatccagtttgtacatcagtagaagtgctcctctttaaattcatatagcaaggtttggcacattcccttggttttcccctaaattacctcatgcaaaaaaggaattgtacct

SEQ ID NO: 487538 - DNA, 390 bp, Homo sapiens
gctcctcgacacttgaaatgtgttgagaaattggactcagtacggagaatagcactgaaatgatgaaagaaatggaatgatgtatttatggaaaaaggttaaaggagctgaacatgtattggctggataagcaatgactaacagggctggggtagcacctttcaaatgttgacttagtgctaccccagccctgttagtcaacatttgaaaggtgtaatttccctcagagaaaagggctatataaatgtaaaataacagtaatagtattaaaatgccatgggaaagcacctaagaggggatagggcagacttagtgtgaggttagtgatttaggtaacatcctgacctcagccatactaacaatagtcctttatttgccatgatgtcattg

SEQ ID NO: 487539 - DNA, 772 bp, Homo sapiens
gcgtcgacggacgagcggaccaaagcggcggggacatgggcgcgagaatgacccggacggacagtttctcttcctcctgtggcaccattgccgccggcgtcgtgctcatgattcagtcaggtcggcctggacgtcccggactatgtgctcgtgacctctggcgcttgctggaagtccagacccagcggccgtagctagcgtctggcctgagaacctcggctgctcctggctggctgctgtggcaacacactgatgcactggatagccatctgcaatgcgtgcttcccagaaggaaggcatggctgagtgacgcgacgatccgatggtgcgtggcccgggtgcaagtgtggttggctgccggcgaacgaatgggtcgccaaaggcaaacggagtcccggtattgggccacaagagaaaagcaccacaggcagaacacttacaccacaggggcggaaagtctggcacaagagactctcagaagaatagtggccccgcagagagaagaagggctgtcgtgtagagacctcgtggttcaggggctctccttcatttgaaggaagtctggtggttctagaaatatttccagaattattcaagagtactcaggatgggcatgtgaagtgactgaccttaagaatgtttccattactccctgtgaattttaacgttgacactcattcctgatggtttgaataccctggttgaaaaacaattcagtaaaagcatcctggcctcaggaattgagaaaaagaacaaacaaaaaaacaaaaaa

SEQ ID NO: 487540 - DNA, 92 bp, Homo sapiens
cgttggggggatcaatataggcgcagggtgggtgtttcggatcatttatggatggggtttaaaaaattaaatgaaaaatggtaacattaata

SEQ ID NO: 487541 - DNA, 397 bp, Homo sapiens
  misc_feature (326)..(326): n is a, c, g, or t
  misc_feature (360)..(360): n is a, c, g, or t
  misc_feature (371)..(371): n is a, c, g, or t
  misc_feature (387)..(387): n is a, c, g, or t
gaaattctctcaggaatcttctgcacatctgttttacccacactgcaagctattttcaaattctctcggagttcatctccgtggactgctaacaagcaaaaatacagctaattttctctctagaattacatgtttctatttccacagaaacaatactgctcactgtactcacaacacagatcttgtattcggaccaaaataaacagtagtttcccttgtatttctgtaaaactcctaaaagagtttacttaataatgagaaatgaaaggaaatgaatttctaaaggctacaaacagattacaaatccacagaatttcttacccgcntgggataaggtgtatggtgaaggggatcttccgnaaaagtaaagntgcaggctgaatacanctagatttta

SEQ ID NO: 487542 - DNA, 643 bp, Homo sapiens
  misc_feature (22)..(22): n is a, c, g, or t
  misc_feature (39)..(40): n is a, c, g, or t
  misc_feature (111)..(111): n is a, c, g, or t
  misc_feature (121)..(121): n is a, c, g, or t
  misc_feature (183)..(183): n is a, c, g, or t
  misc_feature (197)..(197): n is a, c, g, or t
  misc_feature (228)..(228): n is a, c, g, or t
  misc_feature (246)..(246): n is a, c, g, or t
  misc_feature (288)..(288): n is a, c, g, or t
  misc_feature (379)..(379): n is a, c, g, or t
  misc_feature (457)..(457): n is a, c, g, or t
  misc_feature (476)..(476): n is a, c, g, or t
  misc_feature (492)..(492): n is a, c, g, or t
  misc_feature (500)..(500): n is a, c, g, or t
  misc_feature (523)..(523): n is a, c, g, or t
  misc_feature (547)..(547): n is a, c, g, or t
  misc_feature (600)..(600): n is a, c, g, or t
  misc_feature (607)..(607): n is a, c, g, or t
  misc_feature (626)..(626): n is a, c, g, or t
gggccgagtccgtcttttgaanaactgggacgtgtgccnngacatggtgggcaccttcacagacaccgaggaccctgccaagttcaagatgaagtactggggcgtacgccnttctccaganaggaaatgatgaccactggatcgtcgacacagactacgacacgtatgccgtgcagtactccngccgcctcctgaanctcgatggcacctgtgctgacagctactccntcgtgttttcccgggacnccaacggcctgcccccagaagcgcagaagattgtaaggcagnggcaggaggagctgtgcctggccaggagtacaggctgatcgtccacaacggttactgcgatggcagatcagaaagaaaccttttgtagcantatcaagaatctagtttcatctgagaacttctgattagctctcagtcttcagctctatttatcttaggagtttaattngcccttctctccccatctnccctcagttcccatanaaccttcnttacacatcaagatacacgtggnggtcagtgaatctgcttgctttcngaaagtttctggggcttaagattccagactctgattcagtaaactatagtcancgtgaanaaagagcagtatgaataanggcggcgaagcttatcc

SEQ ID NO: 487543 - DNA, 1083 bp, Homo sapiens
  misc_feature (264)..(264): n is a, c, g, or t
cacggtgtgatcacacctgtaatcccagtcactttgggagactgaggcaggctggaccactggaggttcaggagttagataccagttctggcccaacatggtgaaaccccgttctttactaaatagcacaaaaaactcggtctggagtgatgtctggtgcgagacactgtagttccctagcctatctccagtgagtgccttgtagcgtcagtgtagatactctgtccttgtaaacgctggcgaagtgacagagcgcttagcagntggagcacggagctcggtgccattgacactccatgcctggcgacaacatgcttggaagactccatctcgaggagaactacaacctaagagtagcagtaagattggaacaagtcaaactcatggtccgagagcatttgtgcatgagcccaaggtgctatgctctcctacatgcatagcttccattcataactcctgcgacgcttgtatagctccgtgacaggcctgatcattctacccgaggtcaattcccgcgagaaaaataacgcctgttataacaaaaagatgctatattcggggatcccttcaagaggcccaagagggtgttgccttgaagccccgtggtattaagctaaacagtcaatttttgccaagggtcccgagggccctgcgggctgggaccttccaggaacgctccgtggattataagttgtccttaatgccagcttccttgggggcaggctgcccccgcaaggtggccaaaagtccgaagacactttcggcgctttggagcaggctcacgggcgacgcttttgcccgaaagaataccaatggtctctttggaagcacaaaacacaattggggcgccggtaaatacacccctattgcttctttccttaagcttaaacccaggcttaccaaactacatgtttaaggccccaagcgggtgggctggcgtggggcgcgtccaactttgccctatggtgtgcaagatccccccaagggtatatacgtccaggggggcacgcggccgtttgcaagcgccagggctgtatgaaaaaactcacacctgtatgaaggccccctatgaaaaggggctca

SEQ ID NO: 487544 - DNA, 224 bp, Homo sapiens
gtgtaatacgataaggcacaaatatgaaaacttatgtaggcaaagtgttactgaatcagaaagaaaagcggctctttatatgaactgttatttataatgtgataggtaaggctcaggtgtaacatccatgggtaatagagaaacatgggtggagccaccaacaactcgttaagagaccccatcctcatgccgcaccaggctaaaagtgcagaacttagcgtcgc

SEQ ID NO: 487545 - DNA, 382 bp, Homo sapiens
tgttggagtgcttgtgtcccagttactcgggaggctgaggcaggagaatggcatgaaccttggaggcagagcttgcagtgagccgagatagcgccactgcagtccaacctgggtgaaagaacgagtctccgtctcaaaaaaaaaaaaaaaaaaaattgtttaaaaaaaaaaaaatcaccattattcctactctacaaacttattacattcattaacattttgggttgtttttggatgcaccaaatagcaaatacctctcttttctgtctcctctggtgttgtccatttttcttccacctgttccaaaacccattaaacctcaggttcttcgtgacttcacgcctcaggtgctcccttctaagacattatcaggctgcccttc

SEQ ID NO: 487546 - DNA, 875 bp, Homo sapiens
gagagcaggccacgttttagaccaggcctaaggcggcctttgtggggacacccaagtgtgattttgttgagaacagaccaatgaaattaagtttggattcctttttcaccagttgctttaaaactccctgtctcccgactgtgaacaccggggtgcacctcagacagaggaaatttcctggaccctcccccctccttggtccctactagagacctctcaacagattctgtggggccacacattggggttttatcaagctgctataatgtgaactaagttttttacttccccgatatacagcccctaccttcttgacctccccaccccccacccacccccatcttttaatatgctgtgcggcatagaactccggatgacccgcatgatattttcagagtcttgtccccggggtattagcacctctttgttgcaacacgggaattgattcacagagttggacactggtctcctctgattatcacggtactggggctgagggcattcaaaatagtaagcctccctcctcgtcccctgcctcaagaaattgcctccttatgttatcacacatctcttttcctccccttccctgagagctcaccagtacacatgtgttcagaagcccccaatttgcaccacggttttcagccaactcagaatgctctaattctttttctttgagaaaggaattaagatacactccttctgtgcccccatctttcctcccaactcctgcctgtgtttgttgtggataccccgtcccagaaccaccctgttgagttggacaccctgtaaacccctgggtaactctcaagtcatgatggagacttcaggttgttctgtataaaaagccaaattaatgtttttattaaccatga

SEQ ID NO: 487547 - DNA, 678 bp, Homo sapiens
ctcgggaaaaattgattaatgcttaaaaggggggaaagagggaacattcgaaactcagattaatgatgctttgtcctcagaggcaattggtttccactatatgctagtgaattgtgttcggacagtgggcatacaatgagacgcctatgttagcgatgatttaaaaagatccaaccaaagactctgtttgagcctaggaacataaatcatttgacggtaaacttctttgacctgattacccaggggttagaggccaatgacgggggtcgatgtcgagaaggaatattctggctactgagacagaaattttaaatacgtggctaagctcttggcgtctatgaaatggcggctcttttactgacttgaggtaaacgcatactcccaaacaaagtgctcaagggaggaagccgtgcaaaaacgagcggagacaggttcctaggggaattaaataggagtcacacaaagggtgggaggaggctttacaaattatggcagaggcaaacagaaagttggctattaagaggtttaaacagcccgggggtgcaaagagtcattttttgactagagaaaggagccggggccttttggggttccggagactttcccggtaaaagcagggctttctaaaaacaattttggacccttttccaaaaggggggacctttagaaagtttttgt

SEQ ID NO: 487548 - DNA, 611 bp, Homo sapiens
  misc_feature (115)..(115): n is a, c, g, or t
  misc_feature (265)..(265): n is a, c, g, or t
  misc_feature (289)..(289): n is a, c, g, or t
  misc_feature (296)..(296): n is a, c, g, or t
  misc_feature (312)..(312): n is a, c, g, or t
  misc_feature (322)..(322): n is a, c, g, or t
gatttccaggggcatccagagaagctgatcagactcaggaatccatggggtgaagtgaagtggtcgggagcctggagcgatgatgcaccagagtggaatcacatagaccccggcnggaaggaagaactggacaagaaagttgaggatggagaattctggatgtcactttcagatttcgtgaggcagttctctcggttggagatctgcaacctgtccccggactctctgagtagcgaggaggtgcacaaatggaacctggtcctgntcaacggccactggacccggggcnccacagntgggggctgccagaantacccaggcncctcctaggttgaatcagctgaggcagcacctgatgaagaaactcaggaagacagccccacatctctaaggagaaatgaagaaaagcaaatcctgctctctctacttttcacctcctgctccccatgttccctgcctggtttgctgttgatctgttgattgacttagactgtaagcgcatggggcagggccagtcactttcttctcatgacagagctcactgcagggctgtgctcggtgctagggaagcagcattagaataaaaccccacctggatgcaaaaaaaaaaa

SEQ ID NO: 487549 - DNA, 385 bp, Homo sapiens
tttgagaccgtgtctcactccgtcgcccaggccggacagggagtctcaactcactacaacctccacctcctgggctccagcaattctcctgcctcagcctccagggtagtggggactataggcacgcaccaccatgcccagctaattttgtatttttagtagagatgggttttcaccatgttggccaggctgggctcgaactcctgacctcaggtgatccgcccgcctcggcctcccaaaatgctgggattacaggtataagccaccacgcccagccaaaataaattcatttttaacaatcaaaatgttttttaaacaaattataatttcactatcatttaaaactttttaaattttttaaataaattttttttaattaaggcgg

SEQ ID NO: 487550 - DNA, 1362 bp, Homo sapiens
  misc_feature (744)..(744): n is a, c, g, or t
  misc_feature (865)..(865): n is a, c, g, or t
ggtggttatgtccttcatactggtccgtgttgccctctcaggcctcctggtgatggaacccatgacgcctctggcgaatctcacaatcagggtaccatctcacgaggcagatttgtgcgagccattatcaacggattttgcttgatgtagtgagcctgcttccttcatggaactaacccggcatgatttgttctactcgtgcagtcttccgagaattaaatactcaatccataagactatcggtagatagcccttgtgtgctcgtaggtgccaccaatcagcctctcgttcgcgaccagcactcgcaagaaagtcgccatcctacaaggaggtagggtgctcgttctttggcttgttcccgacatattcgtacagctctcgaaatcaagtcaagcgaaactcctgagtcacttcgtcttcctgatcggtcttgtgtgaccaaaggctgcgatcaacgggtattaggaaaccatgaggcttacctcggtccccagctaggaatggacctcaagccaacctttgtgggccaacaccgaggattactccttgcacatctaccgggtcgtaccttgctcctcatctcgagcatttgcgcacttccctcctttggtagctttccgttgggcaagtgcgacaatgcgcacttgcgccttagcgccctagtcgtctaattgcgggcattccgttctaaccgcatagtgtcgagacaccacacattcttacatacgacctcaggatttgtgnttgcgcggtgacagatatccattcccaaacgattcccttgttcgctttcggagtcaccgtttaacctgccttcatccttgggcgttggtggtggcatagtccctacatagagaccctcccnaaaggccagattccaaaccacggaattccattaagcgcggtattcttatacgcgaagccgctgcggcaccaccgaatccgagatttttgttcccacggcaaattggcacacaccttttgaaaacacggctccaattagccaataggctgtggattcccaaagggatttctctccggatgggccagaaacaccaaagggaggaccaaagggaaatccccaaactccccgaagggtttgtgccataccattcacaccccttgcggccccattgcggttcccccttgtccttgcaatttggcgccctcctacggaaccttctcgtttggtttggtggcctttggggccatgatccctaggccggtgcgaaccagaggcccccctgggcttttggctgtaggggtattgtttgccgcatgtgtgggtttgtaacccggaattctttgggtgtcaacgcagccagaccgtttatgcgtcttggtgtttgtcccttttagggg

SEQ ID NO: 487551 - DNA, 633 bp, Homo sapiens
  misc_feature (18)..(18): n is a, c, g, or t
  misc_feature (161)..(161): n is a, c, g, or t
  misc_feature (583)..(583): n is a, c, g, or t
  misc_feature (593)..(593): n is a, c, g, or t
  misc_feature (625)..(625): n is a, c, g, or t
ctcagcctcccaaagtgntgagattacaggtatgagctaccatgcctggcgttggttataagtggtgtgactatggaggccatctgtgtgttacaataagtgctatggcctgaagatttgtgcccccagtcctgaattcatacattaaattctaacccccnctgtgaggatgtctggagggggggtctttgggaggtgattaagtcatgagagtggagtcctcatgaatgggattagtgcccttctagaaggcacaggagagcttcctagtcccttctacccttccaggacacagtgagaagatggccctctatgaaccaggaagggggccctcacagacaccagatctgccagtgctttgatcttggacttctcagccttcgaaactatgagaaataaatttctgttgtttataaggcacccagtttacagtattttgttgcagcagccagaacggactaagacaacaaggatgaagtgaagcatcctggatatcctctgcctgtaatccggtctgatgtgcggcacttcatgtccgagcttatccatttggttttggtctttggaaaagacaacgttagtnacttactagntgcgatgcatggagaagaggctcactgtgggnaaggtacc

SEQ ID NO: 487552 - DNA, 713 bp, Homo sapiens
  misc_feature (229)..(229): n is a, c, g, or t
  misc_feature (663)..(663): n is a, c, g, or t
  misc_feature (673)..(673): n is a, c, g, or t
  misc_feature (705)..(705): n is a, c, g, or t
ttgaacccgttcaaagatcggcgaaaaaatgcttgagagtgttctcagagaagaaggcccaggccctagaaattggggatgtggtagctggaaacccatatgagccacatcccagtgaggtggatcaggaagatgaccagttcaggaggctgtttgagaagttggcagggaaggattctgagattactgccaatgcactcaagatacttttgaatgaggcgttttccangagaacagacataaaattcgatggattcaacatcaacacttgcagggaaatgatcagtctgttggatgaagaaacacaagacaccatgcaagtcccagactcatctgagaccttctggaacacggaagctgacattttggacacagtgagaagatggccctctatgaaccaggaagggggccctcacagacaccagatctgccagtgctttgatcttggacttctcagccttcgaaactatgagaaataaatttctgttgtttataaggcacccagtttacagtattttgttgcagcagccagaacggactaagacaacaaggatgaagtgaagcatcctggatatcctctgcctgtaatccggtctgatgtgcggcacttcatgtccgagcttatccatttggttttggtctttggaaaagacaacgttagtnacttactagntgcgatgcatggagaagaggctcactgtgggnaaggtacc

SEQ ID NO: 487553 - DNA, 761 bp, Homo sapiens
gctaggtagaggctgggtgtgaatcggccgaggcagacttcgctcgtactcgtgcgctcgcttcggttttcctccgcaaccatgtctgacaaacccgatatggctgagatcgagaaattcgataagtcgaaactgagagaagacagagacgcaagagaaaagatccactgccttccaaagaaaggattgaacaggagaagcaagcaggcgaatcgtaatgaggcgtgcgccgcctatatgctactgtacagttccaccagagcattgccgttcttattttacttctgtttagctgtttaactttgtaaagatgcaaaggaggttggatcaagtttaaatgacgtgtgctgcccctttcacatcaaagaactacgtgacaacgagaggccgcgccatgcctttcccatctgtctatcttatcttggcttggcagggaatgcgaaagaacttgctaatgttgggtgtaaggaagaagtgcgggtgcgaagaacagtggggtgggactgacagtgataatctagagtaaaaccaagctggcccaaggtgtcctgcaggctgtaatgcagttccaatgcagagtgccatgatcatgtcctcttgggttcgccttggatgttccacgttatcgggcaatggcccaatttttatcaacctatcgcaagctaagcaccgttgaaaagcctttgaaaacacctctcaagcctagtacctcagccatatactccgcccgagctaattgagccggcgtgccacagctggcc

SEQ ID NO: 487554 - DNA, 268 bp, Homo sapiens
tgctgggggtaaagttggtcaggttaagcttttacagagcaaaacccaaagctcttgtttggtgagccgcttcaagctgcctttgatctctcctgcagacctcctgggaatcagtggtccgaaagggtcacatatgaggaaatcaagaccccgagagggaacgtaacttgctcaagcttgttcagctggtttacaacacgggtgggatcagaaaccccggcatacagggaccgattctttcactctatcataaaataaaaggagctcc

SEQ ID NO: 487555 - DNA, 169 bp, Homo sapiens
agttgctgctgagaaatctcactttgatgtgtgtgtctgagaccgggtgctcagtccggctatgtattgcgagatggagccagacctgccggtggcatcttgtatcctttcgtctccggctgctcagtaggggatggagatttgaactcgtcgccaagcctctgccaca

SEQ ID NO: 487556 - DNA, 992 bp, Homo sapiens
  misc_feature (30)..(30): n is a, c, g, or t
  misc_feature (45)..(45): n is a, c, g, or t
  misc_feature (54)..(54): n is a, c, g, or t
  misc_feature (62)..(62): n is a, c, g, or t
  misc_feature (105)..(105): n is a, c, g, or t
  misc_feature (126)..(126): n is a, c, g, or t
  misc_feature (133)..(133): n is a, c, g, or t
  misc_feature (145)..(145): n is a, c, g, or t
  misc_feature (150)..(150): n is a, c, g, or t
  misc_feature (165)..(165): n is a, c, g, or t
  misc_feature (176)..(176): n is a, c, g, or t
  misc_feature (181)..(181): n is a, c, g, or t
  misc_feature (184)..(184): n is a, c, g, or t
  misc_feature (193)..(193): n is a, c, g, or t
  misc_feature (197)..(197): n is a, c, g, or t
  misc_feature (204)..(204): n is a, c, g, or t
  misc_feature (212)..(212): n is a, c, g, or t
  misc_feature (216)..(216): n is a, c, g, or t
  misc_feature (220)..(220): n is a, c, g, or t
  misc_feature (224)..(224): n is a, c, g, or t
  misc_feature (229)..(229): n is a, c, g, or t
  misc_feature (237)..(237): n is a, c, g, or t
  misc_feature (246)..(246): n is a, c, g, or t
  misc_feature (271)..(271): n is a, c, g, or t
  misc_feature (277)..(277): n is a, c, g, or t
  misc_feature (279)..(279): n is a, c, g, or t
  misc_feature (288)..(288): n is a, c, g, or t
  misc_feature (292)..(292): n is a, c, g, or t
  misc_feature (302)..(302): n is a, c, g, or t
  misc_feature (309)..(309): n is a, c, g, or t
  misc_feature (316)..(316): n is a, c, g, or t
  misc_feature (319)..(319): n is a, c, g, or t
  misc_feature (327)..(327): n is a, c, g, or t
  misc_feature (331)..(331): n is a, c, g, or t
  misc_feature (339)..(339): n is a, c, g, or t
  misc_feature (364)..(364): n is a, c, g, or t
  misc_feature (367)..(367): n is a, c, g, or t
  misc_feature (375)..(375): n is a, c, g, or t
  misc_feature (403)..(403): n is a, c, g, or t
  misc_feature (411)..(411): n is a, c, g, or t
  misc_feature (433)..(433): n is a, c, g, or t
  misc_feature (446)..(446): n is a, c, g, or t
  misc_feature (448)..(448): n is a, c, g, or t
  misc_feature (526)..(526): n is a, c, g, or t
  misc_feature (529)..(529): n is a, c, g, or t
  misc_feature (547)..(547): n is a, c, g, or t
  misc_feature (555)..(555): n is a, c, g, or t
  misc_feature (572)..(572): n is a, c, g, or t
  misc_feature (674)..(674): n is a, c, g, or t
  misc_feature (977)..(977): n is a, c, g, or t
cccgggctcgcccatgaggcctctgcccancgggaggaggaaganccgaggcanctccctangactcttcgccctctgcctggccgcaacccgctgtctgcaaantcaaggtgtgtccctaaaaantcctcangccaacaacaangccantgtcaaaaaaaaaancctgctctcanttgantantcctgtcanggantgcccancaacgaangganaaantcanccaantggggaangcaaaagancgtggagtggaaaacaaggactcangccaananctctcaaanccanaaagaaaaantctgcanctttganaanggctccanccanctcttcancgtgggagtgagggattccggctantangtcatcancgtgacggagcgcctggggagcagccantttggcancatcgtgctgcacgtctctganatcctctatgaananctgcactttgtcgctgtcatccttgcttttctcgctgctgtggccgcagtattaatcagcctcatgtgggtttgtaanaantgtgcatataaatttcanaggaaganaagacacaaactcaaanaaagcacaactgaggagattgagctggaagatgttgagtgttagccaaggctgggcctgactgcattcctacctcaagaggaaaccattctccaacaaaaanagcaagcacagctattatacccattgtgtgtggtcctgttgcagcccgctcctaacaggacagtgggagattaacaacattgactgcatggagttgaggactgtggatgggacaaagctagtattaggactcgcgctaagttcaaggagaagagtgattgaggctttgaaccaggagcttcgcttggctgcagcatcagggccgtgctgacacataaccaatgggtgagtgcaggcgttggctgcttgctcacgacacttgctctggtgtgcaggatggcctgttgtcaaattcctgtatcanaggcagaggatttca

SEQ ID NO: 487557 - DNA, 369 bp, Homo sapiens
gctatttagtaatataatttaagaacatgagttaacccatagtattgagggtccaagtattagttgccagcctaaaaactaaaatatggccaggcgcagtggctcatgcctgtaatcccagcactttgggaggccgaggcgggtggatcacctgaggtcaggagttccagaccagcctggccaacatggcaaaaccccgtctctactaaaaaagtacaaaaattagctgggcgtggtggcgggcacctgtaatcccagctactcgggaggctgaggcaggagaatgacttgaacccaggaggaggttgcagtgagctgagatcacgccactgcactccagcctgggcaacagaacaagactccatctcc

SEQ ID NO: 487558 - DNA, 667 bp, Homo sapiens
  misc_feature (255)..(255): n is a, c, g, or t
  misc_feature (259)..(259): n is a, c, g, or t
  misc_feature (266)..(266): n is a, c, g, or t
  misc_feature (268)..(268): n is a, c, g, or t
  misc_feature (270)..(270): n is a, c, g, or t
  misc_feature (286)..(286): n is a, c, g, or t
  misc_feature (289)..(289): n is a, c, g, or t
  misc_feature (326)..(326): n is a, c, g, or t
gtatatatggttgccatggaactggtgtttgtttgattacctggggctgtttgggcctctgagagtcctttatagctgattgtcttttgggagagtggagttggagccccaccctgtctcttgagtcactcctaaggtgcatggtcaggcaggtgctggggaatcggctactcctccagagctttgcgtgccatccctgtggccctctgggagtctggagcccattccctcacactggtactcactgcagctggngacntctgcantngnaagacaggacacggcntgnaagctgcctctgcccagaagccatgacattctggtcnccagcctgatgctataaaacgagtgtcacggccgggcatggtggttcacacctgtggtcccagcactttgggaggccaaggcgggtggatcatgaggtctggagttcgagaccagcctggccaacatggcgaaaccccgtttctgctaggaacacaaaaattagccgggcgtggtggttcatgtctgtgatcccagctgcttggaggctggggcgggagagtcgcttgaacccgggacgcatcggctgcagtgagtcaagatcgagacactgccctccagcctgggcaacggagcaagactctgtctcacacacacacacacacacacacacacacacaca

SEQ ID NO: 487559 - DNA, 223 bp, Homo sapiens
cttttaaaaaggggttttaaaccgaaaacattttcctttttttttattttaacaaaggtgaaaggggggggtttggacaaaaaccccccacaaaatttaatgggggaaggaaaaattccccgtggttgggaaaaaaaaattatgggggtttttaatttaaaaaaaaaagggcaaatttcccccccccccccctattcccgggggggggtttttgtcgggggga

SEQ ID NO: 487560 - DNA, 688 bp, Homo sapiens
atcgcgccattgcactccagtctggtaacgagagcgaaactccgtctcaaaagaaaaagaaaaaatatttatgaatgtccaaaacatgtaaaaagatactcaacataattgcaagggaaatataatatttttttttttttgggaaacggggtctcgctttgtcaacccaggcgtggagtgtgcttgggcggtgactcaatagtttaacgtgcaacctttgacctcgtggtggcctcagggtgactcctcttcacctttagcctcccgagttagcgtgggactacatgtgggtgggtggccatcgtgtagtttccagcgtgctcgggaaggctgaggcgggagaatcgtctgggactgggggagacagaggttgcagtgagctgagatttatgccatggtcactccagccggggtgacagaaccctgtctcaaaagagaaaaaaaaaacaaagagaaacaggaaatttcgaggaccctttaacgtttgcaaatgtatcaaaatctgtggccagagaagaactgtttaacgagaaagacctctaacttacgggggaaggatttacccatctggccatgctcttggaaagagaccccactttgtgcaaccctgtcccaggttctcccccaaaaagctccaaaagaattgggtgtctcccccaaattctgcgagggactatgggggaaacat

SEQ ID NO: 487561 - DNA, 378 bp, Homo sapiens
  misc_feature (58)..(58): n is a, c, g, or t
  misc_feature (296)..(296): n is a, c, g, or t
agccgagggttgttcccctccagagcagaacccggcagccgcaggggttgcctggggncgtgtgtttctcggccaccgcggtaggactgtgtgtggggctgtgtctcccattctcccttctctctctgtctctcaccctctgtgtgcttctttccctctgtgtgtgtgtgtgtgtgtgtgtgtgtgtgtctttggacgaatgtgccctgtgcgtcaaaaagggatgtcttttatgtggaccggtctttggtgagcctctttctgcgtctctccctgggtcctgcggccagctgtcnatcgtcttcgcggcggttccactttgggtctgtgcaggcctcgataacgtgaggggatgcatcgggcccggagcaatggaag

SEQ ID NO: 487562 - DNA, 346 bp, Homo sapiens
gaaggtccatttggatctctggcatggagccaagctctatgctgtctatattgttatgattaatacgacaatagatatactaagaagacaagtaggatataccaatgttcttcggtttagtaagtttgtttaatctgcgtgctctttatggccaggtttctttttacttcattatactggatctgaggacttcgagtttcccaataacgttctattaatgtgcattatctttcatggccttcttggaacagtacgtctcagagttcctgtggttgtggggctgctttcttacctcatcattgatatgcacacttgcactaagccttacaatacctctgtccatcat

SEQ ID NO: 487563 - DNA, 310 bp, Homo sapiens
ctaacaatctaacacccatagtaggcctaaagcagccaccaattaagaaagcgtcaagctcaacacccactacctaaaaaatccctacacatagtactgaactccatcacacccaagttggaccaattctatcacctctatagcacgaactagatgttagatatacagtaacagtgaaacacattctccatccgcaacgtggccccaacgagcccgacacagggccatgtgagagcggacttctcggaccgccgccaaagctcgtctcggagaaagctggcctccataccagcgctgcgcgcacaagaca

SEQ ID NO: 487564 - DNA, 963 bp, Homo sapiens
tggacttgccgacggattccaagtccccaggagggctttattttttcttttacaacatccggtgcgggggcattcctgggctcttttggcccgtatgccagaaaagccggggcgtgggcacggggccatacgggagactagcgaaggtcttggaaattcttctcttcctcaggggatagactcgagctttctccttcttatagacgtcccggacgggcatgaccgggtccggtcagctgggtggccagtttcatgttcttcagcaaaacttggtctcccttctggggggccgagggctccctgggggaagaggatagagtttggagagcgggtactcattcagccgatgaactgtgggcctgcagggactccgtggacttgtccagcctcctgcggatccacagaaatggccgagggtccgggacacactttctgggagaatgccggaccaccctgagctcctccaggctgaagccgaaggccggagcagacaccttacgagggggaaccgaaccgtggggcagcgcacagaggggccgagatgggacccaaagcggggcaccagggagaaaatgcggacgcgccaatggaatagacagggcctaaacgtcaagcgagatctaacgggccggaatagatagaacccaagttggccacaacgcagcccagatgaccaagcactatagatagagaagcgagggagctatcaaagacccagtggccatctaccagagatggggggcgcccaatggattagcctaaagaggacccctgaggcgaatacatgaacaagggcacagggagatagagataacacgcgggcatataaaatcgtgacaatatgggccttaaacctacagagggtgacacacgggagaaactatgagacccccgaaaaggacgtcggagataacacaggggagtgcccataagtggggcactgttaaagccacagggggcaca

SEQ ID NO: 487565 - DNA, 941 bp, Homo sapiens
ggaggacatactgaatgccggtgacaaattaacagaggtccttgaagaggctaacactctgtttaatgaattgtcccgagcaagagaagcagtcctggatgcccactttcttgtttggggcttcagatttggggcaatagagaaatgcaaagcagggtgcgcttaagaccgtgaggtttccttgagacatgtctaaagatatgttgaaactctactcacactatattgggtgtaaaatccggtagaaagttgaagaactcatccgtgatgaagataggccctgattttgaatccataggtctattgaccttcctgaaaagataaccgaggcaggaaacagcgagaaaaacaccttttaataaaaagccataaattccactttctggtgggggttcaatataccggaggagtgccctggtgccaaaagcccacgatgttgactcgtccagggaaaagttcctgtgatacaaggaggagagggcaatgcctgcccagttaacgaacgcatgcaacgactctccattcaagaaggcacccagagacagacgtaggaacgacatcttggggatggtccgcacacatatttgcgagaggatcctgatacccaaaattgtctttctttgactttggggttgatcctcattctttccccccgtacagttgaaaccattcttcaatgttccttcataatacgggatgggtttgcaagaatacgacttgccaagaccggtgcaggaataaaagctgtagtatactggaccacatgggggtttgacctacaccagttgacttcaggataacttggtacggccggagaggtgtgaactggggttaaggggttcacgcgagcggaccacgcttctctggtcctcgttgccacacgagggtgtttggaaaggggaagtcggaagtgttgcgcccaaaaagccccgggcgcgccc

SEQ ID NO: 487566 - DNA, 758 bp, Homo sapiens
atctttcaagccagtaatgcagaattgtcttcatgatcactgtgatctacaagtcagtgccctgtatgctctcacaggtggatgtgctataacagcaagttcccatgaaggtgtgtaaaatgtcggtttttagttggcacttctatgatatggaaattattgaagaagaagcttgcttggcttggaaagaagatgtagaggccaagagtttccgggagaaggcgaaggcttgttgcaggtgaatcagtggctaacctggttagaaactgtgaagaagggaagaatcagaggacgacgctgactaaagaaccaggcaaagccttacaatgggtgcaaaacatactgtggctatgatgtaactgcatttgacctaaccactgcgaaaattcattccgtgtaagtgtttgtcgcaatatttagagcagaagcacgtcagtgaggatttccttctgcgtaagggttcgtgtagtgtaatgtgcttaagtcattagttctaccgatcaaatattttaggagtatcttatagatgtaaagatagtatattagcagggtgcaataattacttcataagttctcaagcagaggcagtctattgcaaggaccttcttgtgctgcagttatcataggctgtgttaagttagaaaatgaatagcaacactgaatactgtagaaatgcacttggtcagtaatactggagttgtgcatatttgatatcctttggtggtacagaaaattttacgtatggaggttgcgaataa

SEQ ID NO: 487567 - DNA, 288 bp, Homo sapiens
ggtcgacggatgtgtctggagtcttggaagctatgctaccctacgttctcctacaaatggaccttgagagcttgtttggaggttctagcaggggagcgcagtacatcgtatacccttgaccgaagaccggtcttcctctatcggggatggtcgtcctcttcgaccgagcgcgcagttctaggagggacgcacatggagcggtgagggaggaaggggacacccgcctagccagccagatcagccgaatcaaccctggcgatcaatggggtgacagatgtcgcagccagg

SEQ ID NO: 487568 - DNA, 369 bp, Homo sapiens
  misc_feature (18)..(19): n is a, c, g, or t
  misc_feature (253)..(253): n is a, c, g, or t
  misc_feature (265)..(265): n is a, c, g, or t
  misc_feature (353)..(353): n is a, c, g, or t
aagtgaaagtccctgaannaggggcgggatgcgcccgagtggcattttttgtcttaaggtagatcgcgtagctgttcttcagaataatcttcagagcgttgacgacagccatcgctgtgcattcctcaagaatagaatgtgtcggaagggtggcgtcattggtgttagtcatcgcttaggatttctcaatctggcttacacgggcgcctgtaccgatatccccgcggatggcgacgtatcgatgttgaattcntcgccagacgangtgcaatgagctgcggctataggcttgcgcagccttagatagccggccgtcgcaggcgcgccggttggccgggatcttcttctgcccntcaggtgtccggtcgg

SEQ ID NO: 487569 - DNA, 1607 bp, Homo sapiens
ggcagagcaatggtgcctcatgaggaagcttcccggcagctcaatgcgagcactactgctgccgaaggcaccacacacgcaagcacgcggttcgacggtgccgctggcctgccgagcgaggctggtccaggccttcgcggtggtcctggcaagtggagagggacgtgtgcgatgagcggaacgtggtccatggtcccgtatccagcgtgcggaggggagctcggaccgccagctgggagccgtacgcaacgcgtgggtctctacgcacgcgaagaggagggcccgtcgcatgaaccggagacacggcacgtgcgtggcccaccagaaggagcaaccgagagagcgagggagagcgacaccgacgtccgatagcgccgagacacatgagggcgcgccagagaggccatcgcaggcgccgcgacctgcgagctctaacgcggcttagtcgcggctatctcaccctggaggacgggaccgctgggcggtccgaacggcataagtgaactacccgcccaacgcggccggtccataatcacaccggcgggaaactacagtggacctcaacctattttctcacccgcgtgtaatgccaattcacaagcctccacaagggcaacttagcccactggggcgcccgttggccacgcgcaacgatctggggccaaggacccaacactggcctctttgacactgagtgccctccaacccactccgcgcgaacgaaatacacacggcccaatcggctcggggaggctaaacgccccttgggggcagcgcgtgacacaggggccccgagcatggcgaccccaccgagaaggaaacatcgcccaagtcgccggtccacccccttggcagaaccgcggcaacgccgcatggccgaagacgccagcatagccggcgaggtgccttaggccttcgttagccaaaacggccagccgtcacctacgcaggcaacctagcgtgccacactgggcaagcgaaaccggcaactccccgaggggcaggaaaacgggcaaaggcgaaactcgcacaacccgcaacgacagggaccgcacgcaaaccctctcccgcaaatgccctcctgtccctgcagggccgcccctcgcatagtctgtcgaaacctccacccccttccactccccacgttcggcacacaccctctggggcaccctcaccccacaacaggcgcgcgctaggcgcagtcagacaacctgtcggagcccgtaacctggatcgccgatcctcccctaccccgcagccaaccttgatccgacacttggccatcttcgcacgacatacctgtctcgcactgcctggcagatgaccaaccgcctcacccgtcgcggcgcaacccccaacactcgacccccgacaacaccgcccagcgggcgggctggcacaccggcccgcacaaaccggccgcccccgcgccacagccccctgcgacgcacgcggcccaccgcgcacagcggcacacacctggcctgcggcgccccactccacccgcaacggccgtcacgcgcccacgcaccaaccggtcccgagcccgcacgctagccacaccacacccgcccaccccaccgccgcccacgaccgaagcgccgacc

SEQ ID NO: 487570 - DNA, 118 bp, Homo sapiens
  misc_feature (4)..(4): n is a, c, g, or t
cccntggagacttcggtgcgtgaaactgtttacggtcatatgcttttctagtcaggttcaggtctcaggagcgcagtaggggccaggttctgggctcgtcaagcaaggcctagcatag

SEQ ID NO: 487571 - DNA, 242 bp, Homo sapiens
gaaagcttaataatgcaatcgaataccaatataatttcaagcactgcttattataatatttactggcgtctcttatttttaccctcctacaaacctcagagatacttcgagatctcctcttcaccacattcccgacgagcatctacgtgctctaacattttttggtagccacagtgcttccacagtacttcacgatccttattgcgtctcaacctttccttcacctattaagactttcgggc

SEQ ID NO: 487572 - DNA, 585 bp, Homo sapiens
tcattcagctcggtaccccgcagtagttcggccccctgggggcgcgcatcgcgatgacctgggatgcccaggggtgggcaacgagatgacggtagtaggcaagcatcaactcatgcagcggtgcatcttcgatggcccgctgcagagctacgtcttgaccgagtgcttgatcgaatccgagatcgtagaggtcatccacggagtccatccgcgagtacaagctcgccggggccacctccagccgcagggccactgcccggatcgtcaaagcacgcaggccaccttcgtccaacagtttcacagaggtggtggccacctgctctatatccactgcccgagcgcgacgaactggtctccgatgctcccaataactcatacttccatattaaccgaactgtgttagttttacgtgcatgttgaatgccgagcttcttccgctccgtgacgaccgggcggtgctgcgaccgatgcgcgcagaggacgcagatgcctatgctgcagggactacagatccggcggtgcatctgtatgctcatctgcctgaacctgaatataccccggcctcggtgactgagttgatccgcg

SEQ ID NO: 487573 - DNA, 371 bp, Homo sapiens
agtactattaaaaaaacagacaaaagactaaagaattaaatatgttaaaattactaatccaaatgtaaaacaagaatacaggcatattggcaatgctaatattcaaaatgggtataccccagtacataattcctctgctcccctcctacctaaaaatctcagacaagtattcataataaattaggaagtacagaatacttaaacaagccaaactagaatgctgcgtcgtaatgctaaacttatacaggtacaatttactttaacagcaccctgtacagccaatggaaagagtcaacaccatatccaacaaaaaaaaatacaaagcacaattaggactgaggaaagggtgtcaaatatgcactggtctgtag

SEQ ID NO: 487574 - DNA, 249 bp, Homo sapiens
ctctagtcgatctccagagtatactccccttcccccaagtgattggtatttgctatcacggggatggagtgtgacaaatctttggccattgcacaacgtggcttctgccattcatatggaggaatttataatatgtcattactgtcagagaccttttcgccaaacagtatctttagttcataggctgcggatttattatgtgattatctcttgtattagtaaaatggaatatttattaaataccttgag

SEQ ID NO: 487575 - DNA, 766 bp, Homo sapiens
  misc_feature (42)..(42): n is a, c, g, or t
  misc_feature (73)..(73): n is a, c, g, or t
  misc_feature (93)..(93): n is a, c, g, or t
  misc_feature (100)..(100): n is a, c, g, or t
  misc_feature (106)..(112): n is a, c, g, or t
  misc_feature (166)..(166): n is a, c, g, or t
  misc_feature (181)..(181): n is a, c, g, or t
  misc_feature (196)..(196): n is a, c, g, or t
  misc_feature (204)..(204): n is a, c, g, or t
  misc_feature (221)..(222): n is a, c, g, or t
  misc_feature (232)..(232): n is a, c, g, or t
  misc_feature (239)..(239): n is a, c, g, or t
  misc_feature (251)..(253): n is a, c, g, or t
  misc_feature (262)..(264): n is a, c, g, or t
  misc_feature (292)..(292): n is a, c, g, or t
  misc_feature (297)..(297): n is a, c, g, or t
  misc_feature (307)..(307): n is a, c, g, or t
  misc_feature (309)..(309): n is a, c, g, or t
  misc_feature (311)..(311): n is a, c, g, or t
  misc_feature (313)..(313): n is a, c, g, or t
  misc_feature (339)..(339): n is a, c, g, or t
  misc_feature (346)..(346): n is a, c, g, or t
  misc_feature (365)..(365): n is a, c, g, or t
  misc_feature (367)..(368): n is a, c, g, or t
  misc_feature (372)..(372): n is a, c, g, or t
  misc_feature (401)..(403): n is a, c, g, or t
  misc_feature (410)..(410): n is a, c, g, or t
  misc_feature (429)..(429): n is a, c, g, or t
  misc_feature (435)..(435): n is a, c, g, or t
  misc_feature (448)..(448): n is a, c, g, or t
  misc_feature (459)..(459): n is a, c, g, or t
  misc_feature (463)..(463): n is a, c, g, or t
  misc_feature (542)..(542): n is a, c, g, or t
  misc_feature (547)..(547): n is a, c, g, or t
  misc_feature (582)..(582): n is a, c, g, or t
  misc_feature (629)..(629): n is a, c, g, or t
  misc_feature (668)..(668): n is a, c, g, or t
  misc_feature (765)..(765): n is a, c, g, or t
cttcatcaaagaaaacacaagtttaagacttaacatccactngatctacagaaagcccaagggatgggggagntggttgctaatttgactgtngtacaantgaagnnnnnnngggggggcgaggaaacaccttagaattacagaactttccatgacagtcagaganagcagtacaaaaatnctcttaaataaagtncaaaattnaatgaagtttcaaaaannccatgaagtngaatatngactgaaacaannnttttaaaannngctgtgtccctttttttttttatagagnctggntatctcatancngntnctactacatatatttttttttttttngtttccntttttcttcttcttctttngnnatanatggcagcctttgtgtccagaatagagannnctttttntaatatctttttgttatantttttncagttcctgggangcatgggatancttntttttttttttttgtggggttaacatttttggggggggcgggggaaaacatctttctcaataatcttaggccagggggnttggnacaaaatataacattaaagttacacttggggcgtngtttaaatttgatgtgatcataaaaataatccacgggggtgtcaaantcattcggccttaataagtaacgcatcaaaatgtaatgnaaacaatgcaatagttttggtcaaagaaagatttaaaaatatgaatatgactgtaccaagagctaccgttatactctcattgcagaagtcgtgttgnt

SEQ ID NO: 487576 - DNA, 151 bp, Homo sapiens
aaaaaccccccttggggaaaaatttttttaaacccggggggggggggggggggggggcccccaaaaaaccccgggccccccaggggggtttttttttggtccccggaaattttccaatttgggggggtttttttaaaaaaaaaccccccca

SEQ ID NO: 487577 - DNA, 691 bp, Homo sapiens
atcccccgggctgcaggattcggcacgaggttcccttcactataacctacatttttgtcacattaagtttttccccattccaggacaggtcaggccctttaaaaatttcaacagctttattgagatataattgatataatttaaaaaatcctgcacatgtgtcatgctggagccctattgattccaacagggatggcgccttgtccaagaagagacccagagccagtgaatgggacatagggtttatttaggacttaaatacagatgtggtccagtggcagtgggctggacaggaccgctactatttgtaaagagtatgtagtttatataacatttcctacttagcactctccacttagcaacctccatttaacccaaaataaaaggccttggttccttgcacatcctgagttccaacggacaggcagggagttcaagtgtccttcacagataagaagtgaatctctctgggttggccattcccggattccttagcttagactctgaacacatattcttcttagaccatacagtcattctcagggtatgcttgagttaatgctgtcggatgcatctgtcatacaaagtgtttaacatatacgatttcatgattttggaaatatgcatacacccatgatatcactggcacagtcaagatattaaatatatccatcacctccaaaaaaaaaaa

SEQ ID NO: 487578 - DNA, 1461 bp, Homo sapiens
cctcatgggatcaagcgattctgtagtcccagctacctgtgaggtggagattgcattgagccaagatctcaacactgcactccagcctgggcaacagcgtgagactccacctcaaaaaaaaaaaaaaaaagaatctgactatataccatggaaaagccaccactctgccacttaaataaacatcaggatcagagattccaagaggacaatctgcatcaagtcttcaccaagtgttttttaagcgaaataatgaaatagggagcagaatatgcctgttgcccatagaaacgaggtctattcttgtcctcaattaggcttttttttcttcatagttacaccagaactaaagtaaaagtggtttttctgttctttctacttctccccatgaaatgggcatatcatctcaacacttcactccaagtcgccacgggcaaccttatgaccctaggtcctccacccctaatgtatcatcattgccacccatttttatggtacttattgttcttaagcttatcctcttaatcttttcatgtaagcaaagctcattaatttctgtcttggaaatgctactactctctttaattactcaccaaatccaactttaacttttgacctggtttctctgccacaagttctgtcccactggagcccatactcacctaccgctttgccatcacatttaacagaaaactcttatcaacttacttcctgcttaacattagctccttcctatctatatccaaatttcttaaattcaaattttttagctggagtaaaaatggtcccagtaccatttcctgttcccttcactataacctacatttttgtcacattaagtttttccccattccaggacaggtcaggccctttaaaaatttcaacagctttattgagatataattgatataatttaaaaaatcctgcacatgtgtcatgctggagccctattgattccaacagggatggcgccttgtccaagaagagacccagagccagtgaatgggacatagggtttatttaggacttaaatacagatgtggtccagtggcagtgggctggacaggaccgctactatttgtaaagagtatgtagtttatataacatttcctacttagcactctccacttagcaacctccatttaacccaaaataaaaggccttggttccttgcacatcctgagttccaacggacaggcagggagttcaagtgtccttcacagataagaagtgaatctctctgggttggccattcccggattccttagcttagactctgaacacatattcttcttagaccatacagtcattctcagggtatgcttgagttaatgctgtcggatgcatctgtcatacaaagtgtttaacatatacgatttcatgattttggaaatatgcatacacccatgatatcactggcacagtcaagatattaaatatatccatcacctccaaaaaaaaaaa

SEQ ID NO: 487579 - DNA, 870 bp, Homo sapiens
cgtcgcttgggtggccaggccgcaatacaataaccgggggaacggagtaccggtaacccggggcccctcttccggggccgtcagggaccccaccgccaggaaagtgggagccaacgggaaatggtaaaacaagccgagagtgcgcgcccacaaacaagtttacgcacccgcccccgggagctcatctttagttcggggagaaaaagagtctctattgccagaggcaccaaacagtcgcgtgactagcaatccgtgcgcccgcgcctttcagcgcagaccgcctgagtgagaaaggcgcccccgccccgaggaggcatagtaaagtctggggaaaatactccgctgtgatacatttatatgatacccgtgctctcccgctcccacgcgcccaagcttgcaggagcccaccttcggctccacccctcctctgtgggaggcaatgcgcgtggaagatgcggtatcttgttctataaaacactgatgtcctcagcgcacgtgcgtgcgtgcacaccacacacatgtttcatagaatacatacgcagggggggtctgtcttgttaaagaagaccccccaccttagtgctgtatgtgtgcaacgcacttcctgttgccacataaccattggatagatttgtcttctgcggctaatcgttaacgagacgtgacttgtgttacgacaaatgggttacaaccacacggattggacctcggcctgactttcgtagggacgagagatagatacaatagaatcaccagaacatatggttatatatatacaccttttgactaattctttcgaataatagttgaatttcttccggcaccacagtctccccacgccaataaaaaagatttgccccccacaaaaca

SEQ ID NO: 487580 - DNA, 1407 bp, Homo sapiens
cctcatgggatcaagcgattctgtagtcccagctacctgtgaggtggagattgcattgagccaagatctcaacactgcactccagcctgggcaacagcgtgagactccacctcaaaaaaaaaaaaaaaaagaatctgactatataccatggaaaagccaccactctgccacttaaataaacatcaggatcagagattccaagaggacaatctgcatcaagtcttcaccaagtgttttttaagcgaaataatgaaatagggagcagaatatgcctgttgcccatagaaacgaggtctattcttgtcctcaattaggcttttttttcttcatagttacaccagaactaaagtcaacacttcactccaagtcgccacgggcaaccttatgaccctaggtcctccacccctaatgtatcatcattgccacccatttttatggtacttattgttcttaagcttatcctcttaatcttttcatgtaagcaaagctcattaatttctgtcttggaaatgctactactctctttaattactcaccaaatccaactttaacttttgacctggtttctctgccacaagttctgtcccactggagcccatactcacctaccgctttgccatcacatttaacagaaaactcttatcaacttacttcctgcttaacattagctccttcctatctatatccaaatttcttaaattcaaattttttagctggagtaaaaatggtcccagtaccatttcctgttcccttcactataacctacatttttgtcacattaagtttttccccattccaggacaggtcaggccctttaaaaatttcaacagctttattgagatataattgatataatttaaaaaatcctgcacatgtgtcatgctggagccctattgattccaacagggatggcgccttgtccaagaagagacccagagccagtgaatgggacatagggtttatttaggacttaaatacagatgtggtccagtggcagtgggctggacaggaccgctactatttgtaaagagtatgtagtttatataacatttcctacttagcactctccacttagcaacctccatttaacccaaaataaaaggccttggttccttgcacatcctgagttccaacggacaggcagggagttcaagtgtccttcacagataagaagtgaatctctctgggttggccattcccggattccttagcttagactctgaacacatattcttcttagaccatacagtcattctcagggtatgcttgagttaatgctgtcggatgcatctgtcatacaaagtgtttaacatatacgatttcatgattttggaaatatgcatacacccatgatatcactggcacagtcaagatattaaatatatccatcacctccaaaaaaaaaaa

SEQ ID NO: 487581 - DNA, 130 bp, Homo sapiens
gtagtgtggtattggcggtgagctgtgtatgttgagtgtatgtgcgtgtgaggagggagtggtgtaagaaaatcgtgacaagaaatatcgcgtggctgatgctattgggagcagatcccagagtacaggg

SEQ ID NO: 487582 - DNA, 1407 bp, Homo sapiens
cctcatgggatcaagcgattctgtagtcccagctacctgtgaggtggagattgcattgagccaagatctcaacactgcactccagcctgggcaacagcgtgagactccacctcaaaaaaaaaaaaaaaaagaatctgactatataccatggaaaagccaccactctgccacttaaataaacatcaggatcagagattccaagaggacaatctgcatcaagtcttcaccaagtgttttttaagcgaaataatgaaatagggagcagaatatgcctgttgcccatagaaacgaggtctattcttgtcctcaattaggcttttttttcttcatagttacaccagaactaaagtaaaagtggtttttctgttctttctacttctccccatgaaatgggcatatcatctcaacacttcactccaagtcgccacgggcaaccttatgaccctaggtcctccacccctaatgtatcatcattgccacccatttttatggtacttattgttcttaagcttatcctcttaatcttttcatgtaagcaaagctcattaatttctgtcttggaaatgctactactctctttaattactcaccaaatccaactttaacttttgacctggtttctctgccacaagttctgtcccactggagcccatactcacctaccgctttgccatcacatttaacagaaaactcttatcaacttacttcctgcttaacattagctccttcctatctatatccaaatttcttaaattcaaattttttagctggagtaaaaatggtcccagtaccatttcctgttcccttcactataacctacatttttgtcacattaagtttttccccattccaggacaggtcaggccctttaaaaatttcaacagctttattgagatataattgatataatttaaccttgtccaagaagagacccagagccagtgaatgggacatagggtttatttaggacttaaatacagatgtggtccagtggcagtgggctggacaggaccgctactatttgtaaagagtatgtagtttatataacatttcctacttagcactctccacttagcaacctccatttaacccaaaataaaaggccttggttccttgcacatcctgagttccaacggacaggcagggagttcaagtgtccttcacagataagaagtgaatctctctgggttggccattcccggattccttagcttagactctgaacacatattcttcttagaccatacagtcattctcagggtatgcttgagttaatgctgtcggatgcatctgtcatacaaagtgtttaacatatacgatttcatgattttggaaatatgcatacacccatgatatcactggcacagtcaagatattaaatatatccatcacctccaaaaaaaaaaa

SEQ ID NO: 487583 - DNA, 418 bp, Homo sapiens
  misc_feature (135)..(135): n is a, c, g, or t
taatttgatacaatattttaaataattttgtgcatgaaacaaagtttcgactgcattttgactgtgatttctggcatgagatcagttatggaattttccacttctagcgtcatgttggcattcagaaattttganattttggagcattttggattttcagattagggatgctcaacctgtatatatattttttaatcgacgtgaaattcacgtaacataggaattaaccattttgaagtgaacaatttggttgcattcactgatgttgagcaaccaccacctttaactatttccaaaacattttcatcactccaaaataaatgcctgtacacactaggcagtcactccctatcttcccctccacctgtccgctggggcaaccactggatctcctttttatttctgtggggctttttct

SEQ ID NO: 487584 - DNA, 856 bp, Homo sapiens
gccgtaggatttaccaacacgtaggcttttatttcttcccattacatctgttgagccacagaaagcatcgggaagaaataaaagcctacgtgtggtgatccaacagcgggggatggagactcataagagatcataggtgctatctgtggccagggatgcctaaagagactgtgctgtaagttggcagtatgaggcggctaggatagtaagtttggaaactggtacttcataattaaatttacacaagggaaagtcagccactgtgtcttatgaggaattggaccctaataaattttagtgtgccttccaaagctgagaatatatgctttggaagttaaaatttaaatggctttgtgcacatacatagatcttcatgaggtgtgagtgtaattccatgtgggtatcagttaccaaacattacagaaaaattttatgggccaaaatgagcaacgaacattgttgcaatagaatttatccacttttgatcctttatattcttctaccacactggaaagcagaccacatagacattggggggtcttctactaggaattcgtttacatgcacttactctttgtcgactaacaatgttgcgttactttctagaaacataaacaaaaggggggggagggctaagaaggaattccatcagaggggcgcagcgatagagataaccagggattttggtcaaaggggtcctatagtgagcagatttacttggaagggaggtgcgcacttttaacattttgtgtggaaaagggtatgggacatgtgaaggagaaaactggggtgggttttgacgccaaccaagggagttaggttggagataattaatgttatggtgtgagacaaatgg

SEQ ID NO: 487585 - DNA, 452 bp, Homo sapiens
gatgatcaaatcactgttatataaaacttataggagacattgttttggactagcctcctacactgcgccccagtagaccagaccaaactataatggagtcaatcatgctaggtgccacataatcaaactgaactctaaaacaggccagtttttcaaaataaataaataaataaaaagtaaaaataaaaaacaggaaattcatagcaaccaatcaaaacgggcctggtttacttgagttggcatgctaaagaagttccctctattttaaccctgtaagaaaagtaactttgaaacaaccaatctgctttttgttctctgtttctgctttcttcagcctgtttctgtctataaagccaattcctctgctcagctcatcggaacactcattcttgttttatagaatgcagtgttgctcaattataaaattgcaaataaaaggcaattaaagtaaa

SEQ ID NO: 487586 - DNA, 172 bp, Homo sapiens
aacagggaagcagagtctaactctagtcgtccaggctggagtgcaggggtgcaagtcatggctcacttgcagcctcagcctcccagcctcaagagattctcctgcttaaaccctcccgagttagctggagctactagatactcagccctccgaggaccttgcttctttcctc

SEQ ID NO: 487587 - DNA, 603 bp, Homo sapiens
cccaatcgccgacggttaagctcccgacctaattgtcagcgttttcagggcatatggcggacatatctttttggaagtcttcaaaacttccgattttggaaggctcttatggtgcccagccgtaaagccttgaggcacagcctgtcaagcaaaacccggctcccgttttctacaaatccccagtgagttctcgctgcttcgcacctcggatgcttccaatgtgcaattttgccgtccattcagcagttcacctgggtctgtagcaagaatgcccctcatgcagtatcagacggaagtgcccatgggcaatgacctggtccttcatgtgtagtcatggtttgtcgttagcaggtctactcgcagctacatgaccccaccagtcttcacccatatcgtcgagcagctacgtctgcggatattgccacatcatactgagaatgaagtcggcgttcatcggccacttctataagtagctgccagccactgtctggcaatgagatgtgcagctaaacccatgatcctggagtcctgacattccgcaaatcctgcaatatggcgctcaactctcgctccccaagctcggtctaccaaactccactgtct

SEQ ID NO: 487588 - DNA, 383 bp, Homo sapiens
  misc_feature (115)..(115): n is a, c, g, or t
  misc_feature (144)..(144): n is a, c, g, or t
aatgtgggatgttgtgagctgggtaggcagatctctgaagggtgtctgtaaataagttattattatcttaaattctcatttagaaagtaatacaatttaagggccaggcacggtngctcacactgtaaatcccaacactttggnaggctgaggcgcgtggatccctgagggtcgggagtttgagaccagcctaaccaacatgaagaaaccccgtctctaccaaaaatacaaaattagccgggtgtggtggtgcatgcctgtaatcccagctactcgggaggctgaggcaggagaatcgcttgaactcaggaggcggaggttgtggtgagccaagattgcaccattactctccagcctgggcaacaagagtgaaactccatctc

SEQ ID NO: 487589 - DNA, 354 bp, Homo sapiens
  misc_feature (5)..(5): n is a, c, g, or t
  misc_feature (352)..(352): n is a, c, g, or t
taatnaaataatcctgtgtcccccattccagataaccccacagtaaaagtgaatacctgcaataaagcaaagtcaccccagaattttttaaatttcccccagtgcatataaaagttatgtttacacctatactgtagccttattaagtgtgcaatagtattatgttttttaaaagccaatgtacataccttaatttaaaaattctttattgtgaaaagatgctaacgatcatctgagccttcagcgagtcgtaatctttttgctggtagagggtcctgccttgatgttgatggctgctgactgctcaaggtggtggctactaaaggttggagtgactgtggcaatttcttanaa

SEQ ID NO: 487590 - DNA, 913 bp, Homo sapiens
  misc_feature (913)..(913): n is a, c, g, or t
ctaatcacagccagttattgtaaggcaccagagtggagaagtctaatcgtgagtgtcaggatgtctgacaacagacctggcctatcatgtgatactcccgtaggggctagaaagaaatatgtaataaccgatgttctgagtgcgcatgctcggtaatcgcaggttactcggtaggctgaggcacgtaggatagacggtaaaccacccgggcgaacgcacgtgtgcagggagccaggatcgtgtacaaactggatatccagtctgcgtggaggtgaccagctgacccaggcaccgaaaatgtagggcaccgaagggagggataggcccgacaggccgggcggccatgtccccggactccgaaggagctggtcggggtcaagaaaagagcgtaggatggggaaccgacatcgacagtgtcatctgcacaaaatggagtcgagtgaaagtgacgactttggtccaagatctactatccatatactaaaccaaaggttgtcttatgaactgttccagagtacccttcctcccgttgattcagacttcgttacaactggaatccccttctctatcctgtttcgcccacacctctctatttgcccgctcggtccacgcatgtgaacgggttgcctctgggtaccctcaccaatgccttggcgcaagagtttgccaggtgccttggcaacgcaatcgcactgacggggccaaactcaaatccaaagatccagggattagctacgcgcacactcggacatcgttcgcctctatacgcacggtgtcatgaaacctggggagtacaaaaccatagcgaggtgtcccggcgcaacagaagcgtgcgggcacctgaacggtcaaaccgtcggtggcgcctctgcatttgagcggacggaggctacatcggttatacgccttacgn

SEQ ID NO: 487591 - DNA, 607 bp, Homo sapiens
ctggcggtttctgacttggaaaaccttccggggccttgggtgagactcaggtacatgctggcttccggagtgacccatcatatcatagttgtggtggctatgagaagaggtgccttctacttgagaaaagaagagggaagaataaatgggactttgtcttgtagtttaggtactagcttagccatagtggggaagagcaccaaccaggttcttggggtccccaagtccaggccttggctcttggacagcatttctggacctactctgagccagaggggatcccactgccctgaagggtgagttgcatgcctggcaacattcaccacaagctgactgaagagcccttgggtcttaagtgaacaacattggtgccctgcagtaatccccatggatctgtggtggtggtggacatggggagagacttctctgcctggggaaaagggaaagaagagtgggaaggactttgtcttgaggtttcggtgtcagcttagtgacaaaacaatagagcacaccaggtagatcctagggttccaactccaggctctggctcctggacagcatctctggactgtctgagccccggggacttggcatgtgctggttcagg

SEQ ID NO: 487592 - DNA, 216 bp, Homo sapiens
gagactccggaaagccgggtgctgcgtttcaccaggtgggggctgctccgagtgaagccaggccgtggagacagaacacggtccatgtcctgtagtgacaagatggcccgattggaccgtcctgggatgccaaggggcactgtgatgcactttcttggagagccatctacctgtcaagctgttgtcatttggagttccatacagccaaggaggcat

SEQ ID NO: 487593 - DNA, 350 bp, Homo sapiens
  misc_feature (166)..(166): n is a, c, g, or t
  misc_feature (228)..(228): n is a, c, g, or t
tttttttttttgtttatgtttttgagacggggttttgctcttgttgctgaggctggagtgtaatgcagtatctcggctcactgcaacctctgcctccagggttcaagcaattctcctgcctcagcctcccaagtagctgggattacaggcatgtgccaccaggccntggcaaattttgtatttttctttattagagatggggtttctccatgttggttaggctggtcncggattcctgacctcaggtgatctgcccacctcagcatctcaaagtgctgggattgcaggcattagccactgggcccgacctcttagctcattttcaatgttggttttatcttgtctaagtg

SEQ ID NO: 487594 - DNA, 226 bp, Homo sapiens
gctgcgagctcgtgtaacctggtggactgagggcgccatccagtctccctggcacttctcagcacatattcgaatgaactcacatcattgtcttgtgtctttggttggggaagaagttgttgttgtggcccgttagagaattacccgcgctgccccctacgaaggctcccagtgccagcttgtacttctctgcctcgtcagccaccttgaatgatttgtactggga

SEQ ID NO: 487595 - DNA, 494 bp, Homo sapiens
  misc_feature (8)..(8): n is a, c, g, or t
  misc_feature (177)..(177): n is a, c, g, or t
atccgggnagcatatgagacagctgttgtcagcgagggttctggcataaccaatgataaggctgcaaagactgtccaatacagcagcaggaccagccactcctacgttgcagcacctgcacaataaatttgggcagcagtatcagtgtctctgctgattgcactggtctgaaactcnccttttggattagctgagacacaccattctgggcccattaaataccggtagagccctctccagtcctactagcctctggtccgaagataacactgatgcagaaattggtctgtatgcaactctgtgatcccagctcggatcagagagggggtgcaggcgagcttggccgcagggccgaacatcttacactcttcgggactgcgcggctggagatatttgggtgacacggcgacgtgggcctccctctcccggcttcctcttctccccggggatacacgggcgtacccgagcttcgaaattcggtaaatcactgggta

SEQ ID NO: 487596 - DNA, 116 bp, Homo sapiens
gtccatacggcgttgttctggattcccgtcgtaacttaaagggaaactttcacatgtacctgtgcccttgtatgtactgtcaaatgaaggaggcaggctgtacctaagcttactga

SEQ ID NO: 487597 - DNA, 1205 bp, Homo sapiens
agcggttgtccatccgtcggcgcggctctggtgcagcggcggcggcttcctgttccgtgccgcgagctctctccctttctatacctccccagcagatcccggagatcgcccgccatggcttatacttactgcggccgaccggactcttgggaaccaaagaatgcatcttggtctcaggtgctatgcatgcccggccatgccagatgcttcctccacggaaatcttgacaatgacatattgtgcttcgacctggatacctaaggaagcagtgcccacacagactccaacgactctctccagcgcacgacaatcgcatggccacagaacggtggatgtggcccaagattcacatggtgagacatatgagtcgtactcgcgttgagcattcgagagcggccatcgcaaacgcgataagggtctcatgcatacacacatacaggtacgctcagaacatccctggacttgcaccagtgtagcaagtcccgatatactccaccagatgtgcgcattaaacacgctcaattccgcccatggaaacgtgccactaggatataacgtaggaccaatacagcccacattgggtcttcacacatgagctcttacagtcacacacacgccccctatgagactatgaagcggagacatcatcatctcattgctgcctcggcatggcggtaaagcctctggcggaccacctgaatctctcccaatcaccccacggaaaggcgacacccaccgtcgtgaatacgacctggcagccttcatcccacccacacacggaacgcttgagggccaaaaaaggcaaccggggcacacggttgccgtttgaccacctgtcacccccccacatcagcttgacaggtctaacagccactcgcgcactgccggtaaccgccacgagccatatatttaacccccaaaagactagacagattcatcgttaacacaaccgctcccaattgtgtccgctctcgacggacttttcagatgctcctgcccactgcggacgtggcatagaaaaccaagggatgctccgttatcgtagtagccaaatgtctgggacacaagcagtactcagaagttatttacggtctactcagtctgtcgagccaaatagttacgtagtgcgcatcagaagagagggaacatacatcaagcaagtgcgtcccggtcagcatgctccgagtctgggtttacattggcga

SEQ ID NO: 487598 - DNA, 213 bp, Homo sapiens
  misc_feature (177)..(177): n is a, c, g, or t
taagggtaattgggcccttggtggcgggtgaagttcactatatatgtgttattattatgtgtgcgccaggcgtgggtgcgcgcgctggccacccacaataaacctcgtctatctaacgctatctagaggttattatctctcccaaagcgcgtatatacccgctcccgcgacacagcntgcagacacggagcatgagcaacagtcagtaagacg

SEQ ID NO: 487599 - DNA, 268 bp, Homo sapiens
aatgacaagtataaaggctaacgcaatgacagttacccaatttcattctttttcttctgaaactgaataaggaaatgatcatttgaagcacataggaataataggccatgtcttgtgtcctgtttaaataacatgtatattttgaaaatctcaagatactgtcgatatcatgcgaaattatgaccaatgctggtacaagaggctccatagaatacatgtactagtcgaaaaagtttcctactttgcacgactccaatttactagtcaa

SEQ ID NO: 487600 - DNA, 402 bp, Homo sapiens
gaaaagaaatccctgaagagtagtttgttattattattatttttttggggggtggggagagtgcttaaccaacatggcaggttattttatttcccagaatagtaaaggagccataagaaccaaaaccatggttttattatcagttcatcttagaacataactccatgttggatagatcctggtgttccaaaaacacaaagagctgaaatgtttaatatggggaacccctaccttagggggctagttccaattgaaatgtgttatgtgttaaatgccccctgattcccagaccccatgtataaaaaagaatgtaaaatatactatgaaacctttttatattgattgccttttgaaatgataaaattttctatatagtatgttaaataaaaaacttttttttga

SEQ ID NO: 487601 - DNA, 134 bp, Homo sapiens
acggcatgccaagttattgtgtgtgtgaaacacttcaaaactgatttaaaagatgtaaatttaaaatgggtgtatctaatatgccccaggttcggtaaataaacaattcttttttttttttttttttttttttt

SEQ ID NO: 487602 - DNA, 1137 bp, Homo sapiens
gttcccacatggtgtgaaagggtttacaaggcccttcaagggggagagttcgccagcgccagtttggtgtggcacttccacaatggggcattctccttaacccccctgtttgccgggaacacaggtccttttaccccggctttcctgtatggggaaacaggggtaatatgtgtaacgttcacccccaaggggaaactgtgccaagatgcccgttgtgttcactggggacctgttttttaaagtttaaaccggtgtcttgtttcgtgctcacaaaacatggtgttctcggaagttctccctgggagaatttgcacgcggaggaacaaaccccgcgggaaacctggagagtgcccttccccccccccagacctgttgttccccaggcgccacgagggaactctctgccacgtagccctttgctccgctaaacatttctagtgaaacccccaaggaaattggttgataacccactgggcacctgggtgttccacagagttttctgggagttttcttccactggaaaaccttggggttaaaatttttggcttcccgaggtatcccccagagagtttaagccaccttaggggctcgccgcggttaaaatttgggatggaagataagtactccacccgcccacaggtctctccctcgggagagccacacactgggggctcgaatctatgggcaccctctctgttggcctgtgccctggcaatgggcctcaccgcccacggagaagagggaggataacgatatctcccttgcccctgcccccctccccttttggcacagggcgcttacctgccttgtgcccctcctggcttgcacgccacgccaagccccctggcacgcacggtttctcctcacagggccttgggtctttcacaaccctgttggcgacacacaggaaggccacgggcacagacactgttggagaggacacacggaatccacaggtcacgggagagggaaggccacggggtggaccgcccactgagcatgtaaaagacccgcaagccacagttgacttcttgcacatgtgcccactgttatgtttctgccaaatgagccacgatgtatccaattgatgccaatttagatgttgatacttaccataaagtttttaatgtgttttta

SEQ ID NO: 487603 - DNA, 289 bp, Homo sapiens
  misc_feature (82)..(82): n is a, c, g, or t
  misc_feature (257)..(257): n is a, c, g, or t
  misc_feature (275)..(275): n is a, c, g, or t
ctcgtcgacgagttcggccgctcgggtcacgatgtcaacgtgaccgagggtgatggggtcgaatgaccctgagaagactgcnttcactgctgctccctgcccgcatctacctccggctcaccggtacgttgggcgtaatagacaactgtctcaccgtagcgagaattccacgactcgtatccatccggaaaacggggatcccgacttctccgtgatctctcgactacgagcagaccgttgtgggcgagggccccgtngcacgctgtcaagatgangctatccatgtcgt

SEQ ID NO: 487604 - DNA, 146 bp, Homo sapiens
cgatcaactgtgtatccaggtaggagcccctcgtgagggcttgccgtcatgcacgactgttggccaatgaggtcatagcgtggtattcttgctgtacttgctctgtaactctcttcaggacacagtattctcctcagatccacgat

SEQ ID NO: 487605 - DNA, 81 bp, Homo sapiens
cagtttgttcatcgcttcctctgacgatggacatttaggttgttaccagtttttagcaattaaaaagaaagccaccataaa

SEQ ID NO: 487606 - DNA, 350 bp, Homo sapiens
  misc_feature (7)..(7): n is a, c, g, or t
  misc_feature (9)..(9): n is a, c, g, or t
  misc_feature (11)..(11): n is a, c, g, or t
  misc_feature (323)..(323): n is a, c, g, or t
  misc_feature (340)..(340): n is a, c, g, or t
tcgtcgntncntcaaaatgctgcgattacaggcatgagcacttgctcccggcccactccctgctatttttagttctatttttatttttatttttattttgagacggagtttctctcttgttgcttaggctggttggagtgccaagaccccgtctcggctaactgcaacctctgcctcccagttcaagcgattctcctgcctctgcctcccaagtagctgtggattacagggcacctgccaccacggcccggctaaatttttgtatttttaggtaggaggacaagggatttcaccatgttcgggccagggttgggtcttcaaantccctacctcagggcantccattcgga

SEQ ID NO: 487607 - DNA, 983 bp, Homo sapiens
ggttctttcctgattccgaacgggacttcccttatgtgcaacccgtcgtgatgtcttttcttgcccctggggctccccaggttgcttgcaaagtccctcggtggattcactcgttctgtggcaattccaacatagatgtgggcagcacaggagagtttgtcaagcgctggcatgtttcctgcgagttatgcctcatggcgcttacactcatcatcgctgtttccgattgagtcccttgaatggggggcgcttaagaatagggactcaccctcggtgttggctggctcacatgacctctgggcgaatcagggttaatcaggaggcgcattgttgcttgcgttaagcacgctgctaaagaacctatacgagcataatgcgagtgtggacctgtgctggatttgacatagtcataggcaccatagccagtaattataagtggagagtcggataggcacacgattagaatgtagtgtatctggagtgagcttatgtgagtggaccagtatgttgctgtcctgcgtgagacagtgtagtcattgcttgttcctaaatgtactatcgagtcgtgaagcaagaagagtgaaatcattgtaactgcagtatgcaaccacgtagaatgaatagaagattcaatggacatctaactttctgctctcactgtttgccgcttcgtttatccttccctgtgattagataaagcgacagtcagcatacagaaatgctgtatgtctcgttcttacgccagtcgagaaccaagtctcgaaaagaatgtgtgttgactcaggtttggagttatgttcaggaagacagatattggaccttttaattgataaatattcgttattatcctggaatgccagaaaagaactatgtcctgattgtctagtgttgtattccgctgacgtttctatgtgatatagatgcatttgtaatactctttttcaagtgtaaaggatttctaataactccacggataaatgttt

SEQ ID NO: 487608 - DNA, 141 bp, Homo sapiens
ggctctacaaaaaagagtttttcaaaattagccaggcgaagtggcacacatctgtggtcccaggtgctcaggaagctgaggtgggaggatcacttgagcccaattcaaagctgcagtgagctgtaattgcatccctgcacg

SEQ ID NO: 487609 - DNA, 264 bp, Homo sapiens
cttccgggcaaaattcccattttattttttgaagggttaaggtaaccttccctttatccggctaataaaaaaattttccaccaaaaaacctggttgccttgaggttttaccccttctttaagaagggttgaaaaacccttatggaagccccggtttttaaggtaaaggttaaccttgaaaaaaaatttttaatccgggggccaaaattctttttttacccccaggggttagaaaattataaaaaataaaatatttttagaaaga

SEQ ID NO: 487610 - DNA, 174 bp, Homo sapiens
  misc_feature (93)..(93): n is a, c, g, or t
ccccggaggggccaggcgggcgggggaaattgggggtttttttcccgggttttggcggggaaggcgggggccgtccgctccggggaacccccngggattaaccttccagttttttcttcttagcggcgattttcccaaaaggccccccttttttaacccccgggagaagaaaaa

SEQ ID NO: 487611 - DNA, 929 bp, Homo sapiens
  misc_feature (5)..(5): n is a, c, g, or t
  misc_feature (9)..(9): n is a, c, g, or t
  misc_feature (571)..(571): n is a, c, g, or t
gctcncccnctcagcgcacgaagagagcaagggcggtagagtgtagtaactatgctttatgggtttgccgacatggcttttcagctattttatggtcttattattcgccggctctgccgttattgccataaaccctagccggtgttcctcagattggcccaggctcaaaatgctgccctccaggcatccattggcggcatacatcggacctttccaaaccagtctcgttcctttaggaccgcgttcttcgggttcgagcacagggggcacgcccccccttcccggggatctttggttaacgcagccccctgggcggtgggacacacaattttcccgcgcaaatggggctgtccccccccgggccaaccaaggggggccaaccccccgcgctcttaaattcttggcgaagactctgccgggagaatgttggcccccagagtgggagcaccaccatgcccgggggaaacccccggggggtcactcccgaatcgtgcgagccttctaccagagaggccccgaaaggcggtggagaaaagagacccccggcggtctcaaggagaaagcccgtcgncacacgagggcacttacccggcaacaggaagcttctccccgcctcgctgtcgaacgatgttatgaagaccccgagggcatccacaatgtggcgctctataagaggataaccacgggctcccactcgtggccacgtgcacgaccacgtcccccacctgaaagagcgcggtcccgccctcaccccccccccccgagagacatgcgtccctcaagggcaccccgcacgcacagcccccgacaaagcgggacagggcgacaccccgcccgggtcagaaacgagcgtgttatcaccagggctttcacccaccgaagcgaaatgcgggtaagggaaaaaaaaaaccctccttccgaacaagaca

SEQ ID NO: 487612 - DNA, 411 bp, Homo sapiens
gcgcacagcttctccaccagcgcctgctcttttccacataggatgtacaccatgtgccatctgcctctgcccatctgtgcctggcttctcaccagcctctcctaccagctgtggcctcttgagaggaaacaggtctgtcttattcaacactgcacagtcagaagtaaaaccggaactggccatggctggtcttcaaaaagaatgaagcaaagactacgcctctctttccccaagtattatccgaccagtccaaaacgagagagaggtaaacacgtggtaataaatggtaaaggaaaataattcttctcaatcttcagtggtttgaaatgcctctggattgaaccccagttataaccccacaccatttgctcaaagtacctgtgacgaaatctcaggtaagttctcagggtc

SEQ ID NO: 487613 - DNA, 327 bp, Homo sapiens
cttcctgacgtgtcctctattaggaacaacgggtgaaaaaatgatacggttctggggcaggcccatgtatggtgcatactggatgaatattaggtgctccttactgctggcaaacgctacagccagagtacactatcgggaacacgcttcaaagatgtttgcccacatctgcaaagctaaaagggtcaatatgctgcaagctgattgatgctacagtatacgatggcctcttctggtaagccgtactgagaacgggtgggttacaattaatggtacggggaacctcctctccagtggctggcttatcgttgatctgagtagttgccc

SEQ ID NO: 487614 - DNA, 548 bp, Homo sapiens
  misc_feature (68)..(68): n is a, c, g, or t
  misc_feature (212)..(212): n is a, c, g, or t
  misc_feature (236)..(236): n is a, c, g, or t
  misc_feature (240)..(241): n is a, c, g, or t
  misc_feature (284)..(284): n is a, c, g, or t
  misc_feature (362)..(362): n is a, c, g, or t
  misc_feature (369)..(369): n is a, c, g, or t
  misc_feature (391)..(391): n is a, c, g, or t
  misc_feature (431)..(431): n is a, c, g, or t
  misc_feature (461)..(461): n is a, c, g, or t
  misc_feature (473)..(473): n is a, c, g, or t
  misc_feature (493)..(493): n is a, c, g, or t
  misc_feature (546)..(546): n is a, c, g, or t
ttttttaaaaaaagaggactttcttgccaatcctaagaaagcctagttcttaatcttgcactacttangtttagcatccaaaaggttgtgtaaaaatacatgtaccccagattcattttaaaacgagagatctggactggtcacctgccgatagatttagaaacttgccttgcatcaggtttatgctgccccattgtatcatcaacggttgngcccaattttggtcctttggtggnggtnnttttttttttttttgatggggttccaaattgatccatcatagntgccatatttgggggatccatgtgatattttccaaatttggtcttgggctaaaggtttttagaatcacccctatctgnataaccnacggtaacccattccataaaanttttcttgccagaatctggggctgctgagctatagaaccngatgcaggaaatcatagtcaggaaaccatntgacagctttangggcaaaccatgggcctggncagggacccttttggcccaagtaaagagggagctggccattaccttgggtggntt

SEQ ID NO: 487615 - DNA, 1109 bp, Homo sapiens
  misc_feature (157)..(157): n is a, c, g, or t
cgctacaggtatatagggacaggtgggaaaggaataggatggcgctgaaaaaaagacctgagagatatgcatattgcccgttggctcgtatttagtcgagagaggtgatatgtttgctggcaaatgaatcatggagtgctaggcatcgagagctagnatgtctgagtgtacgtttgagatccggtacctgttctaaaatggaaaatgaagtgttgagtaatatggcattagtaggcacgtaaatcacacctcttggaagaaggattaactaggttgtcacaccagaaggatgtggaattggaatgtatcattaatctagcacagtgcattatcggagagaagcaccaagaagttggagcgggcggactatcgtgctattggtcccaaactacctgtggaagcgatcaagttggaatctactcttaaacaatacctagtctctggtcctgtaaccctaagaggggacatgtgctaccgcctttattttcacgttgtaacggttccaacgaaaaaaggggttcgtggaaatttgaaaccggggaataaggtgaaggccaattgggaccttgacacgcaaccaaaacgggctctccattgccctttgttctctacttcgaagcatgcgggagtccaattatcctagagggagcaatttttgccaaccaatttaagagggagcatggccctatcccacacccttccctgaatatagggggccattatctaacttgttgggcgctcacacgcatatggggcaacagggacggggacacataggggggcacaggtatttgtcctctccccccaagagctttggaaacatgttccactctgttctaaggaaccggggggattctagactagggttctacactcccactgggtgagaccttagaccgtgggatatttaacccccatcttagagtaccatcgggggcgtttttaccgctgcggagcactactgtataaacagggctccatcgagatacttctatactctctaccgcgccccgctactgtggggggatccacttgcggcatcacccgggatatcttagtctaccagcatacattgcgcgggtccaccgatcacaccatttggttttccg

SEQ ID NO: 487616 - DNA, 148 bp, Homo sapiens
ctcccaggttcctgggttcacaccattctcttgcctctgcctcccgggttcaagtgattctcctgcctcagcctcctgagtagctgggactacaggtgcccaccaccacacccggctaatttttgtattttttggtaaccaagtttca

SEQ ID NO: 487617 - DNA, 744 bp, Homo sapiens
aggacggttcgtagatcatgcgtgtgtggctcgggcctccgaaagtgtgtgaacagtggtcaatatcctgtgaccttatcgtatgcaattgctgtggtgatgcactactcggattgtgacttctccgcatatgtaaaaaatcgggcgagcggtctatcctgaggcgttctgacatgacatattcgaggatcgcgtaggtcacgtcgacgcgtcattagtggatacgtatccattcttgagtacccacaacgcagtcggtacgatctcagatttagtcagagtcctgacaccgaccgtggaggcagccgatcaacagccgtggtcaatttgtacctgcaggcctcctacacctacctctctcatgggcttctatttcgacacgcgatgatgtggctctggaaggcgtgagccattcttacccgcgacactggccgaggagacagccgcgagggctacagagcgtctcctgcaagatcgccaaaacagcgtgacgggcgacgatctcattccaagcgaaatcacagaagccagctgcaagatgaggtggggtaaaaggcgcagaagaccatgaaagcatgacatggcacctggagacacaagctgaaacaaggaccttggggatctttcatggaccctggagttctagcccgaaaaggacaccacgcatctctgagaaattccattggagacctcaattccatagcatgaggcagtgaaagatagatcaaagaaaatagggtaacc

SEQ ID NO: 487618 - DNA, 130 bp, Homo sapiens
cttaactggggtctgctttgaggcctactatgtggtgtaaaattgagtactctctctacaaggttggttcctagtgtccaaagagctgttcctctttggactaacagttcactttacaaggggatctcga

SEQ ID NO: 487619 - DNA, 897 bp, Homo sapiens
tggatcactggcctaacatgctatgtgctgtaaaaatagttaacagggcaaataacttgagatgatggctagcttggtttaatgtcttatgaaattttcatgaacaatccaagcataatggttaagaacacgtgttttaactccatgtaagctggaataaaagtttcatgaatggacctttcaactactttctctacagctttccatgtaacattagtctgggttctgaaacttctctaagggaactggtccattcttggaacatttattccttattccctctgggcagctaatgggctcttaccaagtttaaaccccaaaatttatcataaccaaaaatactactaatataactactgtttccatgtcccatgatcccctcttttctcccaaacctgaaaaaaaatgagttcctattttcgtggaaaggcggggactgattcgaaccactcgtggtgtgttcccatttcaaaatttgggcatatggcaatttctaacttaggaaggcccaatgttcttgggccatccatgacattggcgtaccatcaactcgacatttgggtgctcacacatcacctttgcgggcgtctcagcaaacttccttggaaactcttttatagcctggccttcaatttggaagctttaatctttaccaataggtcaggggtccaagattaccgcttcccggtttgtaaacccctcctgtgctctggtcacacacgccaattttcctgtggggggcatgatctttggaacaaggcgcgcgtataatttatgggccccctacggtgataaggaccccggtacactgggtgtgtctccaccaaataatttcgctcaccatatactgcggagaacccctattgtacaagcacgtggttatcccaaaaggcacat

SEQ ID NO: 487620 - DNA, 108 bp, Homo sapiens
  misc_feature (108)..(108): n is a, c, g, or t
gctttagaggcacacggaggaatggcacggagggttgcgtagctggttggcagctgacacaggatgaccccactgccagagctcggcaggtcctccttggtgctctgn

SEQ ID NO: 487621 - DNA, 294 bp, Homo sapiens
  misc_feature (29)..(29): n is a, c, g, or t
  misc_feature (62)..(63): n is a, c, g, or t
  misc_feature (72)..(72): n is a, c, g, or t
  misc_feature (78)..(78): n is a, c, g, or t
  misc_feature (80)..(80): n is a, c, g, or t
  misc_feature (85)..(86): n is a, c, g, or t
  misc_feature (88)..(88): n is a, c, g, or t
  misc_feature (102)..(102): n is a, c, g, or t
  misc_feature (104)..(104): n is a, c, g, or t
  misc_feature (118)..(118): n is a, c, g, or t
  misc_feature (156)..(157): n is a, c, g, or t
  misc_feature (159)..(159): n is a, c, g, or t
  misc_feature (163)..(163): n is a, c, g, or t
  misc_feature (165)..(166): n is a, c, g, or t
  misc_feature (172)..(173): n is a, c, g, or t
  misc_feature (182)..(182): n is a, c, g, or t
  misc_feature (235)..(235): n is a, c, g, or t
  misc_feature (287)..(287): n is a, c, g, or t
tgtccatagtccacgctgagttacggctncgcacttcggcggccacatgctggcggttcctnngggggactnctttangngaggnntncccctgttgttccntnttttgttctttttnttttttgttttgttgtgttgttgggttttgtttttttnngngttngnntcttgnntcttgtttnttgttctttttttttttttttggtttttggtttttgtttgtttgttttgggtngtttttttggtggtttgttgtttttttttttttttttgtttttttttttggnggttggg

SEQ ID NO: 487622 - DNA, 847 bp, Homo sapiens
gtttcaattgtccttcagataattcatgtggagatttttggagaaaccatgacggatagtttaggatgactacatgtcaaagtaataaaagagtggtgaattttaccaaaaccaagctatttggaagcttcaaaaggtttctatatgtaatggaacaaaaggggaattctcttttcctatatatgttccttacaaaaaaaaaaaaaaaaagaaatcaagcagatggcttaaagcgggttataggatggctcacattctttagccattatgcttgttaacttaatggtttagaagcgtgttggctgttggtaacatcccagagaagattgaaaagggcacatgcttttatccgtgaccagatttttagtcccaaaaaaatgtatttttttggtgtgtttaccactgcaactattggcccctctctattggaatttactggtggaccatgtgtggtgtctctatgcccttggaaagcagtttttataacaaagaaagcccgggtctgcagagattgaaaccgggtgggaaacctaagggtccattgtgtcacgtgcaattaatacaagttatggtgcttttcaaaattgtacacgggaaatctgggacagtgctccacagatggatacattagccttggcttacatcttccggataaccttgtaccattttgaaacctttaaggatgccaagaatgcctttattccacaaaaaaacagagaccacttatagaggtgtttcaaaatagcatgtctggggcaattcaacctctgtgggtcctaggactcacattcggttcagttttcctcagtggtatttgaccagtgtcctaaatggcaaacacctatac

SEQ ID NO: 487623 - DNA, 423 bp, Homo sapiens
  misc_feature (374)..(374): n is a, c, g, or t
  misc_feature (392)..(392): n is a, c, g, or t
  misc_feature (417)..(417): n is a, c, g, or t
aaacaaatttgagttttatatattatattggggcagccctaaggatgtgaactcaattttactattgattttggcacttccaacaaatgactcaatggataagtgaatgagccagtcacaatactagacttgaacataaagtgtgggaattgggtatatcaaaaggcactgatattcaaggtgctatggataagtgaatgagccagtcacaatactagacttgaacataaagtgtgggaattgggtatatcaaaaggcactgatattcaaggtgctatggaaatgtcactacacaaattgtttttaaattttaaaccaatgccacaacctgccatgccaagagccccgacaatatgacctaactcatctctatnatttctttctttattcgnctaagtaattatatctcaagcctgnctgtaa

SEQ ID NO: 487624 - DNA, 388 bp, Homo sapiens
tgacggaacagcagatttaacatcatctgcctcatcagttcgtgaccttagaatatttgtacattacgtactcataatctgtaagaacaatgtccccgtatcatgagagctcaatgattaaagggtaagcagcttgcatcatttccaaatggagaatctacagttttatccacaccaagcggtcgtggactgacaaatctccgactcttcaaatgttttcggcacttcatggcaaaactagacggcatcatattcttaggccactcaaattctgtagtatgaattcgtatgccagattcaagtaaaagtgtagctttaaagtccggtttttgaagacgaatagggtatgtcttattatccacatcataaacattgtttactcccatcc

SEQ ID NO: 487625 - DNA, 193 bp, Homo sapiens
tctagaggatcccgcgtcatgtagtttgccagtgagatttatggtttacacttggtctctgtgacaacctctcggggtgctttactgctacgtagcattgaatatatgattatgtgaccaaaaaaacaaaaatccctagctgagataccatttgggagtctctgattctgaggtagtctgttgcatgtcgcat

SEQ ID NO: 487626 - DNA, 265 bp, Homo sapiens
  misc_feature (13)..(13): n is a, c, g, or t
  misc_feature (50)..(50): n is a, c, g, or t
  misc_feature (78)..(78): n is a, c, g, or t
  misc_feature (168)..(168): n is a, c, g, or t
caggagccatttntgtaggtaactggaccaagaatgagaaaaataatganttcttagctccctgattacacctgccancttggaatccaggactcacacttctgaccctgcctgtttttttggggtttttttgagttggagtctcgctgtgtcgcccagactggagtncagtggtgggatcgcggctcactgcaacctccacctcccaggttcaagcagttctcctgtctcagcctccccagtagctgagattgcaggcacatgc

SEQ ID NO: 487627 - DNA, 296 bp, Homo sapiens
gccaacacgccggcaggctctccctccagggcagcgccagtcccagggctgcagagcctgtgtgcttggggattcccctgatgcagcttttggaactgaaaggcaggggtctcgctgagtgcacctggtgcttcctgagcccatctgcggcggcccaccctggcctaggtgctgagtgcagatgctgcagacagcccctccctccttagtgaagcctgaagggtgagatgctcggagaatcagcgaggtgccgggtctccagagccaaaggtcagaagcagggctgagggaggggt

SEQ ID NO: 487628 - DNA, 247 bp, Homo sapiens
ctacatacttccgcatgggcaacaagagcaaaactccgtctccaaaaaaaaaagccaacggtcagggttgaaacagggaggcccctgaaatagtgatgttccaatgaacacgaaaacttagcaggggagtcatttcttctggctggaaggagatttggcataaccttcaggagacctcacccttccaggacaacagagggggtggaggttacccaggccacttttagaaatggggagagggaactgg

SEQ ID NO: 487629 - DNA, 500 bp, Homo sapiens
cggtaccggtcactctagaggatcagcaccagcacggcgctgagcgacttcgatcaggttgcgcaggctgacctgcgtggcaccgatcttccaggtgatgtcttccaactcacccagcaccatgggcatgacgcccgtcacccacagcacggtgacgatccaggccagccaggacacggtgcgttcgaccaccctcacggtttgcgattgagggaaggccacccgcagcactttgaccgtcaggcggatcacagccagagaagccagcaccgggataaccagccgaaacaccgtcaggggcagcacgcccaggaacatgcgccgggcggccagcgacagcagcaaggccagcacgggaaacagcaccccgtccacgacatgccggccaaaccagacggaatgagggtcacccttctccccacgccacaagcgcagcatcaaccaggacagtgccagacagcccagcagaatgccggcttcggccagagccgagcgctgct

SEQ ID NO: 487630 - DNA, 690 bp, Homo sapiens
tgaactgagcggcccctgagctgacagatacactgcgcagctggaacggcgagcgagccgacgggcgagtgaggggcgcatccatgatcacctcggccgctggtaattatttctcttctgtgatcgtacatgattgaacctacagcattaaggacattgcactacactaagttgaatgcagttgttattgacttctgggcagatattgccgagtccgttaccacaatcatagaggttttatacgaagtataaggttccaggagtcgtgcacgttgcagccttagtggcatctaaaggattttatcacctggggagcctacctgaggagtctctgaattattcgcccttgtgagcacggggacctcttcaatgtctacatgataactctagaattatgttgcgaaactatttatagcactaatgctttgatcactactccgatccattgtgtggacaatgcggatttgcctgaaggtagacactgaaaaccagattgaccagcgattggccggcactcgggaatgcattgttcctgcgatgtctcgatgatctctagtttatcccggctattggcattgctctggagacgcgcagactggacgtctttggggaagaccatactgggagtcgaatggtgtccccggaatgttcccttataggcttactctgcctgtgctcagcgggataaag

SEQ ID NO: 487631 - DNA, 530 bp, Homo sapiens
tggggtaaaatagatggcacctacagtatcatttatttgtgttcttttaattttatgttaaatcgctcaccttgttggctagacagttttcaatctcaaatttttcagagtctccaacaacttctccatctggtaaaatggcaaagatgaacattcgtgcaatgggggcaacgtctgactccacagggaaggataaggcaaaactgcctttcactggaacatggagagagtgagacaaaatggtcataagtgagacaaaatggtcataagtgagacaaaaaggtcataaaaatagtgtcataaggacactattgcttggtcttatccacttgagaactgcgtccattcattctaatggcttagtctctctatgtgccattagttatttggtgaaattagtaggacaatgtctcccttcagaactttaattatagcagaagttaacaaagttcctttcactcacatcttttttatttgatattccacttaactgttgcctaaatcaattaaatatcagtagctccaaattt

SEQ ID NO: 487632 - DNA, 526 bp, Homo sapiens
gacctcgtgtacaatgtgcatgactcggattgagatcgcgtgatgggcactcaccccggctgctcagcacgctgccctgccccgctcctctgcttacttttcctccttgctggatgggcaccccgggagcggggtcctggtgtactgttcacaatgctgtggagttcagagtgcaaagaaactaacctgacttttacttcctgggccgatcgggtggagggagtaccccttcaattcagccttacatttaccttgtttgaccaaagattgcccaagtctggcgttcctcccttgcaggaggtggaggtagttggtggaggaggagccatcttagtatagctggtgcccggaatggtctcctcttcttctctccctatccctccaaactgacttgtaagctgagacctggggaggaaacttctttttggaaattggtgtataagaggtgtgtggggctacctctatgctcctctgcaatgggcctttggcgctgtactggacatggctgaagcttgcttacagattg

SEQ ID NO: 487633 - DNA, 316 bp, Homo sapiens
  misc_feature (3)..(3): n is a, c, g, or t
  misc_feature (194)..(194): n is a, c, g, or t
  misc_feature (199)..(199): n is a, c, g, or t
  misc_feature (206)..(206): n is a, c, g, or t
  misc_feature (223)..(223): n is a, c, g, or t
  misc_feature (225)..(227): n is a, c, g, or t
  misc_feature (229)..(230): n is a, c, g, or t
  misc_feature (234)..(234): n is a, c, g, or t
  misc_feature (239)..(240): n is a, c, g, or t
  misc_feature (244)..(246): n is a, c, g, or t
  misc_feature (248)..(248): n is a, c, g, or t
  misc_feature (252)..(252): n is a, c, g, or t
  misc_feature (254)..(254): n is a, c, g, or t
aancaatttatagaaagtcaattcattaaaaggtatagaacctcttgttgggcatgagggcaagggacaaagctacaacttggccggggccgatggaagctgaggcaggaggaccatctgagcccaggagcctgaaaccagcctgggcaacatagagaatccgtctcaacaaaaaaaaaatttatagccaggtnttctntgagctntagtcccagctacaagntnnnannattncttanncctnnntnattnangatgcaatgagctgtgattgtgccaccacactccagcctgggcaaaacagcaagactgggtc

SEQ ID NO: 487634 - DNA, 211 bp, Homo sapiens
tccgttgggtccttggggggctgggacggcgagtatttccgggtccgccccccccagtgcatcggggcttcatttcccaatgggcggtttttcctggcggggacttctgctctatattggggcgccgccctcattccttatggactctggcctcctttcatacatgatgtttagacagcgcttcttggcgcccgggccccacccgggcgtg

SEQ ID NO: 487635 - DNA, 401 bp, Homo sapiens
  misc_feature (401)..(401): n is a, c, g, or t
gtttaaatagctttgtttcatgctcactgaagttttttttttgatacagggtctcactttgtagcccaggctgtagtgcagtgtcatgatcacagctcactgctgcctcaacctcctgggctcaggtgatcctccaacttcagcctccccagtagctgggaccacaggctagcaccaccacacctagctaatttttggtgttcttttttttttgtagtgatggggttttgccatgttgcccaggctggtctcaaactcctgggctcaagcaatccagctgcctcggcttcccaaagtcctgggattacaggcgtgagccaccatacttggccttgaagtatttgtaattgctgcatttatgatttatttaacacctggagctgggcatagtagctcatccn

SEQ ID NO: 487636 - DNA, 239 bp, Homo sapiens
  misc_feature (165)..(165): n is a, c, g, or t
gtccactgaatcggcagaaatacagctgctgtgcccaagaggccgcagccctggctcccgtatggctccctccccttcggaccccgtcctctgtagcagccttgagggggtctgcagtggagagacacactctggattgggccctgttgtgggttgaattgtcanccagaaaggtacgcgcagaagtcctgacctccagggcctcagtatgggaccttatatgggactcgggttttggc

SEQ ID NO: 487637 - DNA, 285 bp, Homo sapiens
gaacctttttttaaaaccgggaaggggcccataggttttaaatatatttttgggccggagagaaaagggtttttacccggaggaaattgggcccctttaccctttccttttcggtttccttaggaattccaaaggataatggtaaagggggaaatatggtttcctttttttaatccagcccaggtggccaccccaaaaatttggtgcctaggtttttttttgattttgggtttgggggcccctttttcccgcctccattgggaaattaaattttcccccccggga

SEQ ID NO: 487638 - DNA, 313 bp, Homo sapiens
  misc_feature (54)..(56): n is a, c, g, or t
  misc_feature (68)..(68): n is a, c, g, or t
  misc_feature (179)..(179): n is a, c, g, or t
  misc_feature (191)..(191): n is a, c, g, or t
  misc_feature (241)..(241): n is a, c, g, or t
  misc_feature (301)..(301): n is a, c, g, or t
aatatccagagagttggtacggtaggcggcgatggacaggcagaactcttccannntgtaggcgcctnggcgtgggggaacagttcatccatcaactcgatggagtggtcgaggatgtgcgcatcctgttgggtcaggcccatgacgccggagttgagggtcatcatgtcatcgtcggncacgcccatgtncagcaggcgctggcgcagggcggtgtagaggatgctttggtgattgtcgncgtacttggtgtagaaagcgttgacagcagggtgccgggctgtacgcgttcgaacaggantctctggaatca

SEQ ID NO: 487639 - DNA, 101 bp, Homo sapiens
atgataaatcgagctcgtacccgtcaaatatttttttaaaagtataattggccaggtctggctcacgcctataatcccagcactctaggagactgaggcag

SEQ ID NO: 487640 - DNA, 905 bp, Homo sapiens
gagggtgccaagaggcgcaaccagatgtgcagcaagcgttgcgagcgccagtgcacaaagaggcggtggtacaacgccgtgacccctaaggcccgtggggaaaaatgtacgcaggggttgacctcacaacgaaggtgggccctccaaaagcggggtctgggggtgaaaaaatgaggcccaaggggtgccccgcagaaaaaacggtgccccacgcggggcccaaacgcctccacggggtataaacaactactcgcgaattaagttgcgcacccgccaccatagcggttctaactttggcaccccagcaaccggggggacccgggagcataagtgtctcccaccgggcccctttgggaagtagtggcccgcccccccacaccttgggaggtgtaaaacgttacgcgaaatcaatgatgccctcctgttttccggttccccggtgtcagataggaaaagaacaaaaccctcactccggagcatatctagactaaatataggcggacttactcccgcctttgtgagaaagctgagagaacgggggggaccattagtagggaaatgccccggttataaacccacgggcccggagcctagtataatgcctcgacttcgctccccccctttgtgttccccataaggttctcctactgactagtcggagagtccaacttatgttggagacgcatgggagacgcccctcacagggtctataagtgttattttctcataccccctttggggaattagaaacacatattgtgcgggaccccacgaccactccatgatgttctgaagcgccatatttggattttccacaaaatagaaaaattatgcttcctctaaaaaaaaaatatcccaagggcgagggggaaaaaattaaaaaaagatttttcaaaccacaaaac

SEQ ID NO: 487641 - DNA, 206 bp, Homo sapiens
cacgaggccagggctctgtcagtaaatgcatttgggtccaggaggaagcgcggacacctcgcagggaagagatgaaaaagccacatcctaccaagaggaggtgctgaaggatgcattgcaatgttgtcatcagtgcagggccagacggagacaaaactccaccccctgccgcacaggacaggtcctggctgccctgggcatgctgg

SEQ ID NO: 487642 - DNA, 184 bp, Homo sapiens
tttttcataaccccattaaaccccagataaaagggcgggttttccaccccggttgggatagaaaaaaggggtttggggggcctttcaaagggaattgggttttttaaacattttaatgggatggtttaattgggcggggttttgccagaattttgtttccagggaataaaaatttttttcccca

SEQ ID NO: 487643 - DNA, 159 bp, Homo sapiens
gcagtcttctcccatcagcaggatgacaagaccccatcagcgggatggaccccatggaaaaaaaaaaattctaggaactaaaacacgattgggcgggaggctggggaaacttactaggaaggatcagggttgcctttgccaccatgacctagccacgaa

SEQ ID NO: 487644 - DNA, 281 bp, Homo sapiens
ggtttccccccccgggttttttttggtggggggggttggggtttggggtccccccgggccccatttttattttgggtttccccttcctttttccaaaggctttgggggaggggttttccccctttggggctttggtcccctttttgggaaaaaaaaaaaattttccggttttttggggggagttttttcccggggggccccccccaatgtttggtttttcccatgtttttttgggccccccatttggttcccccctttttaagggggttttccccccccca

SEQ ID NO: 487645 - DNA, 298 bp, Homo sapiens
tgcaatggtgatatccaggtttatgcaatgctagcagacccactgaggacaacttgcattgcgggctaaaatgactctgatgtaggccaggcgtgtggcttacgcctataatcctagcactttgggaggccaaagcgagcggcatggcctgaggtcagcgagttccagacaagcctggccaacatggcgaaaccccgtctctactaaaaatacaaaaatctgctgggtgtggtggtgcactcctgtaatcccagctacctggtatgctgaggcaggagaattgcttgaacctgggagg

SEQ ID NO: 487646 - DNA, 434 bp, Homo sapiens
agagaggcacgcagttctgataccatatctggctacgttaacacatatattactctctttctctcttacggttcaaaaattgcaatcttatgaccccctatgttctggagtcaaacaactcctggatagaaagtgattatgcgaagtttattctaaaatcaaaagcgaaataagacctcctacgttttttgtctagtttaaaccaacttactgaatcccctttctgatgaggaatttgccagtgcaacatgtctacatcctgtgttgggatcgccatttccgatttgccccggcggaatttgtctctctgacactgtaaaataatttcgtcctccggctgagaataaccttccctttctcatagtggggccctgcgatttctgtagcgatcacctccatctactcctctcccaaatttgctgtcttctgtttcc

SEQ ID NO: 487647 - DNA, 183 bp, Homo sapiens
  misc_feature (18)..(18): n is a, c, g, or t
aaggaaatatacaccagnatatgcattaaaacgtccaaaagagctgggcacagtgtcacatgcctgtaaacccagctattcaggaggctgaggtgggaggatcggttgaggccaggagtttgaggctgcagtgagctatgattgcacagctgcactccagcctgtgctgagacctcatctctt

SEQ ID NO: 487648 - DNA, 502 bp, Homo sapiens
cacagaccccaacaacgacacccatcagcaccaccaccatggtgaccccaaccccaacacccactggaacacagaccctaaccccaacacccatcaccaccaccactacggtgaccccaacccctacacccaccggcacacagaccccaacatcgacacccatcagcaccaccactacggtgaccccaacaccaacacccaccggcacacagaccccaaccacgacacccatcaccaccaccactacggtgaccccaaccccaacacccaccggcacacagaccccaaccccgacacccatcaccaccaccaccacggtgaccccaaccccaacacccaccggcacacagaccccaaccccgacacccatcaccaccaccaccacggtgaccccaaccccaacacccaccggcacacagaccccaacatcgacacccatcaccaccaacactacggtgaccccaaccccaacaccaaccggcacaccgagtacaaccctgac

SEQ ID NO: 487649 - DNA, 100 bp, Homo sapiens
ttttttggttgagtctctgcctggtttggtatcagacggatgccgggcagaagactcaaccaaaaaatgagaattttagaccaatatccttgatgaacat

SEQ ID NO: 487650 - DNA, 161 bp, Homo sapiens
  misc_feature (122)..(122): n is a, c, g, or t
ttttggccaggcaggaggacctctgcgtcctctcgtttattgttttgctgcaggagcgagatggaggtggacgcaccgcgtgttgatggtcgagatggtctccgggagcggcgaggctttangagggagggaggcagaacttcgatgtgaggcctcagtct

SEQ ID NO: 487651 - DNA, 210 bp, Homo sapiens
  misc_feature (10)..(10): n is a, c, g, or t
  misc_feature (22)..(22): n is a, c, g, or t
  misc_feature (27)..(27): n is a, c, g, or t
  misc_feature (29)..(29): n is a, c, g, or t
  misc_feature (50)..(52): n is a, c, g, or t
  misc_feature (71)..(71): n is a, c, g, or t
  misc_feature (95)..(95): n is a, c, g, or t
  misc_feature (114)..(115): n is a, c, g, or t
  misc_feature (144)..(144): n is a, c, g, or t
  misc_feature (176)..(176): n is a, c, g, or t
  misc_feature (190)..(190): n is a, c, g, or t
  misc_feature (195)..(195): n is a, c, g, or t
tctacggctnagcagttttttntaccngnggcttcggcggaacttcacgnnnttattggctcaactttccncactatctgcttcatccgcggacnaatatttcactttacatcnnaacatcactttggcttcgaagccgccgcnggatactggcgttttgtagatgtggtttgacnatttctgtatgtcncgtcnattgatgagggtcgt

SEQ ID NO: 487652 - DNA, 677 bp, Homo sapiens
gcattagtgttgacgcctgtaatggtactagtttggtagtgccagaggtggttgaagcagctgagtgcagagatctaatcagctgccaaatgagaaaacccgtctacactacaaaagtgccactatgagatcttgaacccgggcttgtttgacagtgcagtctagtgatccgcaggtacttgggcgacggttgaggcaggaagaacttgactcaaacccgtgattcagatcgttcgacaggtaacccgtgatcagtgaacactttcactctggccctgggccaggagagtaagactgccgatcttccaagagatataccctataatagagggagcgtcatgtcccagttttccaacaatagttttgacatttcttgaaacaagcgccttaattttgagcaccactcatttgtaggaccggcgtgctccggtgatgtagaggctgggctatgcgcactaaaaaagttaaactaccgtagagaaggaggtggtaccagcgtcgctaattggatctgtaccaatagctagataggatttggtcgctagtcacaattcaagcacgcttcacccgaaattgtattgtacgtaaaatcagggaacgtggccagagactcgatcagagtaaggacttactaacatacccgtctggtatttccgcaagtgatgagcctgccaaag

SEQ ID NO: 487653 - DNA, 130 bp, Homo sapiens
ctctcacgatactaaggccatacctcttttactattagtaacacacggtctcaacagactgtcaaagtatcagctcattagcacatctagcaatctaaacacattagggacacaaataccccaagcaaga

SEQ ID NO: 487654 - DNA, 453 bp, Homo sapiens
tcgggagcttatcctgaatcagatgctatcagatggtcatcggagcctactaccagcttgccagtgagaatcatctgggtccttgtaggtagccatttaggtccttcccaaaatgcaagatctctaagggaagggccgagatggttggatttgactaacttcctcaagcaattctggtgataggttggggaaaaacttgtccagggtgaccagtgactgagtcctggtcttctctgaagagcacagtggctgctcactttagggcaccctggaaggtgggagctggctcagcaggcagtcttataagggagtaagcttcaagggctctgtccctccaggagggaggtgcatgaccagagagggaggcctgaggatcttcttccctggcccagagggtctgcgtgactgaggctctgtgatagcgcagagagtacaaggatcaaggttgattga

SEQ ID NO: 487655 - DNA, 84 bp, Homo sapiens
tcccccagccccccccccaaaatcctcatgtttctgcttcatacttgaaaaataacaattaaaacagccagctgtactgaggta

SEQ ID NO: 487656 - DNA, 118 bp, Homo sapiens
tcgtcacgatagcatcttcagcttcaactttaaatttgcccacagaaccctctaaatcccctggtcaatttaactggtggggtccaaagagcgaacagcgtcttagcgacactagaga

SEQ ID NO: 487657 - DNA, 291 bp, Homo sapiens
aatatattccgcaggagtaaagatgaaataaacatggtctagcattatatccgtcatggactagtccctcataccgtgtctgcatatgaattaactagaaataacttggcaaggtagagccaaagtctaatgtacctccctacaaccagacgagctacctaagcaacagctatatgatcacacccgttctattttgcataatagtgggaagatttattggtagagaccacaaacctaccgagcctgcttatacctagtctctgtgctgtgataatcttagttcaactttaa

SEQ ID NO: 487658 - DNA, 105 bp, Homo sapiens
  misc_feature (5)..(5): n is a, c, g, or t
  misc_feature (16)..(16): n is a, c, g, or t
  misc_feature (45)..(45): n is a, c, g, or t
gatcngggtggcattntctccctgatgatgggagcctcattctcntctcttcatggttacttgtctcatataacatacatctctcaaagacaatcacttctctct

SEQ ID NO: 487659 - DNA, 394 bp, Homo sapiens
cgaccgaccctgacgctgcaaaccagcaagtctcccgatgcgtatgttgagtgcgtggtgcccaagttcgagaagaacggcatgacctccacggtcacgcagaactctcggcatgcgcggatcgtggtgaccagcaagatcgctgcggacaacatcctggaagtctacaaatcccaggacggcggcaaggtgttcttgtatgagcgcaaaccattggcgtcggcgttcaagccatcgcggttcgagcatgcggcgcaggattgcctgtaatcgactggcgccggtctatcggctggcggggatctaatgtgggggctgtcgagccccagcgaggctgcgatggcatcgctgcggtctgacagtgacaccgaggtgatcccatcgcagcgtcgac

SEQ ID NO: 487660 - DNA, 317 bp, Homo sapiens
cccattggatagtacaaatagctagtaatctaaatagatgttacctaaactcgctgttacctaatgcctgtgcataaggtggtgaagtttatcggggctttatcgattacagaacaggctcctctaaagggatatgaagcaccgccaggtcctttgagttttaagctgtggctcgtagtgttctggctagcagttttagttgatttaactgttgaggtttagggctaagcatagtggggtatcttatcccagtttgggtcttagctattgtgtgttcagatatgttaaagccactttcgtagtctattttgtgtcaa

SEQ ID NO: 487661 - DNA, 1446 bp, Homo sapiens
  misc_feature (404)..(404): n is a, c, g, or t
  misc_feature (598)..(598): n is a, c, g, or t
taaaaaggtaaaaataaatatttttttattattttctctccctctcctataaatattttaacactctctcttaaaataggccaatatattcttctcttttcacaagagacatctagtgccctatctcttaaaaaatattcttaccataggtcctttggccctctcacaaaaaaaaattgtgtgcagggcgcctatgtgtgttttctctggaaacaaatatttctggttatttaaaaaacacctcttatggcagatctatttcgtgggaatattattattgcgctctctctttatattatttccaggggaactcccaaacaccacacaaaatactttcacaggtggacatatatttttatgtgtgttttctttattatcccagagaagagaaaacacaaagaacncacatatggtatgtgttttttctgagaacaactgtgtgtgtccctgggtggtgttggagcacaaaagtgtttcccctctttgggctttattatttaacagagttccttttttttctaacactgtgtcgcgaggtatgtaaaggggttataaaagtgggacatatccatatataaaacattgtggaggatatccnagagtgggagggttgaacaacatgtgaagggatatggggaggaagggacattcctctaaggggcgtaacaccgcgtggtgcccaaataaacctttgagagaaaaaatgtgtggttcccaccagaacacaaaaacagcgcacacccccaaaaaaaacacccctgagatatttttttcttcaaaggtgccacccccttttttaaacaagggggtgttccttctacaacaacttgccgatgaaaaaagccgcgctctatagtgtgtggtcactctctcaaaagaggagtgtccccttgaacacacacatctctgcgacgaaaaacacacggctctttcttaaaacacattattgtttttgtcgtgccaaaacgcaagtgttagcaataaataagtggggagaggagagcagacgaaaactaatccaaaccagtaaggcgaaacaaatacaaccacatatgtgacatgcgactaaaaatagataactacccccgaacaaataataaacacgcgataagtaacaaaaagcagcaaccacgggggagcaaaagccaaaagcacacaacacggaaggaaaagtagaaaaaacacagaataattataaaacagccgagagaaaacaactaacgaataaaacaagaagaaaataaaaagaagaagaaactataaaccacaaaaagagtaactagtaagaacaaaaatataataacaaaagcgcgatagagatgatcgcagagactcttaactaaaaagataagaacaataaaagaaacataaagacaacagaaccaaatgatatcaacgtactctcctattccttcctgtccatcatctctgatgggggggggggca

SEQ ID NO: 487662 - DNA, 461 bp, Homo sapiens
  misc_feature (67)..(67): n is a, c, g, or t
  misc_feature (235)..(235): n is a, c, g, or t
  misc_feature (334)..(334): n is a, c, g, or t
  misc_feature (349)..(349): n is a, c, g, or t
  misc_feature (400)..(400): n is a, c, g, or t
  misc_feature (422)..(422): n is a, c, g, or t
catggtggcacacacctatagtcctagctactcggtaggctgaggggtgaggatcacctgggtccanaagttggaggttacagtaagccaacactgtactactgcactccagcctgggtaacagatcgagcccccatttgtaaaaaaaaaaaaaaaaaaaaaaaaatcaatgtaaaaacaagaagcttggccgggcttggtggctcatccttgaaatcccagcactttgggaggncgaggcaggcggatcacaaggtcaagagatcgaaaccatcctggctaacatgatgaaaccccgtctttactaaaaatacaaaaattagctgggtgctgnggcgcatgcctggantcccagctactcgggaggccgaggcaggataatcgcctgaatccaggaggnggaggttgcagtgagccaggancgtgctccatctcaaaaaaaaaaagctttatgagtgatt

SEQ ID NO: 487663 - DNA, 1012 bp, Homo sapiens
  misc_feature (104)..(104): n is a, c, g, or t
  misc_feature (245)..(245): n is a, c, g, or t
  misc_feature (310)..(310): n is a, c, g, or t
  misc_feature (365)..(365): n is a, c, g, or t
gcggctgatcgcagtccggaggtgaggcggaactctgagcaggtggtccattatggctgacatgcaaaatctggtagaaagattggagagggcagtgggccgcnctggaggcagtatctcatacctctgacatgcaccgtgggtatgcagacagtccttcaaaaggagcagctccatatgtgcaggcatttgactcgctgcttgctggtcctgtggcagagtacttgaagatcagtaaagagatngggggagacgtgcagaaacatgcggagatggtccacacaggtttgaagttggagcgagctctgtnggttacagcttctcagtgtcaacagccagcagaaaataagcttttccgattagtnggcacccatctcagagcaagatcaacagaagtgataacctttcgggagaagaaccgaggcagagcaagttgtttaatcacctgtcagctgtcagcgaaagtatccaggccctgggctgggtggctatggctcccaagcctggcccttatgtgacagaaatgaatgatgccgccatgttttatacaaaccgagtcctcaaagagtacaaagatgtggataagaagcatgtagactgggtcaaagcttatttaagtatatggacagagctgcaggcttacattaaggagttccataccaccggactggcctggagcaaaacggggcctgtggcaaaagaactgagcggactgccatctggaccctctgccggatcaggtcctcctccccctccaccaggccccccacgctcccccagtctctaccagttcaggctcagatgagtctgcttcccgctcagcactgttcgcgcagattgaagtcagggggagagcagtaacacatgccctgaaacatgtatctgatgacatgaagactcacaagaaccctgccctgaaggctcagagtggtccagtacgcagtggccccaaaccattccctgcactcatgaaaccccaataaatatcctcattgacaaccagaaaaaaaaa

SEQ ID NO: 487664 - DNA, 1112 bp, Homo sapiens
  misc_feature (104)..(104): n is a, c, g, or t
  misc_feature (245)..(245): n is a, c, g, or t
  misc_feature (310)..(310): n is a, c, g, or t
gcggctgatcgcagtccggaggtgaggcggaactctgagcaggtggtccattatggctgacatgcaaaatctggtagaaagattggagagggcagtgggccgcnctggaggcagtatctcatacctctgacatgcaccgtgggtatgcagacagtccttcaaaaggagcagctccatatgtgcaggcatttgactcgctgcttgctggtcctgtggcagagtacttgaagatcagtaaagagatngggggagacgtgcagaaacatgcggagatggtccacacaggtttgaagttggagcgagctctgtnggttacagcttctcagtgtcaacagccagcagaaaataagcttttcccaggaattttctgggttctgggggccaaaagccccccccccaaaatgtttccgttcccaaggggaaaaggggcccaaaggggaaaatttttccaaagacacagggaacaacacgggtttgggaacgttaaaacccctttttccggggggaacgaaagaaaccgggaggcagcaaagttgtttaatcacctgtcagctgtcagcgaaagtatccaggccctgggctgggtggctatggctcccaagcctggcccttatgtgacagaaatgaatgatgccgccatgttttatacaaaccgagtcctcaaagagtacaaagatgtggataagaagcatgtagactgggtcaaagcttatttaagtatatggacagagctgcaggcttacattaaggagttccataccaccggactggcctggagcaaaacggggcctgtggcaaaagaactgagcggactgccatctggaccctctgccggatcaggtcctcctccccctccaccaggccccccacgctcccccagtctctaccagttcaggctcagatgagtctgcttcccgctcagcactgttcgcgcagattgaagtcagggggagagcagtaacacatgccctgaaacatgtatctgatgacatgaagactcacaagaaccctgccctgaaggctcagagtggtccagtacgcagtggccccaaaccattccctgcactcatgaaaccccaataaatatcctcattgacaaccagaaaaaaaaa

SEQ ID NO: 487665 - DNA, 697 bp, Homo sapiens
ggtttttcacgaggacccctttcccctgtttgacacatgaagacccctttttcctctccctgtcccctccgaggcaacgtaattttctcgcgtttatcacccccctggtgccacattttctccacagtttgtgataaaaatacacatccctccccctcctttcgatggcgtgggcgtcgaacacaaatattgcccaccccatctcgccccccggtcattcttttgctccccaccctacacgattttctgcggtgtagagtaccacatcctaaattgtatgcttatacagtcaccctcgcccctccttcatcaaggcctctcccctcgcggaggcaattaaatttattaacgcctagtgattcttttcttggcgctaaaacaatgtttgtttcgcagctcacctcttctctccctattttctttcttctcgccccccgccgctctccttcttgcatacaatatcctctcttgtgtgattttgagattatatacatatgagcagagaatgaatatatccactcgtttacacacgtatgttgggggccacctccgagaggcccgcgcggggcccgcgcggtcgcggccctctcgtggataaatgcggcgagcgtccgtgggtcgccacccagttcgaccaccatctgtttgttgttctgtatatataaaacaaaaataacgaaggccccacaataggtaa

SEQ ID NO: 487666 - DNA, 205 bp, Homo sapiens
agagatcccatggccggtgaatcagctgattcagggaagatcatcccagccattgcacgaccacagcagccgtgtaaggcttgtgtgtctggagctgtacaaggttgtgcagggagcaccgaacaggttgactcctacaagaatggtttcctcaacttggacctgcctttctatggttactctgaaccccttgctgaacacgtca

SEQ ID NO: 487667 - DNA, 622 bp, Homo sapiens
cggacgcggtgggcgaatgataagcatacagcaacactaaaggacgaacctgatcgcttatacgtagtatccttaatcatttttattgccacagacataacctccatcggacgtcctgcctcactcattgacaccaagcacccaactatctatagaacctagccatggcacatccccttatgagcgggcgcgggatgataggctgttcgctcgtgaatgcattaaaaatgtgcctaggcgccacttcttaccatcggaaggcatcgacctgaatcgacccgtgtgatctcccataactgagtattattattcgaagagccatcaggcctactcgattaccgaacccaaatagccctggcccgtgacgcctaagccgactaaacgattactgcaaggccacctatcgtacaatgcagcgctacatcggaagcgcgccactcgctagacgatatcaacgatgaagcttccctctacgcttatcgatcgttcagcaatttctaatactagccgtgactatcctagaaatcgctgtcgcgcttaatccaagggctacggttttcacactttctagttaaggcgctctacctgcagcgaaacatagtaaaaacaatacaagaacagg

SEQ ID NO: 487668 - DNA, 186 bp, Homo sapiens
  misc_feature (128)..(128): n is a, c, g, or t
gctgctgttgctgtggtccgtgttcccatggcgcattaggccaccaccacgcgcaggtacagcagctcctcggcgatgctcatgtcgttgcgcgccaggaccctgggccgggggttcgggctgtgcgnacccctggggctcaccacggcgcacacacccgccacaacccgcgcacggacggctccc

SEQ ID NO: 487669 - DNA, 199 bp, Homo sapiens
gagaggtggagatgtacatcgtgagatgtaccaaacgggccaagtgcaaagtaccgtttggtgaagtttagtgtcatataaaacactaagtaaacgaaacgggtggtactctgtctcatatcctgaaatgttttgagaagaatattgaatttgaccctaagggcattgctagtgaatttcaaacagagatttcagttga

SEQ ID NO: 487670 - DNA, 121 bp, Homo sapiens
cgccgccgcagccgctgccgccgcaccgaagaggccatgttgtgtggtgtgtggggcggggggaggaggaggagggagtaaagcctagagaggagacgggagagagacaccacacacacgg

SEQ ID NO: 487671 - DNA, 996 bp, Homo sapiens
attgccgtctgcgcgtgtcttacgagtgctcagcctttgtgttgattcgaactctcagtggtcatacttgatcatatctcaggatccctgcatcgaccgaactatctcagaaagggtgtggagtgcagaatataacactagagacgcgaactgcatacattgctaggccgtaaccattatgggcgttgtctactattgctaccaaccttgtgcaccttcatgcggatgaggaggttcgatcatgtgttgttcgccttactcataggagtccttcgcttgtcgctgagactgcattattatgaatgcttgctctgtgaatgggactattccctgtatgcacctcacaatcttcatggatcactgggagcgctgttagatcacagttgtatgactcgactttgatagttcgatggtggcgagtgccttgcaggtacagttggcaatggtggggctctatgggcacgtgtccaggcttctcactcctcttgctgtcgcctatgtgacatatctatgcaacctattcagccgactgttggaggccatctcggcaaaagcttcgttccgccacagctgttgccggaggcacagacccttctcttcgaccttcagtacttatgagaagaacttgacttgtatggccatcattgtgctctctgccttcgtgaattgccataaaaccctcacaagtaacgggataaaatcaacaagataagtccattgagagggagcagcttgactttcttctctcagatctaaaatgcatctattttatccaagcaatctcaactactgtgggaggaaagggcttgagagggattatctcctgaccgtagtgagactagacgttgtcatattcctgggttgaagaaaaaaggcggtgttgcccccgaagtgattgatagccagtccacaagcactaacttgtaggctgctcttttccgcttgggccttgaagttcctctctcttaaggcgctagtcacctttgccgttattgc

SEQ ID NO: 487672 - DNA, 341 bp, Homo sapiens
cacgactgacgaatcctcctgagttagctgggattacaggtgtccgccacacacacccgggtaattttcgtattttcagtagaggtgggggggttcaccatgttggtcaggctggtctgtaattcctgacctcacgtgatctgcctgcctcggcctcccaaagtgctgtaattaacaggcgtgagccgctgcattccggcctccttatacatttatatccgttacctataccgttgtcatagaagccagggtgtcaggcctcaggtatgcagtatatttctgtggacccatcagcataactgtcaccctgggagctccttagaactatcaggactcgtcag

SEQ ID NO: 487673 - DNA, 362 bp, Homo sapiens
cgagctcggttccccttttggggcttgcttattcatctgtaaagaggagggggtttacacaatgagataccatctcacgccagtcagaatggtgattattaaaaagtcaggaaacaacagatgctggcgaggctatggagaaataggaacacttttacactgttggtaggaatgtaaattagttcaaccattgtggaagacagtatggtgattccttaaggatatagaaccagaaataccacttgacccagcaatcccattactgagtatatacccaaaggaatataaatcattctactataaagacacatgcacatgtatgtttactgcagcactatttacaatagcaaagaccccaaaag

SEQ ID NO: 487674 - DNA, 445 bp, Homo sapiens
  misc_feature (424)..(424): n is a, c, g, or t
  misc_feature (436)..(436): n is a, c, g, or t
gattccacatgaactttaaaatcagcctgtgaatttctacaaagaagccagctgctttcctgatagagattgcatagactctgtagatcaattttgggggtattgccatctgaaaaatgttaagtctcctgatacatgaacatcagtctgcttttgggctgccataacaaaataccacggatttggtggcccaacaacaggcatttattttctcacaattcagaagtccaagatcgggtgcaagcaactttagtttctggtgagggctctctcctttggttgcagatggccgctttcccactctttgctcacatggcctttcctttgtgtgtggagagagaaagagttggagggaggaagagagagagagagagagagagagagagagagagagaaagagagagtttagacagagggccaatgntcccccgggggntctcctttc

SEQ ID NO: 487675 - DNA, 252 bp, Homo sapiens
gtcgactctgacggatcccttcgtcgaacaccacggcatctagaagctggttccctctgctggtgtctagtgtttttttccctctcctgtccttgtgtatgaaggcagtcaactaagggtgtccagccccattccctctctactcttgacagcaggattggatattgtgtatagtggtttattttattttcttcatttagttctgaaattcaagtatgcgaaacaaagaatatgccgttatacttcgacgaa

SEQ ID NO: 487676 - DNA, 505 bp, Homo sapiens
  misc_feature (23)..(23): n is a, c, g, or t
  misc_feature (71)..(71): n is a, c, g, or t
  misc_feature (127)..(127): n is a, c, g, or t
  misc_feature (185)..(185): n is a, c, g, or t
  misc_feature (189)..(189): n is a, c, g, or t
  misc_feature (236)..(236): n is a, c, g, or t
  misc_feature (243)..(243): n is a, c, g, or t
  misc_feature (505)..(505): n is a, c, g, or t
tggatcccggctgcaggaatcgnacgactggaatattgcaggcactttggaggagcgtgggggaataatgncctcacagaggtgtactgtctagtgaaccgggcccgaggaatggagttgcctctcnccagaaagatttggtaaatgcgtgcaagatgctggaacgctaaaattgccctatcagnttcngggtttttgacagtggtgtcatggtaattgagcttcaaactcacaanggaaganggaaatggtggcctcggccttggagaccggtttcagaaagggggtccttaacatcccgaagagtttgccaagcttgtgggaatgtctgtccttctggctaaagaaaggctgctccttgcagagaagatgggccacctttgccgagacgactccgtggaaggcttgcggttttatccaaatttatttatgacacagaactaagaattttgtacctgaaatgctttatgtcaataagcttgcattttgccaaggtctcacgacn

SEQ ID NO: 487677 - DNA, 162 bp, Homo sapiens
gaggaggccagcaaaccgtggagaagcagctcgcccctgactagcgcagctcgcccctaagttagcgcagctcgcccctgagttagcgcagctcgcaatagcgcagctcgcccctagttagcgcagctcgcccctgagttagctgcagctcgcccctgagtt

SEQ ID NO: 487678 - DNA, 125 bp, Homo sapiens
gatctaagatccagctccacagactctcaacagtaatgtcttcatatcttaaattctaatataaaacgatgctctcttcatcacatgacactgacctagcttaagctcccaatgaggtgtgcctt

SEQ ID NO: 487679 - DNA, 114 bp, Homo sapiens
cgggtactcacatatcggggagagtgcgatgacggactatgatgatagcgggcaggatagttcagacggtattctatttccttagacgtctgagatgttagtattagttagtat

SEQ ID NO: 487680 - DNA, 896 bp, Homo sapiens
  misc_feature (28)..(28): n is a, c, g, or t
  misc_feature (162)..(162): n is a, c, g, or t
  misc_feature (201)..(201): n is a, c, g, or t
  misc_feature (230)..(230): n is a, c, g, or t
  misc_feature (387)..(387): n is a, c, g, or t
  misc_feature (392)..(392): n is a, c, g, or t
  misc_feature (421)..(421): n is a, c, g, or t
  misc_feature (440)..(440): n is a, c, g, or t
  misc_feature (449)..(449): n is a, c, g, or t
  misc_feature (475)..(475): n is a, c, g, or t
  misc_feature (477)..(477): n is a, c, g, or t
  misc_feature (486)..(487): n is a, c, g, or t
  misc_feature (490)..(490): n is a, c, g, or t
  misc_feature (495)..(495): n is a, c, g, or t
  misc_feature (499)..(500): n is a, c, g, or t
  misc_feature (506)..(506): n is a, c, g, or t
  misc_feature (508)..(508): n is a, c, g, or t
  misc_feature (511)..(511): n is a, c, g, or t
  misc_feature (519)..(519): n is a, c, g, or t
  misc_feature (535)..(535): n is a, c, g, or t
  misc_feature (559)..(559): n is a, c, g, or t
  misc_feature (561)..(561): n is a, c, g, or t
  misc_feature (571)..(571): n is a, c, g, or t
  misc_feature (574)..(574): n is a, c, g, or t
  misc_feature (576)..(577): n is a, c, g, or t
  misc_feature (584)..(586): n is a, c, g, or t
ccgcattgtgtgcatagagggaaacctnatattttaactgtgctatggagtagaagcaggaggtgttcaacctagacacagagcagcacctaccccctcctcctttccacacactgcaaactcttttacttgggctgaatatttagagtaattacatctcanctttgagggctcctgtggcaaattcccggattaaaaggntccctggttgtgaaaatacatgagataantcatgaaggccactatcatcctccttctgctgcacaagttgtgtgaggttcctgggctggaccgtgttcaacagagaggcttatttgactttatgctagaagatgaggcttctgggataggcccagaagttcctgatgaccgcgacttcgagccctncctangcccagtgtgccccttccgctgtcaatgncatcttcgagtggtccagngttctgatngggtctggacaaagtgcaaaggatcntncccctgagnnaantctgntaannctgaananaanaaaataancgaaatcaaagatggngactttaagaactgaagaaccttnangcatgatctngtnannaataaannnagcaaagttagtacctggagcatttacaccgttgggtgaagttgggaaacgacttgaatctgtccaagaaatcagctgaaggaatggccagagaaaatgcccaaaagctcttcaggagctgagtgcccatgagaatgagatcagcaacagtgcgacacaagtcactttcaaatggactggaaccaggaatgatcggtcaatagaaattgggaagccaagataggagtgaagaaaactcagggaaattgaaaaatgggggcttaacaaggaaatgaggagagagcgtcataacattccggaatgagtgata

SEQ ID NO: 487681 - DNA, 834 bp, Homo sapiens
  misc_feature (28)..(28): n is a, c, g, or t
  misc_feature (162)..(162): n is a, c, g, or t
  misc_feature (201)..(201): n is a, c, g, or t
  misc_feature (325)..(325): n is a, c, g, or t
  misc_feature (330)..(330): n is a, c, g, or t
  misc_feature (359)..(359): n is a, c, g, or t
  misc_feature (378)..(378): n is a, c, g, or t
  misc_feature (387)..(387): n is a, c, g, or t
  misc_feature (413)..(413): n is a, c, g, or t
  misc_feature (415)..(415): n is a, c, g, or t
  misc_feature (424)..(425): n is a, c, g, or t
  misc_feature (428)..(428): n is a, c, g, or t
  misc_feature (433)..(433): n is a, c, g, or t
  misc_feature (437)..(438): n is a, c, g, or t
  misc_feature (444)..(444): n is a, c, g, or t
  misc_feature (446)..(446): n is a, c, g, or t
  misc_feature (449)..(449): n is a, c, g, or t
  misc_feature (457)..(457): n is a, c, g, or t
  misc_feature (473)..(473): n is a, c, g, or t
  misc_feature (497)..(497): n is a, c, g, or t
  misc_feature (499)..(499): n is a, c, g, or t
  misc_feature (509)..(509): n is a, c, g, or t
  misc_feature (512)..(512): n is a, c, g, or t
  misc_feature (514)..(515): n is a, c, g, or t
  misc_feature (522)..(524): n is a, c, g, or t
ccgcattgtgtgcatagagggaaacctnatattttaactgtgctatggagtagaagcaggaggtgttcaacctagacacagagcagcacctaccccctcctcctttccacacactgcaaactcttttacttgggctgaatatttagagtaattacatctcanctttgagggctcctgtggcaaattcccggattaaaaggntccctgtgtgtgaggttcctgggctggaccgtgttcaacagagaggcttatttgactttatgctagaagatgaggcttctgggataggcccagaagttcctgatgaccgcgacttcgagccctncctangcccagtgtgccccttccgctgtcaatgncatcttcgagtggtccagngttctgatngggtctggacaaagtgcaaaggatcntncccctgagnnaantctgntaannctgaananaanaaaataancgaaatcaaagatggngactttaagaactgaagaaccttnangcatgatctngtnannaataaannnagcaaagttagtacctggagcatttacaccgttgggtgaagttgggaaacgacttgaatctgtccaagaaatcagctgaaggaatggccagagaaaatgcccaaaagctcttcaggagctgagtgcccatgagaatgagatcagcaacagtgcgacacaagtcactttcaaatggactggaaccaggaatgatcggtcaatagaaattgggaagccaagataggagtgaagaaaactcagggaaattgaaaaatgggggcttaacaaggaaatgaggagagagcgtcataacattccggaatgagtgata

SEQ ID NO: 487682 - DNA, 1090 bp, Homo sapiens
atgcaggaccacttcagccgcgcgtcagcatcatagacgagctcttccaggacaggttgcgttcacccgggagccccaggatacctaccactacctgcccttcagcgctgccccaccggaggcctcacttcttctttcccagagtcaccgacatctgtcgcgcaagcttgagtgcaccttctcgtccgtacgagcccctgaacttccacgccatgtaccagcccttccttgagatgatacacagaggctcagcaggccatggacataccaacttccatagcccggacattccagacaaccacgaacaacagaatacatacgagaaggcgacgatgaccggactgtgtgccgggagatccgccacaagtaccacgggctgcctgcggatgaaggaccaagtgtgacaagtgccagggagatctagtactagaggaactgtaccaccaacaaaccacatcccaggctaagctgcgtgcgggagctcgacgaactccctccaggtacgctgagaggtagaccaggaaatacaaagagctgctaaaagtcacataccagtggacagactgctacacacaacacatccatccttgacatggaagcaacagacacgacgcacgacaacaacaggcatgacccgagagagcaaaacctcacgcaaggagaaagaccagtacaccacactgcggggtaaccaaggggaacccaaacagctgaactcagaacgaacatacccggagatcactgaggagggacagaaaaacctatagaacggaaacccacacacgggaccggacaacagaaaaagaatccagaagaacgcaaaaagcagagaaacagggagaaaaaagcaagagaacaaccacaagaacacggaaacgaaagaaaaagagacagaaccaagggagacgaaatacacaccagaaagaggtggcaccagaggaagcagcaccagacaggacagagcacgccagggcaaggaacgggagcgacacccggccgaaagcgacaggcacagaaacaggggcgaaaagacaaaagagaaaacgggacgccagcccagaatggaagagaggaaaaggagaagacagcg

SEQ ID NO: 487683 - DNA, 158 bp, Homo sapiens
gggtgtcagatcatagagcacccgtgtggagttgccagggttacagctcctcatctcagaacagctctctttggttccatcgacgcccatcaagcttgtgtggtcgcgcacgaattgctgcatccacctcttcaacacaatgattcagtcacaaaacc

SEQ ID NO: 487684 - DNA, 199 bp, Homo sapiens
gttacttctgagaccagtgttgctccgtacgtgctccgcctcgccatgacttcctacagctattgccagtcgtcggccacgtacgtccttcggaggctgagcggcggctccgtgcgatttgggccgggggtcgcttatcgcgcgcccagcattcacgggggctccggtggacggcgccgtatccgtgtcctccggccgc

SEQ ID NO: 487685 - DNA, 412 bp, Homo sapiens
atctaaagaatcccggcgatttaatcgtggaacaaacgaaccttaaatagcggcggcaccatcgggatgtccggatccaacatcgaggtcgtaaaccctatggttggatatggactctaaaataggatggcgcggtaatccctagggtacctggtcccgtgggtcaagtcatgggatcaatggagtatagtagtccgcttggactgggtgaagtcttagcatggtactggcccggaggtggggttctggctccgaggtcgccccaaccgaaattttaaatggcaggttgggtagttaagggacctggtatgattgggtccacgaggtgttcagctggtctcttacttttaaccagggaaatggaccggcccggtagaagaggcgggcataacacagcaagacaagaagacgg

SEQ ID NO: 487686 - DNA, 205 bp, Homo sapiens
tcgtctttgataggcaatgttcattttcttatgcacaccagaaaccactgcaggcttataaatagataaataaataacagttaaaagatatatagactttcttttatgtggttgttgtgtgtgtgagacagagtcttgctctcttacccaggctggagagcagtggcctcatcatacctgactgtcaccccctatcaaaagacga

SEQ ID NO: 487687 - DNA, 402 bp, Homo sapiens
  misc_feature (1)..(1): n is a, c, g, or t
naggttgcctttaaggctcacttctttctgatacgtctgacgcatttcctcgccatgcgccttgttacgctcgtttgcttggaaatgagtctcatgcttctggccgtcatacgacctcaaccattcatcattctcgtctcgatctgccattccctgaatcctcgacctggttgcccgtagagcccctgacagacggcgtggtggccgtctgatacccaaggctgattctacgcataccatcgtattattggcaaaaaatccgatggcacagagcgtttgtagatatggatttttactgtgaagtgcttgtttgaaatacgtgaacaggctgaaaactgtggtgcttgcaaaagcgatgaagaaatttcgggttgcgaaagaattacacaagccggtcgacgc

SEQ ID NO: 487688 - DNA, 546 bp, Homo sapiens
  misc_feature (98)..(98): n is a, c, g, or t
  misc_feature (485)..(485): n is a, c, g, or t
  misc_feature (511)..(511): n is a, c, g, or t
  misc_feature (515)..(516): n is a, c, g, or t
  misc_feature (520)..(521): n is a, c, g, or t
  misc_feature (527)..(527): n is a, c, g, or t
caatatgcaatatgcactcaatatgcaatatgccggctcacggcagtaggggaatctggcctcgagacgtgttgaagaaggtctctcgaggtctttcncgggttgaggcaggaaaccctgggttccctcgacttgtgcaggtgacctcagggggcttctcatggtggctctgagaagccagggaaactggaggtgggaggggcctctcgggactccactgggtttggtgcattggaagagggcctcatctccagttgaggcaggaaccgcagggtacctctgatttcagactccgatcgcagggtccctgcagactggggacaggagagtcaggcctcgtcttgggttgaggcatggaactccgcttgcctctcgagatgtccccggggagagaggccgcttgtcgagctgtatttggaacctgggggttttttccgaacgatgcacgggaaaactgccccttcgtgttgacttcattcacaggntggagttcggagaggtgtccgctcgngccnnatcnngagggnaccgggaaatcggggtcct

SEQ ID NO: 487689 - DNA, 189 bp, Homo sapiens
  misc_feature (127)..(127): n is a, c, g, or t
tgatatgcaaaatgaagacgaaagcaggtgggtcatccctatgccttctgcctcaatacgagatcacgttcagtgctgtgagtgtgtcacccaacccaccaccatgacaaccaccaccacagagaanccaactccgagagcaatcaccaccaccactacggtgaccccagcccggtcccccagcccggt

SEQ ID NO: 487690 - DNA, 1193 bp, Homo sapiens
  misc_feature (407)..(407): n is a, c, g, or t
  misc_feature (691)..(691): n is a, c, g, or t
  misc_feature (745)..(745): n is a, c, g, or t
  misc_feature (1132)..(1132): n is a, c, g, or t
  misc_feature (1158)..(1158): n is a, c, g, or t
  misc_feature (1162)..(1163): n is a, c, g, or t
  misc_feature (1167)..(1168): n is a, c, g, or t
  misc_feature (1174)..(1174): n is a, c, g, or t
gaattcggcacgaggtcgcatcaagggtgccaagtgccctttcgacctccaattcctaacgtgggacttctcctgaggcgctgtagcgggaaagggcttcatcttgcgatgacgggggagccacgtggtttttctcgagttacggcgggattctcgagttacgacggggaattcaggctgcctcttgtgttggcccaggcaagtccaatcttccattcgagttgcgaaggaaagctggggattgctctcgagtgactgcagggccaatagacctcatctaggcttgtgtccagaagccaatgttcctctccaggggcgacagggatctcggggttgcattccagacgcacccggggagacaggcattcatctcgagtggaagcaaagaaccccgctctgctctcgantcgcgacgggtatctcttggagctcactgggtggactcaagggagtcaagcctcctgaggcgtttggagagaggtcgcgagattggtctctaggccatgcaggagacgaaggccctcatctctcgatgacgggggaatctcggggttgttctcgagcggcggccccagtgtgcggtttctcacgaggtacgacggcgaggtcagtgagcctctcgtggggcgccagggaagtcgggtctccatgcgagtggcgagggggagcgcgtcattgctctcgagtcatnagtaggggaatctggcctcgagacgtgttgaagaaggtctctcgaggtctttcncgggttgaggcaggaaaccctgggttccctcgacttgtgcaggtgacctcagggggcttctcatggtggctctgagaagccagggaaactggaggtgggaggggcctctcgggactccactgggtttggtgcattggaagagggcctcatctccagttgaggcaggaaccgcagggtacctctgatttcagactccgatcgcagggtccctgcagactggggacaggagagtcaggcctcgtcttgggttgaggcatggaactccgcttgcctctcgagatgtccccggggagagaggccgcttgtcgagctgtatttggaacctgggggttttttccgaacgatgcacgggaaaactgccccttcgtgttgacttcattcacaggntggagttcggagaggtgtccgctcgngccnnatcnngagggnaccgggaaatcggggtcct

SEQ ID NO: 487691 - DNA, 151 bp, Homo sapiens
aaaaggcacacattcacttttgctttagtcccagaatccctttttaaactctatctcttcaatgttggctcaagtctttcaaaaatgtgaacaacgttggggtagtggtgttaaattcctttgctatttctcctcttgttgtgacagcaat

SEQ ID NO: 487692 - DNA, 1172 bp, Homo sapiens
  misc_feature (386)..(386): n is a, c, g, or t
  misc_feature (670)..(670): n is a, c, g, or t
  misc_feature (724)..(724): n is a, c, g, or t
  misc_feature (1111)..(1111): n is a, c, g, or t
  misc_feature (1137)..(1137): n is a, c, g, or t
  misc_feature (1141)..(1142): n is a, c, g, or t
  misc_feature (1146)..(1147): n is a, c, g, or t
  misc_feature (1153)..(1153): n is a, c, g, or t
caactgtcttgaagtgatacccgtcatcgaagacacaattagccttctacgtctcatcactgtagcgggaaagggcttcatcttgcgatgacgggggagccacgtggtttttctcgagttacggcgggattctcgagttacgacggggaattcaggctgcctcttgtgttggcccaggcaagtccaatcttccattcgagttgcgaaggaaagctggggattgctctcgagtgactgcagggccaatagacctcatctaggcttgtgtccagaagccaatgttcctctccaggggcgacagggatctcggggttgcattccagacgcacccggggagacaggcattcatctcgagtggaagcaaagaaccccgctctgctctcgantcgcgacgggtatctcttggagctcactgggtggactcaagggagtcaagcctcctgaggcgtttggagagaggtcgcgagattggtctctaggccatgcaggagacgaaggccctcatctctcgatgacgggggaatctcggggttgttctcgagcggcggccccagtgtgcggtttctcacgaggtacgacggcgaggtcagtgagcctctcgtggggcgccagggaagtcgggtctccatgcgagtggcgagggggagcgcgtcattgctctcgagtcatnagtaggggaatctggcctcgagacgtgttgaagaaggtctctcgaggtctttcncgggttgaggcaggaaaccctgggttccctcgacttgtgcaggtgacctcagggggcttctcatggtggctctgagaagccagggaaactggaggtgggaggggcctctcgggactccactgggtttggtgcattggaagagggcctcatctccagttgaggcaggaaccgcagggtacctctgatttcagactccgatcgcagggtccctgcagactggggacaggagagtcaggcctcgtcttgggttgaggcatggaactccgcttgcctctcgagatgtccccggggagagaggccgcttgtcgagctgtatttggaacctgggggttttttccgaacgatgcacgggaaaactgccccttcgtgttgacttcattcacaggntggagttcggagaggtgtccgctcgngccnnatcnngagggnaccgggaaatcggggtcct

SEQ ID NO: 487693 - DNA, 1150 bp, Homo sapiens
  misc_feature (407)..(407): n is a, c, g, or t
  misc_feature (691)..(691): n is a, c, g, or t
  misc_feature (702)..(702): n is a, c, g, or t
  misc_feature (1089)..(1089): n is a, c, g, or t
  misc_feature (1115)..(1115): n is a, c, g, or t
  misc_feature (1119)..(1120): n is a, c, g, or t
  misc_feature (1124)..(1125): n is a, c, g, or t
  misc_feature (1131)..(1131): n is a, c, g, or t
gaattcggcacgaggtcgcatcaagggtgccaagtgccctttcgacctccaattcctaacgtgggacttctcctgaggcgctgtagcgggaaagggcttcatcttgcgatgacgggggagccacgtggtttttctcgagttacggcgggattctcgagttacgacggggaattcaggctgcctcttgtgttggcccaggcaagtccaatcttccattcgagttgcgaaggaaagctggggattgctctcgagtgactgcagggccaatagacctcatctaggcttgtgtccagaagccaatgttcctctccaggggcgacagggatctcggggttgcattccagacgcacccggggagacaggcattcatctcgagtggaagcaaagaaccccgctctgctctcgantcgcgacgggtatctcttggagctcactgggtggactcaagggagtcaagcctcctgaggcgtttggagagaggtcgcgagattggtctctaggccatgcaggagacgaaggccctcatctctcgatgacgggggaatctcggggttgttctcgagcggcggccccagtgtgcggtttctcacgaggtacgacggcgaggtcagtgagcctctcgtggggcgccagggaagtcgggtctccatgcgagtggcgagggggagcgcgtcattgctctcgagtcatngaggtctttcncgggttgaggcaggaaaccctgggttccctcgacttgtgcaggtgacctcagggggcttctcatggtggctctgagaagccagggaaactggaggtgggaggggcctctcgggactccactgggtttggtgcattggaagagggcctcatctccagttgaggcaggaaccgcagggtacctctgatttcagactccgatcgcagggtccctgcagactggggacaggagagtcaggcctcgtcttgggttgaggcatggaactccgcttgcctctcgagatgtccccggggagagaggccgcttgtcgagctgtatttggaacctgggggttttttccgaacgatgcacgggaaaactgccccttcgtgttgacttcattcacaggntggagttcggagaggtgtccgctcgngccnnatcnngagggnaccgggaaatcggggtcct

SEQ ID NO: 487694 - DNA, 144 bp, Homo sapiens
aagagttattagaaaagcaaaaaggttattatgaaaaatatacacatcttactgctcaaagtaataagactatattccttacctatatgtaacacaagtatcattgcaatatagttaaataaaatgctgagctctagtgatgta

SEQ ID NO: 487695 - DNA, 188 bp, Homo sapiens
gtccaagcacaaggccttgaggaagaccctgacgctgtgttgtcagctgttggtgctgtgtggttcttgttaagctcttttgagtaagaaggcagcttagtgaaggggaggcaaatctgtccgtcccaggccaaggccatagtaggtgttcagggaatacatgtggaacgcgtaagccacgtggttgg

SEQ ID NO: 487696 - DNA, 327 bp, Homo sapiens
cttttggggtctttgcttgggaggcctaggcgtgagaatcgcttgaacctggaaggtggtggttgcagtgagccgagatcctgccactgcactccagcctgggcaaccaagcgagactctgccttaaaaaaaaaaaaaaaaaaatggggcccatatccccaatggaatcctatgcggccataaaaaaaaatgggatcatttctggtccagaaccgtgtatggagcgggaacccattatcctaaaagaccccactcagaaccagaaacccaaatcccacttgttctcacttataagtagaaccaaaccgttgagtccccatggttcca

SEQ ID NO: 487697 - DNA, 307 bp, Homo sapiens
aatcctgctgcaggggacaagggtatgagtcagactggaggagatgagcagtctgcctattcgtagtaacactcagcaaactggtagtcgaaaatgtctgctatgaccagtctttcccaatctctcatgtgcgctatctgggtcctgacagatcatatttgtgtctgtacccacactcttgtacctggctcatgtgttctctgtgatgcgaaaggaagagcacctgaacaagaaagaggaagcactccaggttgcccaaactgatggtgtcaatgtggacatgcacttgaagcagtattgtataaag

SEQ ID NO: 487698 - DNA, 306 bp, Homo sapiens
gatgatatggtcaagtgcattcagagtatcaggacataatcacaagactgtcctttcccacatgaaaacactttacagaaaacgtaaagcactactcacgtagcatgatgtaggcatcacactctttgcacttacctcttttaggtacacaagtataatacaacaaagcaaaaatattttacagtgtctgttaacaaaaagttctctattagcatagaagaaactacagtatcctgaagctattaccccaagagctagtttagtagataagacctttgaacccatcttatatttccttcttaatat

SEQ ID NO: 487699 - DNA, 193 bp, Homo sapiens
  misc_feature (2)..(2): n is a, c, g, or t
gngacgcctgagctagacgagggcggagtggaccaccttgcaaggcttcaggcccgccgcctccattggccggggatggcccgctgtggcccagcctaccctgccctcgctagctgaagctcgacgacatcacgacagcttaagcatcatacgcccattcgctctggccctcccaccaggcttagcagagcct

SEQ ID NO: 487700 - DNA, 291 bp, Homo sapiens
accattcatgttaaatacatttttgaagcccttcttttattgcattacataatggacagccatttttgatggttgcggcagccattataattttaagtcagacccaatatatgcatattaaaattctgtatactttgataaagtaaaaaataaagctatataaattgatctttagatttttctgcaaaagtagaatccccctttcatgacccttctaacatatcccatcagggctgcttatagacccaacatcagaaagattttcattccggttcccccccctatccctta

SEQ ID NO: 487701 - DNA, 110 bp, Homo sapiens
ttcggacgacatgtatgattgacatttttcttggtctaaaaattatattaaacatttattttgaaatagcttttcttcgtgtttttttcttctgctatggtccgagcgga

SEQ ID NO: 487702 - DNA, 396 bp, Homo sapiens
attgggcacacacacatacaaaactaatgacacttgactcttccgcaatgcaaatgaaataatggaaaacacataaatgagtgtgtagaaattatgtgcatacacaccttacacacagacactgcagaatgaaacactcacacacacagatggagagggtgagtgggttcagaaatcgaatcagagctcttgagagaagatctggggtgtttcaaattgtcctaattgccttgtaactgcaaaatatgagatctgcaataacacaaagaaataaactagacgaggctgacaagtctgcatctgaacgattaggaatggagattaggatatcatctaactgccacaccagtagagagagtcgacgcggccgcgaatttagtagtagtaggcggccgc

SEQ ID NO: 487703 - DNA, 154 bp, Homo sapiens
caagacagtaggatatcactgtatgtctagcgctgtacagtgcatgtatacaccaggctgtgtctagatgcacagttacagcaggagttgatatttcccatcacgggatgccgtgtctgtagcccgggatgtgccgtgccctgcagtatgtcag

SEQ ID NO: 487704 - DNA, 418 bp, Homo sapiens
gcccgatgtgggttctggctgatcaagcggcgtgtatcgggatacctcttgattgtcaccgtcagcctcttgaacagcagacggtgtgacggcattgagcatggtactccatgatggcgccgatccacagcaatgctgcacggccaggaagccattcccggatgtacccaggttctccgccatcaggggactgtaggttcccattggtcctgactttgagaaccgtggcaaaagggaagtagtgtgccagccttctgtctctttcaggaaaaaggagcctgtttgggtccacatgtaatttctccgtgtgtaactgaaccgtaggtgatattttaccgccagcggcaggggctccttgctgtggttgaaggggtgctcgaagaccacggcggccagcacgctggacgagcagttgtcg

SEQ ID NO: 487705 - DNA, 167 bp, Homo sapiens
cgctgttaccataaatggctgttacctaaatggctgatacctaaatggctcttcatactactggaagtcagaccatacttcttagtgtactctttctcccatccttgtaaaagactgtatcatacagccatttaggtaacagccatttaggtaacagccatttaggt

SEQ ID NO: 487706 - DNA, 816 bp, Homo sapiens
atcaggctaggtacgaggccgggtggtcattgggaaaggacaggtgccgagccctgcatgtggagccctcccaacccacccacagatagttagggaaataaccaaaaaactaccaaagcaacagaaacccacatctctagactgaaaccccaaagtgggctatgatgggtgggtaagtgtttcaaggggaaagtgaggcagaggttctgaaaagggtctctgaaaaacagtgtacatgtagccataggcacatgtgagcagaatacttaagcctggccgccgaaatgccgcctgacacacacacgtgccacacctgcgctgattcattgtgtgtgctgcacacccacaaggtgtgtgggtgcatggctgagcttcgggccgggaaggcagcctgggaatctgaggctggagacaggggtttagaggtgggggccatctctgcgaagcacatatggagggaaagacaagagagcccctctccctagcttctccatgattagcatcctatctgcatcctgaccccacctccttgctcattggcagcccctactagtctctgtgctaactccatgttcccaccaactccaggctgcttcccaacttacctcttgggttacagtaacttgtacaatagcgaactattggaaaaacgttcagccgggagttaacaagccaaagaacctgtatacacaaaggtggatggacgattcgctctagacgtgagatctattggacaagtctatgactcataagacagacggccggacggacacaggaaatcaacagagaggcatgtcccacccctacagcagacac

SEQ ID NO: 487707 - DNA, 105 bp, Homo sapiens
tgcttagaggatcctcgacatctctcctctcgacattctctcctctccgacatctctctctctccgacatcctctccctctccctccctctccctccctctccct

SEQ ID NO: 487708 - DNA, 428 bp, Homo sapiens
  misc_feature (16)..(16): n is a, c, g, or t
aacctaagtaacaganaagagagatgatcttcaaacataatgagtttaatggggagtgcagagtggatctgcaaatccaagatatgcaggctaaggagactacagttgtatccaaggaggttgaggcaaggagatgcttttaaaggcaaaagagaaaagtacacataatttggtttgaaacagagaacattgtttacagaggcttatcacagaagatgacactaattttttaatagagacagtgtgtcaggcaagtattcttatggatctttctagctgtccttgtgactcacctagcaagctacagtttggaatccttggcaaagactcttgctataggcacacgtgtaagagccctttagagagtctttgtaatagttcttatcataggcatatgtgagtgagggcccttcattcttaacttccca

SEQ ID NO: 487709 - DNA, 502 bp, Homo sapiens
ggcggcctgcagtcccgggcccgcgccccggccgcccgcgtgccgccatggagcccggcccgacggcccggcgcctccggccccgcgccatccgcgagggctggttccgcagactgcagctgtggcccggcaggcctgtcgctgagtgtgcatgtccaccaccgggctcgcgctaccaggacatcctcgtgcttccggagataagacctatggcaacgtgctggtgttggacggtgtcatccagtgcacggagagagacgagattctcaataccagtgagatgatcgccaaccgtggcgtctctgcacgcgcagcccaaacccggcgaaaagtgtgctgaatcatcgagggccggagaatggacgcgtgtcctgcgcggacggtggtgaaggcgacccctccgtggagtccgaggtacagctgtgagatcgagcaaggatgtcactccaagatctcagggaagtttcctgtccacgggatggccattggcataactctagga

SEQ ID NO: 487710 - DNA, 857 bp, Homo sapiens
  misc_feature (168)..(168): n is a, c, g, or t
gagcatcttgtgtgtcatcgtatgatgttagcgtcgtgtaacgcggtgtgtgatgctctgttgtgtattttgtagtcaccgtgtgtcggtgcgtgtggcgccttgtgtgtttatgcgtcgtctgcccggttgtggatctgcacgtgtccgaaaacccgctcgggggangcccgtcccgcctgtggggttacccccgcgccaagtgttgttatgccctcctcttggggcttgttttcccaaccccaagtgtctcgggccccgcgtttctttgctgggggtaagcgcccgcccaaactttcggtttgccacccctttctgtttccctgcccggtccccgaacaaaattccccggggttttcgccgcttccccccgggggtttctttctcacacaaaaccgaagtgggggccccccgatttcggggttctggaacaaggaccgcccgcgggttgtttttaagtaaatggcgcgccccccaccacacacctggggaaattcccccccttgtatcaccgcgcccacgctttgtgtatccggtacctccggcaggtagccccctccccgcccccagagaccctttgccgaggagaccgggggtagattttcctaacaatcctccggaggttttctcacgcgcgcttcctctttgaggcacccgccccttctttgattgggcgggaaagaccccctggtcgacggtggtgcgccgcggcccacaagtgccgctttgtagacactgtgggcgacttcgcgcccatgtaccccgcgcctcctgtgggttttcagaaggggccccccccccctcggggcccaaatttcccctgcccccggaaaattaaaaaaaattttgtaaaccca

SEQ ID NO: 487711 - DNA, 499 bp, Homo sapiens
ctacattaactagtaagacataaagatttgaaactggaactatattatactttttaaccaatctgtgtggcttcactcatgaaatgtacttcagttaatatgagactgggggttaagtctgtactaatatgcaaaattgcttcgtatatttggtgatcttgtaatgtaagtgaattgattcttatatcactgatactattaatcatgcaatgtacaattcaaaatcatgcaatgttgcactttacaattggatttgaagaactcgactttatgtgatcatggtattggaatacatgtggggcggttaacttagtccttaattctgttactttcggtatataccgacccggcttcacgaaataagtggttttaacaattaataatgtattaatggaggctccctattggggttccgtgttaatgctttgccggacctagaccccaacaaaaggtggctcgggaggttagttccccttgtgaggcgttaatccagcttccg

SEQ ID NO: 487712 - DNA, 266 bp, Homo sapiens
  misc_feature (251)..(251): n is a, c, g, or t
  misc_feature (261)..(261): n is a, c, g, or t
cagtcggcaagatgggtcaccagcagctgtactggagccacccgcgaaaattcggccagggttctcgctcttgtcgtgtctgttcaaaccggcacgtctgatccggaaatatggcctcaatatgtgccgccagtgtttccgtcagtacgcgaaggatatcggtttcattaagttggactaaatgctcttccttcagaggattatccggggcatctactcaatgaaaaccatgataattctttgtatataantaaacattgnttttc

SEQ ID NO: 487713 - DNA, 634 bp, Homo sapiens
ggcttggaaaacctctgactgcatttgcggaacaggtgcggccagttttccacccgccggtgccgtctcgttcgttcacgggcctgcccatgaagaattgtagtagtgcccctgcggtacccagacgtgaatcctgtggtggaaagcgagctcaacccggcgccatttcttcggacgttttccccgacggcgccgtatgccgccatgtgattcatactttgctagtgggattattcactccggccttatttgggcacccggtggagcaccccgcagtgatttcccacgtctgaacccctttgtcggtcgtgcccttctgacgccgtccccaggtggtaggagggccccgcacacccaccctggggggagaccccacccggctaggggagccatttttcacaggcctcggtttcgcacaatgacctaccgttttttttaagcgtctttattgctggccacgcaggataggcatgtagcttctctcctgcttgccggccaatgtggacgcgagaatttccccgtctgcatttgtagtacgacgaaggcccccccgggggaacacccaccactctttatctcgagaatggtgttccaagccttctcaaaaaaccacctttttttcccccacaaaaac

SEQ ID NO: 487714 - DNA, 228 bp, Homo sapiens
ataaggttgtcctcatgctgtagtcctcgccctgaaacaatacatcctgagtaatgtccatagcatggctcggatgctactacatcagtaccgaaagaagtcatacctttttcctgccaaagttctcctggttcctcttacgagatgagtttccgcttactgtataatcacgaaatgggattacattttaaggaattctcagcatctttctgattatattaattctca

SEQ ID NO: 487715 - DNA, 125 bp, Homo sapiens
agctctctctgtagggggtgactgatcactgtcgcttgtttcggggaacctcactgaccgagggggccccctgtgctatcagaagatcttgtggataccatgctgtgagccttgctggctccaga

SEQ ID NO: 487716 - DNA, 416 bp, Homo sapiens
ttccgttgtctattataaaaatgctgtatggtcacttgagtgtttacatgggatgttgctttctaacttgcattatttagcctttgatgatccaaggaggaaagattctgtataagaaacacttatacacatatatataagtgtttatatggatggtatcttttgggtagacacccaggaatgaaattgctgggtcatatgtaattttttttttctttttttggagatggagtctggctctgtcacccaggctggagtgcagaggcgtgacctgggctcacggcgacctcggcctcccgggtttaagcgattcttctgctttagcctcccaagtagctggaaatacaggtgcccaccaccacacccaggtaattttggtatttttagtagagacaaagggaaacaccggggatcct

SEQ ID NO: 487717 - DNA, 396 bp, Homo sapiens
gctgctgaacaatatggcgcacatctggatctttggtccagacaacgtatcttccactagagacataaagagctttgaaacttcttgagcatcctgctgctggtccagtgtccaggcccaaggctaaaacaaatcctgatggatcaaggtatcgcctataactgtatagcaccaaggcaaacaagtactggagatgctcacaaatggtccgaggctcataatctttttcttctgggatgccgtctcccagcatgtagtcactacaagtgcttggacataagtagagtgcctgccgaacgctccaagtcgcgaaaccacactagaacgaaatgtgttgacgtaacaagtgaatccacgcgctagccaggcccacacctgagttctctcacctccact

SEQ ID NO: 487718 - DNA, 335 bp, Homo sapiens
  misc_feature (15)..(15): n is a, c, g, or t
  misc_feature (26)..(26): n is a, c, g, or t
  misc_feature (71)..(71): n is a, c, g, or t
  misc_feature (73)..(73): n is a, c, g, or t
  misc_feature (104)..(104): n is a, c, g, or t
  misc_feature (107)..(107): n is a, c, g, or t
  misc_feature (135)..(135): n is a, c, g, or t
  misc_feature (161)..(161): n is a, c, g, or t
  misc_feature (172)..(172): n is a, c, g, or t
  misc_feature (198)..(198): n is a, c, g, or t
  misc_feature (202)..(202): n is a, c, g, or t
  misc_feature (210)..(210): n is a, c, g, or t
  misc_feature (237)..(237): n is a, c, g, or t
  misc_feature (251)..(252): n is a, c, g, or t
  misc_feature (259)..(259): n is a, c, g, or t
  misc_feature (274)..(274): n is a, c, g, or t
  misc_feature (280)..(281): n is a, c, g, or t
  misc_feature (302)..(302): n is a, c, g, or t
  misc_feature (308)..(308): n is a, c, g, or t
  misc_feature (322)..(322): n is a, c, g, or t
  misc_feature (326)..(326): n is a, c, g, or t
  misc_feature (334)..(334): n is a, c, g, or t
gacagttccatcttngtccataactngctctgtgatccagtgtgcatcactcaaacagactatctcttttntnctacaaaacagacagctgcctctcagataangtngggggcataggaggaatgggaagcccgntaagagaacagaagtcaaaaacagtngggttctagangggaggaggtgtgcgtgcacatgtangttncgtttccngtcttggaatctcagcaggtcagtcanattgcagtgtgtcnnttcaccnggtccctcttttaangatttnncttccctctttccaactcccnggtccnggatcctcaacagngtcngggttagnt

SEQ ID NO: 487719 - DNA, 1069 bp, Homo sapiens
ccgtctctactaaaagtacaaaaaattagccgggtgtggtggtgggtgtctgtggtcccagctactcgggaggctgaggcaggagaatggcatgaacccgggaggtggaggttgcagtgagccgagatcgcgccactgcactccagcctgggcgacagcgagactccgtctcgaaataaaaaaaaaaagttctggctataatgtaacttgccccttggaccatctaaaaccaaggggatacaaggttctgatcgcacgttggtgcctataggatcaacctagctcttatatctatgacatatgccggttatatactgctcagctatatcactacagtggagcaccttcacagcaatctcaacaacaggactcggtaacactcagcatagcaattctaatctgcccaaaactgcatgttccacaccatactcgtgtatcttcctgcttgaccctgaagcagcacccgacagcatattcccccgccaggcaaatgaacacactttagccactgttagatgccttatccctaacaagattccagcataggtcggcacagtggtctctccaccactcgcgactcacttacgtgttgttgcctcctcggaaccaccgggcacaactcaaatggtcgtacctcgcggtcaagggtctctccccccagctgacgcgtttcctctcggtgtccggctgctttctgggcgcgcggggtcttggctctggctggcttcgcgggagggagtgggagggggggggactgcggggtcggttagcgtacctttgtgctcgctttggggcgttccagcgaggatgtcgctggcgccgaccgagctacggccgtggggcagcggggatgtgtcgatcgtctgggtgggctgtcgttttctctggtgaggttgactgcccgggtcgcggcctatgacgatgcgatgtcgtctgtgtgttcccctcggcggctgtcgcgcgtgctgggagtctgacgcgcggcgagctgggtgccctgcagaggagcgggatgcggtcgggcgcgtgttccgagtggtgacgatcggtcgtgatgtcgcttggtttg

SEQ ID NO: 487720 - DNA, 1150 bp, Homo sapiens
cgcggcggtgaaggggaggcggtgggcgtcttgtgagaacagagctgagatggagaagctgatggccgatggctgtgaagtctgatgccccatccagacccctgaaccagacccctcagcatgtgctcctggtgactgcctagtgaaagaaaggatggcctagcatgttctgacgaagtgatgtgcagttgatgtgctggacgactgctatgtggggccctgaagacggctatgtcctgacctgtttaaagtgcaaatctgcttccccagtgtggccccgctcccgtcacgatccccatgagccacatggaggcagcatctcccttattgtgtagatctatttcttccccgcagatgcgcaaatatgaaggcctgagacttgacgtttggagcagtcccccttttgggactttgagttgctcaatatgcttttctatgttctcagcaattaagcgggaccatacgaacccataagcccgtaacagagtcggagttaggggaaaagggattgggtttacctaaagcagtcctttcgttgtatgcaagagtcaaagcatcaggcgctttgctgtgatttcccctggacggacagtactacttgacgcgtacttacttcggctaagtgacaacctaaagagcgacgacgcaatggtacagctttgttacttactaggtgtggcccacgtagtattacactggcgaagcgtcccttggggcttacccgttaagacagacaaattgcaaggtaggtgcatagcggcacgtttcagcaagcacgataattaacctcttcctcactcagatacctcacggaggagaacgacaattaacagttgccccaatctggtttgagctcggcggctctatctaacatacaccattccagcccgacgcaccccatgcggacactaaacgcctcgaccactcacaccttgatccgcgcacgagaaaaacccaccagcccacccatcccaaacgcgacggcacgacataaacaccctatgctatcccaacacaaaccctttaccgtggcgatcgatctgccatgtgcacaccacgcgtgtccccaccatacaatccccccgtcacacccacccccgtgatctggatctacttaccccgtacgcgctcaatcctcctcacataatca

SEQ ID NO: 487721 - DNA, 305 bp, Homo sapiens
aggccacgggggacgcccggcggcaacagctcctaaaaaggcagcccctgctggaagcattcgaccccctgcgccggggcctgactgcccccggcatcaacatcaaggacaaaaacagttccacatccccgtgggaacttttggatcaaaggacaaaaaacccaaaatcaacgggcttaggatggagcccaaccatgaacctgctcccgacaaaacgcccccatgcttttcaggggcaaggctttatgttaaaacttcccgtcgggggtggtaggtcagcattaaagtaaggccacccccagtga

SEQ ID NO: 487722 - DNA, 294 bp, Homo sapiens
gctcgacccctatcttcagcctcttcaaacaaaacggttatcggccaagaattttgtatccagcgaaactaagcatcatatatgaaagaaagatacagcctttttcagacaaacaaatgctgagataattcaccattaccaagccaccactacaagaactgctaaaaggagctctaaatcttgaagcaaatcctggaaacacatcaaaacagaacttctttaaagcataaatcacacaggacctatgaaacaaaaatacaagttaaaaagccaaaaccaaaaaaaaagtcgacg

SEQ ID NO: 487723 - DNA, 84 bp, Homo sapiens
gctggacccaccgtggtgggcatgcaggctgccggcaggcttaggtggactctgctggcagcaaataaagagatgacggcaaac

SEQ ID NO: 487724 - DNA, 588 bp, Homo sapiens
acaggcggctcacccgggagcagagaagtgactgctggctaggggagtgtgccaggatatagcagggttctgggagctggggccttgcgaaccaccaactgccaagtcaaaggcctagctcccccacaccccctttctctttcttgctcaacacctgataggagcctggtctggagacccaactgaccacaggaatagtccacttgaccatcaagggcccagctgccctgccagagaagattccacagcgaccacttgtcctctccaggttgtaacaacaacccaaagttggtgttactactaagatgcaaatactcaacattgtctaaaagatcggctcggtcttgaatttctgttagagcaacccacccaggggacactctcgcaccctcgtgttagcctctggggccgagctcagggctggcaacacagatgttcccctggggcaacggccctgtcctctgcgacaagcccagtgccatgtgctgggtgacccgttaaacagctaactctgtcctcccaccatcaacggggatccgtgcacgtcatcgattactaggacatgcagaaattcttgtcttttttagt

SEQ ID NO: 487725 - DNA, 127 bp, Homo sapiens
atcctcctcctcctgagcatggattaccatgtgcaacaacacactatcatgtatgggtaaaactaacctgtctcactgatggtctaaccctgcacactgttcccgtcggaggaggaggaattctgct

SEQ ID NO: 487726 - DNA, 111 bp, Homo sapiens
gccaacatcagcgcggaaaacatcaagaacaattttgtgctcatatatgagctgctggatgagaatctagactgtggctacccacagaattccgagactgcctcgccaaat

SEQ ID NO: 487727 - DNA, 339 bp, Homo sapiens
ctcatacccaggagtccagactccagaccctactacctcagacggaggagtttatactccagctccttctcccttagactcaggagtccagactacagccccttcttcctgagacctaggagtccagacccgctgcctctcctgccacagactccttccacagagtccaagcctccagcccccttgtctctgagactctggatgttgggccccactatcccctcctttctcagacccaagagtcacgaccccccatgccatcatttacccacagccagggcctggcaaatcctccacattatctcaaggaaagagaatgtgggtggaacgattaggccg

SEQ ID NO: 487728 - DNA, 567 bp, Homo sapiens
agcatacctgtagtagggaataacaatattaaaatacatactaaagaagcaccattgtaatctaaggtagatatctactagaacaaacagttcaaacaaagtagacagggaagagaaatggctatcagtgatgtatggctcaacaggtcaaacttcctgccttctaaaatggctctacttgtaagattctgaagattccattcagcaaatcacttgtattataaagggtaataatgtgagaaaatgcaatatgttgatttgcttgattagaagaccacttcactagaaataattatatcaaaacataatgttgtcctccttaatgtaggtgcaagaaaactcaaaataaacaaaaaaaatctaggaatacttgtgtaaagtaaaaccagtattagatttcactctatgtacatttcacccattatctaggaccaattacacatataggcactgaggaataaattcagagcaacaactcctaggggagaactaaattgtctggttggagatcaaaaagaactaaagcatctctgacggcaaaaagcccccaacacagtgaccaaggac

SEQ ID NO: 487729 - DNA, 302 bp, Homo sapiens
taataccccacaagcttttttaactttcattaaatattcccgataccaaatgagattctctacttatcacccccaatattttaactcctgaaccatgtatccaaaatgatgccactgaattctacctcaatcactcttcttgcagtcaatccaacccatggtatcaaccaagccagtatgaattatgcaataggtttcaagtcttttattcctttcagaaaacccttctcccagatactactagacacatgattttgtagaaaaatagactcattctcttattcaaactaatcacccatgtc

SEQ ID NO: 487730 - DNA, 988 bp, Homo sapiens
  misc_feature (552)..(552): n is a, c, g, or t
aattgaatcaacaaaacaccacagcctaattatagcatcatccctctactattttttaaccaaatcaacaaaactatttagctgttccccaagcttttcctccgacccctaaaaaccctctaatataatactgatcctaccctcacaatcatggaagccaagccacttatccagtgaaccactatcacgaaaaaaactctacctctctatactaatctccctacaaatctccttaattataacattcaccagcacagaaataatccatattttatatcttcttgaaaacacattattcccacctgggtattatacgatgagggaaacagcagaaagtctgaaagcagggaaaaatttatataacctagagggtggcctctgtccccacatgcacctcggcgcacatctacacttcacccaaaaacttacggctctccaacaaatttcaatcaatcacatctccaacgtggcaacgaaagatgacaaattcccaacacacaaacgaccacaaaccaacgcacaacaccacaccaacaacaaaaccgggggggngggcccaaaaaaaaaacccccgggggggcacacccttggcagaacaccgccttctctgacaacacgggcaccaaccgggacgacaaataaacacaacagggggggcgcccacccacacaccgtcgagctcgaaacgagaacaccggagtatcttggcatagaacccaacttgggcgggagaccacagcggcagacccaccccacgacaaactaccgagtccgggcactaacaacttcaggcacgggtaacccacgcaaccctcgtcgtcaccactgggtaccactcgactctaacaactaagccccgcagtcacacactctaaacacaagtcgaacacacacacctagcacgcaaccacaagacaccatacatacaccaagcacaacgatccacacaacgcagaagacatccataaacaatgagacataagatcac

SEQ ID NO: 487731 - DNA, 860 bp, Homo sapiens
tagcatcaccagtattagaggcaacgcctggcccagggacacatgtctgacggccgcgcgtcaccctaaccgtgtcaaaggtaggctgtaattcacttgtccctttaattagggacctgtgtgaatggctccacgagggttctgctgtctctatactttctaaccgaggtgaaattgagcctgcccgtgaagaggcgggcatggacgacagccatgaggaggaagaccgctatggagctttgacttggattaatgcgactacagtgatactaacgagatcgccgaatagtggtgctgagtaacctatcctaataacttgcattaagaaaatttcggattggggctgagcatcgtgagcggagcaccaaactgcgagcagtacatgctaagacttcaccaggttaaaggagaattattgtacgtcaagttgatcgcaataactgtgagacgaagggtaacgaagttggcctagggataagagagcaatgcgtatgcgtagagtcctatatcaaacgatagggttagagacgtcgatgtagagatcaggacatgctagtggggcaggcgtattaatggtcgttttgtcaacgattaaggtgtacgtgatctgagtgcagacggcgtactccaggtcggttcctatgtaggtgcgcattcgtccctgtcgagggcacgagacatcggctattcacgggcgcttccccgtggaggtgtctccaggagagtgtacgcaaccaccgggacggtcggaagcgggcggcgagcaactgggcggccgccgaaatcaaccgagggggggccaggaagagcacgcgcgaccggagcggggtccaacggggggggaacaggcaggcagcggc

SEQ ID NO: 487732 - DNA, 324 bp, Homo sapiens
ttttttttttaaagggggccgggcccccttttaaaaggggaacccccatttggggggggaaggtttttccccccaccggggaaaacttttgcccccccctttgttcttttgggggttaggggggaaaaaacttattttgggcctttgccttttaaaatttgggccccccgccccttgggggggggtttaaaaattttttttaaaaaaggggtcccttttcccgcccccccccgggaaaaaaaaagaggggggccccttttccccgttttttttttttttttgggggttgggttttttttttttaaatgggttaaaaaagggtta

SEQ ID NO: 487733 - DNA, 99 bp, Homo sapiens
cggcacgaggccccaccaactgcaaaatctgttcctggcattaagctccttcttcctttgcaattcggtggggtctcaataaaagttattttcccctga

SEQ ID NO: 487734 - DNA, 119 bp, Homo sapiens
catcagtgtcatgttcaactgcgaaatagagtgttgctttgataatggaaaatgtattcgttttaaaattccgttgttgagaataacaatatgtttaaaaatattattgaacaaatttt

SEQ ID NO: 487735 - DNA, 222 bp, Homo sapiens
ctcttcttttcttcatacatgaaacatagaaaagggattccaaacaatgatggtattttaaaatatactacatttcaaattagtacagtgattatggaaaacagtatggaggtccctcaaaaaactaaaactagatctacaatatgatccaacaatcccactgctgggtatatatcctaaagaaaggatatccatatactgaagagatatctgtattccctg

SEQ ID NO: 487736 - DNA, 743 bp, Homo sapiens
agaacttcactccgcgccacaggccccctttccgcaggctgcgctgggggttcatggttggcgggtcggaagtgaaatgttcgtttgtttcgattttgaaatagtggaagcctccggccctatggttttctggggttggagtggagtgtgtgtgctgggtgtgatggcggagaacggtcaccgcatccaggcgagggcctttgggtctcaataggtggggaaactctctgccaaataggaggcctctcggagcgctcaggtttccccatctgctagactgggctctgagcttcttctggcatgagagggctgtgtgacgacgtaagagaggtaggcagcatagcccgcggtgccgggtaggacacgtcagccaatgtcatctgtagccatcgctgcgcatcaccagaagaacccccatctcaatcgaagcgttgctagtgagggcttgcttggagtacaccactacgagtaggccgatgcagcggcttacaggagtcacccttcgtgcggggggacaaacgtggatcgcctagagccctaatgggcgcaattgcgccgcgacggagggaccattctcgtgtcgaaggtgcggggactttcaacagggtcccccggtctaacaaaagggaagtccctgaaaaatgcttacttgccgggtcccaagggcgaatgggttcatttaaccccaagtttgatggccggccacgaaaatcttcctggaagatctcttgatgtggaaagag

SEQ ID NO: 487737 - DNA, 853 bp, Homo sapiens
ggagagggaggctggtgctggcggtggcgctgcgggagacccggtccagacgcctggcgtgcctgcctggcacacaaggctggctttctaggctccctcccccgagcgcacatgcctgcctccttccctgacggacgcctgcagtggcagcgcttgctctgccctaccgtgacgcgctcctgggagacgctctgcgtggtcctggacacctgggtcctgctggcgtggggactgacatgactggaggcgaacgccatacggtagccggtcctgcgagccatcgattcgaggtgacgccaagtccatcgtccacactggactggtcacaccatccatttctcacgggagaccatttcgccacacggggttacccttggagctgagaacgacgcgggatacgatacgaccatcctttgcccgttgacctgatcgtgctagaaacctcagatttggtgcggatatggcgggcccaggtcgacccacatgcgtgacggttgggacaggcaaacattgtccaggtaccaagatgtgccattgcagaaccccgggaaggtccacggggcccacgcatgcggcgtcccaattaagacagtcgtaagtctggttacacagacaaaggtcccatcgcgttagagcgttggacagtggggtcgcgttcaacattcgagcgttgaaattcgttgctaacgcgcaccgagcaagacggtccttcgtttacaccttgcacggttccgtatccatcgcaatatgaccggggaacagatagtggaccatttgccctatgaccgaccaggtaggcagatgcatgggcttgcaagtggaacgtacgccatacattaggagggccagtgtc

SEQ ID NO: 487738 - DNA, 278 bp, Homo sapiens
  misc_feature (68)..(68): n is a, c, g, or t
  misc_feature (140)..(140): n is a, c, g, or t
  misc_feature (176)..(176): n is a, c, g, or t
  misc_feature (194)..(194): n is a, c, g, or t
agacgtccattcttgcatagacgtccattcttgcatagacgtcccttcttgcatagacgtccattctngcatagacgtccattcttgcatagacgtccattcttgcatagacgtccattcttgcatagacgtccattctngcatagacgtccattcttgcatagacgtccattctngcatagacgtccattctngcatagacgtccattctggcatagcacgtccatctggccatcacaaggcacagcagtgcagcaggacgagagcaaagcatgcgc

SEQ ID NO: 487739 - DNA, 156 bp, Homo sapiens
ttctagaggagtcccccagatggttgttcatacctggcactgtggtatcataccatgcacgtgtagtcatacctgcactgttgtcatacctgcactgttgttcatacttgcactgttgttcatacctggtcgctgtatcgggggcggggagcgggt

SEQ ID NO: 487740 - DNA, 438 bp, Homo sapiens
  misc_feature (68)..(68): n is a, c, g, or t
  misc_feature (140)..(140): n is a, c, g, or t
agacgtccattcttgcatagacgtccattcttgcatagacgtcccttcttgcatagacgtccattctngcatagacgtccattcttgcatagacgtccattcttgcatagacgtccattcttgcatagacgtccattctngcatagacgtccattcttgcatctcactttgctacactgccactctgctgattgttttgttttgaacaatccaggccatttttttgtccaggcttgtggtagcttataaaatataattccttcccacacttactgcgttgctaatctctttgctttcagttccatgtattaatcataacccaagttctttcctggtcatagttctcaatcttgaaatttgctttctcacccactcctctgcatttctctccaatgtaaagctgaagggaggaaaaaaggggatgcaagaatggaggga

SEQ ID NO: 487741 - DNA, 239 bp, Homo sapiens
  misc_feature (38)..(38): n is a, c, g, or t
gcaaaatacctcggtaaagcaacatcacaataaagcangaagcgcattgttttagtttcccagtgcatctaagtcatgtttactgcatattgcagtccactaaatgtgcaatagcattatgtctaacaaatatacaaaccataatttaaaaatatttactgttcaaaatgctgacacagaaacgcaaagtgagcacatgctgttggaaaatggtgccaaatagacttgcctgatggcag

SEQ ID NO: 487742 - DNA, 563 bp, Homo sapiens
  misc_feature (56)..(56): n is a, c, g, or t
  misc_feature (149)..(149): n is a, c, g, or t
  misc_feature (169)..(169): n is a, c, g, or t
  misc_feature (207)..(207): n is a, c, g, or t
agggcttcccggccttggacggtgaaccccaggcctccctcaaccttgcccctggnggacaggatttaccccggcaatttgggaaaaggccaaggtagggattcctacattggggaaacctaaaccccccttcttgggggcctgatacncattccccatttgccccagngctgacaacccaatctccccaatactttcaggcctgcnctacaaaagtacctgtcttgtagaaattttacagtctgccattttgggtgcccaccccaatttttaccttttagtaagttggcatgaaattttggtaaaatctgaaaatcacatttcagaataaaacaattgggcaaaactacctaggctttactcttgagtgtctccttttgatagggattgtttctggaccagtttgtctaagtcctggctcttattggttcatatgaaataatgttaacttcacttctttgtatattatgtataaattagaaaatgaaaaatgtatgaataacattgtatgaaataaacctggtcttgtgtttttctctagataaaatacccctctgtacctc

SEQ ID NO: 487743 - DNA, 149 bp, Homo sapiens
tctgatcgtgccagagttcctcagggttggctcaatgcacgctcgtggctgtcagtatcagacgagggcagcttctgcattttctcaattccaaccactcctctccactcacctacccagtatctctactgggtgtcttccagtcatcc

SEQ ID NO: 487744 - DNA, 337 bp, Homo sapiens
  misc_feature (12)..(12): n is a, c, g, or t
agataccgtagnatggttgcaatgataggtacacacacggggagtgaagcagtggcttggagcatatggtaaacgattgttggcttgtcccagccatgggagcatctcttgccactgtggcagtagtggcatgaagccgccaccagggggccacgcaccagtgcatgtggttgcgttctaaactttttggacaataaaatctgaatttcacatacttttcttatgtcataactttttcctctttgacatcttttcactatttaaaaatgtaaaaatcattcttaacatttgggctgtgcaaaaacagctggtgggcccaattttggcctgtatttca

SEQ ID NO: 487745 - DNA, 357 bp, Homo sapiens
  misc_feature (68)..(68): n is a, c, g, or t
  misc_feature (140)..(140): n is a, c, g, or t
agacgtccattcttgcatagacgtccattcttgcatagacgtcccttcttgcatagacgtccattctngcatagacgtccattcttgcatagacgtccattcttgcatagacgtccattcttgcatagacgtccattctngcatagacgtccattcttgcatgctttatctagaacggttctgaagtgggttccctctgctcttaagggcttatacagtgcatgggatggtgtccttggccaacgttccttaagttgggcttttaaatcattatgggtggcttcttcttctctttttctcttcttatctgggctctttttcttcttactcggttcccttatgcaagaagggaggtct

SEQ ID NO: 487746 - DNA, 247 bp, Homo sapiens
  misc_feature (68)..(68): n is a, c, g, or t
  misc_feature (140)..(140): n is a, c, g, or t
agacgtccattcttgcatagacgtccattcttgcatagacgtcccttcttgcatagacgtccattctngcatagacgtccattcttgcatagacgtccattcttgcatagacgtccattcttgcatagacgtccattctngcatagacgtccattcttgcatgatctgaaccagggacccacagcacttgatccccacgcatccggtgccagcgcacgagggcatcctgtatgcgccacccgtgaag

SEQ ID NO: 487747 - DNA, 214 bp, Homo sapiens
  misc_feature (68)..(68): n is a, c, g, or t
  misc_feature (140)..(140): n is a, c, g, or t
agacgtccattcttgcatagacgtccattcttgcatagacgtcccttcttgcatagacgtccattctngcatagacgtccattcttgcatagacgtccattcttgcatagacgtccattcttgcatagacgtccattctngcatagacgtccattcttgcatagacacactctgggaagcagcagcagcttcccacagacagggccacatgaag

SEQ ID NO: 487748 - DNA, 427 bp, Homo sapiens
  misc_feature (318)..(318): n is a, c, g, or t
  misc_feature (422)..(422): n is a, c, g, or t
agacagagtttcgctcttgttgcccgggctgtagtacaatggtgcgatctcggctcactgcaacctccacctcccaggttcaagcaattctcctgcctcagcctcctgagtagctaagattataggcatgcaccaccacacccagctaattttgtatttttagtagagacgcgtttctctacgttggtcaggctggtctcaaactccagatctctcaggtgatctgcctgcctcagcatcccaaagtcctgggattataggtgtgaaccaccacacctgggccagaagacaatttttctatggatggtgggaaggggngacagggagccataggggaggatggttttccgggctggaaactggattccacctcagattcagggcatttagattcttcattaagggaggcacgcaacttaggntcctt

SEQ ID NO: 487749 - DNA, 626 bp, Homo sapiens
cctccggctggctccgcccggggccgctgaacgcagggtgatgcgctggtggtgctggccgggggggtccctgccggggcgcctgggggtgctggtgggaagcctggcccaagtgaagggggcggcatgctggctgtgatgtagccaatgtggctcctggtgaggcaccgttgtggcttcctgctgtgtggtgtggggctgtgctgtgctgtgatgtgtgggcatgcaacgcctgtgctgcgacgcccgaagggcaggaaaaaaaatgaaaaaaagaatgaaggagagagagaagaaaaagcagaaacacacgcacgacccaccaacgaggagagaagagaaaacgaaaacgagaaagaacgagagaggaggagcaacacaaagaagcgagaaaagcaagcaacgaaaaaacgaaagaagaaaagaaaaaagaaaagaaaaaaaaacagaacaagaaagaccggcccaggccaagcaaggcagaaagaaagagagagagagagacgaaagaaaaagcagcaaaaggagaacggacgcagcaagagagcaaacaaaaaaagaaagaacaacaaagaaagccagcgaagacagaaaaaagagggagagagaaagaaaaacaaaaaaaa

SEQ ID NO: 487750 - DNA, 329 bp, Homo sapiens
aaccaaaaaccaagagaggaaccccctcttcattctgctaaagactacactttgtagactgggaatggtagctcacccctataatcacagctccttgggaggctgaggtgggaggaccgcttgagcccaggagttcaagaccaacagagagagaccctatctctccaaaaaccaaaaaaattagcaaaacatggtggcacattcccatagtcccagcaacccaggagggtgaggtgggaggatttgagcctaggaggctgagacctgcagtgagctgtgatcatgctgctgtactccagtgtgggtaacccagcaaggcccttgtttta

SEQ ID NO: 487751 - DNA, 326 bp, Homo sapiens
  misc_feature (3)..(3): n is a, c, g, or t
aangatgagatagatatgttaaaaccaaatagaacctctgaaattgaaaaattcactaaagaaatttcaaaagtagagttggaagctttaacaatagaccagaccaaccagaagaaagaattttagagctttaagaccagtcttttgaattaacttagttaaggcaaacaaagtctctcataaatatagagttatgtaaagtaacaaaacctatgacttactggcattcctgagaaagaaaagcaaaagtaagcaacttgaaaaacatatttgaggaaataattcagtaaaatttccctgctctagctagaacaggttgacatcca

SEQ ID NO: 487752 - DNA, 153 bp, Homo sapiens
cttgaggatccgcctgctgctggtgggatattgagactctcagtgaatcttgttctttggtctcagcccgacagggctcgtcgtgcgtcatggctatgtggtatggaagagacgctggcccagagcattacgctcagcgtgcttagtctcaat

SEQ ID NO: 487753 - DNA, 206 bp, Homo sapiens
  misc_feature (67)..(67): n is a, c, g, or t
  misc_feature (96)..(96): n is a, c, g, or t
  misc_feature (128)..(128): n is a, c, g, or t
gcaccggctcctgctcctgataggccaaggcaccttccttacctaagagctgactttcttgaagagnggcacaggaggagccggcaacctggctgngtaggcacccaggagaaaatctgcagctcagnatcagaagctccaccagcacggctgttgcagagatggggaaactggctgagagggaagggggttgccaaatcaccagc

SEQ ID NO: 487754 - DNA, 510 bp, Homo sapiens
gctaggaacacaagtacaaataaaccaaacccagaaccgatgagtggaagctgccggtgaaccgagtctgcaacacctctcatctttgtacagaccaacagggtggccactaccccaaagtttcacgtatatcatgctcggggtctccagagcgaggtcttattggccagaaagtgactgatagtcataatgtaaggtattcgtgaggaaatatgatcttactctcagagtctcaacaataccctgggtgataacaacgtggctctcaagggaacaagatagctcccaagcaactccagtgcccaggaaagatggtgaagagatcttagcagacgatctatcagttactggggcagaacaatcattgtgactagtcatcttcatacgatagcttagagcagcagactgagaatttatagtgtagcgaagggcagtctaatgcagtagttacttggatccactcttgctgttgagtgaccctgggcaatcaagcttggggatactctagag

SEQ ID NO: 487755 - DNA, 106 bp, Homo sapiens
tactactactaaattcgcggccggtcgactttatgttgtttttattttagtttttttacacaaccgctttttattatcgagtttcagaaacctttcacaagatggt

SEQ ID NO: 487756 - DNA, 253 bp, Homo sapiens
ctagagtatccccggtctatcttgtgcatcgagaaggcataatggagtacgaggaggaggagcgcaagtaagcggctcggcccccggcgggcctgagaccccgttcgaggtcttacgtagtccctccctgaggaactccagaagtgcttcgatgtgaaggacgtgcagatgctgcaggacgccatacagcaatgatggaccccaccgacgcaaagtaccactatgcaggcgctgtattttgactctggccctt

SEQ ID NO: 487757 - DNA, 180 bp, Homo sapiens
ccgacagtccaaggactgaccctggagctggcgggctcccctcggtccccgggtgatcggctgtgcagtgtcgtgcatggcgctgcgtcacccggctcgccatctatgccgcctttgggaggtcataaaatctgaacgctccatcatctggctgaacttctgcctgtcggctagtcgggg

SEQ ID NO: 487758 - DNA, 177 bp, Homo sapiens
atctagaggatcgctgctgctcctcttcagttagcgattctctgcgtcgctccaagtagctgggattacaggaactcttttttagtatctacacctgtgaggactaaagacatcaaaccggtacaggccagaatcccaggctcagtctgtccactcatcaaagaccaggttcaaggg

SEQ ID NO: 487759 - DNA, 492 bp, Homo sapiens
  misc_feature (18)..(18): n is a, c, g, or t
  misc_feature (75)..(75): n is a, c, g, or t
  misc_feature (107)..(107): n is a, c, g, or t
  misc_feature (126)..(126): n is a, c, g, or t
  misc_feature (130)..(130): n is a, c, g, or t
  misc_feature (143)..(143): n is a, c, g, or t
  misc_feature (156)..(156): n is a, c, g, or t
  misc_feature (212)..(212): n is a, c, g, or t
  misc_feature (214)..(214): n is a, c, g, or t
  misc_feature (217)..(217): n is a, c, g, or t
  misc_feature (229)..(231): n is a, c, g, or t
  misc_feature (250)..(250): n is a, c, g, or t
  misc_feature (264)..(264): n is a, c, g, or t
  misc_feature (266)..(266): n is a, c, g, or t
  misc_feature (275)..(275): n is a, c, g, or t
  misc_feature (279)..(279): n is a, c, g, or t
  misc_feature (291)..(291): n is a, c, g, or t
  misc_feature (331)..(331): n is a, c, g, or t
  misc_feature (351)..(351): n is a, c, g, or t
  misc_feature (364)..(364): n is a, c, g, or t
  misc_feature (378)..(378): n is a, c, g, or t
  misc_feature (408)..(408): n is a, c, g, or t
  misc_feature (426)..(426): n is a, c, g, or t
  misc_feature (428)..(428): n is a, c, g, or t
  misc_feature (430)..(430): n is a, c, g, or t
  misc_feature (437)..(437): n is a, c, g, or t
  misc_feature (450)..(450): n is a, c, g, or t
  misc_feature (459)..(459): n is a, c, g, or t
  misc_feature (467)..(467): n is a, c, g, or t
  misc_feature (471)..(472): n is a, c, g, or t
  misc_feature (481)..(481): n is a, c, g, or t
  misc_feature (484)..(484): n is a, c, g, or t
  misc_feature (487)..(487): n is a, c, g, or t
ccattctggatctcagangcatcaccaactgtctacatcagatagatactctgagagtaaacatactcataagangaaaaaagtaatagataaaagttctgaaaganaagcccccttttataaatnaggntttcttgagattnacaagggtgaggncaactcccatgtgggcctctcccatgtgcccagtttctagtttaactacttgccgngngcngttgctatatannnctctgttgacaggctttcnggtactagaatttncntattttacntggnctctcatttgcncctatcggtttctttcttcctgctctttacttccttcgcnacttgcatatgctatggttngcgtagtccctcncttatttccccccnttccctaggtaccacacttatggcatttgnttaggctgggctctaacncncntggctgngatttattttggnatcacagtntccaagcncggnngggccgtcngtntgnggggc

SEQ ID NO: 487760 - DNA, 689 bp, Homo sapiens
cgttcctccttctcgccctcagctctgagccagtgacgggggtagcttttcaaaagccgtcattctaaatggacgtgagcgcactagagtcgcgtggtctactgcgtaggcagacacagggctacacccaacggctcacggaactgtctatcttgtcctatctatctcaccaggctgctagtgcactgtgtgtgtgggtgtgaatgtgtatacatgcccatcagcatttagtcacatgtctgaatttctgtgtccagacgagccccatcaaactagttgggaagggccccagtgaccaagtgtataagcatcccttgaagagggattggggcaggggaggcagaaggggctctccagaccccttttccatgatgacccactccaagatattatgtgtaaattgtgttattatgtatatgggtaaagatgtacaaatatatgtcctctttgtagcagatatgattttatatttataatgtgcatcaacatgtgaaagcaatctaggtcactagcacagaggaagttgccaggaaggtggcttcagcacctccaggttggttctgggtgtcctgctgtgaggggtagaacgggaggctgctgaagtgagtagctgagcagctggagccatcccaagcatcagtgtctcagagtcctcctcgcccgtttcttcagcacgacgcccaaccagg

SEQ ID NO: 487761 - DNA, 1122 bp, Homo sapiens
tcatttcgcaagggatgaggtcccatcccgtggcgctgtgccgcgatatatagggggggccgagatgtgttgtgccccacccctggtgtttcacccggggtgcttttcccaggaggaagacgttttccctgttagtagtccagtcggcgccccctctccccggaggtgtgcccagagagcgtcttcatatttcccctcctgttagtgctacaagcccgccctggggtgggacccccaaatttggttatatgagaaaaaaagacctttggggaaaatacctgggcccaccccctcccgtgattggcccctcgtggagggccttctctgtaatccgcgctgttttaatatcctttgggggagtatcaaagtgggaagctccacttgtactaaaccaccaccgtgtgcccaacaaccacgagccccctcgggaatttttcggaaacgcgcttttttgcgagaatttagagtccattttaagcttattccacggcccattcttcgtgtcacatttctagcctggtggaccccacagggtatgtgtatatgaaacgctgttttagaaatacccgcccccccttatgtgtgtgacaagattatcctcgaagaaaggccacgccttctccgagaaaccccagcggcccggtgaattcctcggaaccccgcgcggggaccccaccacggaaaacttgggtggttggaaacccccacagcggttggaaggcacaccctggcacccagaaggctgagagccctgggcgtgaatttacccatgctctttaagaaattgggatagaggttcccccctggagactccctcggatattctgcctcggtgagaacctccctcgctttcctcccctcgccctatctatccctgcccctgttcccatagaagacttgagacacataataagactggagacccatatttttctcccaagaaacattacctttttccccaaagcccatttataaatctcataatataatgcacaccggctgtggctcccataatatttcaccactccttttggtccaccatcgagggtttttggaaatttccacatccccttgtcccagaattcattcccctaagagtaataataaataatctctaacccc

SEQ ID NO: 487762 - DNA, 346 bp, Homo sapiens
atgctagaaaacactgcctgatacagtaagcatacaataaatatacattgaccaggcgcggatggtacacgtgtgtaatcccagcactttgggaggccaaggcaggcggatcacctgaggttgggagttatgagaccagcctgaccgacacggtaaaaccctatatctactaaaaatacacacacacaaaaaaattagccaagtatggtggcccgcgcctataatcccagctactggggaggctgaagcaggagaatcacttgaacccaggaggcagaggttgcagtgagccgagattgcaccattgtactccggcctgggcaacaagagtgaaactctgtcttgg

SEQ ID NO: 487763 - DNA, 792 bp, Homo sapiens
agctgtggaagctacttgcggggtgcctgtcccagctgcagcctggcagagagctggcacctgtgctggcacctggagctgcccacccttctgcagcagccggcatatctgactgtgcattggccagaccccacactcactctcacaccccttgccgctccatgcagtctcccttggcaggtgtggaatccaggccattagtgtgagctgaacacagcctgccaggtcgagtgagcagaatgagctcagtgggctgaagcaaaaatttgggcaaaggcacgactggctacagaggtttccagccagaaaagcaacaccccaaatatcccataataataggagtgcaaaacctgttgtaaactgtgcatgccagggatctaggttgtgtgttccttatgagaatctagctaatgcctggtgatctgaggtggaacagttttatcccaaaaccatccccagccccatccctgtccatggaaactgtcttccacaaaacctgttcctggtgccaaaaaggttgggcactgctattctataccgctgtaggatgactatagttaacaataatatatagtttcaaaaagctagaaggaagacattgaatgttcccaacacaaagaaatgatacatgtttgagatgatggatatgctgattatcttgatctgatcactatacatgatatggattggaacatcactaggtaccccatgagtatgtacattaattggcaagataaataagtataaaataaaaggcttatctattccccaaaaaagacagcttgaggaagg

SEQ ID NO: 487764 - DNA, 141 bp, Homo sapiens
caagactgactccctggattttactccctatattttattatttaccaacaattagacaattttccccctgccccaaggctgactccctggattttactccctatattttattatttaccaacaattaggccatcttatgtt

SEQ ID NO: 487765 - DNA, 768 bp, Homo sapiens
cccttcggtcctccggatggagttgccgggtccgctcgctggggtcggcccctcccttcgggggcgaggctccatctcttgggtgactacacccccacttcgccaccatactggagtcttagtcctttaaattcttggaatcacttatggggcgctagagagcctggagccgcacagcggggctcctgggtgggctatagagtggggtcctctgggcacttaatgggatttggggggcttctgtgggaaatgttgctgggagctcaactgggatatgtaaaagttcttcgggaaggtgaaggtcaggcacgccgagggggaggaagcgagcggacatccagctgaagagcttcgggttcgacaccaatggctctctggaggtggagtcgagcgtcctgcggctgggcctccgggaggcagacagagaagacctcatgctggtggggttcagtctcaggccgggtgcgggctggcagagttcgttcctattcaagcccgggatttcgcaggactgccctctcgcagaaaagcgagtagcagtgtcctaggtccgtgtacctcatcaacgatcaaggatctgcaggtccaggtgcggaagtatggagagcagaagacgtgtgtatcttacccgggctcctcccgagaatgcaccgtccaagacagggctccagaagccacaggccagcagtcccccggcaagggggatggcggagggagctctgcaggcatgcaagcccaagtgaacaccgcagtgattcaggggtccta

SEQ ID NO: 487766 - DNA, 1008 bp, Homo sapiens
  misc_feature (36)..(36): n is a, c, g, or t
  misc_feature (195)..(195): n is a, c, g, or t
  misc_feature (375)..(375): n is a, c, g, or t
  misc_feature (378)..(378): n is a, c, g, or t
  misc_feature (399)..(399): n is a, c, g, or t
  misc_feature (401)..(401): n is a, c, g, or t
  misc_feature (411)..(411): n is a, c, g, or t
  misc_feature (537)..(537): n is a, c, g, or t
  misc_feature (587)..(587): n is a, c, g, or t
  misc_feature (590)..(590): n is a, c, g, or t
  misc_feature (593)..(593): n is a, c, g, or t
  misc_feature (601)..(601): n is a, c, g, or t
  misc_feature (606)..(606): n is a, c, g, or t
  misc_feature (609)..(609): n is a, c, g, or t
  misc_feature (613)..(613): n is a, c, g, or t
  misc_feature (668)..(668): n is a, c, g, or t
  misc_feature (719)..(719): n is a, c, g, or t
  misc_feature (733)..(733): n is a, c, g, or t
  misc_feature (762)..(762): n is a, c, g, or t
  misc_feature (781)..(781): n is a, c, g, or t
  misc_feature (785)..(785): n is a, c, g, or t
  misc_feature (795)..(795): n is a, c, g, or t
  misc_feature (808)..(808): n is a, c, g, or t
  misc_feature (846)..(846): n is a, c, g, or t
  misc_feature (854)..(854): n is a, c, g, or t
  misc_feature (866)..(866): n is a, c, g, or t
  misc_feature (874)..(874): n is a, c, g, or t
  misc_feature (896)..(896): n is a, c, g, or t
  misc_feature (925)..(925): n is a, c, g, or t
  misc_feature (930)..(930): n is a, c, g, or t
  misc_feature (952)..(952): n is a, c, g, or t
  misc_feature (987)..(987): n is a, c, g, or t
gagggtgacacaccaaaacaaaaaaagaccaaacangttaaaacccagggttctagaaatacaaactcaattcattcaaatccaagcgcacccagaccctggccacaaaccctagtgaggggcatgtcagcgccaagtcagggagagggggcaggagtcactctgaggccaacagagagggtgggaaggggaccnccctagggcccctggggaccaccccccacccaaactggtatctccacaccctcaatgactattaagacataccaggctctgtcctcttggcccccaccccacccctggccagagcctcaaaggccagtcccaaaaggttctcccctcacttgcccaggcttctggcctccctctcctccnccncctccacactccctctgtcantngtagcagggnagggtactgtataagcgcgcagttaggctgggggccaagggggtggggtagagaggggatgaagagaggggaggagcggtccaaggccccctctctccaggggaccccaaactgtacaacacagcncccctatagaaaacacacggatctgagagagtgcactgtaggcataagcngcnatnctggaganctgcngcnaatnagagaacgggatgggctcactggccagctcttggtggggctggctggtaagaganggcagcagtggcagcttcttccaatgggtgaggctgctgctcagcacaccnaagcgggtgctgtnctgcctggcacggtccatgttctcatgcngctccatgctctgtgagtnttcngcagacacancaattatgtggcnggctgttttggcaaggatgggagagagcagggcctgcncaccagtncgagcggaaggnagggtgtngtagttgggctcggctccattnagagctttggtaggggggctgctagggtncagcngccgcgtccgctcctcttggtnctggtccgagttctcgttctcgctgctgttgcgcnccccaaggccggggtcgggcc

SEQ ID NO: 487767 - DNA, 637 bp, Homo sapiens
atccagggtacaagtggagtcattcaggtaaacccatgttattaagggtcagcatgtaccttatatatgtcatttgaggtgtaatggttacgaggatgggactgagattgcgaaatcctggcttggccgatattataagtgtctgtgggcacaatccttaatctgtccttaaattgtctggtctgtgaaatggagatgataaaagtgcctacttacatatgggtataggaatccaagctcagtaatgtgtgacttagctcttatcagactgcagtgggacatattaaagtagtaaataactatgtaattaatctgtagaatattactagttgtgagatcaactttactaatattaagtatctcaactcatccatggtttactgtctatatagacagtcgggatattgccgctttaagtgagtgagtagaaggtggacgtggaagtagttaggaaaacagtctgcagattggtcaacagtggatcaaataatcacctgagtgctgaccggaaactcaaaggtgataagctacttgataagctaatcaatatcaaggtttgcagaatgatatcactcttggggaagaacagggaaaacgaggagtgatcagtatccttcctgtccactgacttcagtcg

SEQ ID NO: 487768 - DNA, 100 bp, Homo sapiens
cgtgtggttctttcttggcagtcaacacagaggtgaactccacaaagatctttccgcagccgggcacctcgacgccgtccacagtgccgggggaatctcg

SEQ ID NO: 487769 - DNA, 231 bp, Homo sapiens
aaatcccaaaatgtgtgcaattactgcaaaccaggacagaccggggcagtgcaaggcccttgaccaccaagtcctccttgatcacctttcccaggttagaaacccctcttcagcctgtgcttcgcatattaccttcatcgtgccgccattcagactgcgccgtttacatcccagtgccacgctgcgtgaatctcgtgtcaatggttttttctgtagtaggcaatcaagctt

SEQ ID NO: 487770 - DNA, 1145 bp, Homo sapiens
cacaatccagcctccagactcacagacattgagaattaagaagacgcttgccaagatggttgaatcccaagcatgtaaaaatctgcatggttcaaacccatcggcaggcagcaaactcgtagcactgcaagcacactgtccttaccgcatggacatggcgtggcacattcagcagtggacatcacaggatgttaacttggttctcagactctttcttcactacgtgttcacaggctgctaatattaaacctttcagtactcttattaggatacaagctgggaacttctaaacacttcattctttatatatggacagctttattttaaatgtggtttaagatgcctttatataagtgggtttatatgaactgcatcaagacttcaatcctgattagtgtctccagatcaagctcatggagtactgaattgcctgttcatcaaaacggtgctttctgtgaaagccttaagcaagcataaatgcagcgcagcagcagatggcagcaaatcgactttgccttttaactgcagaattcagattcgaagtattactaccttgtaaaacagactatagatcgatgatgtgtcgggatactgcttattaatgatagtaggtcctgtgtccttagagatgtgtgtgatgatatccaatgcacattgcacagccgggattcctctgagcggacaacagacacttagaaagaacaataataaatatgcacatgaaacagggaagatataggaggacggaggcaaatgagcacaacacaacaggcagaatacgacccaaaatcgacaaacaaacaagaccatacactcgcacgagaacacaagttcaccacccaacggaacaaaaacacagaaaacagatgacaagggcacaaacaagctaaagcgaaccgtacaataggaaggaacaatcaccacgccgagataagggagaaaacaagagcacagaaaaaacacacacaaaagaggagataagcacagacaaagatcaacgaagaatcgactagaaagaacaagaaaagcgcagaagggaaacataatgataatacagaaacaaacagagaagataccgcgatgagaaaaccaataccaaaaagaagaagaatacacgcagaacctatccaccacctcataagagg

SEQ ID NO: 487771 - DNA, 1604 bp, Homo sapiens
  misc_feature (241)..(241): n is a, c, g, or t
  misc_feature (1284)..(1284): n is a, c, g, or t
  misc_feature (1291)..(1291): n is a, c, g, or t
acgacataaagtccaagcttagacacatcataaagaaacttctgaaaactataacgtacgcaagataaaataacgatcagaccagagaatacaacgatacaatttcattgcaggttgaacatatctcttgtgaacagactgtgatcttcacctagaatactatacgcaggccacgaatagaagtggcgaacaattgtatatgaggtaactgtaaataactgtcgacaccaagcatagttcntactcatccagatacataatattctctgattttaactggcataattaaaagcaagtgcaatataacagataatgagaactatttcctctacaatgacaagtgctacagactggagaggagacattcccatgaagccgcaaagtcacatcttgccttatagaacaatcaaagtgttaaaccaaagatgtctttcagcacaagcaaccagcaattactggagggacaattcagaagactctagggcaatgccagtgcagaggcaactatccatgacaagtgagacatacaagttcactacgatcaacatgatgccaacacttcatatacttattactattctattcatatataacatatacatattaaacacaagagagggcgagccgacatctgtggagagtgttatcctctctcgaaaaggaggtgtctcccaatgcgctatgataaggaccgtataaaccccatgacatctgtctctctgatggctcaccacaacatgtgtgggtctcccccaatatataggggtgggaggtctcccgaatattataaatagaggctctaaggagaccaacttagggccgatatgcggaatttgtgaccaacacgcggtcttcgtagtggaaaaccgagcgggggaacaacagcagtgttgagcgtgaggagcatgaggaggagagagagtcctatgggggtctgggagagagaaggaaaccctgtggaaaagcatttgacgataggagggaatgggttggaacccatttcaactgtttggggggacagccaacaaaactcttaatcggtgttaagacgagagaagaacatttttcaaaaaagaggagtccaaataagtgggggctacagacttcttttcaaccaggtctttctaccacaaacaggtcgaggaaacatcaaacacgcggagcggagttagacaccccccatagcggggtgggacaaaaaaattgcacatgtggcggcgggaccgttgtggaaacacagtgttgtcggtgggcaagtaaccgggggaccgtagtgtccaccgncggtggnacaccagaagtcttttttattaccaccgatcgaacagccaagcagagtagaattaagcaacgagaaagcagcagagcatacaacgaaccgacacgaacaacagacgcaggccgaacagcgcaccacaagcaaccagcagcacacagacacaccagacacacgagacgacagcatcaagccacgcgaacacagccaacacgagaccggacaagacgacccacgaccgcccagcagtcgaacacagccaaacgcagcaccagcaaacaccaaaccaccacgatgcagcaacacagcaccggcaacgacagaacaa

SEQ ID NO: 487772 - DNA, 224 bp, Homo sapiens
tcggataagggccaagctgaggcgagtgcataagaatctgattcctcagggcatcgtgaagctggatcacccccgcatcacgtggatttccctggtgatcctcttatgagtgtgtgaacctggtgaggtggcagacagaagcaccccctgccccgggcaagaaactcccagtgctccaatcaaggttgttgtgcttccattgaggatgcccagtgctggtggcc

SEQ ID NO: 487773 - DNA, 315 bp, Homo sapiens
tgttctgacgatcccaggagctgtttgataaactaaattgactttagcaagtttcaggactcctctattatttttattttttagagacaaagtactgtctgttgcccaggctagtatgcaggggtgtgatctcagactcacagcaacctctgcctcccaggttaaaaccattttcatgcctcagccccctacagtagctgggttatataggcatgcaccaccacacctggctaatttttttatttttagtagagatgggatttcgccacattggccaggctagtctcaaactcctggcctcaagcgatccgactg

SEQ ID NO: 487774 - DNA, 2088 bp, Homo sapiens
  misc_feature (1718)..(1718): n is a, c, g, or t
gttctagaggatcccagaaggctgagctcttccccaggcgatgggcggccaggtcgggagcagcggcttcggctccgatggcttccgggcggtcagttccaagcacaggctctgagaaacgcctcgaaccctgggtatctggtgaccgtctccgcaggcttccgtgagtctccgataggtgtttggggctttggaatactttcagaatactttcccattttttcataaggcaaaacggagtggacggcctttttttgagagaaacagcattctaagagtgtgcttggaaaacacacttttgggagtccacgtggggagtggacactcaggacaggaagcggtggccctaagacctgcggccacccggaggaggcagacgcaggcgatgacctggttcatcatgagaggagctagagttgactcagtcttaggatctcgatggcgtcagaattgcagagggtttctgccagtgccttaggtctaattcagaaagcaaggaaggctgggcacggtggctggcgcctgtagtctcagctacttggaaactgaggcaggaggatctcttgagcccaagaattcgagaccggtctggcaacatagtgagcctccatctctaaaaaaaagtggcaaagctgaggaaatctgtgcccccatcccccgacaccagacaagctaaggtgcattcagagtagggaacgatgtcaaaacctggccgccgtggtggcgcgcattcctctcacaccaccgtacggaggcaggtgacagtcaactgaaatgtccccaaggaccgtgtgaattcggctggcgtggcccagcagcggggtggaccaggtgcggtggcttcagacctgcctcccgccaccccgtcctcccctaaccccttcttgggacctcctgccaatccctgtggtgtttgagtaaagaaagtggctgatggttttacttttttcttccaatattggaaagaacaaactagatattccccttgaacacatccaaattatttccagtgcctgagggttaccgagcactgtaagctcagctcggctgtagctccgggtttctgccgatggcctccatctgcgccgaaagctgaactgagccccgcggtgccccggagccacagcagcaggtgcagcgacaatcgccgtcgtgcgcagtcgctggagtcctggagagccacgctgtcctctgcagacaacagcatcagtccgctgtgccccaatgcatcgacgccctgtggacggggcctgcagtccacccgtggtctgagcttgccgggctgaagctcggctgggacccagggaggggccaccctgggacccacagtctcctcagtcacgtgcagagcaaaaaatgcttcctgtgtttggaagagcaagtgacgcagcatttattgataaaaatggatttttctgtctgatttcatgctgtggtcgttaagtggtcaatgtcttctttttttttttttggacatggagtctcgctctgttgcccaggctgagttggaatggccccaactcagctcattgaacctttcacctcccaggctcaagcgatctcctgcctcagcctcctgagcagtggggattacgggtgcccaccaccacgcccagctaattttggtgtttttacgtacgagacggggtttcaccaatgtgggccaggctgtggtctcgaacacctgaccttgtgatccacccgcctcggctcccaantaatttggtagtttgttacgcgggatcctcagggccttgttttgccccgggtagacgcttgctcggatgagctccggaaacgtccgctgcctggccgtcgggtgttgtgtgcgaggacgtggccttggacccgcgtgtctcgaggtccttggacaattttggctaggggacggttcgtcgaccatccgctgcggtgtgggcgttactcgctcggatagttcgaccggtgtgtttgtgaggaccggttccgtgtggtaccaagcggcgtttgacctttccggtggagtgcagcgtgtggcaccgcggtgcgccccttgggtgtggcatcaccacccatgctgggtgtgtgagttcctagttgcaagaccgt

SEQ ID NO: 487775 - DNA, 545 bp, Homo sapiens
ctgtctcagtttcgggacgatactattcaacccagtgcagatcgtctgtaagatcttaaaagaacaggtcctctgtaacaaaagggaggcaatgaggggcagtggttaggggtgcaggctctgaagtcagatgacccagtctccctcctggctcccctacttgaactgcctgtgtgacctcggcaaggggtatcccccgtgcctgtgccttttccgatgtcctcatgtgtaacatgggaatagtaagagttcctacctttttgggctgttgcgagaattcagtgaggtaatgcacatgaagcactgagctaacaggtaataggagatgctgtatagactgttgtcttcatcactctctttcactcccgtccagttctcaatagcatacacacggctgccacaaatacacagaagttttgggaattagctctgtgagacaggcctatttcagataagaaaaatgaggatcagagaagctgaaagtcttgcggaggacaccccagcaaggcgaattacaggcccagaattctaacgagggcatccgg

SEQ ID NO: 487776 - DNA, 942 bp, Homo sapiens
ggctcacagttgtcaacaactggtacgactcactcatggcacggcgtcatctctcagacctcccactggagccagctctacttcatgaccttttacattgtgaccatggtggtgcatgcacgcatcattgtcgcctttatcctcgcaggccttcgtcttccgacatgaactcacagccgccacagaaccaggactcggaagttgatggtggcatcacccttgacgaccgaacatctccaaagaagacgctggttgccgatcctggagctctaccgggacggcccggggggcctcctcggatgtcaccaggctgctgccgaccctctccacagatggcgagataccagcaacattccatggcgtacactgggacaggcgctccacgaccaaccagcgaactgagcctgaagatgtcccagagagcgagatcccggcgccgccactccacggcgcccgccaccccaccccaccacccacacagcaacacgaccccacacccccaccccccacaacacaccaaccacccacacccaccacacaccacacccaccgcgacaacctgaaacagccacaccagacccgagcacccacattccccatactcccactcactcacccgacagagacagcccgccacacccaccgtgtgaacaccacacccgccaacaccatccatccacacaacaagacaccacacccatcacactcaccacacacgacacacatcccactcactctaccataccccaccccacccaacaccaccacaccacacaggacacgagtacccacaacctgacgcgcaccgaggagggcgtacaccgcagagagacgggaggggacgggcgaccccatgaagcagaacagacgacgcgcgacgcggcaccaccgccggaccggaacgcgaggacacgactcgcggcgggggaagggggcggcgca

SEQ ID NO: 487777 - DNA, 150 bp, Homo sapiens
ggaggagcgtggagcggcggcggcggcggcggcagaaatgatggaagaagcatagcctggacccacgacggcaggaattattggaggccaggactggagtaggtgttagtaaggaaaactagaaaagaggaggaaaaaaacaataaatat

SEQ ID NO: 487778 - DNA, 131 bp, Homo sapiens
taacatgatacaatcgagctcggtacctgaacattcgtgtcgtgacgagaagttatacgaggcgcggcggggctctcctcgtttatgatatcaccagtccgagaaacctacaatgcgcttactaattggtt

SEQ ID NO: 487779 - DNA, 644 bp, Homo sapiens
ggtctcgcatacatacaaagtttaccaggtgataccatttttcacatatacaattcagtggcattaagtacattcgtgtagccattggcatgtaaccatcaccattatttatctccagaactttttcgacatcccaaactgaaactctacccgtaaaacaaacttccctttcctccctccgcccagacccctttaaccactattctactttccgtctctatgaatttgattcttgtaggtatctctataagtggaaacatgcaatattgtccttttgtatctggcttatttcacttagaatgacgttttcaaggttcattcacgttgtaacatgttgcagaatttcactcctttttcaggctggagtgcaatgatgcatgatgtgacagctcactgcagccttgacccccagggctcgggtgatcctcccacgtcagcctcctgagtagctgggatcgtaggcacatgccatcacgctccgctaattttttgtatttttgtagggagggggtttcaccacattgcccaggatggtcttgaactcctgggatcaagggatccacccgcctcggccgctcaaagtgctgggactacaggcgtgagccaccaggcccaaagaaaaagaagaacacaaaaaaaaaaca

SEQ ID NO: 487780 - DNA, 139 bp, Homo sapiens
gatatcaggatgtgtctttgtaccatgagttcgagagaaactacattttagtcgtccacagacgatcgggctgctagtcgcatacccggagtaacacctgccgccatcacaaatctcagcagattgatgataggcggca

SEQ ID NO: 487781 - DNA, 912 bp, Homo sapiens
gctgtttgggggatctggatggttgactcctacgagtcaatgttcagcatcttcggcgtggctgagacctgactgatgggcactagagggcacgccagcccacactccctgggtctggcttcctcccgcaacctcactctagatagagcctgtgcctgcctactagcgctctggggttcggagagttagggaatttcctcagagccaactggctcaaggcttgggaacggttggctgctgccctccagctccgctcatcagctatgtgaaggggtgtgtatggagtgatcctgccgccccctccctgcgtctggtccagcagatctcaaacatcctgatgcccctgggtgccacgtatgtttgtgtacaggtggatgaaactagggccgcttgagttgggagcctgctttcactttgactttcccactgttgctgtgagacaataggacatcgttgatgaggaggaaagttctgcacaatctagtcggtaagcagccacttttccttgagaccaaagagagtgcggtggggactgggggggcgacgagcacggggtcccctgtcttgacagtggactgcttgccctactgcaggtgtaccctaatttgctctggtgttggggaatgcagggtctaaattgacggaaatctgggagaacgggagaacatagcagatctgtagtgtcgaggtgtccggaccatctaaagaagttggcggaaattacgtccggaagatccaatcttgtgggccaacaagtgccgggaccaagtttgggccaaggcgctgaggccgctgggacagcacggtggggtccggtgcctgccatggaggatggggcctgggcacgtggccggaatggggattcgcggagtgcctggccggggaagctggcgaaggcgtgaaagggagcca

SEQ ID NO: 487782 - DNA, 367 bp, Homo sapiens
gatcccctgagttcgccggacattgtaatgcgtatgagacactatcatatattaactgctagggtgagtggtatgaatgcttctctttcataggaggtatagcagttggccctagcgaactcgggggtatgctgttcgaattcataacgaacagggaggttagaattagcgcggtcttggctgaccagacactatgttctgttgagttcagggcgagagtgcgttatatgttgttcctctcaacgattgtagtgttccgggtgttctattattatcgtgttcgtgtcttcagctttcacgaattgtgcggtcgggcctgccgcgtattcgatcgttcctgccttgatactattctcggactcccctt

SEQ ID NO: 487783 - DNA, 125 bp, Homo sapiens
ggaggagagcgggtacgagtcggtgctctgtgtcaagcctgacgtccacgtctaccgcatccctccgcgggctaccaaccgtggctacagggctgcggagtggcagctggaccagccatcatgga

SEQ ID NO: 487784 - DNA, 946 bp, Homo sapiens
cgaaagctcttggactgttcaaatgttatcgcttacagagcacttgaacgcattgtgtgtacactttgtacaacgtatgaccagtaaatggaactggtcaactctgatagtcgcctcaacatggaggtgagaatgcatcgagggtaagactgtgtccagcagtgtttacaaattctctcttctgagtactagtgtccatgtgctcctcatctctcgaccctgttgttgacaatctcaaacgttcatgatagcactgactctctgggttgggttaactatgcccggccgtccagtaggtatttagaatcttcattatcttcagcagaggaattgttaatcttctcacttcatctgtgtcttgcgagttagctcaagttgatgtcatcactgatttcctaaactagaaactatggaagcatcttgtgacttttccttgttctctgatggattagcttaatcaccaagtcctgtcaacttctgagaatgaatcgtcaaatttgcttcccttctctatctgttgcccctgatttgccttaagttctaggcctgagtgatctcccagcctgtcgttctgtctcctttggttcagtctttatacgtgctcttgagtaatctttctgaaatttaaattgatatttacgcccctctgctgggaaaactttcactaggctttccccattttcctactctttaaggaattgatttctgtaagccgtcagataagaaggacctttatgatctggccatattctgaaatagcttcaatcctctctcatactctgtcccagtatacatctttcctgtcttattctgaacatttaaaccagttggtattctttaaatgtctgtgcctctccggggccaggccggggaaaatccaatccttcggagagggaatgggcggtattaattaagggaagtccccgacggcaaataagggcgaaag

SEQ ID NO: 487785 - DNA, 151 bp, Homo sapiens
caggattcctggctcctggagcccgttctaacatccagtaccgcagcctgccccggccagccaagtcaagttctatgagcgtgaccggcgggcggggttggaccttgcccttttagcagcaggatttacccaaggtttcttagaaccaaga

SEQ ID NO: 487786 - DNA, 289 bp, Homo sapiens
  misc_feature (169)..(169): n is a, c, g, or t
gtgagaacatggcagagctggtgctgctgggatagggcaggcgcccagcattccagcgtgctcttgtgctgggcccaggcgcaatatggaaactggttaggttgtgctttgatccacacattctcctgcagtcgaatcccccttttctaccccacatctctatctagangccagactgcactactcgcgtccaagaacaagtgtcaatgacgtgctaatcacctaagttaccccatcttatgagctctggagactcaactaagcagcacacagccagtggatccttcag

SEQ ID NO: 487787 - DNA, 152 bp, Homo sapiens
gaacatcttattgttgggaaaagggctttaaatttgtctgattttatttttcaaagttttttcatttatgaaccccttttccttgggatattatttaaggaaaatctcttgaaaaaaaatttttatattaaaaaagatttttttttgcttta

SEQ ID NO: 487788 - DNA, 296 bp, Homo sapiens
  misc_feature (96)..(96): n is a, c, g, or t
tcctgaaagatgaatgagaaagctgcccattctcaagactcatctgcctagggagggtcacagaggcaggatgtaagacccactgtgttgatttcnggcccaagtcatgaaaatggagccagagagcctggacatcagggacttttgcccacagcacatgacaccgacagcggcccagcaaaataacaagatggggaccagcacagcaccagaagccatgtgggacaggtgggctttgttcattcaagccacggggatgaaagggatcttgggcattgcagagattttaaaaaaaa

SEQ ID NO: 487789 - DNA, 158 bp, Homo sapiens
cccggggaaaggggaagacggttgtaagaggtgaagggggcaaccgggtcgggtttggttaaactttctgggagatggccaatggggttcaccgtctgggggggctgcttattagtctcctggtactacggggggcaaagtagatcacatagtgtcat

SEQ ID NO: 487790 - DNA, 162 bp, Homo sapiens
tctatgaggatcacccctattacaccacgacacttcattttggaaactgtgttttggattctagaattagaatatgaaccacagttatgaaatacaggtctagatcacaacctggtctgtcctgcggaggactagagccaactagggctgctgggaaaaaga

SEQ ID NO: 487791 - DNA, 941 bp, Homo sapiens
gagtttgttgcgacacagcccggaaacttagtttggggaagtttataaatttttgaaaggcaatcttgttaaccgggtggccggagcataactgttgcgctgcccagaaaccgcttgttggggaaccaagaattggcacaaagtgccgcccccccttttttgggtttttcctggttataaaaaagtttgtgattgtgagaagcggcctctacttgggtccgcccaccctgggactggggatccattgggagatccgaagaccaataaattggattaagaattagggggagggatgtaatttacccagggatttcatgcggacggggatctcagaatttcctcgggacccattaatgagtggatttcctgccccccaccccacaccgccaacttttcgcttggtggaattttgtttaatgtgacaacctgttaattggggctaattccccaagatggttgtttgtttttcaccaattttttgaacgagattggggcccccctatagagagtcacacgcagtgggtaattgttgtttttgcgctttttttggttaaaagggagcccacagtcgaggagcgtggagattaacgctggagccatactccctggagaggattcaagcgacgagtagatgggtgacaccattttaaggggaaagggggggtttgtttaaaatagtgaaataccagtaagtcacttctaaattttaaggaacaccacaaattgggagttgaagaataaagtaaggtgttcccctatggcttatttgcgcgttttctttgaaaaaatatcaacccttttgtttaaaaaactatgcatggttgtcccttttcctcttcaagtaagattttaactgggtttatcacttaattttttaattgttaagataaaataagattttgactcttgtgttaaagtgttacccaatttaaagtttttta

SEQ ID NO: 487792 - DNA, 142 bp, Homo sapiens
tttttatccccagccccccgtcctcccgccaaagggtccctgccccgagtgaccccccatcccctcccatcccccggggggtgtgtgtaaagcctcagggctgagtgcccaataaaggtgggggcaaggctgcggtgaggca

SEQ ID NO: 487793 - DNA, 139 bp, Homo sapiens
tagaaaaacaaaaatgttagctgggcgtggtggtgctaggatggtctcaaacgcctgacctcaagcagtcgcctttcaaggtcctcccaaagtgatgggcttacaggcataagcctgtacgcccggccagaaaaagcca

SEQ ID NO: 487794 - DNA, 220 bp, Homo sapiens
gggaagcggcggcaggcgccatgttcggccgcgaaggtggcaagaagaagccactgaacagcccaagaagcaggccaaggagaatggacgaggaagttaaggctttaagcagaaacaaaaagaggcgcagaagaaacttgaggagcttaaagcgaagcccgccgggaaggccccttgcacaagtgtattagtatctgcaatagtagctcttcttctccta

SEQ ID NO: 487795 - DNA, 794 bp, Homo sapiens
attaaaagccccaggataagcgtggtggttcacacctgtaatcccagcaatttgtgaggccaaggcgggaggatcgcttgagctcaggagttcgagaccagcctaggcaacatagtgagaccccacccatctcaatttaaaaaaagagagaaaaaggccaggtgtagtggctcatgcctgtaatcccagcactttgggaggccaaggcgggtggatcacctgaggtcaggagttcaagaccagcctgatcaatatggtgaaaccccatctctactaaaaatacaaaaattagccagtcctgatggcatgtgcctgtggtcccagcgacttgggaggctgagacaggagaattgcttgaacccgggacgtggaggttgcagtgagccgagattgggccactgcattccagcctgggtgagagagcgagactctgtctcaaaaaaaaaaaaaaaaggagagagagagagagagagagagaaagccccaaaaatacctggggcctttacaacctactgggtcccagaatcgtcttatggtaaacccaaagccaggtcttcgggttcgaaccagtcaaagtgggtactctaaaaacgttaaatagatgattcaacaatcgtgtggggggtttatctctattagaaatcccctttccagtacaaggaactcttctttttttcctaaagtatagaggccttcatagccataaattatttgggcaccaagcattttagtgggcacctaaagtcatggggctgtattcatataccccagggcaccccttgctccctagaagg

SEQ ID NO: 487796 - DNA, 307 bp, Homo sapiens
gtcccaattactctggaggctgaggcaggagaatcgcttgcacccaggaggtggagggcagaaagcgtggtggaagggagctgggcaggacagccacaggcaggacagccataggtggagtgaggtgaaggggcaggtcccagaagtaggaacaaaggaatttggagtgctcagagcagcctgcaaggttcagcatggggaagggaaagtataagaggggtggacagcaatgggcaggaaggaatgactgcccttaaagccttgaacctttgttgcaaaggtgtgaatcttgggccaggctctttac

SEQ ID NO: 487797 - DNA, 851 bp, Homo sapiens
ggtcaggagggacgtaagccgggctcccccggcgtgttgatccgaacccgcgcgggaaaacttgcgcaaaccaaaggagggaagagtcaggcagcccccagccccccagggaggcccaggtgaaaaacagacgccggcctcgcctctcccggtgcggatgatcccggcactcccagccccggccctgctgccccgagttcggctccctcagccccatcatcctctctggtcatctaagtggactgcagctgctcagggagcatgtcgcgaaggatagggaaggacagggggtctgcttccccagtcagcccgtccagacccccagggctgcgtaggggccggactacccgtatgcccccatcctggacttgctgcacccgtgaggtgcgcacagcagggtaacacaggagcaggagtggggagcaaagctctggcatagcagtcatccatctcataggtcaccttccttgctgtcctagggctgcagatgccagggtctctgaggccctgaggtcctgtctggtggcgacggggcttacctcctatccacgtgacattacactgacccggctgagtctagaggcacacatgatacaaagcagaaccctccgaaagacaggcgacgctcaggccctcacatggtcacggctgcttatgctctgggcccagcctgggatttgcctcagtcgccattagcgtgagtcattgaggaattcaacagagggtcttttcaaggttccactcattgtctttacctctaactggactttgagtacaaacaacggaagctcctttgacttccgtctgccgaacctggcaatgcggtgattccctggaaccgttgaaaacca

SEQ ID NO: 487798 - DNA, 224 bp, Homo sapiens
tttaacaaagtaacttggattaatatatgacaaaatgaatctctagtataataaaatgtacaatctggatttatttatttacttagagacggttctcgctctgttgccagactggagtgtagtggcgtgatctcagccaaagtgctgggattacaagtaggagccaccacacagggcctagttactggtttgaataataacagccctttcccgaaactcaacca

SEQ ID NO: 487799 - DNA, 226 bp, Homo sapiens
tgggatgttgtgagctgggtaggcagatcctctgaaggtgtctgctaaatagttattattatcttaaattctcatttagaaagtaataccaatttaagggccaggcacggtggctcacacctgtaatcccaacactttgggaggctgaggcgcgtggatcacctgaggtcgggagtttgagaccagcctaaccaacatggagaaaccccgtctctaccaaaaatcc

SEQ ID NO: 487800 - DNA, 124 bp, Homo sapiens
  misc_feature (1)..(2): n is a, c, g, or t
nntgtcatgggtggatctatgtaatcacggaggccagtttgtccagacaaagttgggaggtttaatttccgtggtctcttcctccttggatagtgtcttgatgatctccttccctcttgtgcct

SEQ ID NO: 487801 - DNA, 262 bp, Homo sapiens
gaggtgggttcagcactcacatttcaccctcaaggtcagcaggggggggtaacagaaggctcagcaatctccccccaaggcatctggcttccttccgcccttggggcttcgtgtatggtcttccattcaaaagtctcaagcctcaacgtggtctgctcagtcctcacggcagcaaccttttcaccccccaaagtttttcatccatggcaagcacaatcatggcaaccaacccccatcattgtggtgggggctgagcagcaag

SEQ ID NO: 487802 - DNA, 253 bp, Homo sapiens
accgaattcctaatacgcagttataatacagtaatatatacttgaaaattgatgatcttaaacattctttccctacgcgcgcgcgcacacacacacacacacgcgcacacacacacacacacacacttcactaatcaactatgcggggtgatagatgtgtaattctctctctttttgtgccatgcccaaggtatgtggaagtcccaggccatggagtgaacccaacacaacatgtcgcccgtaatgagggttg

SEQ ID NO: 487803 - DNA, 208 bp, Homo sapiens
aaaccaagatggaacctgaaagttaatgtatccttgcttttagcagagactcagtttctaataaactagtccctaaggacatatgccgcaattgagttaatttttacctttttacccctattggaaaactaaccatgggtgctggcacttataaatattactcctccggaactccagtgttggttaagttaccaggcttataccaggt

SEQ ID NO: 487804 - DNA, 904 bp, Homo sapiens
cgagaccaacgagagaacaccgcctgcagctagaacagcctggtcaggagcgtaacggagtggtgcgccaacgtgagaggaaacccgtgcgcggctgcgctttcctgtccccaagccgttctagcacgcgggcaaaaatgctttctgaaagcagctcctttttgaacgggtgtgatgcttggaagcattttctgtgctttgatcactatgctaggacacacttaggattggctcatggaaatagaatgcaccaccatgagcactcatcacctacaagctcctaacaaagaacgatactcttgaaacactttcagaggactgagcgcatggcagctcagctaagagcatttcgagctatactgtattatccttgctaaaaacccaacagatgtgagctcttctgggctgcagctaacaggacgacttggaccaacacactgtgacacaagcagcagcttcttcagcttctgacacaatgttaaagctgtcctgacgctcacatctaactactggacacaaatgacatgctggttaactgcatgacgaaacagcttacaacatacgccttctgataagtatagcagaccaatacaactggcttcttccttgcacgccccactacgtttgctatcattgacaacctaaagtactcctcgttacccacacggcatccatcaccagccctttctactctaggccacactatcaccatctggagaccttgacatatgctgggtactggcaaggaggcactcgtccttacgtgtacaatcactgtacccagacttcacagcccttcctcaataatcccagaacagtgtcccgcaccgcgaacggcatgcatctggacacatatctgcccaatacccagctcccagcggccctcacatacgccggcagcatc

SEQ ID NO: 487805 - DNA, 439 bp, Homo sapiens
tagaatcaagctatgacattgtatacggtttcactgtactttgatctagaccaatattgctgtccaaccattctttagacttactagagcctatctgatgatccagaatttcgttgccattgctttcggtgtttcagacataaagtccttgcccatgactatgtcctgaatggtattgcctagtttttcttctagttttttgatggttttaggcctaacatttaagtctttaatccatcttgaattaatttgagtataaggtataaggaagggatccagtttcagctttctacatatggctagccagttttcccagcaccatttattaaatagggaatcatttccccatttcttgattttgccacgcttgacaaagatcagatggttgtagatatgtggcattatctctgaacgctctgctctagtccattggcctata

SEQ ID NO: 487806 - DNA, 2069 bp, Homo sapiens
  misc_feature (1)..(1): n is a, c, g, or t
ngagttgagttgattgttttgtgttgtcatggtgtctttttggcggtcgtcgatggtgggcgttagtgcgcctcatttcggctgggctgtgtatgtgggtgagtcggttattgtgtctctacgtccttttggatatgtgtctggatcttgatgcgtctaggtttgggtggtggtattggtgtgatgtgtgtgattggttttagatgtctgatttgtaatggtgctggttgctgtggtggggtgtgtgggtgtgggtgggtgtgttggtgtgagtttgtggtactgacgacttctgtggcattggcgtggtgtgtgttgttggtgttgttgtttgtggttgtttgcggttggtgtgggtgtgggtggtgtgttgtgagcttgtggggttgttgttgatatgtcttgtatgtgtggtgtaccagcgcgtattgcttgcttgtctattgatgactaagtgctgtgtaggtcactgctgctgagtggggtggtaggtccgtttccgtttgtgtggtgtggtgttgtgtggcgttcggttttttcttcgtatgcatccaggatgtatgtgtgctgctgctcggctgtctactgtctgaggtagtggtgatgggattgtaattgttggtgttgattttcttttctgtcatacttgtggtagtgcatcggaggtatttgttgtctgtcgcctgccctgctgctgatcggttgtagtttggtaggttctgtctggtgtggtcgtcggtctgcgatgagagtggggaggagggggtgtgagcgggggtggtgtggggatgtggtggacagtgggtcggtagtctgtgtgtggtggtgtggggtggttttgtgtgttgtgggtgttgtgtgggcgagtgggtgcgaccactcgatgggtgctccttgtgttgtttgctgttggtacgtcagcggcggtcggcttgaggctgtttgttgtgttttttgtcgcgtagtgggtgactgatgcctactgcctcgttctttttcgtcttgtctgcgtcggtggggggaagaaggaagatcgcaagaccaggctctattggggtatgtcttcgacatgcatctatcatcgagcgagctagtggattggtggtgtttgtttgttggttttggttgttgacaggatgttagtagattaatgttgttggtgatttgtggtgggtagtggggggtatagagacgggcgtttcacacccgacacgtacgtctacatgattacatctactgttgggcgtgagtgtggagagtgggaggtggtgtggttgtgtgtgtggtgtgtgcggagggacggtgacggggattgtttgttggttttataagaagacaacatcaccactcaccacaacaacagacgacggcgtggcggttcgtgtgtgtttggtgtgtgagtggtgaacagagactaaaacgcggctgtgtgtgtggtagtcttcgtatagaaggttgtagcgtcatccacgcacacaacacaccgccacacacacaacctacgcgcgtgtcggtacgattttggtgtgtgtctcgtctctctctcgctcttcgttgtacactatagtcacactactactcgactctagacgagtagtgtatgttgttgggtcgctgctctcgcgatgaacactacacacacacgcgcgcgacgacgaggttcgtctcctcgaccgaccaggtggtgtcacacacacacacacatggtgccaaccacactcactcacacacacactctacctcacgcacgcacggtggtggtgtgtcagcgcgctagtagtggtggtgagttgctgagttgtgtgtgtgtatgtgatgtgtgtgtgtgtgtatgatgagatgtgtctgttctgtctgtgttgatatagctgtctgttagtcgccccacaccgcgaagatgagagagtgagtgtgttctctcttcattctcagtgtgtgtaccacacacacagagattgatgtgttatgttgacttctctctctctgttgctgtgtctgccacccaccacacaataaagtacaagataaataaaattgataatagaataatatatatattaaagtatata

SEQ ID NO: 487807 - DNA, 890 bp, Homo sapiens
gggtttgatatagataatatgttgtgatgtaaattgatggccgcctaacgatagaggatgtcacccatgcgtagggtgtaacggagaagatgggtgtaaggtcgtacaggagggcttccatggggtgtggaagtacgctatccctgcgtagtgcggaggggtacgactgttcaagacttgttccgtggctccgtgactccactagtaagcaggatggcgagcacggatgtagcggatgagtgagggagataggtaaaggacgtgcaagtaacgcttgtgatgggtctgatctctattgcagggagggaaaaacgtcacataatccgcggagagtcaagccgaaatttcaactataagggtgctacaccataaggtctacgatttcgaaccatagattgcccctcctcggagtatgagtaggaatagagtgttaatttcaacttgagtggagaaggaaacagactttcattgtaacccaaaaaataggcgaattgtgtgccttaggtggacccagatttcaaaccagttgttggttaggagtagatgggggtcctgctctaaacgcataaaggaaaaagggtttagggcacatgtagggcaggtgttccacacggaacatcaggtgcctcccgaaaagttaatatgggcacaggggtcttcctaaggcaaggctagtttcgcaccgttgagtggaactttctcgataggcttcccaattagctggcgcatgcccttaatttggataaaaaataacttttctcataaactccaaacgttctaactctctcaagctatttgagcttcttaatcatggaagttcacttggttcttctccatttaactcacacaattatacaagacgttcccaagggtaatgtacaccacacgcg

SEQ ID NO: 487808 - DNA, 884 bp, Homo sapiens
  misc_feature (329)..(329): n is a, c, g, or t
gcgtgagtattggtgctgcgttgagcaatgtacgcgacgtagtgcactgcccgttatcttggccaccgtacatctgtggatagccgtgctggagcaagattcgttaaagcagaggcacatggacagtttctgcatggcggctgctcgtctgatgccgcacgagacgtacactcttatatcaggggagacgcctgctgcactcttgcgtgtaccgcggccccaagctccagagggacggttggtgaaccactatcgaagcaaccagatgacacaggagaaactgacgcgtttcaggaagggtcatccaaccctgaccccgcaacgagctngttgtcatacaagttctctgagtcgagatgcacggacatgtcgccatgtgtacagatggtaccctagaccttgctctgatatcgccacatccatcgagcaagtataccatatagaaaacacacgcacatgcttaattaacgaaatgacatcccagaggggaatagtgagccacgatatggcatgcataaatagatgtggacatatggagactcaatcgagcttgaagaacgttgggtttgccaagccagctgggagagtctttggaggcatacaaaacatcttgtgtacgtctacattcaagccatactcccctggtacacagcatcgttcccagaagtattcagcattcaattgcaagattgctttacacgttattactattgtacgggacgtaattggtagtcccataccttatcgacaacaggtagtggctatgtttagcatacctatagaacgcggggtcaatcttggtgtcacccaataggttatgcagagctaacagaatatacactatgcacggcaacgttattgtatcagacaccttctgtttccgc

SEQ ID NO: 487809 - DNA, 252 bp, Homo sapiens
acagaggcacaaaggagggattaaaggtgaggtgagcagatgaggaagcagaaggctgatgagaaatggaacgaagaagggagaggaatgtccagacccagagagcatcagatgagcatgaggagcaagagcctgggacaggcaggcacagattggaacgaagaccctgcagccacgcaccatctcacagtaagccatacatacggcccatgcacgcgagcctgctcaactctgggttttgggcctctcata

SEQ ID NO: 487810 - DNA, 448 bp, Homo sapiens
aatcatggtcttaattgcatgtagttgatgtgtggtagtgattgttgagcctgagagaggttgaggctgagtgagccaaggtcatgccatgactccagtctgggtgaagggtgagatcctgtctcaaaaaaaaagaaaaaatggaaaagtttctttccctgcaaagtggcttatagttgttggtttgtccaatgttggagagcatcccatttagtcctcatattgcccattagcatgtcattcagaaacgtctctttttcgtgaactggctcaatgaggagagctgggcagatgtcctgcaggtgccttgctgggtttggaggctcgcaattcactacagcagctgagtcgtgcctaggctccagtctaccaaagccagtctgtatggaccatgccccaaagggttggtgggtaactcctcgtatgcggagatgagagagtgtagaaa

SEQ ID NO: 487811 - DNA, 117 bp, Homo sapiens
cagcgccagggattcaatcaaccggggtttttgcgagatgactacaatatacgaggatgaagatgtaaaaaaagccataagtaagacttcctggagaacctttataatgacaggatg

SEQ ID NO: 487812 - DNA, 420 bp, Homo sapiens
ttattccatgaagagttttaaagagctgcaaagcaagatcctgtcaatctaagatgagacacagttccctatttaggagaaaatacagttacatctccctctcagggccttcatccccacatctcttgtacaggaggccgggctccgtggctcacgcctgtaatcctagcactttgcgaggccgaggtgggtggttcacctgagctcaggagttcgggatcagcctgggcaacgtggcaaaaccctgtctctaaaatacaaaaaactagccgggtgtggtggcacatgcccgtggtcccagctacttgggaggctgaggcacgagaattgcttgaatctgggaggcggaggttgcggtgggctgagattgtgctactgcactcagcctgggcaacagagtgagactctgtctcaaaaaaa

SEQ ID NO: 487813 - DNA, 984 bp, Homo sapiens
cggttcccttttaaaaatgtgattgttaacctgcctcttgaaagattcaaccgggtgtggtggctcacgcctgtaatcccagcacattgggaggccaaggcaggtggatcacctgaggttgcagtgagctgagatcgccccattgcaatctagcctgggcaacaagagcgaaactccctctcaagaaaaaagaaaaccatcctggccgacatggtgaaaccccgtctctactaaaaatacaaacaattagctgggcgtggtggcaggctcgggaggttgaggcaggagaatcacttgaacccgggaggcggaggttgcagtgagccgagattgtgccactgcacttccaagccctttgaaggaacaagaaggggaagactcccattcttcaaaacaaaaaacaaacacaaaagaggggcacaatcttaaacacagggccaagttagggttaagccacattacaactctttgtgacaccaccgtggtgctattacacacatacacttctcataagtggaccccccggggtgatactcaagggtatttcaaccgttggttgcaccagagagggattttcagagcttaagtcggatcatatagccaaggactatggacaacaaatcctgagggacttatccacgaacaaccctctataaccaacgtggccaactaagaacaacacaaaagagcacacgaaatattagcgcagagagtaaggtggacatacaaaccctgtaaaaattctaaacacgtgctaggacgaaagcccgcgaaccaaacaggcactgacacggggcccacccaaattgtgaacagaacaccgggggccacaaaccagagacaccagtgctcacctacgaccaccatagagaagacggaggaaccgcggaaacaaccaacataaccgaaaaagctaacaacacatgacagaataaccgagggccacaaggacgagaatggtcgtaagcacaaagaaaagccaag

SEQ ID NO: 487814 - DNA, 244 bp, Homo sapiens
cattgcataagcgtatgaggggtaggcatcagggatgaggccccaggtctattttcccatcgatgaggtgggtagcggcgccttccctgataagggcactcaggggaagatacacttttgggggaggatgccaaggtcagtttgggacatggtgagtgagaggcgcctagtgacatctggtaggcattttgattgatactgagatgaggttccagtgctctgggccaggacgcagaagagtgag

SEQ ID NO: 487815 - DNA, 543 bp, Homo sapiens
ccagattgtggcttatggacgctttaagacactaaagagaccacatggtaataaagctgagtgcggtggctctcgacctgtaatcccaggcactctgaatatgctgacgcgtggcggatctacaacgtcaggagttcgagaccagcctgtccaacatggtgaaatcccgtctctactaaaaatacaaaaattagccgggcatggtggcatgcacctggtaatcccagcgtactcgtggagtgctcacagcatggtatatactcacttgcaacttgtggacacaggagtgtgcattgagccaagatcgcgccattgtactccagcctgggcaatggagtgagactccgtcccataaaaaaacccatgaagaagaaagaaagagagaggaaggaaggaaggaaggaaggaaggaaggaaggaaggaaggaaggaaggaaagaaacaaaacccacatggtagcactaagcctaggcgaggacccatcacctttaggcttaatggggtcttggcctccacagcaccagcagagggcctagaggtgag

SEQ ID NO: 487816 - DNA, 146 bp, Homo sapiens
caggacagcctcctccttctattcagaaccaccctttgagccctctgtgtgaacatatgcggcgggctgccgcgcgctgcttgccttggccaggtggacgcgaaccactcagagtttactctgtacgaatcacggctgttggacat

SEQ ID NO: 487817 - DNA, 628 bp, Homo sapiens
cgggggggtggggggtttttaaacgctaaaacagccgcaaaacaggaaggtccccccatgcttggggtcccttattcccaccggggggtttagggtcaactttctagtaaagttgaggcccggaggtttggggggattggcggtcccagcacagatgccagtgccagtgatgtccacggcaatttcgccttcgagggcattggagatgaggttttgttatttccccggttgggatgtttgccctctaccccagaggaatttacaaaaacttgccctgggcctgtgtcccccaagaaaggggggggggggttttttcctttttttttccaaccaaccccttttttttgggccaggggcctggtttcctccctttctttgtccccgggggggggggcacaagggatggcccctttttttttcagagggggccctcgaggccaaattggcatttggttttttgcccaaagtttaagggcccatggctgcctcccttgggggggaaccatagctccctttgggcggtttttggctttttggacccatgggccaaaggccaaggggaggggcaggggtttgggtttggttgggcccggttccccttctttaaattcggccgggttggggccta

SEQ ID NO: 487818 - DNA, 389 bp, Homo sapiens
gcggaatgcatcctcatgtgagagccccaatcccttgtgcaagttgtgtcctggtataagacatcatccagccacttgtccagggagcacatcccaatccagttcctgaccagacaaggatctgcccctctttccagctgggtgacctggtatatgttagaaagttccagaaggaaggactcactcctgcctggaaaggacctcatactgttatcctccccatgccaaaagctctgaaagtagacagcattcctgcttggattcatccccctcacatcaagaagaccaacaaagcccagcaagaaacatgggtccccaagcctgggacaggccccttaagctgtgtttaagtcgactgaagccgtttaattaattgtttgcatttttca

SEQ ID NO: 487819 - DNA, 1910 bp, Homo sapiens
tcggggagagctgttctggtgtccggatgtggtccatggtaggtggttgagctcgaccattcttgaccggcaaagctgctgctcagtgtcagccgggattcctgcgaggcatccattgaggccagtgacatccggatggtggagtagtgaatggagggtggagtctgaatgaggttcagatgacctgaggaaggcatgcctgagtgaactgcgagtgtcgtggagtggcttgcgtccatagttcctccttagtgccgtggatgacctgcacgacaggacattgcgtcctagcgttagacacgagtcagaacggatcgtgcgtgcgaagaaactgagcgtgcggtgatggctcgagttacgccctcgccgagcgttcaagggttcgaacttggggggcacttgggatcctcatggcgtcgcggggcaggcatttgtccatttggctactgtgattgcggccaaggtgtcgaagtgcgcccgccggcggacccttggggcatgattatccggccaatcccctcaggtcttaggcggcgttccaacgcttggcccgttgggcattgcacgtcccatttacgtagtggccattcctgttgctcgttgccgccgtcctgccgacgaacttgtcctatttttgtcggatgtggggcctggacacccggttgtggcgcggttccaaattaaccaggtttcgggctggatcctggaaagagagcggtgacctcggggtcgatgacattaatgttatcctgacaggaacacgccatttaaccccccgaaggctttgtacacacggaacgacgtctacgcgttgtgtggtggcatacccaagtgtgcggaagtacgcgttacccacagtctctataaccttcgtgtggcgattttgccgggggcaggaaaaccccctttctctggagggtacccctctatgacccgaaggaggggccaccacgaagcggacggaggcgagtccgcgaatggggcaaaagacccctgttgagaccctggtgaagcggctcacattgcaaacaggccgcgagggacagcactaccttacgcacacatcactaccacgcgcatgtcaaaccagcatccattcctctgaaaaatgcgcgcgcttgcaacacgctggtgtgcaccgacctagacacgatacccttcgggggcgactccccaagaaccattccgagcacgacaagggaaacaaactccacagtcaaaacagaggtcagaccgaaaacatgagtagctcgagagcactccacaacgaacgtcgttggtagaccattgttcgtcctcgccacacgaccactaccggagccacgcacccgagaagcatattacaaggagcgcggttcccccaaagggcggcgagagacaagttctagccccggaccacgacgcgcccaacaccgctggtgcccagcgacacaggagcggcgcacaaccaagcagaaaccaggaccgcggacaatacacacggagcaccaacagacccgctgggagaccccatatagaggtcacggcccaacaactaaccccagcgggcggggcaggcggcaaacacacccgccacggcggggggcacccaccaccaacacaaccacgcgacgcggcttggacgagcaacccgatgaggagcgacgacgacacccaccgccggacgcggtggagatgagagcgagctacccccgctgcgacgcaaccgcaacacgaacgacggacacacccacacacagccgagcgctcagcagagatgaccagctcgacccctaccgctcgcagcagaacacaacgaagacacccatcacagagacgagcgacacgcacccacccgcccacgaccgccgccggagtcgaccgacccaacacatccagagcacacgggccgccacggagcacagcacttt

SEQ ID NO: 487820 - DNA, 134 bp, Homo sapiens
tccgtcaatctcccgagtgggagtgaaacaggatatgcgccacacatattactgtttgtatttttaatagagaggtgtgtatcaccatgttggccaggctggtctcgaactcctggcctcgagcgatccgcccg

SEQ ID NO: 487821 - DNA, 446 bp, Homo sapiens
tgctgacgtgggtcggtacacagctgcaccactcaccaatcagtttgtctgtgcaccagtccatggacatgtccagcactctactgcaaacaagtctgttcattgtgaggtgcacaagcatgtggcattgtgtgtgttactgctggatgagtcacaaagcagcagcaggaagataagtaatctgtgcccactgttacattaaataattcccattgttgaaatgccctttttggagcaaaacttaaccaattcaataaagagcctacgttgggaacccacaatctgcactgcccaatcaacttctcatcaatgcttttcccatcacattctacagtcacatgtgtaatggcgatctacagttcagacgcaagcaacagctggtattcatgttcgcaccaaaagctatggggtaaggccaagctagttctgtcaggccctccaacccc

SEQ ID NO: 487822 - DNA, 155 bp, Homo sapiens
aatcctctaagctggacacctggtcgtatcaaagaccatctagcagagtggccgattggctctttctaaactgggacatgtcgtgcttgactgaaagtggatcagatgttagatttaggtttcgctgaacacagttgaagatattattcactgaa

SEQ ID NO: 487823 - DNA, 442 bp, Homo sapiens
tcgacgaaattatttgattcatttgatcagacacaggaaaaccattgatataaatgcacatccattcacaaaatgttttaaaaaccttaacaaactacataaagaaacttccttaatctaataaaatgtatctaccaaaaatgcagagtaaacagcatcctagttaataattagacatttaaagtcagtaacaataatgcgttctattattacgtctactcaatattattctagaggttctaaccatggcagtgagacaagaataggcagtaaattagaaacctatattcaggggccaggcgccttggttcacgcctataatcccaacacttcgggaggcctaagtggaagcatcgcctggagccaggtgtttgagagcagcccagacaacatagtgagacctcattgctacaaaaaagaaattgttttttaattattcagg

SEQ ID NO: 487824 - DNA, 1738 bp, Homo sapiens
cagagccccagcagcagagagcaacagacacccgttgagctggcagtctcttgccatatgacgcgctcgagcgatgcactcgggctcctcccacaggtggtgggctcgaatgatgcgcagatgaactcgatccatggccccaacagtccgcgtgctcgtggactatggtgagtgccagagggatggaggagtctcgtgaccagccacgcgacggtgaatgctgatgagacctgtacagtgcaaggtaatggagctgattggagcgaagctctgcgaaaaagtagagagatgcatggcactatagctgttgggagccagcgtgagcgtggaacagcgggacaggactccccagtgcccatggggactggtctccgggaacccgagaggacttgcagtcatgaggccacttgtctgaagcacacacgtcaccaggcgggtcaggagtctgtgcgtgatggaaggctcggcagtccctgtctgctgcgggcctaccacctgcaggacgagttcggcgtccgacgcttcgcccgtgagacgacggatgcttgctaggagctcgcaggatggggaccctcatgctggccctgaaccgatggcctcgctggcgggggtcgcggtgcgcgagccgacttgacgggactgggcctggacctctcgaggagggatccccttctgtcgttcgacagccgatgctacttggtgtcccttgggtacctggggggttcacccgatgccggtctcggaaaccgccggctgcctatgacggaacgcccggccgccagaccacgcgcccgcgaaacgtccattgcccgaaccccagcgcaaggacccgccgcgccgcgcaaaaggcctgcgagcaatagtagcacaccatcaccgtgttcacagaagaccaccacgcaggtccccgaacaacagtaatacacgtgacatcggaaacataggggccgccaacgcgtacagcgactagttcttcgaagacgatcggaaaaacccccaccgggctcgctacacacccaccaactaagccaaacagttgacagaaagagcgcaacccacgagaagctcggaagcacgtacataacaccacgacacaaaatcacataagcaaaccacaagcaccccccacaccgcagaagcgtcgagcgcccacgaatcccgacaagaacagtttccattcaacaaacatagggaccacacacaccgtcattagaggcggcgcacacgcaagaggggactcggcagagctaggtcgcgcgcacgtccgcgggcgacggacgcgagcgggtgatgaggagagaccgattaggagacgtgtgggagtttcgagtacggcgacgatgagctactcgatcaagtggacggagataagtgcggatgcagcgaagtgagggagagagggcgacgaatgcggcggtggaggcgggaacgtgagcagcagtcgacgagaaccaggagtagacgtcaatacagaaggacctgacagagcgaatcgcatcgaaccacacccaaggaagtaagagaagccataagcgaggcagagaagaccagcacgtcagcgtagaagacgccacacaacagccaacaacacagaccacacagacacagaaagcaccaacaacaacgacagcaaacatcgacgcgcaccaacaccaagcacacaaccaacacctaaaccacagacgccacaaccaagacacaaaccagcacacaccaagccaaagcacccacacaaaca

SEQ ID NO: 487825 - DNA, 295 bp, Homo sapiens
caagctatcggttcaatggaatggaatggaatggaatggaatggaatggaatgtattggaatggcatggaaggggaatggaatcgaatggaatcaattcgagtggaatggaatggaatggaatggaatagattggaatggaatggaatggaatggaatggaatggaatggaatggaatggagtgggatggattacagtggagtggagtggagtgttatggagaggagtggactgtagtggaatggaattgaatggaccagagtggaatagtgtggaatcgagttcggtggaatgg

SEQ ID NO: 487826 - DNA, 289 bp, Homo sapiens
  misc_feature (77)..(77): n is a, c, g, or t
gaaagagtcttgctctgttatccaggctggagtgcagtggcgcaatctcaacccactgtaacctccgcctcctaggntcaagcaattctcatgcctcagcctcccgagtagctgggaccacatgcgtgtgccaccacgcccagctaacttttttgtgtttttggtagagatgggtttcaccgtgttggccaggcatgtctcaaactcctggcctcaagtgatctgcctgcctcagcctcccatgagtgtggtggcaccacacctagcctctaaaacaattttaaatgat

SEQ ID NO: 487827 - DNA, 120 bp, Homo sapiens
atactggtggcccttagagtgtgacaactctggagatattatgcaatagcaagacaggcatgcacaataccaggcaggataaggccaaccatgatgtgctcgcgctactctctctttctg

SEQ ID NO: 487828 - DNA, 116 bp, Homo sapiens
ctgtagaggtgcagtgcaggacaccgccggcacaccacgcttgttcagcgccatggccagcaaggcgatggtcacctgctcccccgtggacacaatcacatccagctcacgcggca

SEQ ID NO: 487829 - DNA, 414 bp, Homo sapiens
  misc_feature (4)..(4): n is a, c, g, or t
  misc_feature (336)..(336): n is a, c, g, or t
gacnctgaggaccccaattctgcccccacagcctgatgtgttttcaattctctttgttttttatacctaggagtggagttgctgggtcatatggtagctctatgtttaactttttgaggcgctgtcaaactgctttgctgcccaacttcattttacattctcaccagctgtgtctgagggttccaatttctccacatccttgccaacacttattaatctctgttttttttaattgtaaccatcctaatgggtatgaagtggtatctccttgtggttttgatttgcttttctcaaattactaatgaatggtgttaagcatcttttcatgtgcttatntggcatttgtatatcttgggagaaatgtctatttaagtcctttgcccattttctaattggattgtctttttattgagt

SEQ ID NO: 487830 - DNA, 127 bp, Homo sapiens
gcacatcacattggctgatgtggatggccaggtatactctgtttgaagtggcaagagactggtaaaaaagagacaatcgaggggtgaggacaattttgacaacttttgaccactggcgcggctcgga

SEQ ID NO: 487831 - DNA, 131 bp, Homo sapiens
aatttgatgatgtcaatgtatgaagctgtttgttgaattctgggtagagcgtttggcatgatcatggggaaggtatagaggatgagactgggagctgagcagctccatgccaattgcgatgaagggcgagg

SEQ ID NO: 487832 - DNA, 393 bp, Homo sapiens
ccccgacgagggaagagagctaaacagcacccacccctaatgtgtttttagctcaaaaacatttatctcaaagaggggattttgcagaacacatactgccccccttcagtataatgagatttatctccctctatacttagcagtatgatttggggaaagcctccaaattgttacatgacttatggcattttgttgtaaaagagaatgagactaaataagattgaaaataggcgccagctttggacttggattctgttctgaggtaagcattttagaaatggaactgaaaaggcctttcaggagataattctgttctctttaagagagcttatggaatttttatttatcaaaaaaatatctttgtccctcattatgttgtataagcatttgggc

SEQ ID NO: 487833 - DNA, 337 bp, Homo sapiens
gtgtcactcactgtactgtagttgatgtgtgactaggaggtgttcacaatgcccagtgtgccagtgatatctagtaaagaagggtttcctaagtaagtcccttccgcgcttgacattggagtgtggatcggtgcaaaggaacacactgtcagtataacttcttatctggcttgggatgtactatacacaaggagcagcagggaacaagcagtggggactggaaggcaaagagcacactcaaccccccacctggaaggtgcaaagaaaagccagcagtcccatgtatgtactcctgtgctggacttgtttcctgagtaacccagcaggtcccttataa

SEQ ID NO: 487834 - DNA, 735 bp, Homo sapiens
tctcccctccccccctttcaccattcccctcggaggcgctttccccgggcaggggcgagccggtctcaccccagggacacaaccacagagacccacgaagagccataatgcaagaaaagagaagacacaacaaacaaaaaaacgcgagacacaaagaagcgatgaagacaagcagaaaagaaccatggatgacataaccaccacacgaaagacgaaagaaaaacgacacaaaaaagcaacgaagaaaacagcaacgagaaagaaacagaaaaacacacaaaaagaaaaaagacaagaacaaaagacaagagaaactacaagaaaaaaaacatataataaacaaaataaaaaaaataggaaacaaaaaaaggaacaagaacacaaaaaaacacaacaaaaaacataaaaaacataaaaaaaaaatcaaaagaaacaaaaagaaaaaataaaaaaaaaaatacaaaaacagaacaaaaaacacaaaaacagataataacacagagacatataaagaaaaaaaacaaacaaaaataaaccacacaaaaaaaaaggcaaacagaacaaacaaagaatgaagaaaacagagccagtaaaaaccaaccgaaaacagagaaaaaaaatagaaaaacaaacaaaaaagaaccaaaagaagacaaaaaaattaagaacccatgagacaaaacaaaaggaaaaataaacaaaaaaaaccccaaatactcaaaaagacaaacggag

SEQ ID NO: 487835 - DNA, 430 bp, Homo sapiens
  misc_feature (21)..(21): n is a, c, g, or t
tgaagtctttatggatcacanatttaatctacagtcttatagtagtctcttacatcattatgcaccagggacgaattataggacctccccaaacagttgatgctgaaactatagcttatatatagagatcattacattttttattcatatatacttaggatagaatttgatttattatttagacacaagagattaataagaatacagtaaaactgctataatctactgaaagaaatattatatgaatattatctactttttaagtattatctatcatatctatctatcatttatctatgtatctatgtatcatttatctatcatatctatctatcatttatctatgtatctatctgtgtatctatctgtgtatctatctatctatgtatctacctgtatatatatccatctatctatcatctgtcgacgc

SEQ ID NO: 487836 - DNA, 553 bp, Homo sapiens
ctagctatgtcgaccagcgtcgccagcgtcgcggtcaggcactgtgatatcccacatcccggaactatgtgattgcggtgcatgaaccaggtgtgccttcgcgggatccatgccttgaggaccactgaacgccccgccgacatgcatgccgtggtactcgcggtgtgccttggggtggcgctggacggcgggcccgaggcctcgggctgcggcgcgctcgcggagcgcagaagcagtgccgcagagttcgtcgttcgcctttctaccaggcggtgcgcgacctgttacccgtgtggctgctggaggatatgcgcgcctatgtgagggcctttccactggggacgagcgcgtggcgctgactgtcttgctacttcgcgccttctgagtgacgtcttggtacctacgacggctcgttgccacgacgcatacaaaaggtgttaccgcgcatttaaccttgcatgtgctcatcgttttccccggactgggtaggctgccggccttcgggatacctcgtccccatggttgacgcgggggctatttcccggctttgtct

SEQ ID NO: 487837 - DNA, 89 bp, Homo sapiens
aaacaaatcctgtgtaatttgtgcttaaaaatgttctgttttgatgtgtttccaggatttgtttcaagcacaaattacacaggacctat

SEQ ID NO: 487838 - DNA, 610 bp, Homo sapiens
  misc_feature (429)..(429): n is a, c, g, or t
  misc_feature (451)..(451): n is a, c, g, or t
  misc_feature (579)..(579): n is a, c, g, or t
  misc_feature (594)..(594): n is a, c, g, or t
  misc_feature (598)..(598): n is a, c, g, or t
gcaaaaattggctttatttttttcttaaaaaaaaaagtctaccaaaggaatttgcatccagcagcagcacttagacctgccagccactgtcaccgagcgggtgcaagcactcggggtccctggagggcaagccctgcccacagaaagccaggagcagccctggcccccatcagccctgctagacgcaccgcctgaaggcacagctaaccacttcgcacacacccatgtaaccactgcactttccaatgccacagacaactcacattgttcaactcccttctcggggtgggacagacgagacaacagcacacaggcagccagccgtggccagaggctcgggggggctcaggggctcaggcacccgcccccacacgggggccccgtgggtgggctggccttgtttctacgcaattttattccaactccatntctcccaaataccgttgatgtnattatttataggcaaaccgtctctttatttagaaacactgataatacactgcggtgggcattcttttccacatcctatagaccctgggtttggaaactcaggcagagtgggacctctagacatcactntcagcttgctacttnaggncacccataggtc

SEQ ID NO: 487839 - DNA, 1196 bp, Homo sapiens
  misc_feature (800)..(800): n is a, c, g, or t
tttttttttttccctaaccaaaataatttattgggaacacacagtctacagcactctatgtacaagcacatggacgcctcctggactatcctcaactaggggacccttttcttccccctttgccttggggacctcttctatcaaatctttcaggtacgggatctcctgggccagggaatccgccctctctttataaagccctcggttcttcttttccagactcttgtggcactcaccagttaagagcctccgggctcgcgcccatcttcttcgtgggggatacctaggtggcgtgcgtggtctgggtttggcctccatttttttacagagcttctatatccagatttctacagcccttatacttgtgggcgggctacacatcttctctccagggaggatcgctaagggttggggcacgggcagaacccacgagagaacacctgggaagatggggaggctccaatttgggaagagcccctgggtacaggggctgtggctgaggaagaccccagataggactctggggctcatacagatgccactatcattatctgaaggggtgtcttcctcctttatgccctgagggatcatgggcaacgtaagcatgtgtagtctgggttccaatctccttcagtgatatccacttcactggcccgagtctaaactaaggggaatgcatctggacctggcgggaccaggacccccgtgtgcgacaacgggcaccgacggtgtcacgaagcgcacacgggggacacctgggacgcgttcgggtaaaccttccaggcacaatgcgcaatcgnggtcacacgacatgcggaggaccagcaaaaacgccccggacaacggggcacaaaaactcacaaggcgctgccccagcgcgtgcaaaaggcaccagggaaggagcccacacaacaatacccaaggggggaccaaacaggagacacgctctaaaaacactgttgtccaacacccatctgccgggacagaaaacacctgtagctgttggtgactagagccaaccaccacaagcacacgatgagccaccacgatggcggaaacaacaaagggtggagacgcccgcatcaaaaaacgactgatcacacaagcgacagatagtcatcaacctccagaacattgatccaaccgcagacgagatagttccttgaactgtgacgcgcgtgtctccagtctcgcgt

SEQ ID NO: 487840 - DNA, 345 bp, Homo sapiens
  misc_feature (1)..(1): n is a, c, g, or t
ngcgctctctcttgtgtctaaactctaccacagctctggctccattcacatgtcatctggcggtgaccctggcataactccgttttatttctacttggcttgctcctgactcatgtccctacttgtcggtgagtcgctctgtatttgcctgttcggtgctgtttggaatttttctggcgttcatgccagtaagtctggtcccctgcattcctcacactgtctgtgcccttatggatgtgtccattctagcgcggcctttgagacatcttcataatgggggagagagagagagagagagagagagagagagagagagagagagagagagagagagagagagagact

SEQ ID NO: 487841 - DNA, 156 bp, Homo sapiens
gtggatctagaggatccctcacacgcacttgggagtcgtgtgttggatgcagcaagcggtgtgtaaactccatctaaggtaaaataacggcacgagaccgatagtcacagtacgtaaggaagtgaaagacttgagagagagtccagttggtgggta

SEQ ID NO: 487842 - DNA, 602 bp, Homo sapiens
cgaccagagaaacagcgagcatggcgagtggcctggtgcttccagaagaaacggcgctgactgggtggggccactccaggcagcagcaagagaagtgtgagtggaagggtgtggtgggggctggggagctgctggacagaggactctgaagggcatgcagtagggactgagcaggtgccacgccaaacacggggcgggccctggagacagagggagcagcaggctggggatgtgggacgggggtgacgtgggacgcgggtgacgtgggatgtggcagagacggacttgtgcaggaccccagggaacctgacagaaaagctgggtggagacagtgactgccatgctgaggagcaggctgagggtgaggggagacagggccatttcaggaatgtggaacgtgggatgcctgagggccttgagtgggatacagaacaggcagatgcagaaggagaggcttcaggggggccgtggctgaagacgggctggggagacgctggccctcagaccagtggggaggagaccctgaggggaccagtcctgggggatctgggcagagcctccccaaaaatgctggttgcctcatcgggtgatgatagccaggg

SEQ ID NO: 487843 - DNA, 372 bp, Homo sapiens
  misc_feature (97)..(97): n is a, c, g, or t
  misc_feature (272)..(272): n is a, c, g, or t
  misc_feature (280)..(280): n is a, c, g, or t
  misc_feature (367)..(367): n is a, c, g, or t
  misc_feature (372)..(372): n is a, c, g, or t
gtaggccttccttctattaagtaataccaagtattctttgaaattctttgagctcctaatgtttaagatttgtgtttttcgacttacgtttcctcantgtgtaacacgactcctggcatacagttgatacgcaagtatttatgcatggggatttatttttcctaatcagtattatatgaattaaaagattggttatatcagtttctgtgtttcgttatttgcgatcttgaaatctctagcagtttctaaattctttcatcacttcagttagngtgttganaagttcccatcaaaataatatcctcaaattttccagtattaaatacaatttgttaagtgttctgaccatggatagtaggtgtatttnagcgn

SEQ ID NO: 487844 - DNA, 195 bp, Homo sapiens
  misc_feature (63)..(63): n is a, c, g, or t
  misc_feature (65)..(65): n is a, c, g, or t
  misc_feature (69)..(69): n is a, c, g, or t
  misc_feature (72)..(72): n is a, c, g, or t
  misc_feature (187)..(187): n is a, c, g, or t
gggcccgaggcgaactctgcccggatgaggaacaaagcagtggggcaggcgcgtccccaagcnantgcnagngttgggcagccccttcccgaagcttctggacggaaggcccaggtgttccccgagatgccccaacccgtggcgggtgcacggccaccgcctcgggagaagttgggcggccccgggnaccccgga

SEQ ID NO: 487845 - DNA, 533 bp, Homo sapiens
gctttctgggagtgctgcttgtgttaggtttactgtgaatgattcccaacacactgaggccctggtaaatattctggaatctggacagaagccatacagcaggcaagcgactctgccacagcaggcatgccctgtggcaccgagggcagcatgcctcttgacaggggcttcctcagtgtttcccacgtgtttgtccaattcagctaagttcgagtcacaagtgcaggctgtggtgccagtctgtgtcacgtgctgaagcctctgtctttccaggttggtcacatgagaaggtttgctttgtgtgcttgcagctgttttcctgtctttgccaagcccaggctgggaccataggcagtgaagagaaaatgtttttttccatagcatttgagtagatatttggcagaagggaattactcaacccatggatacagtgtaattacccacagttctaacagaatggtacagagaggccaaatcctttgtggaatgagacaggtatgaataaataaatgtgatattacctgccctaaaaa

SEQ ID NO: 487846 - DNA, 130 bp, Homo sapiens
aggggagacgcaggagtatggctgtggtgctggcggcgacgcgattgctgcgggctcgggtcttggggctgtcgcggctgaggtttggacctcctgcgtacagacggtttagtagtggtggtgcctctgg

SEQ ID NO: 487847 - DNA, 140 bp, Homo sapiens
caaatgcaatcataacctgctactccccttcaccagacatgtgcttagaagctccagagtggaactctcccaccaggagactgcctcgagagacaacagtctatttacaacaaaaaggacactggcaatgaaactctact

SEQ ID NO: 487848 - DNA, 1070 bp, Homo sapiens
cggagtcggacgcaggccagacatgtggaccctggtgagctgggtgcgccttaacaggcaggcctgatgcggctggaacgcggtgcccagatggtcagttttgccctgcttgggtctgctgcctggaccccgtgaggagcctcaggctacatgtctgctgacctgtcctccttctggacatagatggcgccacagtcactgatcaggcgatcttgctggtgaaccccgtgtcaggtttggtagctcacctgactctgtcggtcacatctcttgcatctattaccgtctcatgggacttccatttgctagccccttcccagaggaccgttgtcaatgcgggtgaatggacattcattggctgcccacggggcttctcagctgaacgtgcataacgggtcagaatccttgttttctccaaaacatcaagtgtaagcaactcgcgtgaggtgccaactcattgctccgtgagtagttgagttcggaactgcccggtagcttctcctatcagtggctggtgtttattgtgtcgactgagtcgtcctggggggtgcgtgggcccttgacctccagagcttcctgtctgtgcaccgactggggtgtactgtctgtcccgtcacggctgccttctgcgatctggttcgttatcccggctgcttcagcatcctcgggcactctgcccttggccaaagaatgctcgctgcccatgaggactagctggtcattgtccttgtccagcctcggccatgtgttccggacgctggtcccggctgcgctgatggttcaagcctggctgagaactgcgcagcggggaagtttttctgtggccgatgcccaacgcacttgtgctcaatacgtgatgttagcccagacactggttttactgtgccaagaagtccttccgggacccccaggtatcatatagggctgggccacggggaataacgtacttggttcccgggactcggcacaaaggctaagggccatacccggtttggcaactagtctcggttacaagtttaggctgcgtgttagcccaataatatatcaccgagtcaagccaagagaccgga

SEQ ID NO: 487849 - DNA, 1036 bp, Homo sapiens
  misc_feature (29)..(29): n is a, c, g, or t
  misc_feature (84)..(84): n is a, c, g, or t
  misc_feature (112)..(112): n is a, c, g, or t
  misc_feature (130)..(130): n is a, c, g, or t
  misc_feature (154)..(154): n is a, c, g, or t
  misc_feature (158)..(158): n is a, c, g, or t
  misc_feature (184)..(184): n is a, c, g, or t
  misc_feature (189)..(189): n is a, c, g, or t
  misc_feature (197)..(200): n is a, c, g, or t
  misc_feature (221)..(222): n is a, c, g, or t
  misc_feature (236)..(236): n is a, c, g, or t
  misc_feature (251)..(251): n is a, c, g, or t
  misc_feature (257)..(259): n is a, c, g, or t
  misc_feature (261)..(261): n is a, c, g, or t
  misc_feature (264)..(264): n is a, c, g, or t
  misc_feature (268)..(268): n is a, c, g, or t
  misc_feature (271)..(272): n is a, c, g, or t
  misc_feature (274)..(274): n is a, c, g, or t
  misc_feature (279)..(279): n is a, c, g, or t
  misc_feature (284)..(284): n is a, c, g, or t
  misc_feature (292)..(292): n is a, c, g, or t
  misc_feature (296)..(296): n is a, c, g, or t
  misc_feature (299)..(299): n is a, c, g, or t
  misc_feature (305)..(305): n is a, c, g, or t
  misc_feature (307)..(307): n is a, c, g, or t
  misc_feature (317)..(317): n is a, c, g, or t
  misc_feature (330)..(330): n is a, c, g, or t
  misc_feature (364)..(364): n is a, c, g, or t
  misc_feature (406)..(406): n is a, c, g, or t
  misc_feature (437)..(437): n is a, c, g, or t
  misc_feature (580)..(580): n is a, c, g, or t
  misc_feature (925)..(925): n is a, c, g, or t
  misc_feature (927)..(928): n is a, c, g, or t
  misc_feature (949)..(949): n is a, c, g, or t
  misc_feature (1036)..(1036): n is a, c, g, or t
tttgtaattgttcatattgaattcaagcnaaataaagaaaatccaagttcctgtttcagtctcaactggccggggtattaaagnaatgcactcctcttttaggaggcatgtntcaagttgtcagtgttgnggccattttttcttgacccttaantctntgcttcttgtttcagcaataccaggnatgtnttttgtannnntttttttatttttttggtttnntttttttagttgtntttgttgttggtttntggttnnntnttnattnacnntntgttntggtncatatagntttnttnttattntntggggggggngtgaggggcagcngggtggctttcaaaagatccctggactgtgctgngagggcttctttagggctttccatgatgctgaatagccagtnaatgaacttctgggtctgttccttccatggntctttctgcagcagcagagccatgctattgggaaggagagtgagaacctcctgcagagtgaccctgtgcattggactcctgccaaggaagcttggtactggcccagccgggccattctcctgatgccatggcaaccaactggnactgaggcgcgaggaggagaggggcagtgtggtcagcccatgcaaccactgcggttgcaaatatcagcaagaagaagtccaaagcctcgtcaagagccgtattgtgaaaggatgttgactggtaagcaacatttctaatataacccatcagttccaagagccactccattctcttcaaaacgcccgtattggcatggctcacaatccgtgcctggtataagctgtgcagaatcatccaggccaaacacctctttctcacggtgctgcacagcaacgctcagcatatcggtcaggttcaccaaggggaatcgtccttgagagactaagtacagtttgacaaggccncnntttctatgttgctcttagtanctgggcgatccgattggcatcatcatctgtcatttctaagaggcattttgctatgctgatatacagctctagattctttctccgaan

SEQ ID NO: 487850 - DNA, 400 bp, Homo sapiens
gcgtgtagtgatatcatatagtaagaaacaatagccagacataaattataactttttcaacatgagatatttttttttggttccaaccttaatatgcttattggactcaccttccttctaggcagtataacagcaaaaggtaagttggcaagtttctttaagtcatatcccgtatggtaagtgcccaggagaagtaaaataggttatggttatcctaatacagttatcagaaatggattcaaacatacttttagcatgtcaaacatttaaataatagaagaatctgagtccggttttagaatgctgggagacctatagatatggaattccggtctgcctatgtcacataatcggtggatccttagatagaggggtgagtcccctattttccactgacacg

SEQ ID NO: 487851 - DNA, 788 bp, Homo sapiens
ggccggcggctcacgctggctagaataagtcttcagcttcccaggagagccatcagcgtgtcatggccgcatagtgtgggaagaagaactggctgtgaccgtttgtgctgacctggaatgggcccagccttgtggcgtgacatggcaggcgcccacgcccgggccgtccggttgtctgatccctacctcatggctggttggctctcttctggcatgggctccttgggctgcggatctatgtgggatctggtgtggagcgtagctgatggtggatcatcagagcgttccggagggttggagcctcccctcttacgtctctgtgcttgtggctctggggaacctgggtctgctggtggtgaccctctggtaggaggtctggcgcccaggaaaggactgagcagggtcccctatccgggtggtgcagtgtgctggggcatggtgggcactgacctgctgtcctctctgtggtacgcttgttggacccagtgggcaggacagtgagtcttctgtggccttacttacgcacgtggaccttgtgtcgctgggtactggtatgcttgtgcctctgatgtcacttacctagcccttcttgagccaactgacaggctcggttcttgcggtcatgcttcctgtggtcaaatgccttgagtggcctgactggcctgtgtgctggccctagtgcaggggttgttggggccgcctcgagtgccctgcagaccccatcaaaggaaccctggacccccgatcgacttccttgaagcgttttcccgacaggacttcttctggga

SEQ ID NO: 487852 - DNA, 191 bp, Homo sapiens
  misc_feature (1)..(1): n is a, c, g, or t
ngagagtggagatggagagtgacaaatctggagtctcccttgagtcccttcctaggaggcagtggtgctctagggcgtcagagtgtttctatgctagtctttctattaattattatgggacagcaagttaaaatttggaactttaaaggatatcggaaagggggctcaaacaataatacaaaatattggac

SEQ ID NO: 487853 - DNA, 703 bp, Homo sapiens
gactagttctagatcgcgagcggcgcccttagcttgtgctctttttcgacagcaaaagtgaattttaaacacataatctctaaatactcgtaatgcaacatgtacaaatgtctgtaaagtaattagactaatcttccgaataatataagcctcacataacaaatacacaatcgggaactcaggactcacgttgagaacaagctgtaaatagtggctgtacataggtactggacatttagaaaagaccagttatgggtcaccagtacaaacttatggctagacaaaaacacaagaacaataaaaacctcacaccaccaaaatagaaagaaaagccagaaacagactgacataatatacaaaatcacaaaacaacgagaggagggcgggtgcgggcacacaacgtaatcacctctcacttgagtggcgggccccaatagagctaggcagtccatacgtgttcttgcttctaaacaaccgtgcgtcatcactgcacgcccgatccttgatgttaccaaagacccaagcgccaaacgcgtcgcgtacgctacactgcacacacagggttgtaaccaacagatgcaatcaccatacacaaggccgcaagtggcaatatcgtcacaggacccacccaccctaccataagcacattacgcccaatcatacactgaggaagcccattcccccaccgaggaaatagatcccc

SEQ ID NO: 487854 - DNA, 862 bp, Homo sapiens
gaacacgggcataaaaatcatcaacaaagtgctggcgggctgaattcaacagtacaccaagaagataatgtgctatggtcaagtgtgatttacccaaagatgcggggatggtttagcacatgcaaatcgataaatgtgatgacatcagtggaatgaaggaagagactttatgattgtctcaatagatgcagaggatgttgatagattcggtatcccttcatgatgaaaaaaaagctctcagcggattagacatacaaggagcatacctcaacatagtagaggccgtatatgacagattcacggtgagtcatgctggatggggaagggctggaagaccttcttctggaaactggaaccagagcaggatgcccacattcaccactcttgttcagcatggccgctggaggttctggccggggcagtcaggcaagagaaataaataaaaagcatctaaattgaaggggagtaagtcaaattgtctctttctgtagatagcatgatcttatatatagacaactaaagactttaccaaagaaaaaccttacaactgataaattcagtacaatatcagaatacaatattagtagtattgatgcatcagatgaaaagctgaacagcaaccaggaaaccaatccattaacaatacataaaaggttacaatactcgacctaacaaacgggcggggtccacagggaaccggggacaaggaggaaaaccggggagggcaatcagggagacgaaagaatcacaacgcccaggaacgcaacggcaaccacaacacgcgcggcagaccaaaaccaggataaggcgacaccgccagacaggcacacacagagggacagggaagacaaacacaaaaaga

SEQ ID NO: 487855 - DNA, 535 bp, Homo sapiens
cggtaccggtgttccttgtctatttatattatttatgagacagagtctgctctgtgcccaggctggaatgcagtggtgtgatcttggctctctacaacctccgctgcctgggttcaagtgatccttgtgccttagcctcccaagtagctgggattacaggcgtaagccactgtgcctggccaatttttgtattttaagtagagacagggtttcactatgttggccaggctggtttccaagtcctgaccttaaatgatcctcctgccttggcctcccaaagtgctgggatcacaggcgtgagccaccacaccggcctggctaatttttctttcttttttttttggagactgagtctcgctctgtcccccaggctggagtgcaggggcgcaacctcggttgattgcaagctccgcttccggggttcatgctattctgcctcagcctcccaagtagctgggtttacaggcgcccgccaccacacccagccaatttttggtatttttagtagacaacgggaaacaccggggatcctcta

SEQ ID NO: 487856 - DNA, 160 bp, Homo sapiens
gcgcacggcgtatgttgggccgtgtgcagacccgcgtgttgcgcaggcaagggaccctcaaaataaacaggcctgttgctttgccgaagccgtctttccccaggcctgccgtccgaagttttccgccgttcggggccccgttccgacggcggaggtatct

SEQ ID NO: 487857 - DNA, 118 bp, Homo sapiens
tattgtgtactgctggaggaactcatgaaatagagggaggagagaaggaaggtcctggaggaggaagagcatgaggatgaagcacggttgaagcctgatctgaaaactcagagaggag

SEQ ID NO: 487858 - DNA, 205 bp, Homo sapiens
gatccaccttaccaccagacaaccttagccaaaccatttaacccaaataaaagtataggcattagaaattcaaacctggcgcaatagatatagtatccgcaaggtaaaagatgaaaaaattataaccacgcataatatagcaaggactaacccctataccttctgcataatgaattaactagagataactttgcatggagagcca

SEQ ID NO: 487859 - DNA, 740 bp, Homo sapiens
  misc_feature (574)..(574): n is a, c, g, or t
  misc_feature (585)..(585): n is a, c, g, or t
  misc_feature (602)..(602): n is a, c, g, or t
  misc_feature (604)..(604): n is a, c, g, or t
  misc_feature (608)..(608): n is a, c, g, or t
  misc_feature (616)..(616): n is a, c, g, or t
  misc_feature (639)..(639): n is a, c, g, or t
  misc_feature (696)..(696): n is a, c, g, or t
gcactcagcgcctttctgggcacggggcttttccggggcacacctggggttacccaggccaccccacgccttgggcctacccatcttttggacaggccagtggcccccgggggcctaccctgccaactggccctatggcgccccttctgggcaccctgattgttgccctataacgccgcccttgcctgggggaatggtgcctcgcatgctgatcaccattctgggcacccgtgagagccccatgccaaccaggaattgctttagatttcccaagagggaatgatgttgccctcccacgtttgtacccacgcttccaatgagacccaccggagagtccattgtttgccaataaccaagctggattataactggggaagggaagaaagcaccactcggttttccccacttgaaagtggggagaacacattccaaatacaagatactggttggacactgacaccaccattcaaggttgccagtgaatgatgctcacttgttgccaggaccatcatcggggttaaaaactccatgagaatcacgccaaactggggattttttggtgacatagacctcnacccgtgcttncatatacccatgatatnanctgnaaggggcnagattaaaaaaaaaaaagaattnaaccttacatgtgtaaaggtttcatgttcactgtgagtgaaaatttttacattcatncatatccctcttgtaagtcatctacttaattaatattaccgtga

SEQ ID NO: 487860 - DNA, 196 bp, Homo sapiens
cgtgataactactgcacgtcatgcctggttgatttttgtatttttagtagagacgaggtttcaccatgttggccaggctggtcttgaactcctgacctcaagtgatccacccgccttggcctcccaaagggctgggattacaggcgtgagccaccgcacctggcctgctttcattgttgggtactacgctttggca

SEQ ID NO: 487861 - DNA, 180 bp, Homo sapiens
aagatttggccctcatgcaggacaaggtcagggagcttcagaaccaggagcagagattgtcggggcctggaggtggtttggataatgccctgctagctcttcaaaggcccactgcagcccaggtactacaggccggcgtggcagaatgacctcaggaacacctccccttcatgaccagtt

SEQ ID NO: 487862 - DNA, 621 bp, Homo sapiens
cgcatcgcgatcgccttcagcggcggcctcgactcgacggtgctgctcgatgcggccgtgcgcgtcgcgggcgcgtcgcgttgcgtcgcgctgcatgtgcatcacggcctgagcgcgaacgccgatgcatgggttgcacatgccgaagcggaagccgcgcggctcggcgtcgcgttcgaatcgatgcgcgtcgacgtgccgcgcgacagcggcctcggtatcgaggccacggcacgcgagcgtcgttacgcggcgctcgacgcgatgtgcgagcgccatggcgcggccacgctgtggctcgcgcaacatgcggacgatcaggccgagcccggtgctgctgcagctgttgcgcggcgcgggcatcgccgggctcgccgcgatggcgccgcgctatcgccccgacggcgtgagcgtcgaacgggtgcgcccgttgctgcgattgttgcgcgcgcaacttgagcgctacgcggagcagcatgcgctcgcatggatcgacgacgaatcgaacggcgacacgcgttatgcgcgcaatgcgctgcgcatcgacgtgctgccggcgctggccgtgcatttcccgggctttcgcgatgcgctcggccgcgcggcgcagcatgcggccgc

SEQ ID NO: 487863 - DNA, 170 bp, Homo sapiens
attataggggtgacgaaaaatcagaataggtgtggtatagaatggcgaagtcaatcttcaggcgaggaagaagagtatgtttatgtgacataagtgacggaaaaataaattcaacaagatagtaaatagaatttaatatggtctcatgcgccctgaagatggttggcttg

SEQ ID NO: 487864 - DNA, 293 bp, Homo sapiens
aaaaaaaatttgcccccggggaaaaaagggcttcttttaaaaaaggctccttttaaacccggaagggtaatttggccttaaaaaccttttggtaaaaaaaggggaaattttttttaatttttaatttggggtggccccaaaaaacccggaaatccggggggcctccctccaataaatttggtttttatttttttggggtaaaccggtttccaaggccttttgccgggtggtttaaccttttaaaatttaaatgatggggaaaatttttggttttaaaatttaaaaaaaaatcc

SEQ ID NO: 487865 - DNA, 486 bp, Homo sapiens
tgccctccccacacccctcaccctgcagcctccccccgccccacctcatccaggagtggcacgactacaagctgcgctgggacccagctgactatgagaatgtcacctccatccgcatcccctccgagctcatctggcggccggacatcgtcctctacaacaagtgagtcctctacagggccttggtgggcaggagtggccagggcctgcccctgcccagacagggagctccaccaaggcccagcctggcccagcgggctatgccagccccatgcatgccagcccaggcccagaaggaagaagcaggagaaggaagaagcaggagcaatggagaaattggtgtgggttgaggagggaagggtccccccaggccagcaaagaggctgagggcaccctgggtctcagcactggagcgtagagccggaggggcctgagagtggctatggcacctggacacagtgtccctgcggaccagtcctgaggcct

SEQ ID NO: 487866 - DNA, 429 bp, Homo sapiens
aggcaataacgtaagtcctagtctgaaggctgaggaccaggagcaccaacatcggggggcacgaatgggatgtcccagcagttcacccttcttccccttttttggttctattcaggccctcaagggataagatgacgctcacccacatgggtgagggcagtcttctttactcaagtctactaattcaagtgctagtctcttccagaaacaccatcacagatgtacctagaaatgtggttggaccagctatcaaggcatcccgtagcctagtcaagtggacagaattagccatctcatcagtatccacaaggtattttaatataaagggatttagccggagaagcttccatggtacagtatctttttttttttttgagggggagaacaaatttccggtctgtgtggccttagaatgggacgccaaattgg

SEQ ID NO: 487867 - DNA, 258 bp, Homo sapiens
acgactatctattatataaagtcaaatccatattctttatattttgagatggagtacactcttgtacccccaggctagagtgcaatggcacgatctcggctcaccgcaacctccgcctcctgggtccaagcaattctcctgcctcagcttcctgagtagctgggactacaggcatgcgccaccatgcccagctaatttttgtatttttagtagagacggagtttcaccatgttggccaggatggtctcgatctcttga

SEQ ID NO: 487868 - DNA, 143 bp, Homo sapiens
gatacaataaataagctagatacggaaacctcactgcatgttggatgttttacccacatgacttattagtgcataagccaaaattccagtttaagtaattgcctacaatagaaagaaattttgcctgccattgggccagcggg

SEQ ID NO: 487869 - DNA, 118 bp, Homo sapiens
aggcggggaacaatcactttggctagggggactagcaaaagtgaacaaataggattacatgaagtgaaaaagcttatgtacagcaaaggaaacaatcaacaaaggtgatggttccccg

SEQ ID NO: 487870 - DNA, 362 bp, Homo sapiens
gtccaagcccacatagctaataacctatagggtagagccttgaatcgtgtgtctgacaaaagcgcttgattttctaaccttccacttgggcgcttctcatataatgtcctatttccaggcttaaatccatgctccaatatggtcgccaggaacctgaaaccactggttgtcacaggcacaaagtcccttaaagccagaggtatgcctaagaatgttgctaataatctatttttctacaccatgtatataaggtatgagtccacgcaatgcccgcgtggtgtacagctatctcatggccatatattgatagagccctgtgagcacctagaggggggcacctaaaatgtggagaagcgcgcgtg

SEQ ID NO: 487871 - DNA, 150 bp, Homo sapiens
ccatccggcaggttgtactgattattggttgctgcttggccaatggcatatgcgttggtactgtctggaataatgatggtttttgctggagacactggagtttgtttgagctcttggtgtgctgctggcaagcaataaaggcttgggctg

SEQ ID NO: 487872 - DNA, 701 bp, Homo sapiens
  misc_feature (637)..(637): n is a, c, g, or t
gagccgcggagcctcagcttccgcctggacccagcctcgtgggagccccgcgggtcctgcccagatgtggaagactgaggcctgttgaaagtgcagagctcagccctggcaccctctgttcccaagagctccatgcaggtgccacaggatggagaagaccttgctggccaaccttggtaccacggcctcctgtcccgccagaaggctgaagctcttcttcagcaaaatggcgacttcctggttctgcgcctctgggtcccgtgggggcaaccccgtgatctcctgccgctggcggggctcagccctccattttgaggtgttccgtgtggccctgcgtccccggccaggccgacccacagccctctttcaactggaggatgagcaattccccagcataccggctctggttcacagttatatgacaggcaggcgcccactgtcccaggccacaggggctgtggtctccaggcctgtgacttggcaggggcctctgcgacgcagctttagcgaggacaccctgatggatggcccagctcggatagagcctctcagggcaaggaagtggagcaacagtcagcctgcagatttggccatatggggcggtcaagagaagaccccgctgggatggaagcctccnacatgcccatatcttgcttgccccgaacgagcagtgacccggtgttgctgaaggcccctgctcc

SEQ ID NO: 487873 - DNA, 691 bp, Homo sapiens
ggaccagaagcatattcctctgcagacactatggaagttcaagtggtggatatgccctgggaatggagtatctgagacaacaggaagtttcttacatgcgagatttagactgctcgaaactgcgtgtgcgagatgacatgactgggctgtgttgcggacttcggcctctctatagaagattttgacaggtggcgattacttaccggccaaggccgcagtgcgtaggaggatgcctgttaaagtggatcgccatagaaagtgttgcgagaccgagtctacacaagtaaatagtgatgtgtgggcatttggcgtgaccaatgtgggaactagctacagcggggagaatgactccctagtcctggggtccagaaccatgagatgtatgagctatcttctccatggccagcaggttgaagctaggccgtaagactgcctggatgaacgtgtgcaagatttaatagagtgaaaacagagctcccataaaatggaaggagacccaaagggggttgccgttgccggctcgaatgcctgggtttctatcccaatcattgtccctccccctgtactctcaggtgatagatattagctatttctttacctcctgtattgcctaattagcattttagtgagctctctttactacctgattggtcgggtgtgagctaagttgaagccctgtgtttaaggtggc

SEQ ID NO: 487874 - DNA, 413 bp, Homo sapiens
  misc_feature (7)..(7): n is a, c, g, or t
cgcttanaaactgagatagaggcagccaacagcgatacaaatttccctctactcgatgagatgggggatcccgctgcaggctgatgaggcacccatgagaacggccggaaagcatgcatcttagaaatagcccctcaattccaggagtcagcatgccaaagaatgaggctggagacaggtagctccgagggaggacttctggcatgagatctcggcacggcaagcccagcatcgcctcagcccagacaggctcgagcaggagatcaagcgggggctgcctttcaggagtcacctcctgagccacttcagagttctggaagtgaccacggatgcagggtggaggaatagacttctagttcattctgggacacttgagccagagcgttgaaagcttggcacgaccagactagaaa

SEQ ID NO: 487875 - DNA, 1143 bp, Homo sapiens
gggggagtatgccgtgccttcgatgcggtggccctgttccttgtgggaagaacttcagtgggcatcttggcatgtccctcctcagctcctggcctgacctctgtacgacagcattgaggagaccctgccccctcgacctgaccacatatacgatgagccctgagggagtggctagccctgtccctctatgacatgccctgcaggagcccctggtggtgatgtgcatggaggatgtgcagtgctgacaagcttgacatgggacccttgctgtccttccacgcatgtccatgccagcctgggcagtgatttctctgcttcttggcttgtgcagccaaggaactgagtatgacaatgtctgtactaaatgaaaggcccaaagtgacagaggcagcagagggatggtccaccgccccttggcttcttgctggtgactcctcctggccacttgcatcagaagaacctcctcgtgccccttctggagccctgaggcctggactgtcttacgtatggggctgataaattgcctctcccagggacctgcttgggtgagtcaccatcgccaaagcaggaaagggtgccctgcgagagaaccaacctcctcctatcttttttccagattccatcctcttctctatcccccaagctgacggaggaaccttgtgggcatttaggggcccgatgacacaaaggatgtcagccaattgcatgggcctgacttggctatagccacgccttacgctgccttgctgactggccactctcacggtgctccagcccttgcgggacccagatgcaccccaagtgtggcaactggcgtccaggataccctggccaccttttccacaactacctcgagtcggccattcctcgcactttacaagaaccacaagaaaacatcacttaaccttcacacatcacacttaactgctacaatccatcattacctcacacaacaacacttcaccagaccgaatccactcccacactctcatatatacattcctcaactctacctcatccctgccaccccccatttaccagccctctcccctctagtccgctctacacttcataccatgagacccatccttctaacttcatcttacgacaatactcgttcccttaatctcgctatcccctccc

SEQ ID NO: 487876 - DNA, 183 bp, Homo sapiens
agcaacagctcaaccactcccaagacgtccatgaaataacctactcgatctcctcagctgagccctgcacaactgacaaaaggggttcaagctgcttcatgctgactgatatcggctgaccctctctatacggaagtgatgataaaaatcaggagcagaacagggcatcaggtgagctgtcct

SEQ ID NO: 487877 - DNA, 628 bp, Homo sapiens
cctggtacggccccggaatttttgggatctcagagtggggcgcgcttgactgacaggctgagaggcgtgcgcagttgcagagtgctgtgctcggtgtcagaggccttccacatcactccatgacccctatagccctgtcgctgtcagctgtcaacaaaggatgcgaatgctggcctgcttccatgtggtgcttctgtgtcacccagaggtgagcccagagccaggatgggggactccagggacctttggcctcaccttgactccataggagaggtgacaaagaggacttgctgctcaaatctaagggaacctgtcaagtcgtgtggggtcaccggaccaaagctatgggcctgtctgcaggttggctgcccctatgtaggctgcggagaatccttcgctgaccacagcaccattcatgcacatggcaaaaaagcacaacttgaccgtgaaccttgaccacgttccgacatgtggtgtaacgccatgtgagaaaggaaggtaattccttggaagcaatcgtagctgagtagccccatactgatggagatccatcataccaaaggttctcatgaacaaggacatccccggaaagacacatacaacaccataatgaaaactagtacctatc

SEQ ID NO: 487878 - DNA, 507 bp, Homo sapiens
gcacgagcaagttaaatactcaaagcacccgtagccgtcgatgcgtcttgttctcctacgcttttctctttccttcaatgcatccttgaaaattgcgaaagtgccaacgaaaaagaaaaatacagtaaaaaaaaaagtcaaacgccaatgaatatatacttgttgctacgctttcggtttcatcaaataataagtagtatacaattagccatatacagtatcaataataaggaagttacgcgactttaaataaaaggattgttctaatatgtagatatgtgaatggcggcttgataaatcaaaatattattatttttatgcataaaaggaccccgatttcgattttcttgcttgaacttcacttataccctcaacgaaatcttcgtgtttaacggaagattgcccattccttaaggcaatcatacctgcctccacagttaccgcctttaactgggcaccattaaactcatcagtagacctggcaagttccccccagttaatatcatc

SEQ ID NO: 487879 - DNA, 585 bp, Homo sapiens
tggttacttcctccttattcccgccgctgcatgctgcgcatcatgacgggaaatcgtgcacttgcagtgccggtgcatgtgcggcaaccaaatcggcgccaagttttgggaggtgatcagcgatgagcactggcatcgaccccacgggcacctaccactggggacagcgaccatgcagactggaacgcatcaacgtgtactacaatgagtgccacctggctggcaagtactgtgccccgcgccgtgctcgtggatctggagcccggacaccatggactcctgtgcgctacggggccctatcgggcagatcttccggccggacaacttcgtaatcaggtcagagtggtgctagggaacaaactgggaccaaggggcacatacacagaaggcgcggagctggtaggactacggatgacttggatgtaagtagagaaaggaggctagagagctgtgactagactgccagggttaccagcatgaccaactcactgggtatggatggagatggaatctagagatgggtaccctcctcatcacaagatccgggaagagtaccagaaagatcatgaacactaaaggtgtgcc

SEQ ID NO: 487880 - DNA, 226 bp, Homo sapiens
gtggggtgagaatatggcattgtctttctgtctccaaagttgattatatgttgtaccaaaccagattaaaaataagcaaactctgtggcaggagtcaactttggagccagacgacaaccatctgagcatcgtcaccctggaggaggcccccttcgtcatcgtggaagacatcgacccgctgactgagacatgcgtgaggaacactgtgccgtgtcggaagttcgtc

SEQ ID NO: 487881 - DNA, 381 bp, Homo sapiens
  misc_feature (6)..(7): n is a, c, g, or t
  misc_feature (11)..(11): n is a, c, g, or t
  misc_feature (18)..(18): n is a, c, g, or t
  misc_feature (75)..(75): n is a, c, g, or t
  misc_feature (77)..(77): n is a, c, g, or t
  misc_feature (161)..(161): n is a, c, g, or t
  misc_feature (255)..(255): n is a, c, g, or t
  misc_feature (282)..(282): n is a, c, g, or t
ccgccnncgangtgatcngtggcctcagcgaagatgggccgggcagggaccatggcggtggagcagaggtggcangngcggggcggctggcggtagaggaggctgtggtcctcagggggctgtaggtggaggtatggctcgggcagcagcgggaacggccnccccttgactgcttccagtgaacaaacctgctgttcctcctcatccagctgccctgcccactttgaaggaacaaatgtggaacggtgtttcctnccaccacgaggtgccccccctcatcanggaagggtgagcccggcggaaggggtgaccccctcgttccaaccccccctccttgccgctatcgccgtttaacttggcgactccggtattgagctcttg

SEQ ID NO: 487882 - DNA, 203 bp, Homo sapiens
aggcctgggaaattcctttcactgttcgcactccgtcaaccccatcacgggtttattcgtgttcatcctgagcacaattgcaatatagcaataccagcccatccaacagatgtaaacccctgcgcgacgaaaaagacaaaaaggatcgtttctcgttgttcactgtccgtcatggccatcgatgcattattcgtattcattat

SEQ ID NO: 487883 - DNA, 609 bp, Homo sapiens
ggccatttcctgtttctctgcagtttatcctacagctttgggtgtgtggccgctgccgggcatcggcttccagtcctggcggagggcgaggcggcgtggacagcggcccggacccagctgccccgccgccgaatgccggctgcccgtccgccagcgccccgagcctgccgcattcctattctccagctgccctgcctgacgcctgaccgaaggttaacagcagagcggccctgatagcaggccatacaagtagtagtaggaggtcgggagacgggcagcttgtacggtaaaaactagagcctaactggattcatgtatacacaaacccagatcgcatatcccctgggagcaaatataatcgcctttacctggttcgttcagcaccaactctaagttacttaggccacaattgtctatttcggtcacgcaatgtgcaacacgcacctgggtggaaacatcgtagggagcactacaataggggaactaacaacgcctggcaacaacagcacacgcactcacataggccacgacattaacacacccccgtaattacctaaacccaggcacaaccagcactgctagtaccacgaactttggataatcccccta

SEQ ID NO: 487884 - DNA, 213 bp, Homo sapiens
ttgcgaattatatccccacatagtaaatacatatccttgctacctagaaatgataatcatcactccccctgctgtctgagagcgcttctcctaccttcacactggctctgccacaaagctaagtataagtagaagtagaagccaagactcaccactagcctgtacatttatcagaggtgaaaacaggagtcagagtccccacaccagcagaga

SEQ ID NO: 487885 - DNA, 722 bp, Homo sapiens
  misc_feature (2)..(2): n is a, c, g, or t
  misc_feature (108)..(108): n is a, c, g, or t
  misc_feature (136)..(136): n is a, c, g, or t
  misc_feature (187)..(187): n is a, c, g, or t
  misc_feature (195)..(195): n is a, c, g, or t
  misc_feature (206)..(206): n is a, c, g, or t
  misc_feature (258)..(258): n is a, c, g, or t
  misc_feature (311)..(311): n is a, c, g, or t
  misc_feature (323)..(323): n is a, c, g, or t
  misc_feature (330)..(330): n is a, c, g, or t
  misc_feature (351)..(351): n is a, c, g, or t
  misc_feature (360)..(360): n is a, c, g, or t
  misc_feature (395)..(395): n is a, c, g, or t
  misc_feature (397)..(397): n is a, c, g, or t
  misc_feature (409)..(409): n is a, c, g, or t
  misc_feature (416)..(416): n is a, c, g, or t
  misc_feature (426)..(427): n is a, c, g, or t
  misc_feature (430)..(430): n is a, c, g, or t
  misc_feature (434)..(434): n is a, c, g, or t
  misc_feature (476)..(476): n is a, c, g, or t
  misc_feature (486)..(486): n is a, c, g, or t
  misc_feature (499)..(499): n is a, c, g, or t
  misc_feature (507)..(507): n is a, c, g, or t
  misc_feature (511)..(511): n is a, c, g, or t
  misc_feature (514)..(514): n is a, c, g, or t
  misc_feature (527)..(527): n is a, c, g, or t
  misc_feature (542)..(542): n is a, c, g, or t
  misc_feature (554)..(554): n is a, c, g, or t
  misc_feature (570)..(570): n is a, c, g, or t
  misc_feature (573)..(576): n is a, c, g, or t
  misc_feature (614)..(614): n is a, c, g, or t
  misc_feature (623)..(623): n is a, c, g, or t
  misc_feature (690)..(690): n is a, c, g, or t
gnccaagagtttttcaagtaaagacatgctcttctctcttctgtataaaactttacgaaataaaggcaaaagattatgtacatcttgctggaaaatgctgcccagggntctggagagggtggctgcccgggctccnttcactgtccaggtcctgaaagagtcttgttcatgaactgtctcttcacanagcaagtncaccacttgcngggtttatcattctgagggtcgaaaactttctcacaaagtctcagtccagtntcttgccttagctgttgtaaataggctctcatcacttcatcttcctgtttgtntgcaggtttggnataaatngcgttaagtggaaaaccaggntctccaggnatgggaaaattagtgattcccagcgtatacatttntntctcaccttggnttttggnatggcactgnngcngtgncttcagagattcagaaatgtagagagtgatatatatcaaggncctatcagcntcattcttaattncatagtgntggnggnagacattggcctngaagtaatagagggnttcatccacaanagctgtgtctgtgggntcnnnnggggcaggccctttgaattgacttctgacaggcaacanttccatgtntccgatgagtttggtatcaggatccatgacacaagagtggtaagccggcatctcggcggcgcccggntttcaaccagacgagcaggatccaggtacagc

SEQ ID NO: 487886 - DNA, 331 bp, Homo sapiens
  misc_feature (49)..(49): n is a, c, g, or t
ctaccttcccgctgggcaagctcattcccggctgggagacgatgctgcngctcatgcacccgggcgatgagtgggagctctatatcccgccggaatacgcatatggcgaaaagggcgtcggccccgtgccgcccaacgccaccttgatattcaaggtggagctggtgtcggtgaagccgccgccgaagagctgaggcgtcacaggcccccgcgcccgcccttatttcggcgcgcaagcgcagggaatgcgtcgatcgggatcgacctcggcgctctcaacgtagaattccgcgccgccggggctcgccgcatagatgatgaactcattggc

SEQ ID NO: 487887 - DNA, 333 bp, Homo sapiens
  misc_feature (21)..(21): n is a, c, g, or t
  misc_feature (40)..(40): n is a, c, g, or t
  misc_feature (82)..(82): n is a, c, g, or t
  misc_feature (93)..(93): n is a, c, g, or t
  misc_feature (119)..(119): n is a, c, g, or t
  misc_feature (144)..(144): n is a, c, g, or t
  misc_feature (161)..(161): n is a, c, g, or t
  misc_feature (217)..(217): n is a, c, g, or t
  misc_feature (327)..(327): n is a, c, g, or t
taagacagagttttactctgntcccccaggctggagtgcnagtggtgcaatcctcagctcactgcaatgcctcccaggtgantctcctgcctnagtctcccaagtggctgggattatangcatgcaccaccacgcctggctaanttttgtgtttttagtanagatggggtttcgccgtgttggccaggctggtcttgaactcttgaccttaagtgancccctcgcctcagcctcccaaagcctcagcctcttacagtgttgggattacaggcatgagacactgtggcccgggatgattttcagtcacagttttttgttacgagtggnaaatgc

SEQ ID NO: 487888 - DNA, 146 bp, Homo sapiens
tttgggctgttttgggccccccccccggggggttggggtcgggatcaaacccttttggcctgttatgattttgaacctttggcttgaaccccaagggaatttttttcctgggggcccaaaaaaaaggataattttttcctgcggga

SEQ ID NO: 487889 - DNA, 146 bp, Homo sapiens
acgcgccactagctcatgcatagggattcaacttggtggtcatctgcagtcccaggcacttggtgaggctgaggcgggagaactgctcgaactggtgaggcagaggtgcagtgagccgggactgcaccactgcactccagcctggg

SEQ ID NO: 487890 - DNA, 157 bp, Homo sapiens
gggcagctgggcacgcaccccaagaaggagcccatgggaggcgctgaacacggcgcagggcgcgcgcgacttcatctacgcctgcatcagaagatgctgcaatgcgtcattgctgcaaatgataccccgaatgtttttccagactcatgttgttgat

SEQ ID NO: 487891 - DNA, 429 bp, Homo sapiens
agctggttggtaatcttaacttttagtcattaaggaacatttttaagacaaaactctaattcagctacttacctggaaataaagctcaggctgatgatcgctctctaccatcatagagaggcaggaaaaaactcacactcaccttctctgtcagaagcaagttgaaactcaagaaagaaggtgcctgctctccatcgtcatggaagcaggaaaacttgccttccttgttggaaatgagtaaaacttcagaaaaggagttgtacagcaaaataacttcaaatagcaaccaaattttgggagatcagggactctctggaggggagaagctccccaagctccacaaattagcctattggcttgagaaataaagataacccaggttggtatcaagcaaaaataaaagctttatcaaaggtcaaaaaaaaaaaa

SEQ ID NO: 487892 - DNA, 216 bp, Homo sapiens
taacgtaacgcttcatgactgaatcatggatctccatcatcacagtagagaaaaagaaagacaactctccttgtttgcataatgtatcgtttatgaagcatattcatacagactatctgaaaataaaatcagaattaaaaagacaattcaggctgggctcagtggctcacatttataatccctagaacttttggaaggctgaggtgggaggatttg

SEQ ID NO: 487893 - DNA, 107 bp, Homo sapiens
gtctcttctggggcctggttctgaaagttcttccatcttgtggatttctgacaagcagagttggggttatagtggaagaagagtctcccctgagtgatggtgaggtg

SEQ ID NO: 487894 - DNA, 352 bp, Homo sapiens
  misc_feature (352)..(352): n is a, c, g, or t
cccacatgcatgtgcgctccgaggaatgggatataatgacctctgaggccaacccatatgacagcgtgagagttcttttggtgtgctccaagaacttaaagccacggagaagcctctcatcttatggcactgacaaagagaagaacattcacacttaccctggaaggggtgaagcccactgatgaagagctggccttgtttcttgtggagtcaagtgaagaagcaaagaagcaccttctccaagtgcgaaagtgcacctcaatggcacaagggaaagcgatgatcgagacttagacgggtataatccctgagaaccagaatgtgacttgcgatggaaagagactggaggggn

SEQ ID NO: 487895 - DNA, 231 bp, Homo sapiens
cagatgtaagagaagacggcaagtaaggagaagcaagggctaaaggtggactggatcttaaaaattgcgggggtgggatggtgcctgcctaccttgagagaagccagggtcccacagtaaaggacacttatatacaaacaggatgaggttccctgcgtctgagcacggtgcagccccacatgatgtttgtagtgcaaatgaaaatagactcccatttctccataaggcgca

SEQ ID NO: 487896 - DNA, 126 bp, Homo sapiens
ggcaccattgtgcggcaaaaagaagtgagcgggagatggatcacagcgaaggagtaaggtgctgcaatgatgttagctgtggccacggtggatttttcgcaagaacattaataaactaaaaacttc

SEQ ID NO: 487897 - DNA, 112 bp, Homo sapiens
cctctaaataggtcttagaaggatgtcaaatttatccgagccaggacaaaaaatagacaaaaattttaaaggaaaaaatgcatagggaaggggcgaaggaacctctaggggg

SEQ ID NO: 487898 - DNA, 322 bp, Homo sapiens
tgttaaaaaggcagaccagcctggcaacatggtgaaacaccgtctctagctacaaatagaaacaatgagctgggcgtggcggcgggcacctataatcccagggaactcaggaggctgaagcacaagaatcgcttgaacccaggaggcagaggttgcattgagccgagattgtgccactgcactccagcttgggtgatatagcgagactcagtctcaaaaacaaaacaaaacaatcttcatatgtaccgcatatcctttctcactcctgacttttttttttaactgcttacccttttcccccccttttcctggggagcagagg

SEQ ID NO: 487899 - DNA, 286 bp, Homo sapiens
catacgctcctctagagcgcgatataagcaccgcccggtcctttgagattttcacgctgtggctcgtactgttctgtcgatcagtttcgttagatttcacctgttgaggtttagggctaagcatagtgcggtatctcatcccagtttgtgtcttcagctcttgtgtgttcagatatcttaaagccactttcgtagtctattttcgtagtctactggagttttttacaactcacgtgatttttcactttcatagcagacggcgtaatctaaaaaaactactttacgc

SEQ ID NO: 487900 - DNA, 140 bp, Homo sapiens
tttctataggtctgactctagagtgatcccatcgtaagttccttcaatgctatccattcctctttgatattggaccatatgcagtgttaccgagatattagtgcgaattaatgatcatgttttgcttgttagatgcgtac

SEQ ID NO: 487901 - DNA, 322 bp, Homo sapiens
taagttgactcgtagagaatttgaaaaggcagtccgggtatggcaggaacgaaggctctagataacagggatgtcgcttggagcctggccctctggctggggcttcttgatgtttcctgtgggaagggctgaaagcaggagagggtggtggccccgtgttcctagcctgctcctccctccattcttcagcccacaagggcctagactgtgcggcctggctaggaaaggtccagggagttcacccagggccctgatctggcgcggggccaagcagaccttccaagagccaaactgagggtagcggagcagccgagctgaccag

SEQ ID NO: 487902 - DNA, 367 bp, Homo sapiens
cactctagtcatcttctgagatgtagtttcagctttatcacctacataacagcattctgcacctcccagattatgtacttagattgacaagtaaacttcttcgttcttcttcctaccctccttctttcccccagatgaacactgtatggacttttctttgggtacccacatctttgtttatatgtcagttttcctctactagaatttaagttcaatgaggagggaaaggccttatcttattcatctttataaacccagcacaattcttaatcatagtaaaaactcttagccgggtgtggtgatacacgcctgtaatcccagctactcgggaggctgaggctggaggatcgcttgagtccaggagttc

SEQ ID NO: 487903 - DNA, 97 bp, Homo sapiens
  misc_feature (31)..(31): n is a, c, g, or t
  misc_feature (69)..(69): n is a, c, g, or t
gatcttcccctagggggccctcttactcctncctctctcctcctccttccccattgctgtaaatatttnaacgaaatggaaaagaaaaaaaaaagac

SEQ ID NO: 487904 - DNA, 465 bp, Homo sapiens
ggagaattaactcctgagtttctgacagtacattctcaggtactattctggtcatctgtctgaaaatgaggagtacctgggagggttggaaacttgatctcacacagtgtgagaagcctgggtctgagagttggaagacctggatttgagtcctggcctggcctctgggtgaccttaggcaagtcccttcccctccctgggcctcttgggttttctcatttagcaagtgacagggaggttgacctccaaagcttgaagaatagtcatgctgattccaggcctctcagtgctaaggttcagttcctgatgcatgggcaaccctctggctgtggcctcctccctgccaggcactgctgggggagagggaagcacaggaagtgataccgcccagggaaaggggactcatagtttggccaggtggacccggtgttccgccaggaaccaaatggaaaatgggctgatggt

SEQ ID NO: 487905 - DNA, 1005 bp, Homo sapiens
tcccccataaaacagtttatattacaacactacatctctattgtgtaactcaaaggtgatgctgttaacagacatttactcatataaacattttaaacaaaaacaaactactacaaaaacaagcattaacttgacttttttcccaatgtgctggcactatcataaatgggccaatatggttattataaccagtaaataaaatgtggcaaaagctaataacttttaaattccacacaggttcccttcaaaaaaaaaaaaaaaaaaaaaaaaaaaaaaaaaaaaaaaaaaaaaaaaaaaaaaaaaaaaaaaaaaaaaaaacaaaaaaaaaaaaaaaacaaaaaaaaaaaaacaaaaaaaaaaaaaaaaaacaaaggggcggggcgccacacatattcttcctaacaggaaccacactaaacaaacaccacacacttattataataaaaaaagacatattctataaaactataataaaaaaaaaccacattccctctcatatataaaacatataacaaaaaacaacatctagtgctcgggattatcgaaagagacaaccccctatagggagtggaacgaaaaggagagaacacctagcaagagactaaggccgctggagtgaacaaaaacacaccggcgcgatgagtgagaacacacaccagacacagctgcgaaccacacacaaccgcagaagggaacaaagaaacacaaacaagcggccccccgaacaccgccgccccggccgcaccggagcgagcccagcgggcacgcgcgcgcggaggggggcggacgggagagccgccgaggggacgacgggggaaggggggagggggcgcgcgggcgcgccgacaagcaggacagcccgccggcgccggcgccgccgccccgcgccggcggggggggaggacagcagaacgcgcacagagaagagagggggaacgagcgagccggggcgaggggaggggcgcgctgaggcccagcaaccgggagagccgggaggagccacgg

SEQ ID NO: 487906 - DNA, 341 bp, Homo sapiens
acgcactggtagtcaggactatagcgtagctgcctgaatcagatgcactacgcagctgtgaggcgagaagcggtgctgagatgagtggagcgtgatatctctgtgatgatccactgctgcagtagcagtgcggtggattggctgacctcggggaccatggcagcatgcctgagctctcagcagtgcggtctggctctgaggttatccatcggacgcatcgcagtcgagagtgccggactgagccgctccaccatccatcctcagcacaccacaatcaaagagattccacgctgctccatgcgagtcgctgattggtacgagctcgaatcgatcatgtcata

SEQ ID NO: 487907 - DNA, 300 bp, Homo sapiens
gcaacctccacctctctgagaatctgaaatccaaaaggtcccagtgagcatatacttggagagccatatggatgcccaaaaagtttaacatttgggattttgggatgggtctgctcaaccgtgtatctcatatcccttaggcattggcaaagtgcttaatacgtatcacctcatttaatcctctcattacttggaaggtacggtaactttgaagtgtagacctgagattggaatccagataatcggacctcgtgcttaaaaccatactacggtactccagaacctaagtataccaggttc

SEQ ID NO: 487908 - DNA, 855 bp, Homo sapiens
  misc_feature (588)..(588): n is a, c, g, or t
  misc_feature (643)..(643): n is a, c, g, or t
  misc_feature (708)..(708): n is a, c, g, or t
tgcgaaatctccgacgtcgggcgcggcggccgatggtcggtcggggtgcagctgatgaaggccctcctggtcctgggtccctccgggcccgcggtcgtcgtcgcctggaggaaccctgattccctttcccgagtacgtttgacgcgagatacctgagcctgagtccgcggagtttctagtcgtgcagtacgtgtatccttacagtgttcgtggacgatgaacacggttctccaaccgacgcccttgaaggtgactgttccgtcatctacccgcctcactggggacagccctgcatgtgggtgatcccctacatcaggaaggagagccccctgctcaactgagttaccggggcttcctggtccgagatgacgcgggtcttcggactgggaggatggacgaggagcttctaggccgtgcagacccttgggcctgcggggcgggtgctctgcggtacgagttcgctgtgccagtggccaccgctagggtctccacaggcgccctccctccgcgcctccctccccctcgagccgccgcgatgtcccctgcgctcctgtcccctcccgcgtagtgcttgcctttgttccaggnatagcgctccaggctcctgctgcagctcctgggccgcactctagagcgcgttgcntccgccctcttttgccagcccagcccctccatgcacatttggacgctgtcctgcacttcaggtgncaagctgggctcctgttacatactggacagaccacccacagccgctgctgcaacccactccactcctccagactgcagccaatacatcattctgccaacagacctacgctaccactgccatcgccatcaccgatctaacaaagatgg

SEQ ID NO: 487909 - DNA, 1237 bp, Homo sapiens
  misc_feature (588)..(588): n is a, c, g, or t
  misc_feature (643)..(643): n is a, c, g, or t
  misc_feature (708)..(708): n is a, c, g, or t
tgcgaaatctccgacgtcgggcgcggcggccgatggtcggtcggggtgcagctgatgaaggccctcctggtcctgggtccctccgggcccgcggtcgtcgtcgcctggaggaaccctgattccctttcccgagtacgtttgacgcgagatacctgagcctgagtccgcggagtttctagtcgtgcagtacgtgtatccttacagtgttcgtggacgatgaacacggttctccaaccgacgcccttgaaggtgactgttccgtcatctacccgcctcactggggacagccctgcatgtgggtgatcccctacatcaggaaggagagccccctgctcaactgagttaccggggcttcctggtccgagatgacgcgggtcttcggactgggaggatggacgaggagcttctaggccgtgcagacccttgggcctgcggggcgggtgctctgcggtacgagttcgctgtgccagtggccaccgctagggtctccacaggcgccctccctccgcgcctccctccccctcgagccgccgcgatgtcccctgcgctcctgtcccctcccgcgtagtgcttgcctttgttccaggnatagcgctccaggctcctgctgcagctcctgggccgcactctagagcgcgttgcntccgccctcttttgccagcccagcccctccatgcacatttggacgctgtcctgcacttcaggtgncaagctgggctcctgttacatactggacagaccacccacagccgctgctgccgaactcgcactctcgcatctgcctgccagaactgcgcaggccatacctaccattcagttctgtccctactagaccatactgctactcacttgccatcgccagtccagccgctatcttcaccaacaagaactgtggctcctctgtgatgtaggacttcacctcaggaggtatccgagctgggactacgagctccctggacagtgatccagatcagctggccgtccccacaaggagcctgtcacctgtcagcgagacccattttcctccccatccccagagacctcattgtgttcctgccacatagctgtcagggcttaagtgtgcctggcaaccaaatcgaatctctcattttctcctgtggaccagttacttttgcctagaatcctgtatttcctctgaatttgcagctgtctctctgatgggtgccttttgttcaacacagtaagctgctcccttctactccgaggcactacctga

SEQ ID NO: 487910 - DNA, 970 bp, Homo sapiens
gcctatatagcctgccggtgagagaggattacatagggctccacagctggggctacagagctcaagccatacatagaaaggaccttgggaccgtaagcaaccaagtgatcgtcgaatacagtatctaaactgtagtagacgacatatagttatctcctctgttcagcgaccagctactctgcgccctatgctgggttccaggggagttctcctgactctgtggctatcgtctagtgttctagggggtgcaagcctcatgtgtgtggctttgtgtgtgtctggtgtgtgcgtactccatcatctatgggtgctcatgcctctgggtgtgtgtgtgtgtgtgcgtgtgtgtgtgtgtgtgtgtccggtgggtgggtgtgtgtgacagggggctctggaatgacatacatagtgagggaggagtagatacaccgatgaacagacgtatagagggacggcgtgacgcgaccgggcacggtctcaggggcctgtagccgtacatgcatcaacggcgtacatactagttcgggggaattggtctggacagtcgtattactgtggccgaggggtcattgatggaagaactgcttcgacgtgcttcagtgaaagagcgggtgcccgggtcgtaaataatgctcactcgtgacgcggggggatcaattggctaccaggagagagggcgtggcggggcatggattgaaacatgccagtgaactgccgaggcagctgcaaggaataggctggagaacaaatccaaggcttgggaagacacatacatctggggccccacggggatgtgcgcaagacccgcgggaggagcgaggcgggaactggcgggcatggtggaggtacgaaaggcggagcggagagggcaggaaacgcgcggggaagaaaggggggagacaacctagggaaccacgcagggagggccgacgacaggccagacaccgggaaaagagaaacaggacacaag

SEQ ID NO: 487911 - DNA, 252 bp, Homo sapiens
  misc_feature (61)..(61): n is a, c, g, or t
aaagggggggggcccctttttttttcccccccccggggttttttttggggagggaaaaaantttaaagccccccctttttttttgggggggcccccggggtttttttgggggggggggttttttttgaacccccccggggggggcccggggggttttttttttgggcgtttgggttttttcccccccccccccggtttttttttgtttttcgcctccccttgggggggccttaaaggggttttttttttgta

SEQ ID NO: 487912 - DNA, 431 bp, Homo sapiens
aaaaagcattaactcccaaacaaacaggcaaaatatccacattttataaaaaagaattaatacaactaataagcaaatagagtgggaactatccagcccttctagtgatgaggaaatatgaattaaagactgtagggtcccgctgggcgtggtggctcacgcctgtaatcccagcactttgggaggccgaggcgggcagatcccgatgtcgggagatcaagaccatcctggctaacatgatgaaaccccgtctctactaaaaatacaaaaagttagctgggtgcggtggcgggcgcttgtggtcccagctactcgggaggctgaggcaggacaatggcgtgaacccaggagacggggcttgcagtgagccgagactgtgccactgccctccagcctaggcgacagagtgagactcggtctcaaaaaaaaaa

SEQ ID NO: 487913 - DNA, 946 bp, Homo sapiens
tggagtagaaataagtcatttctttaatacatcaaacggggggatttctggacctgtgcttctctccgggtccgggcttccccaaaggatccacggggcggggctggagcccgtggggttggcagggtcccacaaaaggactgggggctgcctccctgggtccggagccccaggggcagactcgggtccggctcagtagcagtcggcctcgtccccagtgaaggaagcctcccggggcacagaagggtcctgcaggagggacgggggactcttctccacggggtcgcggttctcggacagcgtgctccgaaggccctccaggtctagggaccgtgagcagggccagcacagctcaggctccgggtccccggggggcggggcctgttcacccgcccgcacacctcggacaggggggcctcatgcgagaggcacgtgtgggggctgcccgggactcccgaaggcctgctgtaggaacgcaatctggtccctcaggaagagaaggaggtcacaagattctggccaaaggggggtcgaagccaaacaaggcacaaaggcggaagacaaagagccccacgtggagagagccctcagggccccggagagtggtgagtgggggcacctcgggaaggccacggctagggaggggaacacggggcccaagctggccaagacacgagggcaaggtcagggctggggggaccccaagcacggccggcacgcagcagaaaagtggccaacagcgcccggacgggccaagacggaagcagccgagaacaagaaaatggatacgcgaggaacccgagtccgaagatggagaccagcacagtagcgacaatctcagagagggaaagacagggaaacagagagaccggacaaggcggcggggagcaaagataggcccgcagaagagcacggagcagctaagacagggcggcgcggcacacaa

SEQ ID NO: 487914 - DNA, 1369 bp, Homo sapiens
gtgccagctccggaatgggatccggctgactgtcgtccgaggatgtatgtttccgcgttgctcctcctttgttccctccgtcctctcttgtccttcctcctccgggcgtccggtctggccgatccgtgtccgagtcacggctaggagaatgcagcacgatccacttgcgtggccttgcttctggaggtctatcactgtagcattacggatgacctggtttagcacgtcacacgtcagtcgtcgtggcaaggctttgacttgggccgaaggaatcccattgttcaaaccaagacaagggtgaggtgcatagagacagtcgtgatgaaccatgttggtatgagaaactgcttgaaccaatgaggaggtctgtgagagccattggtcaggacatgacgcattgtaacaacgcacacgttcgtgaggggactgcaccggatgcattgcaatggaagccggatatctttgcggttgtagggccgcaagctcataaattcgaaattggtttctagaccaaacgcagagtgccagagtttttcgctacataattcagtctaatgggacaccatacaagttatccatacacgccaaagccactcagaatccatttccaacacggggggtacactttagacagaagaattgggtggcgcacttcctagtgtcaggagaggtgtgaatctaaactagggcttggcccatttgccacaggccccgtgactaaaggttccaaaggcggcatgacgcacggaagattaccctagaccattccgaacattccccaggtgggtccgttgtccgcttccaagcaaatcaaaggtattgtttccactatcgcgttggtcaccatacagtgggacacgaccccagcaaaaaggaacaaggaggcagcaaaagacatgggacactggcggtgggagtcgccagcgggctgacaaccagggcacggggacagagtcaggtggtgtttgtgaggaaaagcccctggggtacctgggtgggcaccggccgcaggcaccgccccttgtgaggccgagcacaggtgtaaccccggggagcaaatacccaacagcggttgatcatggagacggacagaggaaattgcagcgccgggacattcagaaacagtatagctgacgcgaagtcgacatgatcacccacacgcggcacatataagagacagtaacacgccaagcggggggcacacaacacagagagtcgcggatgaggtgcagcaaagacaccacaaacacagagacagtgggcgcgcctgccatgagaaagcgcgcaacacgaaagagcgacatgcgacaaaagagggggaacgagtcagcagagaggggacgagcgacaaatccagaaacgcgacccc

SEQ ID NO: 487915 - DNA, 1111 bp, Homo sapiens
  misc_feature (209)..(209): n is a, c, g, or t
  misc_feature (215)..(215): n is a, c, g, or t
  misc_feature (219)..(219): n is a, c, g, or t
  misc_feature (238)..(238): n is a, c, g, or t
  misc_feature (1090)..(1090): n is a, c, g, or t
  misc_feature (1100)..(1100): n is a, c, g, or t
ggcagtttgtattttcctgatgtttgatgggcccgacatcagaggatcctcgaaagtcatattccctgggaaatctgaccaaaccgtaagaacgaaaagactattggctaactttgtggagaccactgagagctcagtcctcagcagaggagctggagggaaagagacattggaatacttcactgtgattgtccacgccgtcattctcntcatcngtanaaactgtggctggttcacnttaaccctgagcaggagctgcctatgaaagaggatggctggagtcagatgcctgggcactcttctggtcaagtcgggagctctcagtgcctgctgactcatctgtaaaatggggataacgtcaggatgagctaataacgcggaagccagaaaggctgatgccatctctgtttccaatatgatttttatggcctccaagatggtgtccttagaatctttctctgcagcaggctcgtttttctcctcaaattcctctgtgtttggctaagaacaatctgtttttcctacacttgtcaagttgctcgaaattcctaatgcccattcatgttctttccaaggattagcagagcactcctcgcttgtctttcatcacactccctccgcacatggggtaaaaattacatttgagtggaaccctggctatcgatgcctgtaaaatggagactttggcgagactcacttgcctgggtcagagtgggaaacaggctgaaaaacaggcctgagcatctttaatgatgtgcagaaagagaggggcctctgcccccacgggcagatgtacacagctgctaacagagaagcccctcatcctgtacgaccagtgcagagaaacgatcccctcgaatgcttcctagtggagttaagaaattttttgttgatcgtgcctttgaactaaggtcatttaagtatacaacagatgttcctctgagggaaacagacttataaagtcaggaacacagaagggacctaatggtttactaggggtggcgcattaagttcatagcaatttaactcctttcaatgctaaacaaaacaatgacgcaatttgatgcgcaataaaaacttgtcaaaagtntcaacttacnaaaaaaaaaaa

SEQ ID NO: 487916 - DNA, 534 bp, Homo sapiens
ctcattccctagaataattataccatgttctatttttaattcagattatgaagaaaggggtttcggttttttcacgataaacagatgtatagtttcatagcatctgcatgaaatcgtttgaagagcccttctcactggaagatctgccatcccctgaatagcactgacttgctctccaactctgttctattttcacttttttcatagagaattctttaaaaaaaaaatgaagttttttacttcaaaataaaaacagagtagataaagaggatacatattggtgaaagtgcatattcttttttcttaggggtgaaagcttgagttgaggtgatcgtataagtaaatagaacacatcaaaagtgtatatagattctgtttgcctagggcctgaagcctcagttgaccaatttaatgtctgtatagataatatttggttttataactgcatttaaaatgaaatcttggcctcccaaattactgggattacaggcgtgagtaccgcacctggccatccctctctctttaaaatgaaac

SEQ ID NO: 487917 - DNA, 1769 bp, Homo sapiens
  misc_feature (496)..(496): n is a, c, g, or t
  misc_feature (605)..(605): n is a, c, g, or t
taaaaaccctcatcaatagatggagacttacagaaatagtcaaaccacattctacaaaagtgccagatatcagggcgggcggctttcgaagcccaagaggtgagtgtttgggatgtgttaagggtgaaaatattagttgggggggattgaaggcagaataggtgagagaaagtgtgagccaattaatgtgagcgtgtgaagtctccgggtggaagccctgtgtgggctatcacaaaaacatgtgttgtgacgccgataaaatgtcgccggctgcgagaaatgtggtgtgaaaggggaagactctcagaaggtatacctcgtgaggcgttgtgtatggagaggggcgctacacacatatatagagaaccccacgagtataaaaatgtgtgtgtaaatatacacgcacacgtgtggcttgtgacattatattgtgtgcgtgtctctgcgggtgtgtgtgtattcctcatatatataacacctataagtgggtgtgaangcctctcgagggtgtgtatctgggtagatacccctcgcgtgagagtgcgcgagagtatacatatagcgcgagagtggtgtgtgtatatagagagagtgtggggacaccntctacatgagaggggggagaatataataggcgcgggagagagtgaaagtcgacgcgtgtgtgtgggagggtgccacaagtgtgggcaccttcctccataaagtgtgggagggggggaaaagagggagcccaataagagaccggtgagacaggtgtggggtataacaacacgaggggggccctacgacagaacaaaaaacatctccccgtggggcgaaaaacgagaaaaacaaaaaacaacatgtactgccgtgcagaaggcgggcataaaataataacaccagactgacgggggcaaaatatatacatcccccgcgggtataatatccgacacaaaggcgggccctattatacgaggcgggagacacccccggcgtgttcgtgtcttgtgttcggtatggcgtgtgtggacccccctgggggggtatatgtggcgctggcccttcatcaccattcacgaggggtgatacaacccaacttatcggcgcggaccacaaacaacaagtggaggggacacaataaaacgggggcacaaacgcagcgagaaggagacagagagaaacacagaaaacaggggccccaaaagaaataaatagagaaagaagcagacgaggttaaaaatggaggaagctgtgtgcgaacaaggcgtaacaaaaaacaccaccacacagtaggcataataacagggccgacgggagcgagggaacacaaaaaagaagcaaggaggagccgtgaggttaacaaaggcgggccccgcccagttgtataataaggggaggaaaccaagcagaggggacagaacagagtgactgcacaaacagataaatcaaacgaatacgagggaacgaggttgatagaacaaacaacaccgacgacgacggcgaggcggaggtgcatgagcaaaacatcctcacgagcggtaaagagagaagcagagaagacacccacagccacacagtagtacacgacccgccgggccacacagagccggaggcagcgcacaacaaagcgcgggcggagataacagagccggtcggcaaaaaaaatccaacacgcagggagggaccaagaaattataccacaccaagcgagcaagtcagacagcccaggacagaacacaaatacagagaagagacgcaaacagaacaagtggtagagcacacag

SEQ ID NO: 487918 - DNA, 930 bp, Homo sapiens
  misc_feature (93)..(96): n is a, c, g, or t
  misc_feature (102)..(102): n is a, c, g, or t
  misc_feature (338)..(338): n is a, c, g, or t
  misc_feature (384)..(384): n is a, c, g, or t
  misc_feature (423)..(423): n is a, c, g, or t
  misc_feature (440)..(440): n is a, c, g, or t
  misc_feature (445)..(445): n is a, c, g, or t
  misc_feature (488)..(488): n is a, c, g, or t
  misc_feature (499)..(499): n is a, c, g, or t
  misc_feature (527)..(528): n is a, c, g, or t
  misc_feature (534)..(534): n is a, c, g, or t
  misc_feature (557)..(558): n is a, c, g, or t
  misc_feature (562)..(563): n is a, c, g, or t
  misc_feature (571)..(571): n is a, c, g, or t
  misc_feature (603)..(606): n is a, c, g, or t
  misc_feature (610)..(611): n is a, c, g, or t
  misc_feature (613)..(613): n is a, c, g, or t
  misc_feature (618)..(621): n is a, c, g, or t
  misc_feature (623)..(625): n is a, c, g, or t
  misc_feature (629)..(629): n is a, c, g, or t
  misc_feature (639)..(641): n is a, c, g, or t
  misc_feature (643)..(643): n is a, c, g, or t
  misc_feature (646)..(646): n is a, c, g, or t
  misc_feature (649)..(649): n is a, c, g, or t
  misc_feature (727)..(729): n is a, c, g, or t
  misc_feature (732)..(732): n is a, c, g, or t
  misc_feature (739)..(739): n is a, c, g, or t
  misc_feature (930)..(930): n is a, c, g, or t
gcaagcgtggggcgcgggaacccgagcaggactctccagtcctcagtcaccttggacaaagaagtgtggatcctcagattccatcttttccannnntttgtntgccatggcagagaaggtgctggtaacaggtggggctggctacattggcagccacacggtgctggagctgctggaggctggctacttgcctgtggtcatcgataacttttattttgccttccgtggagggggctccctgcctgagagcctgcggcgtgtccaggagctgacaggccgctctgtggagtttgaggagatggacattttggaccagggagccctacagcgtctcttcnaaaagctttatggcggtcatccactttgcggggctcaaggccgtgngcgagtcggtgcagaagcctctggattattacagagttnacctgaccgggaccatncagcntctggagatcatgaaggcccacggggtgaagaacctggtgttnagttgttcagncactgtgtacgggaacccccagtacctnncccttnatgaggcccaccccacgggtggnngggnngggggggnttttttttttttttttttttttttttttttgnnnngggnngngtgtnnnntnnntaanactttttttnnntnttnctncgctatttcaaccccacaggtgcccatgcctctggctgcattggtgaggatccccagggcatacccaacaacctcatnnnttntgtctcncaggtggcgatcgggcgacgggaggcactgaatgtctttggcaatgactatgacacagaggatggcacaggtgtccgggattacatccatgtcgtggatctggccaagggcacattgcagccttaaggaagctgacagaacagtgtggctgccggatctacacctgggcacggcacaggctatcagtgctn

SEQ ID NO: 487919 - DNA, 273 bp, Homo sapiens
aggatcccccttgcggtgtctcataatgcactgtggcacttaggtcctaggtctccagagggtgaaagctggatgtctgtcaatgtcctactgagacagcacagaccaaccttaggctagacaacattatgttttatgtctagaacaattatatactatatagaattcagctcaacagatacacaagtctgaaacaggcttcatgtgggtggacatctaacatgtagttgctatggttttctaggaatgagaacttactatctctggctatct

SEQ ID NO: 487920 - DNA, 532 bp, Homo sapiens
  misc_feature (39)..(39): n is a, c, g, or t
  misc_feature (44)..(44): n is a, c, g, or t
  misc_feature (57)..(57): n is a, c, g, or t
  misc_feature (75)..(75): n is a, c, g, or t
  misc_feature (84)..(84): n is a, c, g, or t
  misc_feature (118)..(118): n is a, c, g, or t
  misc_feature (125)..(125): n is a, c, g, or t
  misc_feature (130)..(130): n is a, c, g, or t
  misc_feature (132)..(132): n is a, c, g, or t
  misc_feature (197)..(197): n is a, c, g, or t
ggcaaggcgctgcagaagtgccccaactccggtatcctntggtntgaggccatcttnctccaggcaaggccccanaggaggccncaaagcgtggattcccttaaaaagtgtgagcatnacccccntgtgntnctggccgtggccaaactgttttggagtcaacggaagatccccaaggccagggagtggttcccccnccctgtgaaaatttactcggacctgggggaagcctgggcctttttttacaagttttagctccagcatggcccttaggaacaccaggaggaggttaggaagcccttttaaagtgcaaacccccggcatggggaactttggtgccccgtgtccaaggacatcccccactggcaaaaaaagatcggggacatccttagggtggtggccggccgcatcaaaaaccccttttgattgagcggttgccatggccggtttccgtggggcagggttgggccgcatgtggaagggcttttaactgggtcctccttcattaaaagtttttatgtttcgggtcaga

SEQ ID NO: 487921 - DNA, 1218 bp, Homo sapiens
  misc_feature (428)..(428): n is a, c, g, or t
  misc_feature (573)..(573): n is a, c, g, or t
  misc_feature (612)..(612): n is a, c, g, or t
  misc_feature (621)..(621): n is a, c, g, or t
  misc_feature (698)..(698): n is a, c, g, or t
cttcatagtaatacccatcataagtcggaggctttggctagctgactagttcccctaataatcgtgtgcccccggatatggctgtgttccccgcaataaactagacataagcgtatcttgactcttacccccctctgcatccgtactcctgctcgacatctgcttagtagtgggagcgccggatggcaggaagccagcgttgcacactaagttcgttacccatccctatacgcagggaacaccaatctacccctaccactggtagtcctcacgatcagaccgtaacccagtactatacattccttaccgagcactaggagaggataggttcttcaactttcatattccttaaggggcgccattgctagactttcaattcaactagaatcaagttagtccaactattagaagacgctcccctgtcacantagaccctcgatagtaactcaaacatcggccactcctcattactgtcgtggtaatccagttcgcttaatagtccacaagctacgtcccatatcgttcttccgcttgaatgctcatcccaaagttcggttatgcttggcctgggcnatcgacataagtacataacagtaaacaatgcaccatgcngaccttcanaacacacgcaacacgtattcgtatctcgactccctgcctggcagggcagtgatgactcgccatatctattaccaacnaccttaattctagattctttccgggtcgagccctttgataaggtgtatattatctactttgatttcgcataaccctaaggtctttgcgagaaattagatttcgtcccacagtaactttgctacaatctttaacctcatctccccgagaatatagaccactaaagcccactcttttgggaataagcgattacgggtcatgcggtctagacgccttaatgattactacagatttgtggggccttcacctaaaaggggttttcattccccggttggttgaagaccaggcatcgcaattgaatctttgtgtagccaccgactactgggaaactttagaccgcgtaacgaacgaacgatcgaaaaccaattcatttttgcaccccttccgggggtaacgcatttgaaactccagttcggtttgaatccgcccaatccggggggttcagaagagtgcattttcacggcttgtaaatccgctccaaagctttcccaccgggaaaacgcaaattcttggacccttgga

SEQ ID NO: 487922 - DNA, 411 bp, Homo sapiens
gaggccaaggtggatagatggcttgaggtcaggagttcaagaccagcctggccaacatggtgaaaccccatctctaccaaaaaaaaaaaaattagccagacatggtggtgggcgcctgtaatcccagctactcaggagactaaggcaggagaattgcttgaactcaggaagtggagactgcagtgagccgagactgtgccactgcactccagcctggggtgacagagcaagattccgtctaaaaaaaaaaagtgttatttcttagtaaaatagttcaatctgctttttcttttctgtttttctttttccgctgagttctgtccgcagaaaccgttctctggaacagtgcagattgcagattacgtttactacctccgccatgtcccgcccttcagatgtttgaagatgact

SEQ ID NO: 487923 - DNA, 193 bp, Homo sapiens
tacggcctgctatatgcgtggtcgcgctgacgtcccggtgcatgccaggagtctgttagcgagccctcgaagtgatcaagtcctggcaacattgtaacgccactgtctaatagatcgtagatgttatcaccataagcaatttggattcccttctgagattccatcaatacaaactcattattctttctttttt

SEQ ID NO: 487924 - DNA, 120 bp, Homo sapiens
tctaaaagctgccgcacggccaccaccagcctttctataacgtgctggtggaggacggctcctgtcgatacgcagcccaagaaaacttggaatataacgtggagcctcaagaaatctcac

SEQ ID NO: 487925 - DNA, 401 bp, Homo sapiens
  misc_feature (1)..(1): n is a, c, g, or t
naaattgcatattctcggtcatatgtgagagctaaaaaaaaaaaaaaaggtttatctcatggaggtaaagagtagaatggtgattatcaaagtcttggaagactagaggggtggaggtgatgaagaaaagttgtttataggtacaaagacatagtcacattgaaggagtacattctagtgtttgatagcaaagtagagtgactataattgtattttgctttgtattttaaaacagctaaaaaagatttggaatgttcccaaaacaaagaaatgataaatgttcaaggtaataaatattctaattaccctgattttgtcattacacattgtttcatgtatcaaaatatcaaatgtaccccataaatatatacaattatgtatcaataaaaaagtaaaaatgc

SEQ ID NO: 487926 - DNA, 91 bp, Homo sapiens
agcccgtctggaagagaagggagaggaggagggagcgtcatccgaagtcgccgatcgcctgcagcccccgtccggcgcaacgggaggcagc

SEQ ID NO: 487927 - DNA, 219 bp, Homo sapiens
  misc_feature (31)..(31): n is a, c, g, or t
  misc_feature (61)..(61): n is a, c, g, or t
  misc_feature (98)..(98): n is a, c, g, or t
  misc_feature (131)..(131): n is a, c, g, or t
  misc_feature (151)..(151): n is a, c, g, or t
ccatcatgagcctcctcaacaagcccaagantgagatgaccccagaggagctgcagaagcnagaggaggaggaatttaacaccggtccactctctgtnctcacacagtcagtcaagaacaatacccaagtnctcatcaactgccgcaacantaagaaactcctgggccgcgtgaaggccttcgataggcactgcaacatggtgctggagaacgtgaagg

SEQ ID NO: 487928 - DNA, 240 bp, Homo sapiens
taaaccagggagtaggggtttattattactcaaatcagctccctgaaaattgggaggctagggtttttaaaaggtagttgggcgggcaggaggctcggaaagggggaatgctgatgggtggggtcggggatgaaatcataaggagttgaagctatcctctggcacggagttgggtcccgggggtgggggccagaaaaaccagagtgagccagtttggaccgtgggggggatacccgagct

SEQ ID NO: 487929 - DNA, 482 bp, Homo sapiens
ggagcagacgggtggagcagtcaccgagggagtggaggagtgaaggaggtaatgttggttgaaactgaaaactttcgtcgctcagagaaccatgtggtacctccatatctgaatcgagctccatgtcggcggtagatcccgctgagttgcattcattttactggttctttggactagctgtgctagaggaagatgaacacttcttgttgccagacttaacacctggcgcttggaagtaagaagtaagggagttggcaaacacatccttctgatgacataccctggttgttatggcaccgaagatccaccattcgtcaggaattcctcggggagtagatatattaccgccatgatagttgaccaatttggagagatcgtagggggcactaaaatgctggattattccaacaacttctgtctcctcatcagtgccatcttcaccatcatagagtgcacgcccgaattctcaaattcagcttctt

SEQ ID NO: 487930 - DNA, 408 bp, Homo sapiens
aaccttaatgtgggccagcacataagtgcaagacctcttgttatgtaattattatgcaaatggcgtctccactcgggagtatttctcgattgtcaacctcaaggactcgcaggtcgcctggttctagatataatggggaaagtatgtagaagttatatcttagtccgccgtagtcggtgtactcgtaggtctcagtaccattggtggccaattgatttgatggtaagggaggaatcgttaccctctcttgttatgtaaagtatgcttacggatgatagtccgattagcactagaatgatggcggacaggatagtacatgcgctttatctttcctgagcgtgagagatgtgagtattagttacttctcttgtgagtgataggaaaagggcatacaggtctagcacacct

SEQ ID NO: 487931 - DNA, 387 bp, Homo sapiens
caacgtgcagcctctctgggatgtatggagacttctcagagaaccaacaacagaactaccatttgacccagcagtcccactactgggtacttacccaaaggaaaataaatcattatataaaaaacacacctagaggatgggcgcagtggctcacgcctgactttgggaggccaaggtgggtggatcatgaggtcaggagttcgagatcagcctgaccaacatggtgaaaccccatctctactaaaaatacaaaaattagactggcatggtggcgcgcacctgtaatcccagctacttggggaggctgaggcaggaaaatcacttgaacaagggaggcagaggttgcagtgagccgagatcgtgccactgcattccagcctgcctggg

SEQ ID NO: 487932 - DNA, 872 bp, Homo sapiens
ttttcccggtcggtggttgctgatgagtgtctctagggtgatacgtgagcgtgacagaggtactggttccgtgaccagagaactgcagcgcggcctggtacgccatagccgtacgagtacagaattgaggacatgtcagggatctgtaccggactcacagaccggggatgggatgccgatctgtcaaggatggcaatacgagataagggagaacggtggacagtatgtgaagagtgaccgcagtcgcattgccatgcataaggccttttatcaccacatgtggtacgatgcgactggactacaaggaggaccgtgcaggaggaagactgacaacacgctaccgccgtgtgctccctcgggtgtagtgcatggtgacaggacatctgaaaatgaatcagaccatcattgtttgggactgttttatattgaccttactaacataatgctaattcaagacgacaagtatataagacaagttaaacagtgtattttagtatataactcaaaacaataataaagagagatttgtggaaaaatccaagttacgggtggaggggaaatcggttcatcaattttcactttgcttagaaaacaatacttttttcttaaagcacccgttcaccttcttggttgaagtgtgttaacaatgcagtagccagcacgttcgaggcgcgcattccaggaacgagtgtgcttgtcatctgccactttcgggagggtggatccactgtgcaggagtggacggggaagctggcagcactcaagtgaggtcgccggcacacaaaggcacgttggatttactctttgagagagttatcattgggagaagcgggggacagaacttgaagtctgacagttcggggcagtgagac

SEQ ID NO: 487933 - DNA, 103 bp, Homo sapiens
gtagaaatataggtgaacttttttctgttcttttggcaggatgtgtcaggggcggttgactgtggatccagaagagggattttcgcttcgtcttatgagttct

SEQ ID NO: 487934 - DNA, 166 bp, Homo sapiens
atgcgttttgccgtctctagagtgttccccgcgcggctgccgcacgggagtcggctgcggcacgggagtacttggtgaggtcggggaatagctgggtgatgttggatgagtagcttgcgagcaggtttggcgctgtacgttagggcgtgctggcaccgggcacgac

SEQ ID NO: 487935 - DNA, 152 bp, Homo sapiens
aagtcagctgagcttctcagaggcaactagcagcgtgctctcagtcaggaggcacacaggctggtgcaccagtgcagcccttagtggctgaggagaattgacgctgcgtgatgtcgatgtcgtgatgtgagcaggtgtcagatgtcttgagc

SEQ ID NO: 487936 - DNA, 118 bp, Homo sapiens
tatcagtgcactcaggaacgaggaggcaggagatcagctgaatctggtaggtggaggttaccgtgagccgagatcatgccatgcgctccatcctgggcaaaacgagtgaaaccgttgt

SEQ ID NO: 487937 - DNA, 364 bp, Homo sapiens
gagacgttggcgggaagcgcagctcgaagcgcgatgccgagagtggattcctggggctgctgcccacttcggtggacccagcgctgaggcggtgtatggcgaggcccaagaaataagaagcggagctggcggctgcttgctcatgagccgctgatgctggaggtagaccaggtcctggaagacgtgcggctacaggagcgctcgagcggcggcttgttgccagaggcgcccaatgaatgactcttcttagtggacactggcttcaaggagagaccacttctgggtgacctgatactcgagaacacattcaaagttcctgctcgcgacgtgctggtgcaccacgttcccagcgccgaggctgagc

SEQ ID NO: 487938 - DNA, 1684 bp, Homo sapiens
tgacgctggacttgggcgacctggtgaggcacaggcaggggagagatgggcgacccctgccccagcgcagtgccggccacaccccaatggcggttgccagagcttaagccccgagacggagcaggctagtaacatagcatagatacgtagagaataactacacgtgtaagactagatgcacgaacaagatctggacaaggcagtaagaatgtggagttatcgaggaggaataaaatactcacacaccacccatgactaaacacacaagaatataactccataaaatataaataagaaaaacaacaacattataaaaaaaaacacaaaaacatcaaaatcatctcatataatcgtcaccaaaaaaaaaataaaaaactgaaaatatcaaagacacaaaaataccagacaacaaaaaaaaaacaacaaacgataataacctcaacagctacaaacaaaacgaaccaaacaacttcaaacaacaacaacctaattatatatatcacctaaacaaaacatccatcaactcattcataaaataaaaaacagaaagacacatgaaaatgagacaaagcaacaagtctagaaaacggagtaggcaacaacggcctcaagaagacactaccacaaacaacaccacgacaagtcagacaccaacgagcgcgaaagctcggatgcgaatagaatccaataaaaaatcatatcacgctacactacgagagaagagaatgacgacatgccacacacaaatgaccgatattgaagacgagctcacaaagacaaacatactaaccaaatcacaacatcaacccacaacctcacaaataacacacaacaacaaacaacaaactaacataatccaacacaccataaaccaactcataacataatcacatactacataactcatccaagatccactaaataacatagaataaattctatactaaatcatcattcaaacatacaataactacaacaacactatcaaactaaactaccaataccaaacaaacaacaatacataaacacagaaacagataccaacaatcacatccaaccaaactacataatacaatatactacatcaattaactataacccgcagacacgatataacagaatcagtaaaaacatttacgcagtatacatctaaatatatgtacaagaaagaaaatacttacactatctagtgcacatatacacactcacaacgtcatgtaaattcatgtacgatatttacttacatagacacactaagttactactaattatcaaacttagcaccgacaatcatagacaatcaatgattcaataactacgtattacttaaaatcaacaatagaagaattagatatgaatacaatataaagccatatagaacaatacaaacaatatcaaaatgaccacaaatacacactaaatatgatataatatctatataacaaacaacacaacaaccaaataaaaaaaaccaaataaaatattaaaaatatagctaatctataagaaactcgtataaatccacactaaaaaattaactcaaatacacaacaagaccaacaacactaaacaactgaacatattaatcgaaacaatcagaaaaagacacacaaaaaaacaatacgaaacaatcattaaaaaaacgacgatcaacggaacgaaagaataaacatacacccaaacc

SEQ ID NO: 487939 - DNA, 859 bp, Homo sapiens
  misc_feature (5)..(5): n is a, c, g, or t
  misc_feature (23)..(23): n is a, c, g, or t
  misc_feature (53)..(53): n is a, c, g, or t
  misc_feature (76)..(76): n is a, c, g, or t
  misc_feature (118)..(118): n is a, c, g, or t
  misc_feature (815)..(815): n is a, c, g, or t
  misc_feature (824)..(824): n is a, c, g, or t
tgatnacaaagaacggagccctnatagatgtgtgagtcatccaccgatcactncacacacatctggtcactgcttntttcggacagcccctgatcctcctgaatccctgatccctgtngctccttgcggagttttctagccctcttatttgaagcatgtctttcagagcctcgcaccacccagcttgggtatctggtgaattctgtggtctgcatgtccatgtttttgacattctgggaagggtggcccaggctgtgatttgccatctactgctgcaggctatggatggtattcagaagggaggggagatgctgtgtgcgtgttctgaagggtttcccactaaatggagagactgactctctccataagtatttgatttttactttatctcctcgttgacttcacagtgtaagtgcagtttgtctctactgggtgatgcatgcagataaatgtttatgtgaacataagaagtctgcatgtgtgggtgaactctccacatcatgtcatttattgtccatcattacgtatctgtggtgtctagcacattcctctaccttattttctgtcattgtacctacttctacctgaacacgtattaaatatcttattaaaaatacacaaatattatgtttcctcagtggttttttccccctcacattggggccctcctcttcagtgggactacagtgtgggtacctgcaggtcttcagggccttctggggagggttccagcttttccggggatggctctctctctctgggccagcttcaggctggaaggcagtggggtgttgggtgcccatcccgttggctantagggtgantaaaccggggttgtgtttttgaacccctagttttt

SEQ ID NO: 487940 - DNA, 468 bp, Homo sapiens
  misc_feature (447)..(447): n is a, c, g, or t
gaaggggtgatgcggtaggatcacttaaacccaggagttgaggttatcgtgagctatgactgtaccacctgcactccaggcggggcaacatagtaagactgtatctcaaaaaaaaaagagggtaaaagataatggaacggaaatggttacctgaacattcagaataagcttaggggcaagataaattgggttacacacatgtcaaatttaaaaggcctataagtttctaaatgggcaagatgtgtcaccattgggatatacaaagaccgggaatccagaagcatgagcatctaagcccagctggcatgggggcatgacttgggctctggtttggacaacttaccctcccttttatcctatttcccaggccaggctctccaaggtgagctacaaaatacactttaataactcctttctcaaactccgggcctcaagtgatccaaccgnatcacccgttcgggtaccgag

SEQ ID NO: 487941 - DNA, 631 bp, Homo sapiens
gtaaactcagccactttgctcaggagaagtgtttgagcatggtctgttcctagttacatgttggctgtatatgtatgttgagaagtcagtccaagggaggtatgttgcttcgcacaatcaggccttctcaggcgctctggctatttcctttgaggaaggtagcaagtgagtttccatgttggcatgatgtagtttaaataccgtcagattttattaattgagaaatacagtacccctccctccagatccgaatctggtaatttatggtaaaattgtggttctgtgaacgcagctattagtctcatcttcttaagctcccgtcaggcatccatctaaattctttgatcttcgtcttccacctctctggctctcagtggaagaatcctttgacacatgaaacacaatggaagctggagaaatcttgtcttttagaaaagagaattaatcacaaggtatctctcttgcgtaaatagataaatataggtaaatctccataggaaatggggaatttagtttctctacatgtgatttcggtctccaaagctccctgttggctttttaatgcaattgttaattgttggaagtaataacatagtccaagggtgtttcgttaaaaataataagagcataa

SEQ ID NO: 487942 - DNA, 1606 bp, Homo sapiens
  misc_feature (75)..(75): n is a, c, g, or t
actatggcgtgtagtttggttgtggtgtggcggtgcggtctgtttgttggtttcccgtacagctggtcgtggttnggttccggcttgcggtgtggcgtgtgtgtttgtttctttcggtgtggtgggcggtgcctccccgcccgcagcgtgttgtgtttggcttccggcgggccttgtggtggtggcgttgagtatgtagtagctgttgtgttgttgagcttacacgcgctcggtgtgcgtgcttgagttgtttttgtaagtcgcgatcgcgcgcgtatgttggtccgtcgtatgcgtgtgtgctctcgcgtgctgctgttgttttgccccgcctctctccgggcgggtggtgtgtggctgaaggggaggcggtggttggttgtgtgacggtgggtcgatcgtggctgtgctcggagcgagacttcatttgctgcctacggcggtggggtggctcgcgatcacttgatgtagtgcagcgagtgtgtgtatgttgttgctcgtccggtccagcagtctgctttttgtttgggtggagcctccctctgtgcggggggtggttagtgtgttgtcatgcatgtgtcgcttgttttgtgcaccgaccactgctcagggggtggggtcgccccggccgtgtggctgcgggggccgctcctggtcgtgtgttgtgtgtgttggcgtcgccagcacacgggctgctcatgctcctcgccgtgtagtgagagcagcgctcggcgtggggttttcttcgtcgctgtcggccgacgctgtgtggttggcgcgtcggttgtggggggagggccgcgacagtgtcttctcacctatagatgtcgtcgtctctctccctctatagggagagagaggttgctatgtttttcccccccgcctctctctcgagggggagatgttctcttctcctgtcgtctacgctcgtgggtggtagtggccccccgctctctgtgtttcgtcgcggggtagctccccgctcgtgtgcacacaccaggctcgctcgtcctgcgcgcacgagtgtctccgtctctgtctcctctctcgtctttctatgtttctctctcgcgcgcgcgcgagaagatatataactctgtttttctcgtcccccccacacacactctttctctgcgcgcgctctctctccgcgcgagatctcacccgcgcgctgtgtcttctcggtgcgttgtcctcccgcgcggccgggctcccgcccccgtctgtgacacactctctctctctctctctctctgtgtggggggcgctcctctcctattttgtttctcttcccccgcgcgctatatatattatataaatatgttttctctgtggttgtgtgtgaagacacctctctcctcttcttgagagcgcgcgagaaatcatctctctctatatagtatatagtagagagacacaccctcccctctgcccctgtggggggaaaaaagggagagacccccccccccgccccaccgctctcgtcgagagacccccgaaacacacaaaaaattgaccacaaaaaagagagagagagagtggcgggccccccccaaagggggtggtcaaaagcagcaccccccgggcccccttgtttttttctaca

SEQ ID NO: 487943 - DNA, 281 bp, Homo sapiens
tcagacgctgaactatgtgatttgaggcacggtagatctcgcctgtcatcccaccacttttggaggccttggcgggaggatcacttgagttcaagagctccagaccatcataggcaacatggtgaaaccatgtctctacaaaaaatacaaaagttagccgggcatcctggcgcgtgcctgaagtcctagctatttgagaggttgaggtgggaggatcccttgagcccaggaggtcaaggatgcaatgagtcgtgttcatgccactacactctaatctgtgt

SEQ ID NO: 487944 - DNA, 86 bp, Homo sapiens
gttggatattaatgctttgtttgctgaggctaaacactatcatgccaagttggtgaatataagaaaagagatgctgatgcttcatg

SEQ ID NO: 487945 - DNA, 456 bp, Homo sapiens
acatatcaattaattctagctgtattttgtttttctatttggggtggcggaggcgaacggaaggcaatacccggtaagagaaacgggctggagaacaggtgacctttttgtttttattttttctcaaacagcaagtactgtgggtctgataccaggttcacctgaagggtacatcttaacagcatccagaaggctttcttttgacaaatcacacgcaccaccgcatcaggtgggaggggtctggccatgcggctcaagtgtccaggtggagatgaatgtgtggctcccgcaggcctgaactcacccaggaatggcttggcaaggagggccggtggggaccgagagggctcatcccaggccccacaagcagccgcttgcagtgggagaaggaccagcagacaagaagctcaggtaaggaatgcctggaactgtcgggtggtctaaatgcactcagga

SEQ ID NO: 487946 - DNA, 184 bp, Homo sapiens
gtgaaaggaagccagaagactgattggagggccctatcttgtgagttgggcatctgtttggactttccaccttggtcatatactcttcagctgttagaatgtcaagactttggggcagcattagcttctgttgtcacagggatttcttgagcagaaatgctggagatcaaccatggggtcagga

SEQ ID NO: 487947 - DNA, 128 bp, Homo sapiens
atcgatgcttcctggtagctgtggaactgtgagtaaattaaacctctttcctttataacttacccagttctcaggtaatatactatacagcagtgtgacgaacagataaatacaagcctcattgtctt

SEQ ID NO: 487948 - DNA, 274 bp, Homo sapiens
tgaggtctaaccagatatgagagaaccctcttatgtacctcttcttgctcttactaatccattcctttccttgcactgtgaactctttttttaacttttttgagacagcgtctcactctgtcactcaggctggagtgcactggtgtgacctcagctcactgcaacctccacctcccaggctcaagcaatcctcccacctcagcctctctggtagctaagaggtgcataccaccatgcccagctaatttttttttttttttttggtagagcacgg

SEQ ID NO: 487949 - DNA, 231 bp, Homo sapiens
cttgaggactcccgtcacgcatcgtcgctcgctgatgcctttctctccgtactagcccgtgaacttccacgccatgtccagcccttccttgaggatctacacagaggctcagcggccattggacatccctcttccacttgcccgggctgtccagcacccgccagacagaattcataccagtaaggccacgatgacccgcgcatgtgtgcctcggagatccggccacaaact

SEQ ID NO: 487950 - DNA, 744 bp, Homo sapiens
agcggggagtggcctggcgcacaggtcgagggcggctgcgtgcgcagtcttgcaacatgtgcgtacccagtgggcatcctggcgccgagctgtgggtactaccctcgtgcagtggtatggaggtgactccctgcgatgggtcctgcagtttccccggacgaactcaggatcctgctgtatgtgttactttgctgctgtaccttggacaggacttgggcatgatagatgctgatgaattgcgatgagatgtctgacacatgtctgggcattgctgaagagatacaataccttttaaccgtgtggagactatgcgcggcttatgagttttcaatgctgggtagagatatgtctggcacaataggttttcaactgaatttaaaagaactcttgggctgtactgaatggctggagactacactttatcagttattgacactgacaggagtggaacatgtagaccctagcgagaattgcagataggccctgatgacgaatgtggatttatgttgagtccccaggctgtgtagttcacttgtctcaaatgatacaagtacctagtggaaagatcaccttcgacgagctacagtcagccttgctgctgtcaaatctgagggctcttacagagcatgtttcgaagacgggatactgctcagcaaggtgtttgttgaaatttcccatatgatggatttcattcactgtgctcatgactgttggaatccaggagggaactgttgactgtttcca

SEQ ID NO: 487951 - DNA, 114 bp, Homo sapiens
ggaagacctcgctggacatcctgcagggccacatggtggctctgcttgtgattctggggtccaccctctccagtcaagagaacccccgtcgggtttaatgtatcaggaaagaga

SEQ ID NO: 487952 - DNA, 413 bp, Homo sapiens
  misc_feature (167)..(167): n is a, c, g, or t
  misc_feature (172)..(172): n is a, c, g, or t
  misc_feature (204)..(204): n is a, c, g, or t
  misc_feature (381)..(381): n is a, c, g, or t
acatcggtcaaaagtgaagatgaacccccagcactgccaccaaagatcggaactccaacaagaccctgccctctaccacctgggaaaagatccatcaacaaattggattctcctgatccctttaaactgaatgatccatttcagcctttcccaggcaacgatagccnccccncaaagcaacaaaggaaaaaactttttcccccntttttggggcaaaaaaatattttgtgatccattcacttctgctactaacccaacttaacccaaagttacacactaggctgatccaagcaattttgccaacttcagtgcttatccctctgaagaagatatgatcgaatgggccaagagggaaagtgagagagaggaagagcagaggcnttgcccgactaaatcagcaggaacaagcaaga

SEQ ID NO: 487953 - DNA, 119 bp, Homo sapiens
ggggggggccccctttttttccaaaaaaaccccccccagaggggggggggggcttttttttccccttttttccccccccaggggggttttcccccttattaaagggcgggggggcccca

SEQ ID NO: 487954 - DNA, 294 bp, Homo sapiens
gtctgccgcagtatctcgctagccctgcgcccgactagcggctttctcggaacttggcagacgcagcttagagagactcatccagcgagcgctcattgttgtcttgcttggaactcattcccatgagatcagaacctcttcgagaaagaagaaggtagatcctaaaaaagaccaagacgcaaaggagcgctttaaaagcaagatccgacaactggaaaaggctactcaagagctaattactatcgaagattttattaccctctaaagatcttggctaaagcaagaatacggcct

SEQ ID NO: 487955 - DNA, 87 bp, Homo sapiens
  misc_feature (17)..(17): n is a, c, g, or t
  misc_feature (63)..(63): n is a, c, g, or t
cccgtccgacaccagcntgttgtccacttcaaggtgtcagcccagggcattacactgacgggnaaccaaaggaagctcttctttagc

SEQ ID NO: 487956 - DNA, 387 bp, Homo sapiens
  misc_feature (153)..(153): n is a, c, g, or t
  misc_feature (183)..(183): n is a, c, g, or t
  misc_feature (190)..(190): n is a, c, g, or t
  misc_feature (206)..(206): n is a, c, g, or t
  misc_feature (220)..(220): n is a, c, g, or t
  misc_feature (229)..(229): n is a, c, g, or t
  misc_feature (240)..(240): n is a, c, g, or t
  misc_feature (243)..(243): n is a, c, g, or t
  misc_feature (269)..(269): n is a, c, g, or t
  misc_feature (275)..(275): n is a, c, g, or t
  misc_feature (312)..(312): n is a, c, g, or t
ggaaaggaaaagggcccggagttgccaggagcaaaccaaagtgaagaaaaaaataggaagttgccttggggcccccccttgcaaagggggtgtgtcccccaaacccttctatgggtggggtggggggctggggtgctgggtagccagtgtttnacttttttttcaagtgggggaaagtggganaggactnagagtgaggcaagttntccccagcccctgnccgtctgtntgtctgtttgnggnggtttttgttttttgggaggcatggnaggatnataagtcattcccctccccttccaggcctcctgctanatttgggggacctgattggtttggttggagtcccatgaggaagtgggccctttaataaaggatagccaacaggga

SEQ ID NO: 487957 - DNA, 1310 bp, Homo sapiens
gagaattgccagtaagcctctgctggccgcctgcgctgctccgtcactccatgctgtacctccacaaatagatcacttgctgtctatgcagcgcattgacagacgtgtaccgtaaacgtagggtgaaggagaatgcacgtagcaatcgggagcgagatggcatcacatggaagccagatactggaggtcgaagatggagacgaatctccacagaagctaggcaatggcctaatcgcactgtagtgctacatataaacgtacagggaggaaagactaggcacagataggagcgagagactacacaaaagatggctagaaaggatacaatcgaggatgcaggaagaaaagactttgtagcgtatgaagaggattggaacaagtgatgtaggcaacctatggcacattggtcaatattactaggattcgtgctatttgaaagatcttgcccatttggaagaggaagtaagaaggagaaaggtgaaagagagagtctgctttgtgacaacagggatcttggatggtggaatgcctcccgacgaacatactaccttccccgagacaggtcacctttaagagtgtcaggggtgtggtaccgattgcacagtggggacgagtgggcctcccttgtgggttgaaacacatgggggcgaaaacataacatgcgtgtgtggaatgtcccccgtgttgcaatacggtacgtggaggatagaccgcacctttcaggagggaccccgaaaattcaattgttaccatttaaccgtttctgtgtgtatgcaaagattactacaaagttctaaaagatttccagtacagaaatttatgagagtcacacggggtttcggcaggttgttagtagtatgagtggacgcgccaggttgaacttgttgtcggaaagtaaagggggaacgaatgggaacacgagattcagattaatgagtatagaatttgacgacagggaagaggtgtaggtatacaaggagtatactggaggccaagagagatatggatagtccacgggcacaaacaaaagtgtgatggcctggatgtcaataacaggggagggaatatcgggacagaggaactgtccaagaacgttgttgagtgtaaataggaacataaggagtgtgtgcaggtggatcaaaggtagacacaggaatttgaaggagttgaaaatgaagacaacaggtaaagggtggcagaacagagggtggtacacgcttagtgacaacgaagtacctgtatccgagaaggtaacaagtgtataggaagtgtagcgcttagtatggttggaaaaaagaagggaagacgga

SEQ ID NO: 487958 - DNA, 1199 bp, Homo sapiens
  misc_feature (270)..(270): n is a, c, g, or t
  misc_feature (272)..(272): n is a, c, g, or t
gaacctgagagtgaggagtgagtaggcagcccactcgaaactgatgcaggccgtggcaagctgaggccttgcacagaaggtggctgtcgaggcatcgagacgacggtgacccagcgtgggtgggcatcgagcctgaaatgtgcattcacacaggaaagaccgagtggctgcgacactacgtcgacgagtacgccacctctagcgtggtcgcctccgcgaagacgtaacgcgaggtcgcgtaaacattcccatacgcactgactctagtangngcaggacttgcacgaggccacgtatacgtatttgcgtcgattgctggtcccacacggtcctcgtacgaatagtggactgaaggacatgaggtcgaggtcgataccaattgtggaagcgagactaggcccaaaacggcttcgtgccccgtggcgggcacccgtagcttgtccaatgcatacgccccaagggtcacctcggagacaaccggtgaccgactaagtgtcccccacgtagaaacgccgacttcgttaattggggtcgggaaacgctaccgcgaaagcagtactatatgatgggaatagccgcctaaacgtatttcacatggggcacttgaacgcctaaggagcctcattcttagcctatacgatccttggaaacgcatcggggagggtctccacgcggtagagcatggtacgcgcgtcgaggcgtgatttgacgccatggaattcatcgacgtgggcagagaataggaatcgcatgtacgagtacgagaacgagttctagatgaggccatgcgggccttggcgagactctggcaggacgatttgatcggaacgctgaacagctcgggaaccaatggctgccagatatgctaggacccgtttgacatcgctacagttcggtgtaaccgcacgcaacgaaggatgctaaaggggaatgaaggctttgctccgtgtttgggacatatctaatatgctgggatgaagaaagatgaggatgccgagtgtgtaactgcacgaatgctaggatcgcgtagcgagggatggcatcaaagtcaccgggtgggttggtccaagcatagaataggcacgacatagtaattgtctgtgcccctggactgaggattcatgggagggtgaagacggtactatggcaaaaaaagacccatggtctgatgggaaggtgaatgggggccgggttcacag

SEQ ID NO: 487959 - DNA, 406 bp, Homo sapiens
ccgttactccccgttgatcagagcctaatcaaactgggggaagagaaatacccaactccattcccttcagtgcatcctgtcccatctaagagaaagaaaatcttagaagttcacagcccagggcccaggctcactagaagactgagatctaagtcataggactatagaacacatcccttcccaccacatcttcccaccaaatcactaaaggcctctttacctatgggtaaaaggtaacaagtgcctattacccgagtgcagcatgcctgcctttcagcaaacaatgccaaggcagactaacaggcaaaaagcacagtccgaagacacaacgcaagcatcagaatcagacccagctatatggcagggatgtaggaatcatcaggctatgaatctaaaacaactgtga

SEQ ID NO: 487960 - DNA, 396 bp, Homo sapiens
atcgatgggacactctcgtgggagccctaccacctatccaaacggtaaacacagcgacgtgaatcacaccttcatgctcgcaacgaccataccgtctgaaatatcctcaagacttttatctatcactctactagcacctattcaattacaggtcactacttccagactgcctttacagataaagccacttttgctctttcccatcccctctaatgatactgatgccttgttttcctaaaccaaaaatctagacttgttgcttgacaatgttgcactgatttaatgggacaatgggacagaatgcttgcagttgttgcggctgccatttatcctcatgattccttacaccctttactgtgaattgtttatagatgtgcttccagtataaatgtgctc

SEQ ID NO: 487961 - DNA, 588 bp, Homo sapiens
tcataagtctctcctgagagatggtgtaaactccagcatggcagcagtgaacggatctgcatacggtcgcacggactgaatgagcctcagcctggcgcggttgcaggtgccgtaatctgtgtgagggaggcggggcccgggtcatccacaaacacgacaggcacgtggcgcaggaacctgtgtgagaggggcttacttccagggtctgatggggagattacaagccccaacaaactggattctccccagacttcaacccatgttggatctgaggtacggtcaacgcctccgtgactccaccatctgtctgatgaaggatatgaccctctgggtccaatatttatccatatctggcaagttgatttcactcacagaacaacaacagccactttccacgttgaacaggagccaaacacaccccattaggtgtgcgcctgtactcgcagtagtgatcaaaagtcttcaagaagcagctctggcgtaatagcactggagaagttgagagccaccaccgtcatgtcaggcaaggcccggagggcgctacagagtgtcatggtcttgccaagaccaggagggccacaaagaccg

SEQ ID NO: 487962 - DNA, 627 bp, Homo sapiens
  misc_feature (587)..(587): n is a, c, g, or t
tagctggagattacaggcacgcatcaccatggccagcgtaatttatggtattgcttagtagagatgggattttaccatgtggcccaggaaaggttcactcttttaacatgtaaaattcagtggctttatagtatattcataaagttgtccatgggtcaccagtacctctttctagaacatttttatcacccccacaaaaggggaaacccccggacgccatttaagcagcatccccattcccaaatccccagacaggttccccgttattctatttatggttactattctgggatgatgaaaggtgttgtgactgtggtcctttaagactgcgtcgactagtataagtccaggtcaccgtgtgtgcatgtagtatcatctttatggtgatatatcgcgatgatatgtctctgaagtacaatcctggagtgaatctgtgacattgtctttcagctaccactgctttgaaatgtctgtgttgctagactgttatcgttactgaggacagtttcccatcgcgcagattgtcaactgaattgaccttgattgtaaccttactcgtcatctgcttccgccttcgcaccagaggngctagaaccaacaaactaaggaacccaaaaacaagaaaaa

SEQ ID NO: 487963 - DNA, 565 bp, Homo sapiens
gggcgtcagaggacccggtagtccggaccaggagtgacagcatgaagaatgagaaaaatctagacagacgtcacagttatatgacagtgagtgtaggaatcagaacccctaaatgggacagacactacgaacaagctagcaaatgttcttgataactatcaagtgcagaaatcctcacttaaagtaccaacaagccatatttagcatcatactagcgcagaaatcctcagttaagtactcacaagcgatatgtagcagcacagtaaaaggattatacagcaaaaccgaggtgagatttatcgcctaaaataaagtggtgcaatatatgaaaaatcaatcagtgtaaggtatgacatcggcgaaaggactgaaatatcgtagctatggcaacggatgcaggaggagtattggacaaatggttaagacccactcatgataaaaatacacaataaactaggactacaaggaaactacagtatgaaaaaccagcactaacatcaccatcaatgctgaaataccaaaacaaacaagcaaaaaaacccttttctcccaagatcaggaaaga

SEQ ID NO: 487964 - DNA, 332 bp, Homo sapiens
cggggttttccgaaatttcgtaaatctccgccccctttcccccatgggggggtgggggggtcggggggggttttttatgccaaactcgttttgttcccttctggtcccctgggtggcccgtccccgctgtttttccttttttgaagcccccggggccgtcccgggccctgggatcttagggttggtcgcggggggggtgggccttttcccccggttccccctgttcccctttggccctttttggttgcttttttggccccgtttgtcccgtttggccggctgggcccggtgggggctttccggggtttcctgggcccccgggtccccagaga

SEQ ID NO: 487965 - DNA, 144 bp, Homo sapiens
aattccccttctccagcgtcacatttactcggaacgtggcgggtacgtgggctgatgtgagatcccaggcgatcccgaatctccgcctcaagatccagtaccaccagagtaaccacctctctgccccgatcccagttcgaccgt

SEQ ID NO: 487966 - DNA, 123 bp, Homo sapiens
tcacgctcggtacctgggagctggggtatgagcaaaaaacttagagctactgggcactacgtatgtgccagccctgagctagtgtgcattcaccatccggaaaaaggagtatcttcaagagcc

SEQ ID NO: 487967 - DNA, 175 bp, Homo sapiens
cgttgtagcaatagaagcaagagtggcattgtttcagaaggaacggaaaagcagagcttggagcacggatgcctctgactaaccacagtgcggaggtgggggtggggcagactgtgccttcgcctccacagctagtctacaccaatcttcctctactcccttgggtaccgagctc

SEQ ID NO: 487968 - DNA, 327 bp, Homo sapiens
  misc_feature (118)..(118): n is a, c, g, or t
gcttacatgcttcatttacactgtcatgctcatctctcagtaccggactggacttggatcaggaggtcagtgagtgaagagacttgtcgtagtgaagagccaaattcactcagactcntggctcacaaagtcagtgctctgctggtggggacatgggaatttcttgagtaagggagtgaaataaaaaatttagtattccaggaagtatactctagccagctggtactgagggactgcattaaacaaaacaagtcagaagtagttccactgaaagtttcaaaatgtaagggagattgacttgttcatgtaagacatcaacagagctag

SEQ ID NO: 487969 - DNA, 366 bp, Homo sapiens
tctctgaggatccccggccgccacagctctcgagtagctgggattccaggtgcctgcaccacgcccagctatctttgtatttgtagtacgatgatggggtttcaccatgctttgccggctggtctcgaaccccttgatctcgttgatccacccaccttgggctcccatagttctgggattacaggcattagctgccgtgcccagccatgtttctgaatttttaagtcaacttctgaataggtctaagaattctttttgtgtatgtgttcaactttcagtgctatcaatcgccagttggacacaaaggttttagtgctatttaggtatgtttgggtgaaatagtgtgaaggaatatagctgcttaaa

SEQ ID NO: 487970 - DNA, 549 bp, Homo sapiens
atttaaaccactgccccaaaaaccctaaacccccttgggggagataggtgccccctccccccccctccatagggtttatggggaaccccggcccttctttacgggagggttgggtccaaccccattaaaatttcccatcctgggggcctccccccataaaccctgcccttcttaggcaaaaggggcccctttgtccctttttttttttccttaaaaagagtgacaaactttagttcctttggggcccgccaaggggcctaaatgagttaagccctgagtctgtttttgggataataagaaggtaaggtgggggcttttccaaactggctggagggcatgtccctttctggaacgggcaaggggttttttgctccagcttaaagttgccagagaaaaaattctggggccatggtactaaaactttcatttttttcaaaaagcccaaaatctgggtggttctggaaaatctccccacttttaagcgaattttgcggttcccggattttgtgaggccccccgtgtttgataagcatagatagaaaaaaaaaa

SEQ ID NO: 487971 - DNA, 611 bp, Homo sapiens
  misc_feature (330)..(330): n is a, c, g, or t
tgggcttgcactatcccatcacaagcagcaggaggaaaaaaaattgggatggctcaaaggactgggtgtactacagaatttctcacgaggaaaaggacctgttttttaacttgtgacggctcaatctcagggatttctcttctccaattagcttacattcagtggagaagagattagtgggaaccttctcccagtgtttaagagtgagtggctttccttcgtgccccccttctgtgccactctcagtgtggcagcggtctcataacagcagggcaaccaagagttgtggagacgggcaagccctctcagtgtgccttgtgcacatgtggnacccttgactggtggatttttctccaattatacccactatgtgggacagacttttttctcaatgtgtggacacccggttgaaaaagaaagcaattctcaggtgggttgtggaggcgcaaaggggtcataccacaccgcggcacaacaactgcggttataccagcgggagcgctcagaaaagggttttcccagataaataccccagggtgggagccccaacctcgtggtgggaattataaaagggggcatactggggtgaactcccacagtttctcccttcc

SEQ ID NO: 487972 - DNA, 894 bp, Homo sapiens
  misc_feature (324)..(324): n is a, c, g, or t
attttacacagagttgctgacctgcatggggtaaacctcagtggatctgtcttttctgttggtctcatgtgattactggatggaacaattgctgctgtcttgttaggaggttcatttccatcttatcattacttacaaacttcatactcaaatagcactgagaatttcattagtggagtatattgaagtagacgtcagattctttggcatcatttctgtattcaattttataaatctatttcgataaagcctataagagtgtttattaatcgtaatattaatgatggcgtcgaatgaactgggcgcagttcctgtgcgaagtcnatgtacatagaacatgagatttcattattaacacactaatcacatttcaatgcagacttaaaggaaatttaataggaaggaatgttagatgaacgatatggagttacgcaagtaattagtaaggaagtatgtgaacgcatacttatgatgagctactcgttgttggttgcaagaaggtaaccagggttctttgattgggcgttttgatgatggtgcaccagacatttcagatcaagattgtttgatgactgggttaagtcttgtgcaggttaagtctcggtgagagaacctggttgtcgtatgtggctgacagtcgcgttgccaaggcccctgggaagagcttgcagtaattgtttgcgcgtaaggaattgattgagggggggattgtactacgaaagattcccgacacattcctaaagcgaaaagcgggggggggcgcttaaaacatcggaggcaaccctggaatttggcgaaaagaattgggttaaaatgaggggcgctccgagatttcaaggcgttgaaaaacagtgcttccgcacaatggggggccatgggctgggattggctaat

SEQ ID NO: 487973 - DNA, 894 bp, Homo sapiens
taggctaggtacgaggcctgggtggtttggtggaggtagcctcaacagcgggaaggtgatgtagcgccttctgcagagtgaaggaccccaagctctttggactgcccatagatttgtcctcaactcaacctggacaggcgagggcgtgaacgatgtgcgcgatgggagcctgctgccagtcacgtcagcaccatggcccagcttcctgaagggggcccattgtgtaccgtcatgcttggcgcggagccgacggaggtatgtgtgacgtccttgtagatgcatcgatggagcatagggtggccaatgcttcaggtgccgaactacagcgttgtcacaagggagattggccgcttccagtgacgtggtacctccaggccccagtgtggctctgtgtaccacaaccatccaagtgctcgtgtctgagcattaaaacgggttcggtgaagactggccttctggtgccagtaggcaggcagaatgtgtggacggccatgacatccgtcgcgtctggtatggaagaacgcggcggtgcccggatgggatgcgcaagcggaatgtggagcagtagcgccgggagcgtgagctgcgtgatggctgctcgtcctgggacgcgtctgtttatcgagcgagcctgtggctggcagaggctcatgcccccctagaggaccggtggggagcacgtcagccatgaatgtgagtcacgacggaactcgcagagtgcatggaggaagtcttgccgttgcacccgtagtggaggattgttcgcgcaggaagggttacgtgcctggtctagcagctcctctcctagtctcgaccttggaaggctgaggagccgttcctggaaagcatacccacaaggaaaccgttgggcgaaccagttgtgccttaggccgg

SEQ ID NO: 487974 - DNA, 630 bp, Homo sapiens
caatgatacttgaaaatgtggcagtgactttggaactgggaatgggcagaggtggaacagattggatgggcttagaagaatgacagaaagatataggacagtttggaagttcctagacgattgttgaatgttttagaccaaaatgctgacagtgacatggacaatgaggtccaagatgaggtggtctccgatggagaagaggagctggagcaaatggtcattcttgttatattttagctaaagagacattgacatttggtccctggcctagagatctgtagaattgcgaagtacagagagatgattgattgtatctgtctgaatatagtatctaagtagcaaagcatgcaagaggtgtacgggttcattctggagacgcatgccactatactgtaaacaaatagatggttagcaaattgaacacttaagttcaaacagggaagcaaagcataggtttggaaaatacaccaggaagcagacattgcaaaattgcagcctgacatctggaagaaaagaaaacccatttactggggaggaactcaagtgagctgctgaagtttgcacaagtaacaagcagtcacctgttaatagccaagaccatggggaaagtgtctccaggcatatcaagac

SEQ ID NO: 487975 - DNA, 354 bp, Homo sapiens
aattcctggcgtgaggacagagaggcaagtgccacgggccaaacaagagcaccatgcagaagaggctctgcaatagaggaactgctccttaccatcagctgttacaaagccggggacaaaggggatcccagactacgctgtacataattgtgcgtactccatagatagacgatgggtccagcaccaaggagcccagaaaaaactgaaacggtccggaatcatgagagccgccaatgaaaggtctcgccgagcagaaaaaacaggctagagccacggatcccggccaagacggtccagaagcccaactgagaaaccaaggcatctcagcggatgagggaaacgagaaagggacac

SEQ ID NO: 487976 - DNA, 124 bp, Homo sapiens
ctcttacatttatcgatcaaagagcacactgactccaattaactctctatggaaaggatatgggtgaagtctttgatctccttgaggcggcaggccttagatatctttgtagccctgcccaaca

SEQ ID NO: 487977 - DNA, 887 bp, Homo sapiens
aggtctataagaagctacttcccctatcatagaagagcttatcacctttcatgatcatgccctcgtaatcatttcccttatctggttcctagttcctgtatgcccttttcctaaaactcacagaaaaattaactaatactaacagtctcggacgctcaggataatagaagacgcgtctgatactatcctggcccgacatcatccctagtaccctctatcgctcctctccatccctacgtcatccttttacataacagacgaggtcaacgagtccctccccttacacatcacatatcgaaattggacaccaatgcgtactgtagcgctactgattacaccgatgtaggggcggcactacatcttccaactgcctagcatagcttcctcccattatatcctagaaccaggtgaggctgcgattccttgactgttgagcaatcgaagtagtactcccgattgatgccccattcgtattataattacatccacaagacgtctgagatcatgagctgtccccacatcaggcttaaaaatggatgcaattcccggacgttaaatcaaaccagtttcacgttagacgaccgggggttactacggtcgatgtctgaaatctgtggggcaagcacaggttcatgcccatgcgtcctagaagtaattccgctagaattgcttgaaagggccgggttttaccaatagatgcctttaaccttttagagctaataggaaaacataaagaaatttgcgcggccgcccaaaagaagacaaacgggcggggcccaaaaaaaacgcgagagcaacacacgaccaagctggccccacaaacgggacacttgaacacggcacaggtccggacccgacccccggagacgaccccacagccaacacaa

SEQ ID NO: 487978 - DNA, 250 bp, Homo sapiens
ctatctcatgatcgatcagtgtactatgattggacatgactgcaagtcatgggcctgtgacatatagatgaaagcataaaaccgatcatgctacaaaaaaaatagtatggtccgttgtgtttagattcaaaacttacctagtacacttccatttttaaagaaactgatggaaaaatgcttccccaaacgtgaactatggtgcgatagcatagtctgtccggaacttcaccaattcagtagctaatcttta

SEQ ID NO: 487979 - DNA, 166 bp, Homo sapiens
  misc_feature (143)..(144): n is a, c, g, or t
tccctctcttgtctcctccacatactgcagcctccctccatgcatcccacatacaagcactccccactccccacgcgtggcctcacgtgtcttctggatcttgtgtgctacatcgaaattgtcacccagtaatttgcaatccnntgaccctcacccgggatacacg

SEQ ID NO: 487980 - DNA, 459 bp, Homo sapiens
gggcttaattgtcaccggacgaatgcggtttgcaattgcaggagcaggcgaactctgcgcggaattcgccgccagcaccaccttgggcggtttggtcgacaagctgcacgtgccgtcggtgggtccaggtgctgcgcagaaactcgcggacaagttcggttcgctggaaagcgtcatcaaggctgagctgggtctgatattcgccaggcgctgccccgagaagcaagccaaggctgtgcgggactttttcgataattccgaaaacgccagccatgccttggccatcgagcagcagctcaaggactatggtatggcattggcagagcgagaaaaaaggtcgttgaaggcttgcccgaaagccggggcacacctgggtactcacgggctccctggagctgatgagccgcgatgtggccaaggacaagctcgaaagcctgggggccaaggtggccggttccg

SEQ ID NO: 487981 - DNA, 413 bp, Homo sapiens
  misc_feature (48)..(48): n is a, c, g, or t
caccaaggagagggaagtaaaaaagggaaaggaaagaaaaagaagtancctagtatcagcatcaagtatgtggtactactgtaagagacatgaatggagatttctaattgtatcggagggaacagaagcttttgtttgcttcattaactgaactgtgaccccttggccttccattcttaatcatggaggtgccaggtgaacaaattttacatcagaagttgcattctcgcgataatcccgtataaaagaatttttttttcttccaatgcagtttttggaaagaaaaattttttaaagggccaagggctggtccattaggttacttgaaataagttgtttcagataaatttcaattagatttaaaataaacattatgtccaccttttaagttaatgaaataaaatttgaaactg

SEQ ID NO: 487982 - DNA, 112 bp, Homo sapiens
  misc_feature (32)..(32): n is a, c, g, or t
  misc_feature (64)..(64): n is a, c, g, or t
  misc_feature (98)..(98): n is a, c, g, or t
ctaagactggaaaaatatttcatggggcattnggtatgatacagagtagggggtcttgcctctntagtagggaatgatcagccttagagtgagcactncttcagccctacct

SEQ ID NO: 487983 - DNA, 367 bp, Homo sapiens
  misc_feature (154)..(154): n is a, c, g, or t
  misc_feature (221)..(221): n is a, c, g, or t
  misc_feature (266)..(266): n is a, c, g, or t
  misc_feature (352)..(352): n is a, c, g, or t
tttgatgctcaaaggttcactcccaactggccctggtgccgcacccttgaagttgaaattttcgaacctgatgccggtggactttctcgcccggtttaattgcgttcccagagcagccgctgccgtgctggagggacggtgttcaacctgcatnacccgcagcccctgagctgggaaacctacgtcgacgcctttcgccaggcaggccacgcattcgagcntgtgagcgtggcttactggcaacgttacctgcacacagtggacangcgcaatgcgctgttcggcgtactgggcttctacctcaatggggtgggcgaggacatcggcgatacctcgatgatccgccatgacnaacgcagacgcggcg

SEQ ID NO: 487984 - DNA, 152 bp, Homo sapiens
tgaccaatggggagagcagtgaatgagtctagtgaattagacaaagtgtcaaattataaatacccctctatgcctgtatgagagttcaaatatttatcctcgaagaagtgtggagcagttaggcgcagtggcccactcctgtaatcccagca

SEQ ID NO: 487985 - DNA, 355 bp, Homo sapiens
cccgggcccaagccgacacacacctaacaggctgaaagaattcattatctttccagttaagaaaacctaactcagctgggcgtggtggctcatgcctgtagtctcagcactttgggtaggccgcggccgggcagtctcacctgaggtcaggagttcgagaccagcctaggctagcattgtgtaataccccatctctactaaaaacacaaaaaattagccaggcaaggtgactggcacctgtaatctcagctacttaggagactgagacaggagaatcgcttgagcccgggaggtggcggttggagtgagtcgagattatgcccttgtactccagcctgtgtgacggagtgagact

SEQ ID NO: 487986 - DNA, 725 bp, Homo sapiens
gatttctgagtgtggatactaactatgttgcttaacttcgacattctcacaaacaattcctgctaatactactttttcagagcttggcaagaaagaaaaatctgacctaagtggagcactagatctagaacacaaaatacttgggtactaggcctggctctgccatcaactagcactgtgtgagtgtgagcaagatttttcatcatctatccaggcctgctttgctcgtttgtcaaagatggatgtgctttgcagatggctaactttccttcaggctctgacatctgcctcatgactttggcactcttcacatgaagatgaagtgacagttcttttaaagtgggtagccagacacacggtttctagattgcctgatatttccatatgaggatggctggtgcccaggttaccttttggaatgatagattctctgacagggaattctctctggtagagaaaagaaaataatatgagtgcgtggaacattgtcttaaggacataactaactaactaactgcgaaatacattagtatatctaccatgacagattcgcatataaaaaactggctgttcccacagctaagccataatatttatatttggtgtatgattgggaagtaagatcttgtgaatttgtgaagccttcaccttaaagcggagtgttctatagaatatgtttggattgcatgtatcagactttgatcatactattctgttggtttctg

SEQ ID NO: 487987 - DNA, 240 bp, Homo sapiens
ccgggaattttaaaggtttttccccaaaccttaaccttttttaacctccggtttgccgttgtggaaaagccaaaggaggaaacctttgtttgtgttgctcccccaaattcccccctgcctttgcctccccaacttccccccatttgggccgttttttttgtttaaaccttaagtttgggttttgtaaaaaaggggggcccatttttttctataaagccttttataaactgttttttatta

SEQ ID NO: 487988 - DNA, 272 bp, Homo sapiens
cgttcacagcagagtctcggacgcctccgcacacctcttgtgctcgacttcttcctgttcccgtccactggacattccattctggtttctgagccaggctgagctttccgcgaggtggagttggcccgccgagatcagtggagagccgcgtgcccggcactcccactgaaggattctaagaatgaagtcagcctaagaatgagtgactcctctgcttcttttactgccgagcttactcagacctttagctcctagtctagtagatctctagc

SEQ ID NO: 487989 - DNA, 277 bp, Homo sapiens
  misc_feature (145)..(145): n is a, c, g, or t
aggcggggatttcacgtactacggctctccccagatgatgcattttccaaagcttggccgggctatctcttctttcaatcccggccatgtctgaccccagtcgggcaccatgtcgcagaatgatgatgacgcagctttgtagatngaaccaccatcggtcgtgcttggtactgcgtacctcgagggatgcaatgacttcaattaccttagcagcaactgttttgagatcaccgtgaagcttagctttgagaagttcccaccttaacaatctccgcct

SEQ ID NO: 487990 - DNA, 279 bp, Homo sapiens
aagaactatcatcagaatagtacgctcgacatggataaaaccaaaggttaattaatattaagcacctattcgaaatagataataaccaaacaaaaactgggcaaaggacatgaagagttcattcacagaaaaagaaatgtagggctgtgatatcaattgaaaggctgtgatcccagcgctttgggacgccgagagtagtagatcacgaggtcaagagataggccatcctggcaaggtgaaaccccgtctctactaaaaatacaaaaattagctggctgt

SEQ ID NO: 487991 - DNA, 941 bp, Homo sapiens
catcctcccgctgaattaaatttcccgaaattcaacgtgccgtgcaccaccaccagagagggggtccaaccaaaagtggtgtccgtgcccattttcaaaatctgatctccgccttaataacgaaaaaggcccccttgtcgtcacgaaaacaaacacatgtcttccccccgggtaaaactctgcggcccataacaaagtaccaaaatagtccccataggcttttaaatcaaacgagcgcacagctgtattttctacccgctcgtcctccccccctaagactcttttaaccttgaaaccaacacgtccttataaaatctttcatacaacctctcaccgatttttttaacccgccgcacttcaaatattttagtccccccccccacaaatgctgttccgaacattaagggctggacgaaaacttttcggcactttttgatatataccacgggaccacgggacccagaattttctatacagggacccttgattcaaaagtagccaaacgttgtcttaataaaatatgtttaatatacaaaaccgaccctgggaggcactacctctgtacaacaaatctatcgcgcccacgtgttaacacagaaaatgccccctcttctcgtgtaaaacacacctaaacctctccagtcaggccccacatattgtatacataattcatttagtaaatcacaacccgttttcgagcctagtgaacacactatttcgaataacatactttaatttccctacagacgtgaattctattttaacctaccccccacgctttgcttcacatgactacatagcacaaatgctacagacccgattcttgttggtgaactacatctaaagggttccccttgtcgaccacaaaacatgtctctttcggaagacgatgacccacggcaccacctctggtataaattttacccaggtccaacaaaaca

SEQ ID NO: 487992 - DNA, 172 bp, Homo sapiens
ctgaatgctgcaggtactctaaggatccgtcgacggggattaagaccagctctcctgttgtgggatcaggacataggaagagttgctgaaaggcacgggtgctttttgggattagtaggcatcactataccatctttgaaccaggtgtattcagaaggtggggaaacatctt

SEQ ID NO: 487993 - DNA, 885 bp, Homo sapiens
  misc_feature (7)..(7): n is a, c, g, or t
  misc_feature (66)..(66): n is a, c, g, or t
  misc_feature (97)..(97): n is a, c, g, or t
  misc_feature (108)..(108): n is a, c, g, or t
  misc_feature (112)..(112): n is a, c, g, or t
  misc_feature (127)..(127): n is a, c, g, or t
  misc_feature (131)..(131): n is a, c, g, or t
  misc_feature (136)..(136): n is a, c, g, or t
  misc_feature (151)..(151): n is a, c, g, or t
  misc_feature (196)..(196): n is a, c, g, or t
  misc_feature (210)..(210): n is a, c, g, or t
  misc_feature (221)..(221): n is a, c, g, or t
  misc_feature (247)..(247): n is a, c, g, or t
  misc_feature (255)..(255): n is a, c, g, or t
  misc_feature (264)..(264): n is a, c, g, or t
  misc_feature (274)..(274): n is a, c, g, or t
  misc_feature (276)..(276): n is a, c, g, or t
  misc_feature (282)..(282): n is a, c, g, or t
  misc_feature (284)..(284): n is a, c, g, or t
  misc_feature (313)..(313): n is a, c, g, or t
  misc_feature (318)..(318): n is a, c, g, or t
  misc_feature (404)..(404): n is a, c, g, or t
  misc_feature (423)..(423): n is a, c, g, or t
  misc_feature (484)..(484): n is a, c, g, or t
  misc_feature (504)..(504): n is a, c, g, or t
  misc_feature (557)..(557): n is a, c, g, or t
  misc_feature (559)..(559): n is a, c, g, or t
ctcgcantcattcctgcggttgcgcgcccttgtagacagccggggccttcgtgagaccggtgcagncctggggtagtctcctgtctggacagagaanaaaaaaatgcngaanactggctcagtagtncctntgcanaggtttggctattgntacgcagcactggttgcttctggtggatcaattgcgtatgtaaancaagcagcgtccgncacttgcttcnaggcttcacatttgcacatctacccnccctgggngcttacccnctctctcacnanccaagnancgtttgccttttcctagctacatctggtnccttngctggcattatgggaatgaggttctaccactctggaaaattcatgcctgcaggtttaattgcaggtgccacgtttgctgatggtcnccacacacgctggagttangtatgttcacgaccccttagcgagtctgttccagcttagactgatgagattaaaatctgcntctccactacaatatattangagaatagtgcagcattgctctgacttttacctaaaaaaaagacaccaaactngncagagaggtggaaatcagtcatgattacaaactacagaggtggcgagtatgtaacacaagagcttaataagaccctcatagagcttgattcttgtatattgatgttgtcttttctttctgtatctgtaggtaaatctcaagggtaaaatgttaggtgtcagctttcagggctctgaaaccctattccctgctctgaggaacagtgtgaaaaaaagtcttttaggagatttacaatatctgttcttttgctcatcttagaccacagactgactttgaaattatgttaagtgaaatatcaatgaaaataaagtttactataaataata

SEQ ID NO: 487994 - DNA, 1877 bp, Homo sapiens
  misc_feature (495)..(495): n is a, c, g, or t
tcatgacatttctatgaatgtgggcgtagattctgatgagagatcgtgtctgctgtgcttgcacgcacatgacggtccctaccacggtgtctcaggcgttactgttgacatgctcgtgtgacacgatggagtgtaccacatgttacatcgagagtagcatcatatgaagagagtgcgtccactgtggcctccgtggacgactgtggtccttgagtggtttagtctatagagatctgtgatctgtgagttgaggaggagcatgttcactctagtacatgtcgctatagtcaacagctcaggaccactgattgcttgagagatagcgcagcgagattcgtctaatattcatagataccctggcgattcgtgacgcctgtgcagtaattgaggcttgttgtgtatcaggtgccgtaacataacggtagatgtcgttcttagacttaatttcccttgtatcagcctaaacgtgattaaggcaagacaactcactgattncgaatctagcaagtagcttcgccctgaggtgagagagccattggatgtaccaactatttagcatgtggccaaaggggtggtgcaatgcgacattaggaagtgctataaaactcattgttacactaaacctcgagtgagtattgcacaataaataggtgagttgcacgcaccttggccctggcattggcaaaccagtgtcaacccacgtgtattccacctccgtgtggtacatggcgtggctcttccatgaaacatattttcccctttgtcacaacagcaatgtggctcctaagtcgttcgcgtggatacgttataccaagaggtaggagaaccacctggttgaagcgtacacgggaaagtcactgggtccgaacgctttaaagcctagcgactgattggaatcccgtttgtagagggggacgcatttggcaagatttgcgctgtgctaatgccttggaacaacaaggggcaaccacttgcatggaatcgtgcacgcatggccgaacaaggtgcctgtggtgccccgatgtgtcggcactgcgacaagcaaagcacactgtgtacccccaagtgtcatttggtgggtttgacatacctaggcgtgacgtatgagtgaggggcactcttaaatcacagaatggcgtatattcgcccactacaatggagattaggagcgattggtctcttattcgtacccaggggtggtggtccttccaaaacgcggaaggaacacggcccggcgggttcctagtaggcttatgaaaagcactttggtcacattggttataccgtagattagtggcacacccgtaggcgaagcaccagcgtgagccctcccaatttggccagggatgtgtaacacagaggataagatacaccatgagatctggtgcaagtagagaggcacacaatgtgagcgcatcaccataacgagagacacaagtgacgagagaggcacgaatcatacaagcgggagcgcctccaccgctcgtgtgacgccccaccgacaagcattgccgcggcgaaccccgtgcgacgatgagaagcccaccacaactagggagggggacaactcgcacaacagattgcgccgagcgtagaggaactgatcaagaagcgaaggagcagacagcgagcaggaaggtaagaacatgaaggaccacgagacagcagggagaaacaacaggcaacatcactacccaagagcgatgacccgacagcatgcagaaggagcgagaacgcacgcgaccacgccgacgcaacagacagacgagcgcacaacaaacaagacgagagacagaagtgagaggacagagaaatgcacgagcgcagcgagcacacaggtgcagagcagcacacacgacacaggcgaaaacggaaac

SEQ ID NO: 487995 - DNA, 1159 bp, Homo sapiens
  misc_feature (650)..(650): n is a, c, g, or t
ggtcacttacataattatcttgtggtggtgcctcccttaaacaccgcggggctttttgataaccccggtataggccctgggggtttttcctccttgtgtggagcaagagagaaagataaatatgccaggaaccctgcgctcaatatggcccctttgagcacatgtggtttgccattttgggcaaaccaccaacgacccgggtggccttttcttgggggggaatacattggccctacattgaaaaaccacggggctaagcggtcccggttcccctgggtcttgacacgggctcgctctttttgggccacgtttaagcccgggccctgggggtgcctatagcccaagccgtggtcttccaggggatcccacagggaaacgctttttgcggttttttcccatagcgataacaatctggtaccctctggctcgcgcactttaaatggggaaattgaagggttcttaacccaccctcttggaaaaaatttcacatgccctgcacaggttttaaaattcgcacaggtgcgccacagttttgctcgaatgtgtctcgccacaaaagttgggaagagtatatagaaaatgtgctcacagcacggagccccccacttatgccacgagaggctcacatgttttcccacggctttaagagnctgagatgaaagagaattataaaaaattgtgacacatactgtcccacacataatgttctcacaataataattataagagagagaaataaagtggcacgcaatttttcgacacttctgaacactttatacctcataaaaaataaagaccacccacaaacttggcacagaagagaggtggagaaaatcacgtcactcgagttaccacaaacctaacacagagaggtggcgagtatgtaacacaagagcttaataagaccctcatagagcttgattcttgtatattgatgttgtcttttctttctgtatctgtaggtaaatctcaagggtaaaatgttaggtgtcagctttcagggctctgaaaccctattccctgctctgaggaacagtgtgaaaaaaagtcttttaggagatttacaatatctgttcttttgctcatcttagaccacagactgactttgaaattatgttaagtgaaatatcaatgaaaataaagtttactataaataata

SEQ ID NO: 487996 - DNA, 898 bp, Homo sapiens
  misc_feature (7)..(7): n is a, c, g, or t
  misc_feature (66)..(66): n is a, c, g, or t
  misc_feature (97)..(97): n is a, c, g, or t
  misc_feature (108)..(108): n is a, c, g, or t
  misc_feature (112)..(112): n is a, c, g, or t
  misc_feature (127)..(127): n is a, c, g, or t
  misc_feature (131)..(131): n is a, c, g, or t
  misc_feature (136)..(136): n is a, c, g, or t
  misc_feature (151)..(151): n is a, c, g, or t
  misc_feature (196)..(196): n is a, c, g, or t
  misc_feature (210)..(210): n is a, c, g, or t
  misc_feature (221)..(221): n is a, c, g, or t
  misc_feature (247)..(247): n is a, c, g, or t
  misc_feature (255)..(255): n is a, c, g, or t
  misc_feature (264)..(264): n is a, c, g, or t
  misc_feature (274)..(274): n is a, c, g, or t
  misc_feature (276)..(276): n is a, c, g, or t
  misc_feature (282)..(282): n is a, c, g, or t
  misc_feature (284)..(284): n is a, c, g, or t
  misc_feature (313)..(313): n is a, c, g, or t
  misc_feature (318)..(318): n is a, c, g, or t
  misc_feature (404)..(404): n is a, c, g, or t
  misc_feature (423)..(423): n is a, c, g, or t
  misc_feature (484)..(484): n is a, c, g, or t
  misc_feature (504)..(504): n is a, c, g, or t
  misc_feature (557)..(557): n is a, c, g, or t
  misc_feature (559)..(559): n is a, c, g, or t
ctcgcantcattcctgcggttgcgcgcccttgtagacagccggggccttcgtgagaccggtgcagncctggggtagtctcctgtctggacagagaanaaaaaaatgcngaanactggctcagtagtncctntgcanaggtttggctattgntacgcagcactggttgcttctggtggatcaattgcgtatgtaaancaagcagcgtccgncacttgcttcnaggcttcacatttgcacatctacccnccctgggngcttacccnctctctcacnanccaagnancgtttgccttttcctagctacatctggtnccttngctggcattatgggaatgaggttctaccactctggaaaattcatgcctgcaggtttaattgcaggtgccacgtttgctgatggtcnccacacacgctggagttangtatgttcacgaccccttagcgagtctgttccagcttagactgatgagattaaaatctgcntctccactacaatatattangagaatagtgcagcattgctctgacttttacctaaaaaaaagacaccaaactngncagagaggtggaaatcagtcatgattacaaactacagaggtggcgagtatgtaacacaagagcttaataagaccctcatagagcttgattcttgtatattgatgttgtcttttctttctgtatctgtaggtaaatctcaagggtaaaatgttaggtgtcagctttcagggctctgaaaccctattccctgctctgaggaacagtgtgaaaaaaagtcttttaggagatttacaatatctgttcttttgctcatcttagaccacagactgactttgaaattatgttaactgtaaggcccatgcaattaaggttggctatctttcttccaacaaaaaaaaa

SEQ ID NO: 487997 - DNA, 407 bp, Homo sapiens
acagtgactctggacttctaaaacttcaacttattatccatctcttttgcctctctcctctccctttaaccatggttagacctcttcttgcttcacctctgttagagattgagcagaggcaggaagaatgaaacccagaaaagtcaactgaatttttagcaataccctcaaaagatttcgagtgggacgaaggttttaactattcatattacctatgtcttattctttgtgtaattgaaaatttgtcagtttcttcttacaaatacatttttattaaaatatgttttcatttaaccagtcttcacctatatcacatagttatcccagtggccccaaacttaaccaaatggatgattaaagggtgactgattctaaaattatgatctagagccaattaatttgttcac

SEQ ID NO: 487998 - DNA, 165 bp, Homo sapiens
gctgctatctccacaaacagtatttttgtgtgttacttaatatttgcgcacatgagaatcattggtgtgacactcatctaatttatcttggttgtgatagttatggtcctaataaggagaaagagggtttaatttttcttgtcttctgtttgtggaggtagcact

SEQ ID NO: 487999 - DNA, 202 bp, Homo sapiens
  misc_feature (194)..(194): n is a, c, g, or t
tgctgggattataggcatgagccaccatgccaggcctaagtggggaattttcaaaaggtaggtttccaagttaaattgttttatacatgaaaatagcccctaacgtccctttgaggtagtaagatgacttcgtttatacagtgaatattattattacaaatattactgtatacaattctgaggaagaatgaaanccaaatat

SEQ ID NO: 488000 - DNA, 128 bp, Homo sapiens
  misc_feature (10)..(10): n is a, c, g, or t
  misc_feature (92)..(92): n is a, c, g, or t
  misc_feature (96)..(96): n is a, c, g, or t
aacagagaanaggtcgagctggaagagttcaccctggtcattgctatcatctgtatagtggtcttagagcaagtcttctagatgactatcanctgncagaaatttttggaaactcctttggaagaact

SEQ ID NO: 488001 - DNA, 439 bp, Homo sapiens
  misc_feature (88)..(88): n is a, c, g, or t
  misc_feature (149)..(149): n is a, c, g, or t
cttcactttctacactttctacacattcctaccagctggctgaaaagaatcaaaagcttcttacaaccagctaaaaagaaagactttnccatgccccttgaaaaagctcattttcacgttactcaggcttcattatgctaaatcaatantcgtttagtcactggggttattgacatattttaaaataaaagtatacccttcagctactgcactcattacaggtaatttgtcttgtcagagagcagggaatattatcctagtctttcaggggctgacagcccatgaaaatacctccccatggttacaactgtaaataattttaaggtaaaatattgaaaaatcaatgactgtttcctgcaatctgtcacaaacaaatcaatcataatctgtactgccagagagtatgatttgaaggaaataggagcaaagaccccaaaag

SEQ ID NO: 488002 - DNA, 132 bp, Homo sapiens
  misc_feature (18)..(18): n is a, c, g, or t
  misc_feature (26)..(26): n is a, c, g, or t
  misc_feature (84)..(84): n is a, c, g, or t
  misc_feature (100)..(100): n is a, c, g, or t
ctgcatctagctcaaacntccttccntttcctgggctccacttgtttttttccctggagctcaggggcgtgccctccctggttnatccatgaggctgacncccctggctttcctgtctcctctccctgcaga

SEQ ID NO: 488003 - DNA, 160 bp, Homo sapiens
gtttagcggctcatccgctcacagcatcacgtcctcagacaggtctttcctcccaaaccgttgtgtcttcgtaaccatcatgcttagcccctgtggtctctcctccctcggcccttctcgcaacaatatactctgaccatgtcagccctgggtccagccc

SEQ ID NO: 488004 - DNA, 136 bp, Homo sapiens
gcacaacgatcccggagatgctcgtgcctgcgcagatatcataacttgcgtctaacccactgctgtcgcacatagtcgctgaatgcgatgatcctcgcaggtttggagctacgtggatacgtcgcacgccaagtaa

SEQ ID NO: 488005 - DNA, 614 bp, Homo sapiens
  misc_feature (101)..(101): n is a, c, g, or t
  misc_feature (103)..(103): n is a, c, g, or t
  misc_feature (114)..(114): n is a, c, g, or t
  misc_feature (126)..(126): n is a, c, g, or t
  misc_feature (133)..(133): n is a, c, g, or t
  misc_feature (154)..(154): n is a, c, g, or t
  misc_feature (156)..(156): n is a, c, g, or t
  misc_feature (175)..(175): n is a, c, g, or t
  misc_feature (178)..(178): n is a, c, g, or t
  misc_feature (185)..(185): n is a, c, g, or t
  misc_feature (215)..(215): n is a, c, g, or t
  misc_feature (236)..(236): n is a, c, g, or t
  misc_feature (247)..(247): n is a, c, g, or t
  misc_feature (327)..(327): n is a, c, g, or t
  misc_feature (332)..(332): n is a, c, g, or t
  misc_feature (351)..(351): n is a, c, g, or t
  misc_feature (360)..(360): n is a, c, g, or t
  misc_feature (371)..(371): n is a, c, g, or t
  misc_feature (414)..(414): n is a, c, g, or t
  misc_feature (417)..(417): n is a, c, g, or t
  misc_feature (421)..(421): n is a, c, g, or t
  misc_feature (458)..(458): n is a, c, g, or t
  misc_feature (470)..(470): n is a, c, g, or t
  misc_feature (472)..(472): n is a, c, g, or t
  misc_feature (480)..(480): n is a, c, g, or t
  misc_feature (486)..(486): n is a, c, g, or t
  misc_feature (488)..(488): n is a, c, g, or t
  misc_feature (494)..(495): n is a, c, g, or t
  misc_feature (499)..(500): n is a, c, g, or t
  misc_feature (519)..(519): n is a, c, g, or t
  misc_feature (528)..(528): n is a, c, g, or t
  misc_feature (535)..(535): n is a, c, g, or t
  misc_feature (546)..(546): n is a, c, g, or t
  misc_feature (548)..(548): n is a, c, g, or t
  misc_feature (551)..(551): n is a, c, g, or t
  misc_feature (553)..(554): n is a, c, g, or t
  misc_feature (556)..(556): n is a, c, g, or t
  misc_feature (560)..(560): n is a, c, g, or t
  misc_feature (563)..(563): n is a, c, g, or t
  misc_feature (568)..(568): n is a, c, g, or t
  misc_feature (579)..(580): n is a, c, g, or t
  misc_feature (588)..(588): n is a, c, g, or t
  misc_feature (593)..(593): n is a, c, g, or t
  misc_feature (596)..(596): n is a, c, g, or t
cccctcggttgcaaggtatttctgcctcagccccgggatggagaaacattgagttaaggctggttagctggtagccccttagctccctcatcccagcagcntngcacactcctnagggttttaccntccctcntgatgtccctggaacaggaantngcctgaccctgctgccacntcntgtgcantttgagcaatgccccttgggatcaccccanccacaagccctttgagggccntataccatggncccccttggagcaaagagccaagcattttccctgggaagtttttttggccaagtttggccagcctggccctgcaggtttnccatnaaggcccccccatggtttnatgggcatnaagcatttcanactccttggcaaaaaacggagtccgcaggccgcaggtgttgtnaanaccnctcgttttgtggttggggtcctgcaaaaaggcctccncagcccgggggntntggccctnaccccngntttccnntttnntgttaaagtggcagctccnagctggttntggcccngtagctggggngnccncnncngggntgntcagngcctgcctttnncaaaattnaagcnttnatggcctgtggccctgca

SEQ ID NO: 488006 - DNA, 172 bp, Homo sapiens
agtatgacaattcatacagggtccagaatatataaagcagctccgaggaaatgtctgtatggacacatcatgtggagtagtgtgcaccccctgggtcatgtaaaaagcaggtgggggagtgtgtgccggggatctgggcagccctcactgacagctggcacagattctcggg

SEQ ID NO: 488007 - DNA, 269 bp, Homo sapiens
atccaaagttgccctgtaagaagagaagaactacagtgacagagtccctacagcataaaggcaatcaagaggaaaacaacgtagacctagaatcagccgttaaaccagaattcttgaccaaggttaagggctttgaggttccggtttaactattcctgggttccaggtattggaagattgagctggcttcgaggtcacagtctttccaggatccaggaaatcagcttggtatgggaggatacatctctgcgctctggagtgctcaccca

SEQ ID NO: 488008 - DNA, 397 bp, Homo sapiens
  misc_feature (319)..(319): n is a, c, g, or t
tgaacagagtctcgatctgtcaccaggctggagtgcaatggcgcgatctcggctcaccacaacctctgcctctcgggttcaagcgattctcctgtcttttaaatgcctgtaacatctttagaactgttcccttttcactcttaaaactgatgatatttgctccctctctctttttatcactcttgtcaagctgggcacggtggctcacacctataatcccagcagtttgggaagccgaggtgggcggatcaggaggtcaggagattgagaccatcctggctaacatggtgaaaatccgtctctactaaaaatacaaaanaaaatagctgggtgtggtggctactgcctgtaatcccagctactcgggaggctgaggcaggaggttgcagtgagccga

SEQ ID NO: 488009 - DNA, 676 bp, Homo sapiens
acaagagccaccgcagattctgtgttaattgcttaggttaatggcttcagctgcacccgtgttgctgcagaggacatgatttcattcctttttatgcctatgtgggttggctttgcttttaacatatactatttctctgagtgtatcagctttgttcaccttgcctcacatttcttatccagtgtaaaccttagttgcaacataaaacaagacagacacactacaaaaaaaaaaaaaaaaaactccggggatggctgggggcattaatatattaaggtgtaacattggggaaaatgggtctttacattattaagtctttctattcaagaacaagaatgattagctaaatttgagatgcaggggggcataacaaggtgggagataccaaagacgggaagtccaatttctgccaaaattggaccgggtatcttagaaactcaggttatagattagagctagggaggcttttcaagattgagagaagaaagccatggggtccttatagttgcttggaaacaaataatactaactaaaagcaaagtatggttgggggcatatatataggaggggaccaatgaatactaaccccagacctcaggcatactaatctctagagggcacggctcgaagtatggacatgaaagaggcacaaggcgatgtaagttatggggaatgt

SEQ ID NO: 488010 - DNA, 1510 bp, Homo sapiens
  misc_feature (327)..(327): n is a, c, g, or t
  misc_feature (949)..(949): n is a, c, g, or t
  misc_feature (951)..(951): n is a, c, g, or t
cgactacgctggggtctcctccgatccaggtagggggaagagagtaaaaaactcttcctttgtgggggggggcagcactagatatatatggggggcgccctaaccacatggtgttgttctacagacaacacaggaattgtaggaggcgagcgtcgatctagaagtgtcttgatagcacgacacggcgaggggcttatgggtgggcaaccagaatccattgtattatcctccccctcccccagacgggagagtactccttctggtggggggttttttgcccacaacacaacaagggttgctcggcgcagtgaccaaagagatttctcngtccatgtaggtagagtaagaagaaggtgggttaattaaacatcccggcgggggtgttctctacgcagagaaggagggggcctctgacgtaacaaccaccctgtgagggggtgtgttggtcccaccactttggtggtgattcctgctgttggtggtgttctacaacaaactatgtctttggttgtgtctggggccgaggaagacttccacctacgactatggaagctggtctttcaccaccaaccaaggttcgttcctttaagaggagaattataataagcggggtagagaattattattgttgggcccccacacagcgttgtcaacacgacaacagcgcgcctatggtggagaacacacaaatgtgggacgcaccgcgggttcctcaccggagtacacaccacggcggtcccacgacagcaacatcatcttcttggggagcaacatgtgttacccactcgtctcagcacaggaagtaccgacaacacacatgttgtgacacgcgcgaagaggggtcttgtgcgcgcaccaagggggacacttctcacaacgcagaaagtttgtgggcgtgtacacacacacacacacactctctgatatgttgtcacatcatataggtggngngacaacatctttggtactctctgtgaggcggttctggcgccccaactctctgagagactctctgggggtgtctcactgagacgccttctctctgagaatatttctatgtgtgtgccacgagaacacactctggagaccacacgggtgttctcacacccgcggcgtctgtctgttgaatacaccgcttatgaggcacaccgcgccctcaacccacaagattcaccgcgccccgcgcacccacgctatcacacgggtgcgcgcgtgggggcacactttccactcgtgcgtgcgaccgtcggtaaaatatttgtgtttaaaccccacgctttgccctcggagaaccctcccgcccttcacacacattcccctcggggagacccaacgctggggtgggtggccccctcgctgctgtcaccctctcttccaccgggagacctcggggcttttgtgcacacacaattcctgtccccacatctgtcggcctatcccccaccccccaaagaattattttttctacccccacaccctccaataaatcccccgcgtttttgggaaaaaa

SEQ ID NO: 488011 - DNA, 147 bp, Homo sapiens
gaacggaatctctgagctgactggttctctgtgtgcgcctatctcctaggacacatcagtcaaacaggcttggagcctgtcagagactagaaggtgccttagggagccactaatccaacctccttacgctatgcaggaggaaggaaa

SEQ ID NO: 488012 - DNA, 1130 bp, Homo sapiens
  misc_feature (1)..(1): n is a, c, g, or t
ntttgttctgtggtatcttgtattgctcgtgttggtctgatactcgctgtgttgtcgtctgtgctttttggctgttgtctttctgcgtcgttcttgctgtgtcgtcttcctgctgtcttgttctccttctcttgtctttctgggtttgtcctgtgttcctgtgtatttcttctgtatgtctttgtgttcatgtgaattcctggttccctgttggttcttctgtgtcttgtgtggcctcggtttgcattttgggtgtctcctttctatttttgccatttttgcctgtgttgtgtgttcattggtattgacggtttctcggctctcggctcttgagcttgtgccctctttgtgatcggttcttctgtttcccatcggtggtcggtatgcgtaatctggtctgtgtgcccggggcctctctcgtcttctcggtgtctgtgcgggacttgcctcattgcccgcctttggtgcggtccggccctctcgcggcctcgtgctcctgcgcctcttatcctcgcacttatctcgttctgttgcattccatggagtagtatctctctatctctcattccatgtcacccatgtgggtccgtatacattagcactcctcatcatggcccgtgattctcgataaatctcccgcgtagtcccgtggccatacgtcctagttcgttgtggtacgtttatggatggctcgtcctggtgctgctagggtgtgttgggtttgcttggatggactggctgtcaccttgccttgggcatgcttgcctgggctctatgcatgcctgcttgcccctgttcgggttgcatgttgctgtgtgtgtggcctgtggatggaagctgactgatgccccatactggtggagcacaccttgcgcttaatagggaatcaccatggcccggcttgtgcctacaccacagctgctgctgttttgctgaatgtaaatggtttgtgtacaatagttttatttgattaagcttcaggatctgttttgtaaagtcgaggtgggaccgatgtggcacatcgtccatgctgcggtttcccggagtcgtggagaggcatgtgtctgtctgctcccgcccgatggctcatgacaatctcaagaatagcactgctgaaattcttgggcagt

SEQ ID NO: 488013 - DNA, 190 bp, Homo sapiens
cagaaacctcccgtggagcagaagggccaagaagattgaagccagagaaggaagccaagatgacagattttgatcgttttaaagttatgaaggcaaagaaaatgaggacagattatcaggatgaggttaagagcttcaaaggcagctctcctgaagcttctccaaaaagcacctggtactaagggtactc

SEQ ID NO: 488014 - DNA, 151 bp, Homo sapiens
tgtaatatagcactgaagtgcgagtcgagacagctgcacatgaagacaaatgaaggtggctaggctgtggttccagctatctggaggtgaggtgggaggataggttgatctgaaggttgacgctgcagttagctgtgattgtagcactgta

SEQ ID NO: 488015 - DNA, 710 bp, Homo sapiens
  misc_feature (9)..(9): n is a, c, g, or t
  misc_feature (105)..(105): n is a, c, g, or t
  misc_feature (110)..(110): n is a, c, g, or t
  misc_feature (117)..(117): n is a, c, g, or t
  misc_feature (150)..(150): n is a, c, g, or t
  misc_feature (155)..(155): n is a, c, g, or t
  misc_feature (180)..(180): n is a, c, g, or t
  misc_feature (185)..(185): n is a, c, g, or t
  misc_feature (205)..(205): n is a, c, g, or t
  misc_feature (236)..(237): n is a, c, g, or t
  misc_feature (247)..(247): n is a, c, g, or t
  misc_feature (263)..(263): n is a, c, g, or t
  misc_feature (277)..(277): n is a, c, g, or t
  misc_feature (281)..(281): n is a, c, g, or t
  misc_feature (283)..(283): n is a, c, g, or t
  misc_feature (291)..(291): n is a, c, g, or t
  misc_feature (296)..(296): n is a, c, g, or t
  misc_feature (306)..(306): n is a, c, g, or t
  misc_feature (326)..(326): n is a, c, g, or t
  misc_feature (372)..(372): n is a, c, g, or t
  misc_feature (375)..(375): n is a, c, g, or t
  misc_feature (377)..(377): n is a, c, g, or t
  misc_feature (410)..(410): n is a, c, g, or t
  misc_feature (412)..(412): n is a, c, g, or t
  misc_feature (428)..(428): n is a, c, g, or t
  misc_feature (578)..(578): n is a, c, g, or t
  misc_feature (618)..(619): n is a, c, g, or t
  misc_feature (637)..(637): n is a, c, g, or t
  misc_feature (645)..(645): n is a, c, g, or t
  misc_feature (700)..(700): n is a, c, g, or t
tcacaagtnaaaaatatttattatatgacacttctttaagaaagaatttgctgacctctagtttagatttagacaagaataacaacaaaaaaaattcttcattgnaaagnatctttnaacagccaagtgaccaagaatatcttgccaganttctntttagtagcatgtctttctacatangcatnagaagaaaaaagaaaaagtnattcaggggtttgggggggggggggcacagnnggccacaccngtaatcccagcacttngggggaccggggcngggngntcacttgngctcnggggtttganaccagcctgggaaacacagnaaaacctcatctctaaaagaaataaaaaaattaagcggggtatggnggngngtgcctgtagttccagctactcaggaggctganangggaggatcctttgancccaggaggatgaggtagcagtgagctttgactgtaccactgcattcagcctgggtgacacagtgagatcctacctcaaataataataataataataatgataataatttaggatgaagccagtaacatatattttgtttaataaaaganagcttatattctacaatatatgtagaataaaaatatatgnntgtgtgtatagacacacncctgcacncataaaaacacatatactaaaattctgggggggacagatcattaacagattgggngcacagaatt

SEQ ID NO: 488016 - DNA, 317 bp, Homo sapiens
  misc_feature (216)..(216): n is a, c, g, or t
cagtctggaggaggagtgggacagagtagtgtgccacatggaactcagcaggacagaggctgagatgcttcagacagaaaaagcatgtttaaaggatggaaagaagttcagtaagcctggagcacaaggcacagaaaggacagtaacagtaaaggaaaggaaaactagagaaaagagaggagaattaattgcgtgatgatgcaacggcccttcccnaagtcatgttaaagaagttcatggcgtacagcatgtgaagtcgttacagactggcagctattggagaccacgttaagaagacagctagcgtccatggtcta

SEQ ID NO: 488017 - DNA, 287 bp, Homo sapiens
  misc_feature (24)..(24): n is a, c, g, or t
  misc_feature (41)..(41): n is a, c, g, or t
  misc_feature (111)..(111): n is a, c, g, or t
  misc_feature (126)..(126): n is a, c, g, or t
  misc_feature (262)..(262): n is a, c, g, or t
gacttgcagacgcgggttctgccngagtgttaaacagagtnctggggggttctcttaggggagggaatcccggcggcgggctcggggctatttgagagctaggtcttattnggggactgggaatgnatggagtgaccggaagtatacgaggacgggatcagaggccgtatcgtgtttgggatgcctttttgggataaatgctagaaaacggtactatagctggtggaatcaaatggccatgggttactgggaggggctgctngtggagcttgctctggcgggggtga

SEQ ID NO: 488018 - DNA, 83 bp, Homo sapiens
agggcggggacgggggttttttaaaaagggttttggggttccctttggggctttgggcggaaaaaaattttttgggggcggga

SEQ ID NO: 488019 - DNA, 115 bp, Homo sapiens
tgtggttggtgttctagaggatcccaatggagtcttcagtggcagccctgaatatagtgaagagaaagagttggaaggatcaccggggaacaagaagagtacaacctgccggtgg

SEQ ID NO: 488020 - DNA, 193 bp, Homo sapiens
gtaatacggctctcttgggacagtcacagttgggtgaggcagcatctcttagtctcctgcagcattcagccgagggcaggaagtgagactgacccttcctcctccccgccccggaaaatgaataaggagtgattattttcgcatcatttcgggggcagaacgaagcagaggaacgggtggggaggcctgggag

SEQ ID NO: 488021 - DNA, 130 bp, Homo sapiens
accccgagacacgggggtgaaaaacatccctttgtaaaaaggttttttgtttaccgggggagggggggggaaaaatcttgcgcctgaaaaggggggttttttcaacctccctgaggggggggtctaatcc

SEQ ID NO: 488022 - DNA, 158 bp, Homo sapiens
aagaaaatgatcctagagtgaatttttctagaaaatatctattatgaaccatgctgtttaaagtaatagctggatccatcaccttcaagctaatactttaaacagcatggttcataatagatatttaaaggattagcttgaaggtgatggatccagct

SEQ ID NO: 488023 - DNA, 138 bp, Homo sapiens
tacctgctcaaacttgttacggaagtcatctgcagccagactgggcgttgtcgatactgcaggacaatcctggagtactcaatggtggcaccaatgaatcttgtcccgcaggacctggatggtcgtgtagtagtggct

SEQ ID NO: 488024 - DNA, 776 bp, Homo sapiens
ggggtcttgctgcccacgatcggccggctcctccgcattccacgaatctccccgtggctctccccgacctggacgggtggacgcccttggggccccaatgcctcggtctgccgcggggggcggtgcgcctggcgcgccatggctcgggtgccgtgagaggtggcagaaacctcagggtcaggcagcagagagactgataaggctgatggagtcgagctgagtcccgtgggaacagcgagagcattcctagatgaggccagttcctgcccggggtgagtggcacggccattctgaagaggaagggctttgccgatggcatgaggaggactctgatggagaactgaatacctggagagcgtgtctagagaaggaacagagtgatgcatccccaggggtgagatcagcctgtgcgattctttttaagtgagggacatgggactcggatgttgaaagctagaatcaaggggaatcgcatatgatgctgactgattagtccaggatgagcaatttctcaggagcttaaaccttggagtgtgctgtgcccccacaaggagacatgatctatgaccccaagtgtgggcaccatccgcctccagctgataccctattattccaagatggtcttctgaaagcaggaccagtttgacgatgctgaagattgagtgtggagcttttctgacttgtaagtgggcgggctccacgtgaagatctcttttgcctgtgctggacgtggagacgttcatgatctggagaaaaatgtttgcaagtgaccccta

SEQ ID NO: 488025 - DNA, 698 bp, Homo sapiens
tctcgcccccccgccgtagacaattcgtaggcagtgtcgtgcgggtttccaactgaaaccggttaggaccgaccgccttagtgtagttgcttccacatagggatcaccgctttacaggtacgaatcctggcgtctgctgtgtggcgtgcgatcgaaacagtgtttccccgggacagcgatttcggcattagccgagctagatctttgcttccagaaggcaccctatgctgatctgccaggcagtgacgatcggtctacaaatagtgtatccctcgggctgccgcattccggcaagagcttgcacaccttttccctatgattgccaacctcaaagatctcaaataactttgtaggctggtgcaggcagagcaacttctttagaagaacttgtcatagatgttaagccccagtggacaccagttgaaaggtattagactagtcttcaataaggatgcagtgtcctctgatgagggttgctagaatgaacttgtcagtaatgcatggttagttttcatgcaagtcattaaagtgattaatagcatcccttgcttttaccccagtcagtagcccgcctccaagctttgacccccgttgcccttacccgtcggtgtaaagtcaacactgtgttctcttcacccaatattcctcaatatttgcgcatattgcattggtgttccaattaatattcaatgaagatt

SEQ ID NO: 488026 - DNA, 114 bp, Homo sapiens
ggagtaaatcacgccgtccatacgatcgcctatcactcctgaaagggaacgtctgattggcgataccgcccagaaccagatcacctaccaaccccaagaacacggtcttatgac

SEQ ID NO: 488027 - DNA, 1027 bp, Homo sapiens
ttaaaattatgacatttttgctttgtgattgaatttcaaatagcagtatggtatcctttcatatattaactagataaaaggataccatactgctatttgaaattcaatcacagaagttttgaatataagcgggtaaagccgatcttgaaggtgacgcctttcacggatatttgtcctgttccaatttggccaaggccctttttgatttggtccactggtttggcaaataattagcaagaacggtgagaccagtgggggggcaacaattgtggcgtaaatgataatcaaacatgttcgaaattctaaaagtctctacatttacctaggttggctttctcccccagttcagaagtttccagcttggccaatcatcagaatcacttgaggacacttagaagagaagctcccttggggtggtagctccctaatgttagggttagggctgagagctctgggattcccccccattttttgaacggggttccccacctgaggggtgtctgggcataagaccgccttcttttggacgcaggcttgctgcgcgggagcttttatttcccccatgtagcaaccccgggaggttggcgatacatttctcgtgttcagtgcgatttcttcccccctccgtagtgggtctctgtaattaaaccgggcccttcctcaaacggtgttgtactattctgccgcgtgtttctttcccatggccccacgcacccaaagatctggttagggttaaccaaagcaaccaaagcaactgctcggcacagaaataacgacaaggggaagacccactggatgaggtaacatacaaaccacgaggggaaggaaattgtgcccacaaaccacacgtgcgtggtgggcaatctaataacccctgtcgggagaagtccacaaacgcgactaccttcacactttagatatcaaaatggcgctcactaacccctgcgcacggaaataatgagtacacccacatacatattattaagaaagcacgcctgcattacacggagtaccacaataaaggcgg

SEQ ID NO: 488028 - DNA, 143 bp, Homo sapiens
ggagcccccgagaaggcttacctcaaacacttaggaaatactaacacagataatttttaaaatactgcctctacatacaatgattgtgggctttctctgaagaagttgtctttttttttcctttttcctctgggggggggctg

SEQ ID NO: 488029 - DNA, 857 bp, Homo sapiens
aagctcgaaccccgttgttagactcgcagctctcgggcttctgctccggaggcttcttccctgacccgcccggggccctgacctgtggcttcttccccggcctgatctgcgcagcccggcgggcgcccagaaggagcaggccggcgcgggggcgcgctgggcgggggagagcgtggcctggagctagcaggcaggcaagcgggctgggactgcatcggccgccatccatgcccggacgagcagctcagaccattgtcgcctgaagaatggacgtatcatagtggtacttcttatctccatcccgcatcggcgttcctcatttaagaaagccggtcctgggctgaagagatggggagcagccgcatgatggagccatggaggctcacccatgattatcaccattgtggcaccaaccaacaacattatgacatactctggtacaccaatccatcgagggacctgggccctcaattcatggcccagaccatgatcctgcgcacggcccatgagctctgagccatggacttatcatccataatactccatgattcgttccagagcgcctcgagacctccctggtgccatgcccacatcccacgcgcctatcacgcaagtgaccagaccagcatgctagcatgaactgcgtgacagcgtggtgagccatggcacagtgaagtccaggaacctgcagtcgtggccccacacgacaggcaagtggacgtcagcgctacagcaaggggggccaacccatggggactggctgccccgaagtgcacctccctgattgagacaagcacgcacagtacagctcactgggactcatgaaggcccgaaataccacgaaagaaccacaggag

SEQ ID NO: 488030 - DNA, 123 bp, Homo sapiens
ggtgattaaataacaataaaccctgtatgtcacataagcaaccatattttaatgcaaacaataactgcattttgaaagacagtacaattagtgagaaaagtggcatttaaaaaaatctcatta

SEQ ID NO: 488031 - DNA, 240 bp, Homo sapiens
agattggagatacagatttgggggtagtttataggtgatgtttcttcaagagactcatagatgaaagagtagtagtgcaagacgaaacttcaatgacactggcatttatagccaaacaaggaggagagattctgaagcagactcaggtgagatgtgggagtggcgtgaggatggagactcgtgagatgcattgcatggaggctgtatggatattatgttttagcctaccggtatttaaca

SEQ ID NO: 488032 - DNA, 228 bp, Homo sapiens
  misc_feature (105)..(105): n is a, c, g, or t
tagagatccccgggaagggaagagagtggctcacctgcagtaaatagctaaaaagccaagccaaagctggagggagaggacagtcgcatgtccacctgggtctgnggtgtagggtttcccttaccctgtgccttctatctggtcatgagcctagtcttgcagccttgtcttagagctgctctatgtcagaacaggatctgtctccttttggacacttcctggacctca

SEQ ID NO: 488033 - DNA, 914 bp, Homo sapiens
gctgcacatcccggcgtacgcgtgtgccgacgtttcctcctccatctcttttcctccgcctccgcggcgcgatggcgaagccgctgacggacagcgagaacgcggacgcagatcagcgtgcgcggctggcggggctaggcgacgtggcgaggtgcggaagagcttcaaccggacttgcacttcatgctggtcaaggaccgcaatgtggccacgcccgcgactacttcttcgcgctggcgcacacggtgcgcgaccactcgtgggccgctggatccgcacgcagcagactactacgagcgcgaccccaagcgcatctattaatctttccctggaatctacatgggtcgcacgctgcagaacccgatggtgaacctgggccttcagaatgcctgcgattgaacccatctatcagtggggttagacttgcgcaagggaactcgaggagctacgcccgaacgatgctgccttgggaatggaggcctggggaggctggcagcgtgtccttgactcactggctaccttgggcctggcagcataccgctatgggactccgtatgaattgggcattttacccagaagcttgtcactgggccggcagggtagaaggaggccggactgaccttggcatgcggctaacgggaacgcccctgggacgaaagcgcggcctgagttatatgcagccgcgcgcacgtactacggaccgcgtggagcccaccccgacgggcgttgcagtgggtgacacccacacggtggtgctggccatggccaaagaaaacccaggcccggctacaggaacaaccgcacaacccagcgggggggtccgccaggtccacaggaatcaagcgcggcactcaccttggccaccacacggcggcgcacgcacggcgacacacccgcgcgctccacaggaaccg

SEQ ID NO: 488034 - DNA, 208 bp, Homo sapiens
tcgaccccgacccttaacgaccagattacaaagtaatctgaattcttggattttaaaaagagtcaacccacctattttggtgattgcgaatctttgacaaaagagtacgtcgatacaaagagaataaatacggaactcctgattaaagaccaaaagatcgacaattacgtgacaactggaagtattaccacggatgcgttcgctaggg

SEQ ID NO: 488035 - DNA, 656 bp, Homo sapiens
  misc_feature (533)..(533): n is a, c, g, or t
  misc_feature (574)..(574): n is a, c, g, or t
cccgatgtagaacatgacctgaaacactgccagtatgacactgagaaaggcctagctgctgggtacaaaggcttaaatgaccatcatgtttacctggcgggcacactgctaaatgccaacatggcgactgctggacatgcatgcactaagaagtatactccagaacaagtagctatagacaccgtaacagctatccaccaaactgaatctgaagctgttcgctgcgatatgatgttagaaaggtggcatgagagaagaggatgccactatgaacctgaatgctaacaaactgtgcactgtagcatagtgctcgaaactaagcatgtcttatggacggaacctgcacgacagtgtactggctgtaagacggggctggctgcaaacaaggatgcaacccacgaagctgttatgaaactggccaatgctatcttgcatgccgccagaggacacgatgattacacgggtattgtagggctgtgttcatacagtatgttgtgacagcctggtatacctactacgggcccaatgcacgncattgctattgcagagcgtctaatgggaaggcttcaacgcnagcacactttcctcttattctcgaaattccacacaatagatttttactgctggaaatccacacctgtaattgaagtacgggt

SEQ ID NO: 488036 - DNA, 115 bp, Homo sapiens
aatgttccatacactatgattatcacgtctattgatgttctactatctacagaagaacatttaaacattaaatagtatgaactctcatcaattttttttttattattttttattg

SEQ ID NO: 488037 - DNA, 185 bp, Homo sapiens
actaccgccgctgggccgaaatcatcgagctatcgatcaacttgaaattggccggtgacctgatcgaacgcatgctgcgcaaagtccagcaacagaagacttcgcaacgccggcaattttccgaagtgggcctggaggaactcagtggcctgcacagccagttgatcgccaacctgcgcctgggc

SEQ ID NO: 488038 - DNA, 345 bp, Homo sapiens
tgtgtgtagaagctcataatagcttggtagaggctattaccgtattacctttaaatggtgctcctgcaactcttgttctcaaagaatttctccaaaccttagagttcctcaggtttcgggattaagagctactctgcattacagggcatcagtcttaaccatgatcactccgggttcattagaatttatcagctacagcgtttcttgttgaataattctttgaagatgtcgtctcataatgtctgatccaaggatatctctcaagtggagcacaaaggtaactacctgacagcccgggcacaaggcctagagttagagagcaccacagtaatatgctcaaggcac

SEQ ID NO: 488039 - DNA, 210 bp, Homo sapiens
gtcatggtagactcgtaaacaaaatggtacagcccttccctgaatagacccgcttcttgctgtgggaccagtcgggctttgtaggactaacaaattagctgcggtgttagaaataatggaataggggtcttgtggcctccgcatgtgagagtctgaacctccccaaattgattcgggggatcagctcactatggtaaagcctgagatcag

SEQ ID NO: 488040 - DNA, 726 bp, Homo sapiens
cgacgctccgccgtacgcgtttctctgaccggtcgcaaatggaagaatgagatcgaccgacgcatggatcatatgacaactggactccggcatgtgcaaatgctggcttttgctggggactgacgctccccgagaccgtgtttccttatccatcgtcgggcgccccagacaccagggcagtcatggtgtggcatggtgccagaatggactcctacagtgggcgacgatggcccagagcaatgcagtggcatcctgacccatgaatgtacacccattgatgcatggcatcgtcaccaactgggacgacatggaggaagatctggcaccacaccttctagcaactgagctgcgcgtggacccggaggagcaaccagtgctgctgaccgatggtcccacctgaaccaccaaggccaacatgatgagacagatgactcagattatgttttgaggaccatatacaacaaccctggacatgttaacagtggccatacccaagacacgtgctatgtcacctctacgcctctgggacgcacacaatgtgaaatatgttcagtgggacatcttgtgatgaaagatgggtctacaccactactgggtggccctctacttaccgacgggctaactgcagtcgccaccaagtcattttctctggtgttattagaacatgagaaatgaccggggacctgcaatgattaccttcatgatgatcatcaatgatcaaataaa

SEQ ID NO: 488041 - DNA, 298 bp, Homo sapiens
  misc_feature (202)..(202): n is a, c, g, or t
taagatctatttgtaaattaggattaaaaagggtttaacccctttttaaggctgggtgaatttttttaaacaaaaaccctttgcaatatgggtttcttagagatttaaccaattataacttattagcagtcgcgagcccatgtttataaagtcaatgtaaaaaacccctaatgagtatttggtaaatcccaggaggcttttncccttagcaaaattttgtgttggcaaattaaggtccaattacctctttaattttggataaaattccttggttaacaaaaaagtggcaaaagcccca

SEQ ID NO: 488042 - DNA, 152 bp, Homo sapiens
  misc_feature (128)..(128): n is a, c, g, or t
gatagcggatgaggggctgttgtcgtttgagcatgtcgagcagttactgtggcttcttgtatatggataagctgctgtccttccccttcaaaactgaccccggcagtacaaaaactagtatatgcatntgtgcttgattgatgatagaactc

SEQ ID NO: 488043 - DNA, 168 bp, Homo sapiens
gagatgagtaacactgtaccccggccggggcgacagagccagacaccgtctcaaaaaacaaacaaacaaacacatctacactttttaatactcctcccttcaataggtcacgtttaatttctaccctatatcccctaatatgggctgtcagtagcaattcacttgggg

SEQ ID NO: 488044 - DNA, 588 bp, Homo sapiens
tccgaatccaccaacgcagaggagtggagagagaaactccggagaagaagcaggagcgggtgcggcggcgaggtcgatgtcgacgacggcggggtacctggcgcggcgcgcgggccagaaggagcgggtgcggctgctctaccgccgcgcgctcaaggacaccctcaactgggccgtccaccgccacctcttctaccaggacgcgtccgagctcagggacaagttcgaggccaacagaaatgtggagaacctggacgtgatcgataggctcatcgaggacgcggaggcgcagcagaggaacttccagcacccggatccttacattgttccatgggctcctggtggcactaaattcacaaggaaccctcctccacctgaagggattgagattatctacaactatggcaaagaagaccaatgaacaagaatcatgcatttgtgagcagagcctggcaccggcggagtgcaaaggacttacttttgcttttccagatgatagcatgcaactgagctgctgtatgatttgttaagaacaaaataaaattactagcctccttccatgtgtttctttttatacacataaaaaaa

SEQ ID NO: 488045 - DNA, 127 bp, Homo sapiens
ctattcacggcacctcgctattcatcggcaccattagctctagaggtccatgcatacttcatattatactttaattcaatactgcatagtattgtgtagtgtggactactatatgggtgtcgacgta

SEQ ID NO: 488046 - DNA, 430 bp, Homo sapiens
acttggagtatgtcctcatccctcatggtatcattgtggacagaattgagcggctggccaaggatattatgaaagacataggatatagtgacatcatggtcctgtgtgtgcttaaaggaggttacaaattctgtgctgatctcgtagaacaccttaagaacatcagccgaaattcagatcgatttgtctcaatgaaggttgatttcatcagactagatctttcaacgctggctggaaagaatgttctcattgttgaggatgttgtcggaactgggaggaccatgaaagcactactcagcaatatagagaaatacaagcccaacatgattaaggtagccagtttgttggtgaagagaacatccagaagtgacggctttagacctgactatgctggatttgagattccaaacttatttgtggtgggatatgc

SEQ ID NO: 488047 - DNA, 339 bp, Homo sapiens
tttcacccacgatcacagggttggtgtaaaataggcggtgaagtgctgctaaggctgacattataaacggcacgatcaagtgaatggtaaagaatcgtgtgacggatagaggactgtactactgagataactctcctcatcattcattgtaactaagtctgtcccaatgtcatggtatagtgccgtgcatagataagtttgtatttactgtggcccctcagaataatatatggcctcacgggaggacatatcctatgaaaggctcgttgcttatagtatacaagctagaggataatgccaatttgacaggtttctgagtacagcaatcatccgtaatat

SEQ ID NO: 488048 - DNA, 123 bp, Homo sapiens
ctctagaggatctccccctgtatacccaccctgaaaattttccgcaaaggaaggcttatgactacgacggccacgagaaaaactatggaatcgttgattaccttgatcgagcagtccgggcct

SEQ ID NO: 488049 - DNA, 296 bp, Homo sapiens
cgtcgacttatttactttgtgtgatattactgtgtgtgtgtgtgtgtgtgtgtgtgtgtgtgtgtatgtgcgcaggttttcatccagtttttgtctcatacgccacatagccattgatacagtgtttgatataacgctggcgcactcagaaataggcttcaggaaacagtctctttctgaccttctcgtgctctcctctcaccttcagagagtagaactctaatctgagtgtgggtcataagactctcattccagagaaggttctgactcataccctggaggaaggaatgccgcag

SEQ ID NO: 488050 - DNA, 506 bp, Homo sapiens
gggttccccccgggggggggcgcttttaaaaaaaagggatcccccgggcccaaagattttggcccaaggtatttttttttcccccaaaaaccttgggcccttttttttcccaaaggtttccctgaggcccccccccccccccttgcccttggttttttaaaaggggcccccccatcccctttttcccccccaaggggggaaaggggccccctcccgggggttaaaaaaaaaaacccttgtgttttggggcccttaatttattcgcccatgcgtgttttttttggccaaggggggttcaaaaaagggttctttttttcaaggtggggttaaagtttttcttgttcaagggcaaattttcctaggtttttttttaaaagggtttgggtaaccaattccattttgttttttttagccggtaaaaaaagggggtaaagggcccttttttaaaaaattacccctgtgtttttccccaggaaaaaaaaaaaaattgggggccttccccccca

SEQ ID NO: 488051 - DNA, 414 bp, Homo sapiens
aacggatgtcgtcactgagcagcatgtgtgagtgcggcaggatgccagtcccaggaagacagtcctcatgctgggaatccggctccaggtgcattaaccctgctgcctggagatgtgcagagctgtgtagggcttctcgttgtctaggcagccatgggtctgctgggttgagagatgtgatgcctgagcattggcctcctctccaagctgcctgaatgttgcctcccatggtggaaggtaatttgtctctcgagtcctttcccagaactggtcaaccatggcaattccccaattcttccaaagccaagtcaataaattggggccttggcttgctcacctgaaaaatgcagaagccaagactgaccccctggaggccctggaggtctctgctcatgaggagcggcctgtttattg

SEQ ID NO: 488052 - DNA, 978 bp, Homo sapiens
gacccaccgaggcctgcgcaaggatggcctgtattggggcatggcatccatgcatcgtgtagccttctctgtggcacgcgcatgggcagaaaggctaccatcaccgcactgcagcatcaaccaagcaagctttcatacagcattggccagtggctcacccttatcaaggacggcccagctgcatcaagaacaatgcctccactgcactatgacctatctgacaagagcatcaaccctctgggatggcttggtccacatatggtgaaagtgaccaatgacattcgtcactgctgacacggctgtgtggtgggaatcacacgacgcgaggtgctcaacctccgacaagatccttgctggatgcagaccgaagcggcgggctctggacgacgacttgacccttcagattcattgacaaccatgctccaagattaggccatggccgacttccagaccatggacggagcagacaagcactcatgggaccactgccgacaccgaccgcactggcacaggcacacgaccggaggcttaactgccaggcaacacgcctcaggccagctgggagagaggtcctcacctacaccaggttactcaccccaccgcacaaccacacaccaaccacaccccacacgcgacgcacacaaaccatacacgcagccgcacccacagccccaccccacaaccgcctcaacacaaaccacgacgcaaaggagacacgggccccacagcacggcacaacgagagacaacaggggaccccacagcggggcaccaccatagaaacagatccaggagggcaaatgcacaacatgcgactacgaaactcctccaccaaccgaatcacagacgccgccgagcagacacacaccagacgcgagaccacacacacgaccggaggcgagcgcaggacacaaaggcggacctcaaacggcgggccaagcggacgagccgtatgaatacccccccagcgcgggagcac

SEQ ID NO: 488053 - DNA, 498 bp, Homo sapiens
gtgctattttacaactgaggaaactgaatccccagaaaagtgaaataaccccagccaagatcatggagctactaaactgtggcaaccattattttgaatcttagtcctctttacatgtaaagttctttaaaatattccatctctctaaaagttcccataaaaatatatatgttggtgcactgcctgtaacccccagcactttgggaggcccgaagcgggcagatcacttgaggccaggagtttgagacctgccttgccaacatggcaaaaccccatctccataaaaatgcacacacacaataatagccaggtgtggtggcgtgcttataatctcagctacttgggaaggtgaggcatgagaatcatttgaacctgggaggcggaggctgcagtgagccgagattgcaccactgcacttcagcctgggcaacagaacaagatgctgtctcaaaaaaataaaaattaaaattaaaaaaggtatattttaaacgtgtggaa

SEQ ID NO: 488054 - DNA, 190 bp, Homo sapiens
attgtacggaccgaactacttgaccacctgtcgtacataaaaacccaatccacatacaaaagcccctccccatgcttacaagcccagtacagcacatcaaacctcacatatcacacatcaatctgcaagctccaaacgccaccccatcatccacataggataccaaccaacaacctgtgtaccggcgctc

SEQ ID NO: 488055 - DNA, 326 bp, Homo sapiens
  misc_feature (168)..(168): n is a, c, g, or t
ctcgccctgaattctttcttgcgcaagatccaagaaccctctcttggggtctggatagggacccctttccagtacagaacctctatgggttcagctatctggaagttccctgtgttagagatgtgtgaaccaaagcaactccaccttgagtaggagctgggtaaaatnaggctgagacctactgggctgcattcccagacggttaaggcattctaagccacaggatgagataggaggtcagcacaaaatacaggtcattaaagaccttcttaataaaacaggttacagttaaagggagctggcttaaaattcaccaaaactgcgat

SEQ ID NO: 488056 - DNA, 430 bp, Homo sapiens
gtcatataagcgctcagatcggtgttcttctaaaacctttaagataaaagaaagaatacaacttatacattaaaatgtttagttagtacatatcccatgaagctataaaaaaaaacttctcctggatagagaaattctctccactagcagcagccattccaaccagtttgtttcactgaggtgttgggataatgctcgtttatgttgaggacatagcagagttttccatgtcgtcaggtactaaataggtataataatagaaaaactctttcatgggcacaataatttactgctaagcatagaatttagggttataagcattcaatacagtcactgtttactgaacccacattcagtgtcccgcaactcccaagagttccatagtagaatatatacccgcttatatgacgctagggtaccgagcctcgac

SEQ ID NO: 488057 - DNA, 151 bp, Homo sapiens
ctcaaggtctttgctggtgggcaggtctttgctgggtcggactgtctttgcttggtgggacacgactctttgcttggtgggacacgtggggactcctcatacgacgtcgaccctgcactgtgcacgtgccactgcttggcaccttggcctg

SEQ ID NO: 488058 - DNA, 119 bp, Homo sapiens
agaatataacgttgtgttacggactgagcagcacatctttgagagcatgcacgtgcgattcgactgggctgtctgtgattctcaagagacagccatgcagcgtgggcccacgggtacat

SEQ ID NO: 488059 - DNA, 801 bp, Homo sapiens
cggtgagagcgccttgacgccgggatccctccccagaccttggagcccggtggccgacctcagatttggcaggacccccatcctgcgtccagcccgaggaccgatcctgtatcactgacggtccaatgaggagacctttgctacgaagtcccatcaaagaggagggggactacgtcgctggtctttgaaatttgcagaggtctactttgcacagtccccgcccaaggtatttgatgtgacgattgaatgcccccctcgtggtgaaggacttggatatctttgatcgtgttgggcatagcaccagctcacgatggcattatacctatgagccatccagaaaggggaaactgagtgtcccgggggaggtgtccccccctcaccgggagaactctaccttgagtttgtccaggggtactatgaccatccccaggtctgtgcactctacatcatggctgggaccatggatgatgtacccaagcttcagcctcatcccgggattggagaagaaagaagaggaagaagaagaagaagcatatgatgaagggtctaatctccaaaaaccagacccataagaacccgggtgccagtcaggcccccgcacaccccacccctatgcctccggaccacagccagcctcatgtttcccatcctggtggccttcggagtcttcattcccaccctcttctgcctctgccggttgtgagaaccaatgactatcctgaaccgggtggaggggtgtgggaaagaaaacccgccatattggttttggtttctgtatttttccccatgattaatgaacca

SEQ ID NO: 488060 - DNA, 1602 bp, Homo sapiens
  misc_feature (760)..(760): n is a, c, g, or t
  misc_feature (924)..(924): n is a, c, g, or t
  misc_feature (978)..(978): n is a, c, g, or t
  misc_feature (984)..(985): n is a, c, g, or t
  misc_feature (987)..(987): n is a, c, g, or t
  misc_feature (991)..(991): n is a, c, g, or t
  misc_feature (1002)..(1002): n is a, c, g, or t
  misc_feature (1014)..(1015): n is a, c, g, or t
  misc_feature (1028)..(1028): n is a, c, g, or t
  misc_feature (1032)..(1032): n is a, c, g, or t
  misc_feature (1077)..(1077): n is a, c, g, or t
  misc_feature (1081)..(1081): n is a, c, g, or t
  misc_feature (1086)..(1086): n is a, c, g, or t
  misc_feature (1108)..(1108): n is a, c, g, or t
  misc_feature (1116)..(1116): n is a, c, g, or t
  misc_feature (1119)..(1119): n is a, c, g, or t
  misc_feature (1122)..(1123): n is a, c, g, or t
  misc_feature (1131)..(1131): n is a, c, g, or t
  misc_feature (1142)..(1142): n is a, c, g, or t
  misc_feature (1148)..(1148): n is a, c, g, or t
  misc_feature (1155)..(1156): n is a, c, g, or t
  misc_feature (1172)..(1172): n is a, c, g, or t
  misc_feature (1178)..(1178): n is a, c, g, or t
  misc_feature (1189)..(1189): n is a, c, g, or t
  misc_feature (1222)..(1222): n is a, c, g, or t
  misc_feature (1443)..(1443): n is a, c, g, or t
  misc_feature (1451)..(1451): n is a, c, g, or t
  misc_feature (1472)..(1472): n is a, c, g, or t
  misc_feature (1510)..(1510): n is a, c, g, or t
  misc_feature (1594)..(1594): n is a, c, g, or t
gttctgtcttcctcccggtccccgctcttgcctccttcctcttcttccttccgcgtggcctcctgcttcgcgccgtcttcgcctgtctctggtctctcgctcgcctcgtcttgtctctctcttctctccctttcgctgttcgcgtctgttcttcgttctcactctctggttgtctctccctctctctcttcctctttcgtctgtcttctctcgttttctgctctctccctctttgtggctcccgcttccttctctttcgtttctctcctgttcgttgttcgtccccgctcctgcttcttccctccgtcttgtccctctcgtctcctgttcgttcgccttctgcttcttcgttcttcttttctttttctcttctatctgctctccttcttctccttctctccctctccacgcttgtctgttttcttttgtttcttgtggtctgtttggtgtgtggtttgtttgcttgtttgtgtgttttatagtgttgtctctgcttctcgctgtttcgttctgttttgtttttttcgtggttttctttgtctttttttttgtcggtgttttctctcgtctttcttgtttgtgtgttgttattgtctccatgttttgttggcctctgttgtttctttgtttctgtgttctctgttgttgtgttgtttgttgtgtgtttctgtggttcccccgcgcccggtgtgtgtgtggtcatacgcgctaccccatgtgtaatgacaagtggacccccctttaagtgggtgagtcccanagacacaccgaatcaccgattttttatgtggtgcacacaccttattagggaaactcccgaaagtgattccccaccacaagagtgtgtgtgtaccaccaggaaaaaggcacggtccttgtgtaaaaaacgcaccgcgccccgcgtattacttattataccgggtncctaaaggttattcgcacggccctcgtggtgtgccgaaaatttcgcgccacacnaagggnncncgcncacacacatgnggcccccgcttnngccacccacacanaccncgtgaaagaaaggccgcgccccgcgggtcacatacacatatgaanaaangtatnctaacaccgccgcccctgggcnacaacganacnttnncacacacncgcgaccacanggcgcncgttttnngcgaaggaagatatcncccacncttattctccnacgcccacaaaggcttcccccacccaagatatnccacggttatatgtccacacgccacttctgagatgagaagccgagaattcacagaagagggccccacgctataagagaggtatttctcccactccaagctgtccacggagaggaaggaagaggaagaaaaggagagagaccacacttatgttcctcgaggttctcacgcccctggatccacggagattattgaagtagatcctcgaccacctaaaggaaantgctgaangcttttggaacttcggcacgntctgtccacacccttcacggtcacctcacagcctaccncttgggatgaatttccaaacccctcggggacccgtttgaattttttctgtagtgcctgtattattttccataaatctgggaccnccccccca

SEQ ID NO: 488061 - DNA, 145 bp, Homo sapiens
taactatggaggacgtgcacattgaagggccaggaatgtgtgtgggaagcggacgaacacatgcatgacaggccactgggctcacagacgatgggctggcctaaggaagtagtggttgatgctgaccgagggacccagagcgaca

SEQ ID NO: 488062 - DNA, 877 bp, Homo sapiens
cagagcagtggcgcgcgtagagtttgacctttatgctccgggatccccttgcgccctgtggagcccccctgagagcctctaccacatgagttgtccccaaggagcatttgcgtatcctaaaattatggggaaggccgagagtgttggtgttcaccactaggggaaacttgtcgccggcatttgtgtgtaaacgtgtcctggcgtaataataaattcgggggcttcctcccccctgctgaaatcgccatgttcgggtgcagccccccaaattctgtggcgtcatgaccaccagcgttttagccctccctcggaaacgtacattcacacatcccacaaacgtctccccccctaatcaaattatactcgtatttcaagaaaaaatttcccaaggatcggccaaagaggccagcccactggcttacaccccacaaaaattttctccctccccccccaatgtcatgccttgtaaccccaggcacctgaaaaggcacccacacatcctcactttcccactcctccccctgaagtagatcctacgcccccacccaggttttgtctttcgcggaggattatttcttatgggaccgttccctccggaatagtggccgccgcaccagtatgcgctgatgtgattctgttccttgggtgtacggcgctctcccttaaatggttagcggtcaattggtctcactcaggttagcactctatgcgtctcgtgccgtaccgaaccccccaacgtatcgtcttcttatgaggggccgccccaaaggagagataccccccgcgcgttgtctttttcttaattccttcgggaccctctgggttactgtcgttttttggcaaataaaaaacaacaccccccgcccacataaacaag

SEQ ID NO: 488063 - DNA, 675 bp, Homo sapiens
  misc_feature (616)..(616): n is a, c, g, or t
cccagaggatcccggcagctatccggttcaatcggaaattaaccccagactgcgcctgaggggagctctggaacatgagttgtgctagagagttaggcccaccttgaggcagggagctggttttcatatcacagaatgagttagtcattcacctattttagtatatctgtgccagtaaaggtcggagaatatttcattcatttgcatgtgattcatgccattgacctgccagagagcgtagatatgttgtctctcagttctaagccttttgattctaaatttacatttgaaatactttttattttcttctcagaacaaaacgtacccactctcttgttccaaaacattacatttgccctccatattatagttcacagaccctgactggtatgaaagggctgaagagttacatctagacacttggtaaagtgtggtcggcaggccagcaacatcacctagaagcttattagtaatgcaggccccaacaactccaacccataaaatcaaaatctattaacaaagatcctgtggatctttgttaaaaagtttgagaagcaccaagatatagaaatctcattgaaataaactgatagtaacttaaagagcctttcaagtnttggaccttttgtgtgggaagagtgcagaactgatagttaagaattgagcttattaaat

SEQ ID NO: 488064 - DNA, 592 bp, Homo sapiens
  misc_feature (93)..(93): n is a, c, g, or t
  misc_feature (99)..(99): n is a, c, g, or t
  misc_feature (149)..(149): n is a, c, g, or t
  misc_feature (179)..(180): n is a, c, g, or t
  misc_feature (215)..(215): n is a, c, g, or t
  misc_feature (224)..(224): n is a, c, g, or t
  misc_feature (240)..(240): n is a, c, g, or t
  misc_feature (255)..(255): n is a, c, g, or t
  misc_feature (264)..(264): n is a, c, g, or t
  misc_feature (364)..(364): n is a, c, g, or t
tgttatcatagctggctgaggctttgacatccacacaacaccaggacttaagacagatgggactgatgtcatcttgggctcttcatttattcngactgngatttatttggagaggggacattgatttcacgcacacattttatgtaggngggctaaacatattttgcgggggggggtannaaaagattgcctatccgctaaaagcacacccaaantaaattggngctgcacccttcctgncgaattttgcctatnattgtatanaactactcaccattcaactcctggggcgccatccccccttgctcctcccctccttaaacagttttattcccctcatttccctctccctttctccgcatcnccatacaaaactcaaaccaggaaacactaaacacacgacccaatctctactctaacttttgtttgattccctcaccctgctcccattctatctgcgacttctttcctcctctttttcgtgtgtcttattttacacctatcaattctacttctcattttagtattttctttctgttacactcttattatttgtgtggagaggtataagtaattctattttattaattat

SEQ ID NO: 488065 - DNA, 117 bp, Homo sapiens
tccccataaattaagaaaagtattctgccctctagtgggtctaaaggtctgtatagcgcggaaggatggattttatagcagccttttaacagaactagttaatttcgtgtatatgaa

SEQ ID NO: 488066 - DNA, 492 bp, Homo sapiens
  misc_feature (17)..(17): n is a, c, g, or t
  misc_feature (76)..(76): n is a, c, g, or t
  misc_feature (227)..(227): n is a, c, g, or t
  misc_feature (252)..(252): n is a, c, g, or t
  misc_feature (316)..(316): n is a, c, g, or t
  misc_feature (327)..(327): n is a, c, g, or t
  misc_feature (371)..(371): n is a, c, g, or t
  misc_feature (394)..(394): n is a, c, g, or t
  misc_feature (401)..(401): n is a, c, g, or t
  misc_feature (411)..(411): n is a, c, g, or t
  misc_feature (431)..(431): n is a, c, g, or t
  misc_feature (457)..(457): n is a, c, g, or t
aagcacctccttcagtnattactctgcccaaggcataagacttcacttagacaaaaagctttcaaaacctacctanaaataagatagttcataaattttcaaaactgttcttccctgttgcggacagcccttgatctttgtaagacttagcaaattttggcatgctctcatgttagctttttaagttactgaaaactcctataaatttagcatcatttctcaaatcngtatagttttctcattccgaatgcntaaacatttaggtcaaaaattaaaataccagtagaaaaatattcaccggtagccaggggggatngggaacaacanggcaagaaactgaggagaacatttaaacattcagagcataaaantacttcaaagcattacgaaactngaacttngcattttccnaaattttagtagttccaacnagcgggggataagacggccagagggnctgggatgatttaagccaactcaaatttgggccgg

SEQ ID NO: 488067 - DNA, 677 bp, Homo sapiens
ggatgcatttgtgagcctcatataaagtgatgctattagtgatacgtaggtaaattagagcaacagcttttgaaacgctttgtcaagataccttactacataaatatcagttcttaggcatctaccaatgactcaccatctgttgtgttataatattggcagaataacaatggcatatatgtacatttatgtaacagacaaatccaggagcacccatgtgctctgatttattctggtgcttttagaacaaagtagaactgccagattccaggggaattagaaaaataaagttacgaactggtcttaaaattagaccagttctaattttaatatctgcattggcagctttgcttccagatcagctctgtcctttccagcattacctagtatcaggatttttccagtaaaccctgtgactaaaataatggttggctatcattattgattcgatttgaacatcactacactcttttcacagccaccactactcctgccctggattgactttctcattccttttggttcttcatacatgaatgctttccatatgggggatttcctaatttcattttaaattgaaaccacaaaattaagtatgaaattgttggttgtcacatggcattataaattcctcaaaatattctcttttcagtatgatcttgtaattggttgttctc

SEQ ID NO: 488068 - DNA, 1561 bp, Homo sapiens
  misc_feature (584)..(584): n is a, c, g, or t
  misc_feature (588)..(588): n is a, c, g, or t
cgcctttttgtgttgtcggccacaccccgggtgggccgccttgttgttggcctccttgtagtccaatacccgtgttggaagtggtctccgtgtctatctgtagactcgtgctctgtgcgctcctataattgtgttttgttgttggtttgtttttcctccggcggctgtgggtctccccatcaatatatcacctggtggtagtgtccgcgggagaatgctcactgtgttttttctaactacattctccctacttttgttggtgctacccccctcgtttcctcgtctcttgtgtgttccatctacacttgtccgggagggcgtctatttggttggtcgtctcttgtccaactatatgccggtgttgtttgttttcctactgctgtccctctcgatcgtctccacacgtggttgtctcagaaaatgcaccatgtggggtggttgcttacctccccccccccaccacatattgttttttgttcgcggcgtgtcataactcctctcctctggaaactttcttgtttatggagtcgtgctcacaacatactgcttcttgtggttgtctcaaagagtctgatctaagatgnggtnagttggtggtacctcctcttccttgtgtgttcatcgcttactccctccttgtatcattgtgtgtgggctcaccttatctgttgggtgggggggcaccacttcgtcttcccccctcccaggtggttgtgttacttacgtttggcgtgcccccaccacccgttggagtggtattattttttctccccagtggacgacactgcgtgcttcctaacacacttctatcttgggcggtatgattatcctagctgggagtggccgccgcactcccgcgcagaggtggttgttctaacagtgcgttatatagctccccgtagtaacacatggtgttttgttcacacacccccccttgtcacaacttgcggctgtgatatttatcagtcgtccccccctctttcttttttttgtgtttccccctctctgtgtggagatactcactatctatagtgtgtaaacagaaaaacgttattttgtgggaaaaattcctttctctctatgctttattgaattatacactcgcattcacgcgccaattgattaccctcacagttttgtcaaccaccccctgtcatttgctgctgtgtggaaataaggcgctcttccaggaataaaaactctcgcggtgactttgcgacacaatatatttcctcttttcttttagaatgaagaaaaatagattttctgtgactgactcctctccccgacgtcattaaggcctccctactcacaacataaaggaggagaaaattttttgtggagaccctctgatatgagagcccctgtgacggggtgcacctttctcctacatattgttgaagagactcatgagtgctgtcagcaaccctcgtggaagaaaaatgctgatattttaatttttttggggaaaaattttgtttttaaacacctctacccccccccaattggggggggttttgtgggggcccaccacaaataaacccccccctgtttttttaca

SEQ ID NO: 488069 - DNA, 309 bp, Homo sapiens
cacctcgtgggacagaatcacttgccaaaaaaaaaagaaatggccaggcgcagtggctcacgcctgtaatcccaggactttgggaagcagaggcgggcggatcacaatggtcaggagatcaagaccatcctggctaacatggtgaaaccccagtgaaaccccatctctactgaaaatacaaaaaattagccaggcatgctggtgggcatctgtagtcccagctacttgggaggctgaggcaggagaatggcgtgaacccgggagccagagcttgcagtgaacctggctgacagagggagactccgtctc

SEQ ID NO: 488070 - DNA, 283 bp, Homo sapiens
agcagtttgagttggggtagggtatttttggttatcagaaaactcaaaaagctttgggattttgaattggtaaatattcatgatgtgtgaaaaatcatgaaacaaactgtccagtttcagtcccataaaattggatgttgggcctacccccaggatttaaaagaaaatgtccaactataaactgcttgggattgtgaaagactttgttctttgcttgtgtttttcaatttcctataatgcccaaactaacttttaaaaaaaaaaggttattttaaaagcctga

SEQ ID NO: 488071 - DNA, 414 bp, Homo sapiens
  misc_feature (10)..(10): n is a, c, g, or t
  misc_feature (138)..(138): n is a, c, g, or t
  misc_feature (166)..(166): n is a, c, g, or t
  misc_feature (190)..(190): n is a, c, g, or t
  misc_feature (204)..(204): n is a, c, g, or t
  misc_feature (275)..(275): n is a, c, g, or t
  misc_feature (285)..(285): n is a, c, g, or t
  misc_feature (294)..(294): n is a, c, g, or t
  misc_feature (347)..(347): n is a, c, g, or t
tatactggtncctccaagagcctgcagccgccaagatcaagcagtccactgccacctgcttgagaagctcttggagttgctagagagcttagcaccactgaaggccccatgagacactctcctccacatagatattgngcacagccaaagctatatggcacaagtntggtgacacggtaagaaaaaacanccaagcacaaacanagcagcaggctgtgttagactgaaagtaaaagataaaacctaagacctatgaagcgcagggcagtgctggngcttcaccanatggctccnttggtgtctgctggtgctgatgaagcagcatccctactgacatgacctagctnaagagggctgagactgctgaaagtgaagctgttataaatggacagcaggacgacagacacatggtgt

SEQ ID NO: 488072 - DNA, 513 bp, Homo sapiens
cgcggtggctcacgcctgtaatcccagctctcagggaggctaagaggcgggaggatagcttgagcccaggagttcgagacctgcctgggcaatatagcgagaccccgttctccagaaaaaggaaaaaaaaaaacaaaaaaaaaaaaaaaaaaaaaaaaaaaaaaatgtgtggtgcggcgcgcggcccgggcgcccaggagaaaaggtttctatagagaaccacctccggttggggcgcgcgggggccccctgaggcgtcaccggcgaacctgtgggccatagcgggggtcccaaagggagaaacccgggggccacagcacacaggggcggggggagtttctcccccaataataaaaaaaccgcgccgggggggacacaacccagagggtgtgtctgggaacaaactcaccaagagagggggggagctccgaggaggggcacaaacagggggagctccttaccacacaggggggactcccaagggcaggccgcgaaatttcaaattaacccccg

SEQ ID NO: 488073 - DNA, 155 bp, Homo sapiens
agctgcgctggttaggggcagagaacatcttgaactcagtattctaggccctgcccgaccatccagtgcttgttcttcacctcactggaaccatttatgcttgtggcgtgaaattgtctaagagcattattatctcggggtaataaatccttctc

SEQ ID NO: 488074 - DNA, 296 bp, Homo sapiens
tgtgcaggccagagtgaccacagatctggacaggtgtcaccagtagcatgaggacaatatcttatcatcgtgcttatcctgagctgatgagatcacaggctttgatttacagtctgaagcatgtggcagccactcacacttgtacacactgtggtgttggtaatgctgcgcgtctctgagctctgccagggtcttattatcctgttatcgtcttcccgaaggctcccatttatgcgagccaactcccgaagctgcatcttccgtagatcatactggtcctgcctgggtccaatggc

SEQ ID NO: 488075 - DNA, 188 bp, Homo sapiens
tacttgaggatccccggtgtccagtggcatcatgacactttggtatcgtgaggatcatgacacagtcatgcatcactgcgaccagaagactgtggatggccctccggaaactgtggctgtgatggcgcggtgtctccagaacatcatcctgtctctactggcgctgcaaagctgtgggcaaggtcatc

SEQ ID NO: 488076 - DNA, 2153 bp, Homo sapiens
ctcctccaactgggaatgctaaaacgggactgatggacgtgtccgaactctgcatcccggaccccctcggctaccacaaccagtaggttgctgaaccgaatgtcgtccgaagacaggcacctgggctctagctgcggctccttcatcaagacggagccatctagcccatcctcgggcattgatgccctcagccaccacagccccagcggctcgtcggacgccagcggtggctttggcatggccctgggcacccacgccaacggtctggactctccgcctatgttcgcaggtgcggggctgggaggcaacccgtgtcgcaagagctacgaggactgtactagcggtatcatggaggactcggccatcaagtgcgagtacatgcttaacgccatccccaagcgcctgtgcctcgtgtgcggggacattgcttctggctaccactatggagtggcctcctgcgaggcttgcaaggcgttcttcaagagaaccattcaaggaaacatcgaatacagctgccctgccaccaacgagtgtgagatcaccaaacggaggcgcaagtcctgtcaggcctgccggttcatgaaatgcctcaaagtggggatgctgaaggaaggcgtgcgccttgaccgggtgcgaggaggccgccagaagtacaagagacggctggattcggagaacagcccctacctgagcttacagatttccccgcctgctaaaaagccattgactaagattgtctcgtatctactggtggccgagccggacaagctgtacgctatgcctcccgacgatgtgcctgaaggggatatcaaggccctgaccactctctgtgacttggcagatcgggagcttgtgttcctcattagctgggccaagcacatcccaggtttctccaacctgacactcggggaccagatgagcctgctgcagagtgcctggatggagatcctcatcctgggcatcgtgtaccgctcgcttccctatgatgacaagctggcatacgcggaggactatatcatggatgaggaacactctcgcctggtggggctgctggagctttaccgagccatcttgcagctcgtacgcaggtacaagaagctcaaggtggagaaggaagagtttgtgatgctcaaagccctggcccttgccaactcagattcaatgtacatcgagaacctggaggctgtgcagaagcttcaggacctgctgcatgaggcgctgcaggactatgagctgagccagcgccatgaggagccacggagggcgggcaagctgctgttgacactgcccctgctgcggcagacggcagccaaagccgtccagcacttctacagtgtgaaactgcagggcaaggtgcccatgcacaaactcttcctggagatgctggaggccaaggtgtgatggccccgcatgcagacggatggacacgatccacatggagacttccacggccaccagcctcgactttctcacacctgcatcggggctctgagctgtcccagaagaaggggtttcttgcttcctggccatgtgcagactcctggggggcagcagatggggagatggggatgggagggtgggggcggggggctcatctgtcacccgaattttctttggtatttttttttttccttctccatgggcagtgctaaggcttgggccggggctgacttcccttagggctggagaccacgggaggaagcatcccttcctgcaagggatccatttctggaccactccatatttaggacctggaggtacctggatgggcagggcttagtgcccagggcccaagagacttagattgggtgctcctgaaggtgttggtatcacagagggcaggcccttggaacaggaggtctctgtggcctctcctggggctctgtgcctcctcagtctagctgtctccctccccttccccctttcttgtcctagtacatccagctctcagtggatgctcctgctagagtagccacatccccaccactaagaggcccctcccctgcttcctgcccctacctcagccagctgaggtaactccaggacatgcacctgggaactcgctggctcagaaaagagttgggtcctatacccacccttgcctgttgtttctcctaatcctcttgggcatggcgagtctagaaacctatgga

SEQ ID NO: 488077 - DNA, 403 bp, Homo sapiens
  misc_feature (32)..(33): n is a, c, g, or t
  misc_feature (45)..(45): n is a, c, g, or t
atatcacgacatctatccacccagtcatccanntcacaggccccncctccaacattggggattgcatttcaacatgagatttggaggggacaaatatccaaattatactacatgttaaagttgaaaagcattttcctagcccctggctttgcaagttcccttcttgttcagcagaaaccagggcctgggggagaggggaatcgccctgctcatgttggcgtcagcttctcacagagtcatctcttctaactggccttgcatagcctggattcccaagggcctcccaggaagttccagcaaggtgtgttgaaaaactctagaactgttctgttcaatgcagcaactactagttgcatgcgactatttaaataaaattctttagttcagatatactagtcacatt

SEQ ID NO: 488078 - DNA, 213 bp, Homo sapiens
tggggagcagtttcacttccacaggcatcggttcataatcttcactgtcaatgctaaaagagccccatgctcgttggggagaagagaatattcagaacagctcaaacacatcagtggcatattggatttagaggtctcacagcagctccagaagaagttcattatggaaaacaacatcctatgttgaggagctatccataatgttcttttaca

SEQ ID NO: 488079 - DNA, 150 bp, Homo sapiens
ggcgtatgttcagcaattgagaactaatcgttgtaatgcaggagtgtgtgctctgaatggaagttatacatcggaggtggctctgatccatatggtcaagcaggactgaaaaatagtgatgtatttgatcctgtaaccaacatgtggaca

SEQ ID NO: 488080 - DNA, 362 bp, Homo sapiens
cccccccccggggggggggggggccccccccccaatttggggccatgccccgggccctttttggggggggggggggggggggaagttttggttccccccccccccgggatgggttgggggcccccaaaggggttttttggggcccaaggtttttttgggggtcccccccccccccccaaggggattttccggggtttggggggcccccccccctggtttcccccccaaggccccccccccggggaaagggcctttttgggtttttaaaggggcccagggggcggggtttttaaaatttttcccgggttaagcccggggaattgggggttcccccggggggaaaaaggggtttccccccccca

SEQ ID NO: 488081 - DNA, 179 bp, Homo sapiens
tggagaatttttatatctgagacggcgcttcaccgtgtgaatcatgatcgatctcgactctcctgatctcgtgatccgcccaccttggcctcccaaagtgttgggattacaggcgtgagccaccgcgcctggccatcaatgtttatttttaagtagcacaagagaactcagcagtgttg

SEQ ID NO: 488082 - DNA, 937 bp, Homo sapiens
  misc_feature (1)..(1): n is a, c, g, or t
ntgtggatcgtgtgttctgtgatttttactgtgttgagcggtatcgtagtgctcgtgtggctgcggagctgtaggtttggaggagagagtgcagttcgcgcttggacgcagcaccacctaccgaatcaggacgcttgataagcgggttttgaccccagggtgcgacagcggggttgttcgactgtgggccatggtgtcgtgagtggggcgcctaaagggttggcgccgggctttcttgctgttttttagagcgccttcagttgtcggggttaccatgggacgatattggcccatcggcgcaccctctgaggtggtgtgaccacggggccaatcaagtggcggggacccccgcggttttcgcgaggccttgtgccgcagggtgtccgtctcgtcccgttttctggtgctgtgaccatttatgagggggtttagtcggagcggtgggataccacttatgtcgggggctgtctttctggtgggcgcattaatacgggtgtcttccctctgtcgcgccctaataggttgcgcccgctgcttgctctagtattgtcgcaactggacccaccagtgggcgtcccctggccccattacttttcccaacagctctaccttctgcaatcttcccccccgaccctttctagtggctataatatgaaacccacgggtcgtacattaaaatgctgcacaagatcacacaagtggtaaacattatttgttttatttcaagcatttccaccaatccaccgtttaaatactctattaatactcttattaacttgttctagagggatgatatgtccacattatgtagatgggccacacgacgggaggagaaaaaacatatgtttttcgacgacaagaatgagaaggaggaggaaaatacccgcataagagtggatccggacgcaactttatcgccccatcaatagacagaaaa

SEQ ID NO: 488083 - DNA, 497 bp, Homo sapiens
ggagcaaagacgatgaagccagagtctccaggactcctcactcaaactcggccatggacgcaggtcgggtgtgaggggggtcgcagcgctgtcggtctgcgtatttccctatttccagtgcttcccagccgggtttctgagccagagggtggaacgggcctggactcctcttcccaactgcctcgaggtcatttcccagtgtgagcacaaggccaaccttagtgtgtctccagtcagacagatgccgcagcatgaaggggtaggagacttgaggatcattccttcctcgctgcaggagcttcccaagctggtcagagagtctcctggggcacaggttatacagacccctggccaattgtcatctactgaaacagggtctccacatgaggggccagggaatatgggtattaaagaagcgtcttaacaaaacagttctctatcatgcagccggagagctggctgtgagcccttttgtgttctaacagagatccctcagg

SEQ ID NO: 488084 - DNA, 337 bp, Homo sapiens
tgcatacctgggaagaacagacatagagttggaaatatatggtatggaaggtaatccagaaaaagacatggatgaaagaagacgacttcttgaaaagaaaacacaagaaagtcaaaaaaaagaagcaaaaagatgattctgatgaatatgatgatgacgactctgcagcctcaacttcatttcagccacagactgtccaacctcagcaaggttatattccctccaatggcacagccatgactggcaccagtaccaggagcaccaggaatgcctccaggcatacctccattaatggcaggtgttccctcctctgatgcacaagaatgccaccagttat

SEQ ID NO: 488085 - DNA, 689 bp, Homo sapiens
agacgctacttcccctatcatagaaggagcttatcaccttgcatgatcacgccctcataatcattttccttatctgcttcctagtcctgtatgcccttttcctaacactcacgaacagaagagcttgaacgtaatactagacatctcagacgctcaggaagagtaggaagaccgatctgaactatccgtggcccgggcatcgatcctagtcgctcaatcgacccgttcccatccctaagcgatcctttacacagacagacgaggtcaacgatcccgtcccttaccatcaaatcaattggccaccaatggtactgaacctacgagtacaccggactacggggactaatcttcaactcctacatacttcccccattattcctagaaccaggcgactgcgactccttgacgttgacaatcgagtagtactcccgattgaagcccccattcgtataataattaccatcacaagacgtcttgcactcatgagctgtccccacattaggcttaaaaacagatgcaattcccggacgtctaaacaaaaccatttcacgtacacgaccgggggtttactacggtcaatgctctggaatctgtggagcaaacacagttcatgcccatcgtccttagaattatcccctaaaaatcttgaatagggccgttttaccctatagaacccttacccttagagc

SEQ ID NO: 488086 - DNA, 163 bp, Homo sapiens
ttatagggtgatagatcggtccgaagtagtgtgaggagtcagttcatatgtttgggcatatacaggtcagtgggtgttgagcttgaacgctttcttaattggtggctgcttttaggcctactatggttcggggagttattactcaacaccacagctgaagagg

SEQ ID NO: 488087 - DNA, 368 bp, Homo sapiens
  misc_feature (1)..(1): n is a, c, g, or t
  misc_feature (83)..(83): n is a, c, g, or t
nggtggggggatcgcctaagctcaggagtttgagaccagcctgatcaacatggtgaaaccctgtctctactaaaaaatacaanaatcagtcaggcatggtggcaggcacctgcagtcccagctacttggaagtctaagccagaagaatcttgcttgaacccaggatcctgtagaggttccagtgagccgagatcacgccattgcattccagcctgggcaccaagagtaagactccatcttggagaagggctccatttctcttgaagaaggtactgcccggccagatgggtggacctgatgtgctttgatatgcctgagtcaaagcctgaattagattgtgtctatactctgggtctatgcaccacaac

SEQ ID NO: 488088 - DNA, 428 bp, Homo sapiens
cgtgtgcaccatttccatcactattacccttgtcggagcttccattatctctcccctaaacaaatataatagactctttcatagatgtccctgcctctgatagtctgtaccctacactgcagccagagaaatcctgttaacacctaaatccgctgctcacatctctcctcagctcagagccctcccatggctcccggctcactcagagtcaaagcaaggtcctcggcctggcacagtggctcacgcctgtaatcctagcactttggggggccaaggcaggtggatcagctgaagtcaggagttcgagaccagccttgccagcatgacgaaaccctgtctctactgcaaatacagaaattaccagcctgaccaacatgatgaatccccgtctctactaaaaatacaaaaattagccaggtgtggtggca

SEQ ID NO: 488089 - DNA, 246 bp, Homo sapiens
  misc_feature (41)..(41): n is a, c, g, or t
  misc_feature (43)..(43): n is a, c, g, or t
  misc_feature (152)..(152): n is a, c, g, or t
aattcgcggccgcgtcgactacggctgcgagaagacgacanangggggagttcgagaccagcctggccaacatggcaaaaccccatctctactaaaaatacaaaagtagccagggtaggtggcacatgccggtaatcccaactgctcaggangctgaggcatgcctgaacctagaggcagttgttgcagtgagttgagatcatgccactgcacaccagcctgggcaacaaaccgaggctgtgtccc

SEQ ID NO: 488090 - DNA, 190 bp, Homo sapiens
gtctatacgggcttactcaatcgtcggcccaatgtgcttagtgtgtgtcaaagaaacttactacattgtacccattacagaaaagttccatgtaattggtattgaaaaaccagaggtgtcgtccccctccccgggtacattttttcttttagggcatgagtctccttggaggatacattcagattcattt

SEQ ID NO: 488091 - DNA, 967 bp, Homo sapiens
ataaggaggttggctcattcatagctataattcggcgctggagctggagcttgtagtgcgccgatctaatgcctctgtatgcgagccgaccttgggctagccaggaaaattactaggtgaatcgaccagatctagcaatgtaatcgtcaccctcccgactgcgattatgctgatttcactctatctctctatcagatataatgactcactatctaattaactacagggagtgactatctgcgtcaccgcgtagaacatagatatcccactcataacttaattacgtaatgacactccgaaataatggatgtattcacactcagatctattaactagagcattaataggctatcttagacatcttatgagcacatcacgctcctctctcttactctctgcatctgcctatgaggttaatacgctagggagggacccgggatgctatggagacatccacggtttcggtgcatgcttctatccactactcgcattaaagacaaggtgaagacctacctactccctacacacttcgagtagtcctccacgtacgtactcctcacatccaattattacggctcttacctttcttagctacggttgtctccatattcatcttccaggcgagtcacagttcagaggtagcatcaggaaggaatttatcccatattccagactaccgctggaaacatacattcgacaaaatactcactacgactctatcctatcgctagggaatgcccgtcctagatacgattagtaagcgccataaaattccttccataaattaatactcactcagtttccattaggttcatgctagtgtttatacataaatatttcttaaacttaaatagaaaggcgataaaccttacataaatccaagttttatttctgcaaaggcccggcagggagagcatgaaagtaactcactatttgctattctgcaaaaccaccgattactggggat

SEQ ID NO: 488092 - DNA, 588 bp, Homo sapiens
gagaatcgcttgaacccacaaggtgtaggttgcagtgagctgagatctcgccattacactccagcctcgtgtgacagagagagactctgtgccccccacccccccaaatgggaaggagagacagcctcagctagagccctttccttctgacgcatgaatgtgcttctcttcagggatttggacatttggtgcgcatcttcagaagatccaggagtcctgggaatcgtgtatgactcaattgctttccctgagcacgacaggagcccccctggcctcagagtgactgtgaggaggaggctttgcctagaggcatttccagagggctcctctgtgctccattgtacgcaagggcagactgatcagtgctatattccctccttaggtgatgctgcgagggtcctggctacagacactggaggctaatggctgtgtcttatctcaagagactggttaacagcgggcccaggaagcacctgctacacacattggactgaaggagatgccgagccactgctttggccatctacacaagaactgtgattcccagtgtacactatgtctcggaggctggagcctcctatgacgggg

SEQ ID NO: 488093 - DNA, 714 bp, Homo sapiens
gttcgctttttgccctcaaccttttgtccccctttttattttgcgacccctttggcctacccgtgttactcagatcctcttgatcagggggagcatcaaactccaactatcccccctgagtcggcgcccactgcggggcagttgccccgcccatttcatatggagtcccccttgccctcatgtttagtagtccagccttgtctaataagggggtcccttaacctttccgcccttctgccgacagccagacaccctctgattactcctgccactcatgagcccctggctctaatatgagtttatctcccccctttgcacgagaccaccggacccccttcgagccttgccgaaggggggtccgagactagtttcacgggttcaacaactcgaatactccgcaggcgcccttcctgccctatttttctatagccgaataccccagcattattataatgaacaccctcacccctacaatcttcctaggaacaacatatgacgcactctcccctgaactctacacacacatattttgtcacccagactctacttttaacaatccccgtttttatgaattcggacagcatacccccggttccctgggccaaatcaaacccctccttgtggaaaaacttccttccactcaccctagcattacttaaatgaaaagtttccaaaccccattacaatgttccagcattcccaccccaaacccta

SEQ ID NO: 488094 - DNA, 378 bp, Homo sapiens
gaattttaaaaaggggccccccccctttggggggggggggccccggtgggggtttcccggccccccccaaaaaaatttaacccccggggggtttttggaaaggtttggggggggggcccccctttttagggggggggtttttttttttttggggggggcccccccaaaaggtccccccccttccccccccccgaaaaaaattcccggggggccccttgggaaaaaagaaggggggttggtttggggacccccccccccctttcccaaaccgggggggggggggggggggttccccggttttttggggggccaaaatggggggggggtttttttaaacccgggttttttttttccggcccaaaaaaggggtttccccga

SEQ ID NO: 488095 - DNA, 226 bp, Homo sapiens
atagtggagaagatttatcgggtgaggcgacacacctaccgtagcctggtcatagcttgttgccggaatgtattaatcgaggttcaacactatccttagcccggtcatacctctaactcgagtgttaaatgtaagcggtgagtccacagaggcccggctctttggacactcggaaaaaacctctggtagagagagtaaaaaatttaacacccatagtgggcctaaa

SEQ ID NO: 488096 - DNA, 1080 bp, Homo sapiens
gatcatgcaatcggtaggcgtagtgaatcgactgtgatcgttccgtctagcccttttgcgtcgcctggaggacatggctcttctgaaagggtgtgcccgacgtccgcagcagcctactgacaccgcttgaccttgttgcgatgagcatcggctgcctggtccagtagcttagagcgcacgtccacgtggctcgcagcgatgttggtcgtctactcaccgggcagccattaggtggtcaattgtccatgcctgctccccgtctcctagtcgagaggccgaacagactacaccttgtgaggtcacacatccaatcagggcttgggttgacttcgttcgtgtccagctagttgttgtagctctagagtcaggctcaagagtcctagactaagccttgacagagcctcaggtgcgaatcagcggcccagaaatgaggaacagagccgtgaatgcttcgtaccgaggaagctatgggcttcgatggacgatgaccattggctacaacgctaccgaactttcaggctaccgcaaagttgtgctcaaagacattgagaagagagcaaaagcacatttggcaatagactaatggacacaagaggggaccccagagtgcaaagacgccattcgctccactcaccacgtaacactctcagatacacacatagaaaggaagccccaaagagagcacccatacatagaccccaacaccaataccttccaccttggtccaatcccagacaaaaccgtggcagcaacacgaatgaattgaggcctgacaatttcactttgtatcaaattacaaagttacccaaataggaaccgcaggtttggaaattaccggaaattggtgacccattgtggaaactttatctggcgtgggacaccgcacaagtgcgaaacacacagcccaagaggtaggcaccccgagcgaacattgcgcgcaacttaccggagataaccccatgtaggcacggggccgaggcaagcgttactacagacagacaaaggacaaaaacaccagggctaaccatgtcaggtacagataccaaaaataaacagacacacgatgggaggacacacgca

SEQ ID NO: 488097 - DNA, 246 bp, Homo sapiens
atttcagctcgctgtcctctccctccgccaggctcgaggcgtttcgaggctggttggtttcaatagaggtttcaattcccagaccttctggctggcacatgcagtgcagcagtgtgtgtgcatgtgtgtgtgtgttcatgtgtgccctgtatgcatgtggctggctcccatatccctggtgccgtgcatccttggttagagctggcccgggcgggcgacggtgcacctgggtgttcgcagaagaaa

SEQ ID NO: 488098 - DNA, 827 bp, Homo sapiens
atggcacatgcagcgcaagtaggtctacaagacgctactatcccctatcatagaagagcttatcacctattcatgatcacgccgcatccataatcactgtttccttagtctgctgcctaggtcctgtatgttctcttgacctagcactcacaacaaaactaactaagtactatcatctcagacgctcaggagatagaaaccggctgaactatccgtgaccgccatcaatcgcatagaaccatcagtcggcccgtccccaatgacatacgcagtcacatggatacagtaaacagaacggagagggcaaagcgaaaccacatcccagtatagcaaacaagaatcaaagtaggagacaaccgaaaaggagatacatgaagacaaaagaagataacacccgaccgacgcgacggggaccataaaatgcgtttacaagacgtcgcgtaacatcacaaatcacacaccaaatgagatatcgcataagaaaccacgcagagacagcagcccgagcagaacatccatatagagcggcttgaaaccaaaatccggaaggtaagagacgaaccgccagaaaaatggaaaaggaccccacgcaaataaccggagaaggtaaattaacagtaagaccagtgaaccaaaagggaacccgaacagaagggtgaagtctcgacatgacagaccaaggcaccaccagacacgaatatgcaaggacatggaaaaaaaaacagagacatggcaacggaacaccacgaggcacggacactaacaacgcaaacacgaaacatcaaagcaccccggaacaagcaaagaagcagcggggaggacaatag

SEQ ID NO: 488099 - DNA, 2256 bp, Homo sapiens
gaaaagttatttgcaaaagataacatggatttgctgcaaaccgccaggggtctgcactgtgattctcctttcagggctggttgaaggctccatacagtatctctatctgccttggacacttcaggcatatgtgccatatatgacagaacatcttgcacaacagtctgaatttgctgcaacccttctcttgctctgggccccactcaaaaccggcagacttacaaattccttcgtaaatgggccagggcagcatggtaaaatgtgctgtatattacctcctaaaacacccgtcaagtatttttttttaactctttcctagcataggagtacatgatgcagcaatttgttttcatttgaaggagataaccaacatgcctcaggccactgaactcctagaaatgtcacatgctcaacatattatccatataatggactagttctgcattttatgggatgttgtgattatcaagacccctgaagccttgcttatgacagaacaggagagttgccatagacctgagctcaaatcgtgaagatgtactgctgtccctgccatgtgaaagcaaacaccttccaaaagtgcctgtaaccaatacagcaggaaaaaaagtatattttacataaatagctgcatcccacatgtcaaaagccattttgatttactctagtaagaataacatatttgaaacagcagcagcaatcaattaaatattgataataagcaatggagagataacaggaaatcacgtagaatatatcattgtttgccaaatattctggctcctttcctactgaggaatcatacttccttaactgcagtcttgtccacgtgacttgcaaatgaaatgtgaacaaaagtgacatgcgtcacctttagacagaagatctaagagctgatgtgtgctttgttatgatgtattttccctctgccataagactaagcaatgttccaaacagaggctgatccacagcctccatctggagtgaagataaaatggaaaagagcttcagtcaagctgcagtggacacatagcaagaataagaagttaacttttgttggccaggcgtggtggctcacgcctgcagtcccagcgctttgggaggccaaggcgggaggatcacttgaggtcaggagttcgagacccgcctggccaacatggtaaaacactgtctctactaaagatacaaaaattagccaggtgtggtggggggcacctgtagtcccagctattcaggaggccaaggctggagaatcgcttttacttgggagtcggaggttgcagtgagccgagatcatgccactgcaccccagcctgggcaacagagcgacacttttgttgtctgccactgggatttttgatgacactaccaaagcctaaaatagcctgacccaacatatacagtctcagagattagcaacagttgagagtcagtgttcagcgatcctgaaacagtcccaagtattttcctctcccatgacaatggccatgggtctcttagggcttgaagaatgatttttagtatatattgcagcaatgtcagtgggctccaggtctgcaaaattgttcagctcccagaactgggggaagggccatgactattatggtgatccaaattagaattctacttacctgataatttctaattatgtagatcaacatatattttagtaggctattttattcctagagatactaccaaagaccctcacaagtcaaaaacattcattttaccactgtggccctgctgcccatgaaagtaactgtgcccactgtgtctctggtgttaaacactgtcacttggtctctgaaataaggaaggcaatttaaagagtagcatttcttattgtcacccccagcactttgggaggctgaggcgggtggatcacgaggtcagaagatcgagaccatcctggctaacacggtgaaaccccgtctctactaaaaatacaaaaaattagctgggcgcctgtagtcccagctactagggaggctgaggcgggagaatggcgtgaatccgggaggcggaggttgcagtgagctgagatcaggccactgcattccagcctgggcaacagagcaagactccatctcaaagaaaaaaagaataaagccacggacctcgcagtgagtgttacagttcttaaaggtggcgtgtctgcagtcgtttgttcctctctgtgggttggtggtctggctgactaaggaaatgaagccgcaggccctggcagtgaatgctacagctcttcaagttggt

SEQ ID NO: 488100 - DNA, 390 bp, Homo sapiens
gggatcccatttacattatcatggattgaaagaatgataaatgagaaaatctatttttcccaaattatcttacatggtgttaagctttaaaaaataagaaaaacaatgttgcaaataggtatgaatttctatttgattggttgaggggaaatttatgaaagcatacctgtgatgacagatcaatgcatggctacactacaccagagcaagcacaaactttaaaaactcatcggaattttcataatttcttcaaatgtttgaattgaagtgagtagatacccagcaaatttttctcatatgcttctgtgaaaatataaaggtatgaattaaattggtttttctttttataaaatgagtttcattgtatatttttcttccaatgtaaagaca

SEQ ID NO: 488101 - DNA, 2265 bp, Homo sapiens
gaaaagttatttgcaaaagataacatggatttgctgcaaaccgccaggggtctgcactgtgattctcctttcagggctggttgaaggctccatacagtatctctatctgccttggacacttcaggcatatgtgccatatatgacagaacatcttgcacaacagtctgaatttgctgcaacccttctcttgctctgggccccactcaaaaccggcagacttacaaattccttcgtaaatgggccagggcagcatggtaaaatgtgctgtatattacctcctaaaacacccgtcaagtatttttttttaactctttcctagcataggagtacatgatgcagcaatttgttttcatttgaaggagataaccaacatgcctcaggccactgaactcctagaaatgtcacatgctcaacatattatccatataatggactagttctgcattttatgggatgttgtgattatcaagacccctgaagccttgcttatgacagaacaggagagttgccatagacctgagctcaaatcgtgaagatgtactgctgtccctgccatgtgaaagcaaacaccttccaaaagtgcctgtaaccaatacagcaggaaaaaaagtatattttacataaatagctgcatcccacatgtcaaaagccattttgatttactctagtaagaataacatatttgaaacagcagcagcaatcaattaaatattgataataagcaatggagagataacaggaaatcacgtagaatatatcattgtttgccaaatattctggctcctttcctactgaggaatcatacttccttaactgcagtcttgtccacgtgacttgcaaatgaaatgtgaacaaaagtgacatgcgtcacctttagacagaagatctaagagctgatgtgtgctttgttatgatgtattttccctctgccataagactaagcaatgttccaaacagaggctgatccacagcctccatctggagtgaagataaaatggaaaagagcttcagtcaagctgcagtggacacatagcaagaataagaagttaacttttgttggccaggcgtggtggctcacgcctgcagtcccagcgctttgggaggccaaggcgggaggatcacttgaggtcaggagttcgagacccgcctggccaacatggtaaaacactgtctctactaaagatacaaaaattagccaggtgtggtggggggcacctgtagtcccagctattcaggaggccaaggctggagaatcgcttttacttgggagtcggaggttgcagtgagccgagatcatgccactgcaccccagcctgggcaacagagcgacacttttgttgtctgccactgggatttttgatgacactaccaaagcctaaaatagcctgacccaacatatacagtctcagagattagcaacagttgagagtcagtgttcagcgatcctgaaacagtcccaagtattttcctctcccatgacaatggccatgggtctcttagggcttgaagaatgatttttagtatatattgcagcaatgtcagtgggctccaggtctgcaaaattgttcagctcccagaactgggggaagggccatgactattatggtgatccaaattagaattctacttacctgataatttctaattatgtagatcaacatatattttagtaggctattttattcctagagatactaccaaagaccctcacaagtcaaaaacattcattttaccactgtggccctgctgcccatgaaagtaactgtgcccactgtgtctctggtgttaaacactgtcacttggtctctgaaataaggaaggcaatttaaagagtagcatttcttattgtcacccccagcaggcagaggatacccgctacaaagctcctaaagggaaatggagctctcctccgcacattttttttttgtaagagaaggtcttgctctgtcacgcaggctggagtgcactgtcatgatgacagctcactgtggccttgacctcctgaggcgggagaatggcgtgaatccgggaggcggaggttgcagtgagctgagatcaggccactgcattccagcctgggcaacagagcaagactccatctcaaagaaaaaaagaataaagccacggacctcgcagtgagtgttacagttcttaaaggtggcgtgtctgcagtcgtttgttcctctctgtgggttggtggtctggctgactaaggaaatgaagccgcaggccctggcagtgaatgctacagctcttcaagttggt

SEQ ID NO: 488102 - DNA, 320 bp, Homo sapiens
gccccatccttaactgatgacattccaccattgtgatttgttcctgccccaccttaactgagtgattaaccctgtgaatttccttcttctggctcagaagctcccccactgagcaccttgtgacacccgcccctgcccaacagagaacaaccccctttgactgtgattttcattaacttcccaaatcctataaaacggccccacccctatctcccttcactgactctctttttggactcagcccacctgcacccaggtgaaataaaaagctttattgctcacacacacacacacacacacacacagggggcggagatttc

SEQ ID NO: 488103 - DNA, 169 bp, Homo sapiens
cctcttgagtttaagtgattctcatgccttagcctcctgagcagctgggactacaggtgcccaccaccacgcccggttaatttttttttttgcattttgttagaagatacggcacttcaccggattagccagaagggtcttgatctcctgacctcgggatctgcttgat

SEQ ID NO: 488104 - DNA, 679 bp, Homo sapiens
ttactgtgtgtatattcagttaatgcattcgtagtccgacagtgagaatgcgcatcatcagaacgcgcatgcatgaagcctgaatcagccgacgcgcgcaaatccagacatcacgtgtgctcagcccatctgccagctaactaactactctctgcaccaagtgcgatggacacacatccgcgcgcgcgtccgacacgcacaccgttcgctacccagctcacttctcggcgaccacaagccagaggtctaatacaaaatattcacaaacacacacaccagtcgcgggctggcaacacaaggccttcagaaactcacccaaggagcggcacacttcctggaggcaccatggcacgctaagcgcggaacacgagcaacagcgcaacatatcaattctgtcacagtataccaacgagatgtttcaccacacaatcccaacaccgcaccatatgatacagtaaacgagcgccgcggcaacgcaaagcacacatttcaccggcaggtactgccgcaaggacgggtatacatatcacgatgcaaacccaccctggcatatatcagaaccgcaccctggatcccccaaaacacagtcatcatcccctttatgggagcccggcacacacacgcgtttacaaccctctaacacttttgcggacattggcgcgttacacgggagaaccaa

SEQ ID NO: 488105 - DNA, 185 bp, Homo sapiens
gtcatgcacctacggggcatgttagtcagctcccccaagtatgagctgcagccccccagagagagctctgaacgtcaccaagtaacaggccccagttccaggccccaattccgccagctctccccgctctggatcctgcatctaacactcgactctgctgctcatgggaagaacagaattgctcc

SEQ ID NO: 488106 - DNA, 801 bp, Homo sapiens
ctatgtctgctggtgttaatcggccgaggcgcagatggcggcgcccagaggctgctgaggcgcggaacggagtgatggctgctggtggcgttggtggctgggtgctcgtgctgggtgcggcggctgagctgtgtgccggtggctggtggctgaggtgcactggacctggctggccagtgcgctcccgtgagccgtgcgcgaagctgtgcagaagcctgagtgctggagtgtgccctgtgtgtaccagtactgtgtgtgctgaagctgctgcttgccctgctgcctgatcgcgtcttcagtgtgtgtgtgcttcatgcattctctgtgtgtgtgcgcttggtgctgttgcctatcctattgttggttgcccatgcttcctgtgtgccctgtgtgcccctgctgcctgtgcgccctgacctgctgcctgcagttgatccatgccctgtgccctatcgcctggatgcttggaccaaaagattatcatcttgctgcttgctggctatgtgattcacacttgctgtcctctaatgacttgcggatgttacgaaatgtctgggggatggtgactcaacaaagattctcagcttggatttcacaggagccggaaagataaaacgagggtgctacgagtatgtgtttgtgagccctcacccgtctccctgcctctggacatgacctcaggagacacgggtgctgcatggtctcctgctggccgagctcactctcttgtgttgactgaccagtggaaggagtcttcagcatgggaaacaatcttatgggcactgtggcagacaggtggca

SEQ ID NO: 488107 - DNA, 2111 bp, Homo sapiens
gaaaagttatttgcaaaagataacatggatttgctgcaaaccgccaggggtctgcactgtgattctcctttcagggctggttgaaggctccatacagtatctctatctgccttggacacttcaggcatatgtgccatatatgacagaacatcttgcacaacagtctgaatttgctgcaacccttctcttgctctgggccccactcaaaaccggcagacttacaaattccttcgtaaatgggccagggcagcatggtaaaatgtgctgtatattacctcctaaaacacccgtcaagtatttttttttaactctttcctagcataggagtacatgatgcagcaatttgttttcatttgaaggagataaccaacatgcctcaggccactgaactcctagaaatgtcacatgctcaacatattatccatataatggactagttctgcattttatgggatgttgtgattatcaagacccctgaagccttgcttatgacagaacaggagagttgccatagacctgagctcaaatcgtgaagatgtactgctgtccctgccatgtgaaagcaaacaccttccaaaagtgcctgtaaccaatacagcaggaaaaaaagtatattttacataaatagctgcatcccacatgtcaaaagccattttgatttactctagtaagaataacatatttgaaacagcagcagcaatcaattaaatattgataataagcaatggagagataacaggaaatcacgtagaatatatcattgtttgccaaatattctggctcctttcctactgaggaatcatacttccttaactgcagtcttgtccacgtgacttgcaaatgaaatgtgaacaaaagtgacatgcgtcacctttagacagaagatctaagagctgatgtgtgctttgttatgatgtattttccctctgccataagactaagcaatgttccaaacagaggctgatccacagcctccatctggagtgaagataaaatggaaaagagcttcagtcaagctgcagtggacacatagcaagaataagaagttaacttttgttggccaggcgtggtggctcacgcctgcagtcccagcgctttgggaggccaaggcgggaggatcacttgaggtcaggagttcgagacccgcctggccaacatggtaaaacactgtctctactaaagatacaaaaattagccaggtgtggtggggggcacctgtagtcccagctattcaggaggccaaggctggagaatcgcttttacttgggagtcggaggttgcagtgagccgagatcatgccactgcaccccagcctgggcaacagagcgacacttttgttgtctgccactgggatttttgatgacactaccaaagcctaaaatagcctgacccaacatatacagtctcagagattagcaacagttgagagtcagtgttcagcgatcctgaaacagtcccaagtattttcctctcccatgacaatggccatgggtctcttagggcttgaagaatgatttttagtatatattgcagcaatgtcagtgggctccaggtctgcaaaattgttcagctcccagaactgggggaagggccatgactattatggtgatccaaattagaattctacttacctgataatttctaattatgtagatcaacatatattttagtaggctattttattcctagagatactaccaaagaccctcacaagtcaaaaacattcattttaccactgtggccctgctgcccatgaaagtaactgtgcccactgtgtctctggtgttaaacactgtcacttggtctctgaaataaggaaggcaatttaaagagtagcatttcttattgtcacccccagcaggcagaggatacccgctacaaagctcctaaagggaaatggagctctcctccgcacattttttttttgtaagagaaggtcttgctctgtcacgcaggctggagtgcactgtcatgatgacagctcactgtggccttgacctcctgggctcaagccatccttccacttcggcctcctgagtagctgggactggaggcatgcaccaccatgcctggctaattttttaattttttatggagatgtctcttggcaa

SEQ ID NO: 488108 - DNA, 251 bp, Homo sapiens
  misc_feature (9)..(9): n is a, c, g, or t
  misc_feature (16)..(16): n is a, c, g, or t
  misc_feature (32)..(32): n is a, c, g, or t
  misc_feature (70)..(70): n is a, c, g, or t
  misc_feature (101)..(101): n is a, c, g, or t
  misc_feature (104)..(105): n is a, c, g, or t
  misc_feature (109)..(109): n is a, c, g, or t
  misc_feature (125)..(125): n is a, c, g, or t
  misc_feature (127)..(127): n is a, c, g, or t
  misc_feature (129)..(129): n is a, c, g, or t
  misc_feature (133)..(133): n is a, c, g, or t
  misc_feature (135)..(135): n is a, c, g, or t
  misc_feature (223)..(223): n is a, c, g, or t
  misc_feature (244)..(244): n is a, c, g, or t
  misc_feature (249)..(249): n is a, c, g, or t
gtggatttnaattganaaatatagtggttttnagcaaattacaactactggctcagaagtaataaatctnagcttcacatttattccatagaattatattntcnnactnataatgaacatataantnanatgngntatatagcagtcatgttgttttattctctacaggtatgttcgcaattcgtgctgatcatgattttgtagtacaggaggacttcatganagcagtcagaaaagtggctgnttctngg

SEQ ID NO: 488109 - DNA, 87 bp, Homo sapiens
atggatttgctggtgcagtacaactaggcttaatactcgaattcgagctcgaattcaacttctaacgttagaagcttgaattcgagc

SEQ ID NO: 488110 - DNA, 900 bp, Homo sapiens
cccacgcgtccggagaaacagtcaccaacctgtgttcccactgggctctgtcctgggagaggcacaagaacctgccctgacgcctgagagaaagactctgaaggcctcaggaccaaatccctggaggggtcttggcgtctaatgaatctagattgactgacttccctgggatgcttctggaaccttctgctaagccctcagcttcttggcagagctctattactaactggatatcagaatatgggtgcaaactagacatggggagtgaagtcagccattctcacagcatctacctaagaaggccaggatcctccacagccacgtagatcgtagagccagtggcatgccggggatgatatacaaagacaagaaactctgaaacagagaacacaaactaacagcccataggccaaatgcagcccgcaggcacatggcttatttggccaacacagcatttaagaaatgttttgagccgaggctgggtgaggtggctcaggcctgtgatccccagtactttgggaggccgaggcaggtggatcacctgaggtcgggagttcacgaccagcctggcagcatgacaaaacccgtctctactaaaatacagaattggccgggtgtggttggcccatgcctgcagtccagctaacccagctgcttgcgggggctgaggcaggacgactcgcttgaccctggggggccgcaggttgcagagagctgagatcaacattgaactcaaacttggggacaacgagcgaactcgtcccttattagtctacactatacacaacactcacacacaaaaagggggcgtcaaaacacacgaggggccatttcagtcccacttttacaagggcccaataggcattaagaagcagcgcgctaacggcgcaatgcatcgag

SEQ ID NO: 488111 - DNA, 482 bp, Homo sapiens
  misc_feature (204)..(204): n is a, c, g, or t
  misc_feature (220)..(220): n is a, c, g, or t
  misc_feature (266)..(266): n is a, c, g, or t
  misc_feature (378)..(378): n is a, c, g, or t
  misc_feature (382)..(382): n is a, c, g, or t
gatttctaagtggcccagaggtgcttgactgcccgaaatgggcaagttcatgaaacctgggaaggtggtgcttgtcctggctggacgctactccggacgcaaagctgtcatcgtgaagaacattgatgatggcacctcagatcgcccctacagccatgctctggtggctggaattgaccgctacccccgcaaagtgacagctgnccatgggcaagaagangatcgccaagagatcaaagataaaatcttttgtgaacagtgtatanctacaatcacctaatgcccacaaggtactctgtggatatccccttggacaaaactgtcgtcaataaggatgtcttcagagatcctgctcttaaacgcaaggcccgacggggnccanggtcaagctgtaagaaagatacaaaacaggcaaaagcaagtggttctccccccaaatgcggttttaaaccctccgctttgctcccttgactttatcaaaa

SEQ ID NO: 488112 - DNA, 114 bp, Homo sapiens
  misc_feature (63)..(63): n is a, c, g, or t
ttcccaggaatatcattccaaactgaaggcctaaaaataaggggcagaagataaccaccccanataaatgcatgatcctttgtttgatccttaattaaacaaagtataattata

SEQ ID NO: 488113 - DNA, 514 bp, Homo sapiens
  misc_feature (204)..(204): n is a, c, g, or t
  misc_feature (220)..(220): n is a, c, g, or t
  misc_feature (266)..(266): n is a, c, g, or t
gatttctaagtggcccagaggtgcttgactgcccgaaatgggcaagttcatgaaacctgggaaggtggtgcttgtcctggctggacgctactccggacgcaaagctgtcatcgtgaagaacattgatgatggcacctcagatcgcccctacagccatgctctggtggctggaattgaccgctacccccgcaaagtgacagctgnccatgggcaagaagangatcgccaagagatcaaagataaaatcttttgtgaacagtgtatanctacaatcacctaatgcccacaaggtactctgtggatatccccttggacaaaactgtcgtcaataaggatgtcttcagagatcctgctcttaaacgcaaggcccgagcgggaaggccaagggtcaacgtttgcacgagacgataccaagacatggcaagtgaacaagtggttcttccagaaactgcggtttctagactgcttttgtctacgatcattacacaattatacccagaacacaaaaacaaac

SEQ ID NO: 488114 - DNA, 650 bp, Homo sapiens
gcgcctctaacggcgcgacaggcctggcctatcccgcgcaaccccagcagcagcagcagccgccgcaccacctgcctcagcagatgcctgtgcagcacctgcggctgcagaccatgatggagtagcctcagacagtgcctgagatgcctgtcgagacaccgcccctgtccaccatagacatggagtcccaggagcggatcaaggcggagaggaagcgcatgaggaaccgcatcgctgcctccaagtgccgaaaaaggaagctggagagaatcgcccggctggaggaaaaagtgaaaaccttgaaagctcagaactcggagctggcgtccacggccaacatgctcagggaacaggtggcacagcttaaacagaaagtcatgaaccacgttaacagtgggtgccaactcatgctaacgcagcagttgcaaacattttgaagagagaccgtcgggggctgaggggcaacgaagaaaaaaaataacacagagagacagacttgagaacttgacaagttgcggcgtagatatagtcggagttgtcgtcatccaagcaccggtgtatgcgagttggattgggtggcgtcgggatggcgccctcagtgtgcacgagtggcaaggacttggcgcgccctcccttggcgtggagccagg

SEQ ID NO: 488115 - DNA, 237 bp, Homo sapiens
cccggattgtcggccaggagaagaagggttactttgaagaccgtcggccttctgccaattgcgacccctatgcggtgacggaagccatcgtccgcacgtgtctcctcaacgaaactggcgacgagcccttccaatacaagaactaagcggactcgacttccagtgatcttgagcccttcctagttcaccccactcccaactgttccctctcccactggtccccactgtaactcaaaa

SEQ ID NO: 488116 - DNA, 468 bp, Homo sapiens
gttttggttttctggtgttagggtttcagattttggtttagccctaccattctgacataaggtgaatgagtgctaaagttcaggtaaccatcccccaggtggccattaaattctggaattttttaggggtttttcccaagcttcctttttttatgccattttaacccagggttgactcatccttgcaaaaattggaatccctacctatttcaagaggacttatccttttggaaagggggccctggtcttccaagagaaatccaggggcgggggcccatttcccttttggggggcaacactgggatataatggctttctggggggctggctgggttaaaggcaccctcattaatataatagcaaaccaaaactcaggagttactttggacatctttgactctttaacttagtaataggaccccgcaggtttattccctaaataaaataatccacctaaatcaaatactc

SEQ ID NO: 488117 - DNA, 154 bp, Homo sapiens
ccgcctccacccaatttactgcatcccaagtcagctcatacaccccaactgacttagagtctctgaaatgcatgcaacttaaaattccctaaagcacacatcaggttccgaagtctgatttttacagggacagaggctacggatgctgactggg

SEQ ID NO: 488118 - DNA, 796 bp, Homo sapiens
gaggcattgaggcagtccagcgctaggggcttctgctgaagggagcaggcggtgagtcgttgcagtgaaacccgccaagataagttttatctcttctttcgagagatagcagattacatagcaaactagcttaataaggaatagatatagccaaataggttactaatgatattgcttgatcgttaagattggtaacgtaacttttaatagcttcaacggattttaagagagcaatgatgaagacgtgagaagagtggcatgaggaaggaaagagataaaaggttgcataaaactcatgacgggaggttgagatgaagcattccatgcatggagtaaataaagtgtattctcataggagaaaatgttgagagaagaaggactacagagcctccgaattgaataccagtagaagggcgaatgcttttagattaaatatgaaggtgacttatgcagcttagagtttagtttaaaagttgtaggtgattaagaataatttgaaggcgatcttttagaaagagatgtaaatccgaaggtgattcataagaccttgaaatccatgaggcagggagaattgcgtcattgaaagcctagattaacgcgtttactaaactgcagacgaatacatggatcagattaatgtgggagtggtacggatgacaagcaatttggaagaagatgagaagtttgaaggtggaacaatctggtattacagaagtacgggaaggcgaaagaagaagaatagagaagataggggaaatttggaaagatcagaactacttttagccagaagacaaga

SEQ ID NO: 488119 - DNA, 134 bp, Homo sapiens
catagtgctcccacgtagcaagaaacgacatggttcatatatgtggtgtctggtattcggcatatatcctccggtgtagttagccagtctttctgtgccattattccacagctgatgggagaagactgcgggga

SEQ ID NO: 488120 - DNA, 136 bp, Homo sapiens
ccccttttaaaagaaaaaaagctttgcttaagggttgcatccttttattggagtaaatttgaatgatcctactcctttggagtaaaactagtgcttcccagtttccaattgtatttagcttttggttggaatttga

SEQ ID NO: 488121 - DNA, 154 bp, Homo sapiens
ccttcaggatcctcaggatctcctcaggatctcatcaggatctcatcaggatctcctcaggatctcctcaggatctcatcaggatctcctctagagatctcctcaggatctcatcaggatctcctcaggatctcctcaggatctcatcaggatc

SEQ ID NO: 488122 - DNA, 264 bp, Homo sapiens
ggtcgacggtgtggtggcatgtacctgtggtcccaggtacttgggaggctgaggtgggaggattgcttgagcctgggaggtggaggttgtagtgagctgagatcacatcactgcactccagccctgggcgacagagtgagactctgtttcgaaaaaataaaacgaaataaaaacttagctgtaagggtaaaaaattagaaactggctgggcacagtggctcatgcctgtaatcccagcactttgggaggctgaggcagtcgacg

SEQ ID NO: 488123 - DNA, 522 bp, Homo sapiens
aatttaggcagaggggtaaaactgtctgctgagccctggggcatctgcgtggaatgggaaactagcaaagtctcgctttggctgcattctgaggggtttatgtgatggcaaacagcccagaatgaagaagctgcctagcagtcgctgcagcggctgagggtaatgtgggacttcagatagcttctgagtagtcaagcagtgcacaatcctggaggaagaggaggctcagcaagaaagagcgcatgaggaatggagtccagaagacaggccacagtgtcctgggactccggagggtctgatgaagcaccgcccaagcccagcagaccgggttatcccagtccgaggtccagcgagggatttttatcccagccccacagcacatggtacaaaccattcattaccaggtttctggctaccctggttcacttggaatcacagccttggttggcagcttctatcccgggtcagggcttctctttcggcccaaacagtttcatgcgatcatagacctcaggagatagc

SEQ ID NO: 488124 - DNA, 274 bp, Homo sapiens
agctcgggaccgcaactaagagctagactctgcccctagaataaaacaaaaactaggcatgcatggttggtgccctgcctatagtcccaccccagggaggctgatggagatggatcccttggagcccaggaagtggactgctgcacgagccacgattgcatcactgcactccagcctgtgtgacagagagagacagagaaagaaaagagaaagaaacagtctggggcggtggctctacgcctgtcatccctgctcttattgcccaggctggagt

SEQ ID NO: 488125 - DNA, 393 bp, Homo sapiens
  misc_feature (5)..(5): n is a, c, g, or t
  misc_feature (107)..(107): n is a, c, g, or t
  misc_feature (159)..(159): n is a, c, g, or t
tcccnttcccttctcagcttgattggcatttaattccaattccattccgattcccattataattccattcccattccattccattccaattccattccattcccatnccaattcctctcgggtggattccatgccattccatttcattccattccattncatgtccactctggttaattcccttccattcatttcgattccattccattgcattccactcgggttgattccattccattccattccattccattccattccattccattccattccattccgttccattccattccattacactcgggttgattccattcctttccattccattccattccattgcattccattgcattccattcgattccattccattccgctcgggttgat

SEQ ID NO: 488126 - DNA, 129 bp, Homo sapiens
tgtcccctgctccccactaggtggacttcacccttagctcagacaagagacttcgcactcctcagttctccaggtgccctctgaaagatgcgaagacgctgtggcctccattcaactccctcagaggcc

SEQ ID NO: 488127 - DNA, 736 bp, Homo sapiens
ggtacagggctggatgattgaagggccggcgggaactagtcggacctccgagctcttgaagactgtcctcagctcggctggttctccacgagctccgggccgagacggcggggggtgggtcggcgtttgaagtcaaaggccttggggctccgagtcccttcctctccccggcgggtgaaggcacgagccagttcacgctgtctgtaaaggtggagccattagtccctgcctcgtatgtgggaaaactgggaggcggaacgatgggaggccgccggtcccaacccggcccaggagcatctttctcctgggaccgtttcctggcgagatcctgcgcagcctgcaggctgtgttagcgccaaaggagtctccagacaggtgttagcagacgcgttgacgcacggaaggctggacgcggacggcacgcgggcttggtggacagcgacgtcacgcagcataggaaagccctcatacgcagagttcctagcacccgggcaccggcctgaggtctacgagtcactgcaggatggcagtctgggccccgagttcctgggcgtggactgagtacagacgtgtccccagaacgcagacctcaagggacttgctccagacggcttggagacacgtatcgggtgatcgacacacggaagacggaacgcgcagggcctgggccgggccaacagtcacatacaggccagcagacatccctccttccacacgaaggagaaagcgcatctac

SEQ ID NO: 488128 - DNA, 402 bp, Homo sapiens
  misc_feature (63)..(63): n is a, c, g, or t
  misc_feature (123)..(123): n is a, c, g, or t
  misc_feature (213)..(213): n is a, c, g, or t
  misc_feature (282)..(282): n is a, c, g, or t
  misc_feature (372)..(372): n is a, c, g, or t
cctcgtgtgcgacaatggctccggctggtgaaagccggcttcggtgaattgacgcccctaggncggtgttcccgtccatcgtgggccgcccccgacaccagggcgtcatggtcggtatgggtnagaaagattcctacgtgggcgacgaggctcagagcaagagaggtatcctgaccctgaagtaccctatcgagcacggcatcatcaccaacntgggatgacatggagaagatctggcaccacacctttctacaacgagctttcgcgttggctcccgagganaccccaccctgctcaccgaggcccccctcaatcccaaggccaaccgcgagaagattgacccagatcatgtttgagaccttcaacgtgccngccatgtacgtggccattcaagcggtgctt

SEQ ID NO: 488129 - DNA, 292 bp, Homo sapiens
gatcgattggagcgggggcagtgtatgatgatggggacgttcattagatagtacattactggtttgaacatggttagtgggtgtatatgtgtcatttgatgatcgctcgggggaataggttatgtgatcaggagtagggttaggatgagtgggaagaagaaagagaggaagtcaagtttaattatgcctttgtgggttgaggtgatgatggcggtgcgagattcgctgctgtgaacattgtcttaggtaatagcttttctagtcaggttacgtctaggatacagtagggaga

SEQ ID NO: 488130 - DNA, 136 bp, Homo sapiens
tggcccaacttaagcactcttggtaggtcccgtgtctcttggcgtacagcttagcaggctccctcggaagctgcgggagctgaaactgcgccatcgtcactgggggcggccatgacaccgctcgtctcccgcctga

SEQ ID NO: 488131 - DNA, 448 bp, Homo sapiens
gccatttggtctcatgccttctttcattcagcatgtatctattgagtgccacaggtatgccctgtttattgaaaatgtcagagataagtagatgagcagactccttacactgcatgctgccatacagagttaacctgtataagatctagtgcggcctagcactcccattctctctgtcagacaggactgtcagggtttgatctagaagcaaagtctcctctgttttctgcctaatccctgtaagagtcatgctcttggggatttcatgttccagtggggatcatgtccttgagatcacaacaagtacatctctatgcaggtgagtgaacagtcgtgcaggtgcccagctcacggtggcctagtgctgagagtgatggacaggatgggtccggagttatcccactgtagatacactatcattgctgtgtttttgattcaaactatccag

SEQ ID NO: 488132 - DNA, 334 bp, Homo sapiens
tcttgatatactatctttctggctgatcctttgtctgtaaggtgagtgggttcagacgtggatggttacttgcccttggcttcttttgtgtttgtttttgacgacagggtctcgctctgtcgcccaggttggagtgcagcggtgcaatcttggctcactgcagcctcctggattcaagcaattctccctcctcagcctcctgagtagctgggattacaggaatgcgctgccacatctagctaatttttatattttcagtagagaaagggtctaccatgttggccaggctggtcttgaactcctcacctcaggtgatccgctggccttggcctcc

SEQ ID NO: 488133 - DNA, 248 bp, Homo sapiens
tcactagagaaccccgtatcattattgatgtgcgataaaacactcgcgtgtgttttatacctcacaatgatggctatgtgaagagcgtgtggagcaccccaaggctttagtgagtcactagcctctggaaggcccttccgacctccctaccatggtggagacatgccttagttactagttcatcctacctctgttccatcctagaacagacagagcaagcacctagtgcattatacagctaggacccc

SEQ ID NO: 488134 - DNA, 133 bp, Homo sapiens
tgtatgcttaatgccactggctggtgaacagtgctgtccacctcttcggatatctgtccttatgacaagaacatttgcccccgggagaatatccgtggtttcacttggagctgtgaggtgagggcttccacaa

SEQ ID NO: 488135 - DNA, 148 bp, Homo sapiens
  misc_feature (49)..(49): n is a, c, g, or t
  misc_feature (81)..(81): n is a, c, g, or t
cccggtgggccgagtgcaaaaatgctccgtaaaggcaactacgcagagnggtctggggcaggcgcgccggttgtacctggnggcggtgttagagtatctgaccgccgagatcctggagctggccggcaacgcggctcgcgacaacaag

SEQ ID NO: 488136 - DNA, 1417 bp, Homo sapiens
  misc_feature (249)..(249): n is a, c, g, or t
  misc_feature (601)..(601): n is a, c, g, or t
  misc_feature (960)..(960): n is a, c, g, or t
  misc_feature (1417)..(1417): n is a, c, g, or t
tgggcaacggcatgggtattccattgaaatttcacaaacacaagggtctctgagccggggtctccacattcggtgaaggaggcagggctcggggaagcacagagtgtgagttccctcccaaaccgtgggacaatttgtgcaataagccctttccgtgcatagggtgctcaagggctccaagggggcccccaggaacccgtgggaaaggggcccgtgtgtagggccgaggggacacagaagcgccgtggnagacccccaagggtgtgccagcacagggcgaaaggcgtgagaaaggccccccgagtgagccccacagaaacaaccgagagccaaggggtgtgcgaagggccccaggggaaaggccggaaggggggttgagactctgaaagagggccaccaaagtcataccaatcgttgtgccccccctctttgtgctgtggtaaatctcaccagatctatcacgtagaaagtagcgggctcctgtgagtggagcgcccacagttttcacacacatgtctcaccagcagggggggcccccccccagagatatccaagaggaaaagaggctcctcgttgagcaccttgtgtgccccacaaaaanctattctgatgtgggggaaaatcatccccttattgtagggttttctcccaagcggggggggaaccccccatctttggaagaaaaattttaccagcccccagatgtttggctctcatacaagggggtcggctttgttggatcatcttatcgaggccgacagaatagccaagcggcacgttggtttgcctcatctttggcgcgaagagcggccaattataacgaataccacacccggcgcgaggaacagggaggggtgatgatatcactcctcacgtaccaaagctagcaaaaaagagaattgtttgaccagaggcaccccagaagacaggctgcaacttgttgagactcgtctgcccagnagaagaaaagagctgtcttttgttggcccccacaagagtgtgggtggcttatgacaaacaacctggtgttgtggcacgtaagaaacagtgtgggtgctagcgaaaacacagaagtgtacacagtagtggaaagccccccacggaatgctgattttgtagggagagaaaatcttccctcctctctaccgccaggaaaggacgggaggtacttccccccaactattctcaccaggggggggtcatcacaaacgtttagtctggaactagaaaaaacgggacctatttacacgatgtaagagagtaccttctctacacggcgacagacaacaacttactatacgaaggagaaggagcgcgtagcaacaagtcattaggtgggcgggcacaccgaacataggggggtgaccagtaaattattaagtaaacagccggcgcccctccctaataggctggtacn

SEQ ID NO: 488137 - DNA, 1368 bp, Homo sapiens
tggcagtgcaaatatccaagaagaggaagtttgtcgctgatggccatcttcaacagctgacactgcaatgagtttcttactcgggagcctggctgcacagcatggctcactcgtggcagttgcaggtgcgcagcttaccaccgacaccaggaccagacacatccattcatctctcagcccaccagcaactaccagcaatgtatccttgcgtgcagcacagggccaggccggcattcgagcgcaacctgcacctgcctgctcagcttccacgcacacccaggctttcggccctcttcccacgcagtggccagctagtcagcacgcttctcatcagctacgcacaacaggttgtgcccactacagccaggtctcgtcgtagccccattggcccccagggccaggagtcatcctgacgctctacaaaaacctacacataagggacagtgctcatgctggtgccggcagtgggcacatgcactaatgcgctgctgacaagccgggactccccactcccctggccacgcagctgcggcgcccgaaacaggcctgccggcagggcatccgacgcggcagatcatgggacgcacaagcctcacagcaaggcacaagcaggggcaataaggctacccactgccacaggccccggcacgggaatgggcccctggcactgaactcccacacacgacgggcagaaaaccacaagggtacaaaccataaccataccgcgctcgcaccaccctaggcacaggtggcggcccacagaaagctaaggcctcgcaaggaaccagagcgcaagactgcccagaagagccagatccaaacggcgctgcacacggaacatccactggacactgcccccccggaggcgtaccgccaaaccacctgggccacacgccacacccgggcgcaccattaacagacaacgaccccccgggccccatcgaaccccacgaccactgacagcccccccccgcatagagcacacgccggaccaccaacggacctcgccagaacactagcctaggcccccccaagacggagagcacgccacacgcacaatcgtaccagaggcaacccaccacggcaacaagcgcgtgctgcgcggcacacagcgcccaccgacagaggccgggccgccggtcgctctacatgtgaccccccccccagagcgcacataacggcccgcagcacagaacgcagcagctatacccccacggggggctcactacgactccagcgcgaccaggcaccacgcctacactacactcatgcgcacgacgccctacctcggaagcccgatacgccgcgcaggcacataaccaagacaaccacaggcacagaccacacccaccacgcccaggggcacac

SEQ ID NO: 488138 - DNA, 436 bp, Homo sapiens
accactcttacaatgctgatgcgactgtgagcttatgcaaccttcatgaaaacaggttgtcaaaacaggagtatgttatgacatcttaagcattttatatacttcgaactagtaatttcatctcttgaaatacatctttagaaaggaatggaggtaaatcttaagagttatttatagcagtgttcatagaaaagataaaggaaacatttgggatataatattaagtgtaaaaataagatatgaaactctttgtgttaagattgtaatgccttaaaatattaggcagaaaattattgaaaattgatagtgagttgtaggcgatttttttaatgctttctttaaaatttccaaatttctttttaaaattatatttttctcttaaaagaaaacaacaaaattgggcctggaaagctttaaaaacaaattaaatactcca

SEQ ID NO: 488139 - DNA, 1976 bp, Homo sapiens
  misc_feature (273)..(273): n is a, c, g, or t
  misc_feature (1769)..(1769): n is a, c, g, or t
ctgctggctttccatctctactggtggttgctctgtggtgcatgttccttctcgactccttccttcttttgtgtgtgagctgtgtcctatcgccggcgtcgttggtctccgttttctcgccgcgctgtgttttataggtgtgaggctgccgccctgtgggcgccaactccttccgtatctacttagcggcttttgtttcacaacctccttagtgagtgtgtgcggggcgcccttcctctgtcggttcagacaggtgtttcctacacggatagngtgtatgcgactctcttgtgtgtacgtttatgttgtgggggctacccccactcgggtcccttgttctccctctgctgggtgtgtaattgtccctgtctgtttgctgttcacaattatggttggtgaggctccgaagatctcgctcgtgtggttgtcggtgtgtggctgtctcaccacgggctcccccgtgctcgctgtgtgcccttggtgttttagcctcccagctggcttcggggggatgttaactgccacgtagtgacccccccggtggaattgttataattggtgggtgagagtaggttgtggtttgcccccccgcttgttgtagcccttccttttgcggctccccccaggtggtgttgaagagcaagaccgttctgcgtgggtggtttataagcactcaggaatgtattgtcgtaattgtcgtgggatgtagtcgtccctgctgggccccctctcgagtggagaactcttctggtgtgtgttttgtaataaaggtgttgtgttgtagatgagtgtgtgaaggtattaggtctgttagaggcgccacaagccctctgtgtcgccccccaccaaaacatgtgttggcggccccccctcgttggtgcggcaccccctcttcgtgtgttggagcacacatgttgttgttctgtaatataatacgccgcgtctcttctggtgttgtgagtgttgtttcttggacaacacgacacatagatgtggcacggctggtgttgttgtaaaactgtcggctgttgaatgtgttgtggtcgactaatagtagtggagatacctctctgatgtagtgctcgtgttgttggtgtggttgtgtaatcagaggagtagttgtttgtttaagaccctctgagatatagccaccacacacaagtgttgtattagtttgaagagtgttcttgtcttctggtgaggataaatttattctactatctgctgttggtgttcgacaagcattgtcttcgtgttggtgtggacaacactagcagaaggttgtagatcactctcttatattagctccctactgcggctgctgatgcgtcgtcgctgattagttgatgatttttgctctctaacggcgaggatataatatattattggtattacagcacacccctcacataagggtgattatgtgcgcgcctccgaagcagagttttggggagctgtgtttttttggtacaccagcagataaacccacagctgctgctctcgtcgcgctttgtctattataaaatatctctgtcttaaatatgtgttcttaaagtttctgtgtctcacacagcagtgagaaatattctcctctctcctggtggtgtgttacctcaccactgtgttgaggaggagacgcgctctttataggcgtctctctgtataaccgcgagagtcacattgtgtctctgtgacacaccctgtgtggtgtgaataatgagatagtgatgatgaaagcacacacatacaatagtgtattctaactcttngaaactctttgtgtaaaataggagtaggtggtgtggaggcgctcaattgtctctggtgtgtgttcccctgtctcccagtgcctctgtggtggtgcaccctggtgttggccacagtggcacacacacgtggtggtggtggtgaaaaacacacccctgttaaaacccgaaattaccttttaaaaattaacccaaaatggggaccctgga

SEQ ID NO: 488140 - DNA, 837 bp, Homo sapiens
  misc_feature (535)..(535): n is a, c, g, or t
gcaacgtgttctgaaacttgcgtgagtaataccatgcgtcggggatcaaggaactaggtggttgcgaatcggaatggtagagcagtagtgctactactttgaggctagaatattctggactggattcagtagaactgtttaacagtgtgtaggttgagtatgcatgtgtatcggtcgtttgttgccaatgtcttgaaggagatactggtgggccagtttgggaagaatgaagagaagtgcgtaataagtgaggtgaagtaagtgcgtagtaagaaagatgttaagctgcctgttgtagatcatggtggacgtgactcggttgctcctaagctgtagagacttctcagtgatgtactggacctcctggttgcagtctctgattcgtaagagtcgcacccctagataacacttatctaaggcacgttgtcgaacattattgaaaagcattaaggcctggggtgtatttcatcgtggcttgctatgggcacctctaggtcggttacctctagggttgggcttgataggtgtagtgccntttgatagttaaggcgaaagttaatgataaatgtcttgttggcaattacaattaaaaagaacccgttgttggaatcccttttcacagtaggagatatggacacacaagaggcaaaggggcggcaaccgttttgcgtgtgttaggccaagggtaaaaacggaaagagttgggcgcgtgtgggtccattgtgaatggaagaatggttttccttccgaatggaagagaaaaattctgtgggttgaataaaaggggcggggagttactaacttgtgcaaagtaggattcgggggaaggatttatgg

SEQ ID NO: 488141 - DNA, 420 bp, Homo sapiens
gtggcaagcagttcttttcagcagattttgcccactattcctctgagctgaagttctttgcatagatttggcttaagcttgaattagatccctgcaaaggcttgctctgtgatgtcagatgtaattgtaaatgtcagtaatcacttcatgaacgctaaaggggaatgtaagtatttttaaaaggggggtatttccaaattggttgactaaatccggaatttccagatttccatgccggatttaccctcaacccgggcctgtttccccaaacttgaagagggaaagctccgaaaatcgggcttcccctcggggtcctaccaaaatgggccttggggggtcaccctttgggaaggtgcagctttgttgtcccttgagccttctgttatgtgcctatcctaataaactcttaaacacaaaaaa

SEQ ID NO: 488142 - DNA, 270 bp, Homo sapiens
gcttgcctttcttctgtactctagctgctaatgttgtgctgaatcgtttcaaagtctttcccatgctcgtactgctcctcgaagtaggtgttctgttcctctgtgctccacgacttccactgccgctggacttttgtgctttcttccgtcttgtcaccagatgaccctaagttccgggaggatgagcgctgtagcttgcaggtgcagcagggcaaccttagatatatttccatgacgatgatcctccaccttcagctccttgctctgcgt

SEQ ID NO: 488143 - DNA, 152 bp, Homo sapiens
ccatgtcaggcaagttgggaagtgctggcatgggcacaatgctgcctgggctaaagaacacgtacccaacaccaatacttaaaactatccttaatctgtctccctaccccgaggtttatacacttccaggtcaggcatcctttgtggcagaa

SEQ ID NO: 488144 - DNA, 232 bp, Homo sapiens
  misc_feature (70)..(70): n is a, c, g, or t
  misc_feature (133)..(133): n is a, c, g, or t
  misc_feature (141)..(141): n is a, c, g, or t
  misc_feature (158)..(158): n is a, c, g, or t
  misc_feature (201)..(201): n is a, c, g, or t
  misc_feature (203)..(203): n is a, c, g, or t
aggaaatatacttttacaagtaacaaaaataaaaactcttataaatttctattttttatctgagttacanaatgattactaaggaagattactcgtaatttgtttaaaagtaataaaattcacagacatttgnctgaatanctactatatgtcagtgnctgtgcaggtattacactctgtaattgaatattattcctcaananattgcacatagagagcgctatctgggaag

SEQ ID NO: 488145 - DNA, 376 bp, Homo sapiens
tccccgatgctatccccaacacaaaaaatttaaaaatcagctgggcatctgtatttccagctactcaggagctgaagtgggaggaatcacttgagcccaggagtttgatgcagcactgagccataatcatgccactgcactgaactccactccagcccaggtgacagagcaaaaccttgtttcaaaaaaaaaaaaaaaaaaggtatttcttggttcccaaagaagaaccttttcttcctgccaaggtataagggttggtataataaagatctatcaaaggttcccggctttccccaaaagaaaacacttccatcccagtaaaagggcctttttaaagactttaacaccccctaaaacctttggaaaacaaaaaatt

SEQ ID NO: 488146 - DNA, 231 bp, Homo sapiens
tgtcagcggctctactcatgctggtgaggaggagagtagggaccgatgaatcttgctataacatgatccgttgcacagagaagctttcctcagctgagagctaccatggaggcttattctaggatggctaatcgagacttgtaacgcggtgtgagccgtgaggtcttccggactatgtagaacagtggtattgaagaccactcttgcatgtgtgacctagaacctgccctg

SEQ ID NO: 488147 - DNA, 148 bp, Homo sapiens
gaactgggttctgacaagatggccggctgcccgcagatcatcaaggaaaccagcgtttctgcagaccagttctgcatcaagccgaccagatgagagcacgccgtatttcatgtggtcaatgctggcctcaggattccccttgaggagg

SEQ ID NO: 488148 - DNA, 262 bp, Homo sapiens
ctaagaatgtcatgtcttgggttagaattttcatttttagccccgttaatgtattcccttaaatctatgttagcaccttgtctccatgcagaacaacaaaccatccaaacattttaaacattgggtgaaacacgaaggggagggttaaagacagactccggtactgtgcaaggagtggctttagatcacaagatccttgtcgatatccttctgcttgatgcccgagcagcctgcccactcatccagggcgatgtacttgtca

SEQ ID NO: 488149 - DNA, 154 bp, Homo sapiens
gccacggtagattttgacaaggtacaagataattaagtgggcccacggcggcttcatgcccaacggcatcggtgggctgatcgcctcgtttgcggtggtgatgttgcctttggtggcatcgaaatcatcggcatcaccgccggtaaagccaagg

SEQ ID NO: 488150 - DNA, 312 bp, Homo sapiens
ccgctgaccaatgacagtggtcttgtcgttggagtgttcagttccagcagtgcagagcatttgggggtggctcagctctgttgggaggcggcagtccaccatcaagtacaccagcacctcctccttccagcaggacgagctataagcactaaagtgcgtctgctagctctcggtcccacagtcctcaggcccctctctggctgcagcgccatctcctcaggtggcctgtcctctcctggcctccagtctcccctgctgtcccaggtagagctggggatgagtgcttagtgccctcatttcttctctctctct

SEQ ID NO: 488151 - DNA, 797 bp, Homo sapiens
tgtggtttactctgagattctgtagtcctaatattgtatcattgtgctgtctgcaaaacaacttgaatctattttgtttgcatctttgttacatgtaacgcagctgtactttatgttctttgcaactgtttccattatgagaacgctgtgctatttacaaggttacatttttcttggccaggcgaggtggtcatgcctgtaatcccagcactttgggaggccaaggtgggcggatcacttgaggtaaagagttgagaccagcctggctagcatggcgaaacccagtctctactaaaaatacaaaaattagccgggtgaaattagccgggcgtggtggtgtgtgcttgtaatcccagctactcgggaggctgaggcaggagaatcgcttgaatccgggaggcagaggttgcagtgagccaagatcaggccactgcactccagcctcggggtcaagagcgaaactctgtctcaaacagaaagaaagaaaggacggaaggaaggagggaaggacacggaacgaaagagagaaccgacaagacagaaagaaagaaagaaagaaagaaagagagacagaaagaaaggaagaacgagaaggaaatatcttgtattgtataaactggaaatttaacagttagctctagaagagttactgaacgtggttactgggaatgtaatagactgcattaaatgactggcatcaactgggtaggaaccgtggataagttcggaattatttttctcttgaagttgtttccaaacgttcgctttttgcaaagtgttatcattcttaacttctt

SEQ ID NO: 488152 - DNA, 790 bp, Homo sapiens
  misc_feature (22)..(22): n is a, c, g, or t
  misc_feature (69)..(69): n is a, c, g, or t
  misc_feature (105)..(106): n is a, c, g, or t
  misc_feature (113)..(113): n is a, c, g, or t
  misc_feature (115)..(115): n is a, c, g, or t
  misc_feature (145)..(145): n is a, c, g, or t
  misc_feature (149)..(149): n is a, c, g, or t
  misc_feature (158)..(158): n is a, c, g, or t
  misc_feature (202)..(202): n is a, c, g, or t
  misc_feature (211)..(211): n is a, c, g, or t
  misc_feature (214)..(214): n is a, c, g, or t
  misc_feature (226)..(226): n is a, c, g, or t
  misc_feature (236)..(236): n is a, c, g, or t
  misc_feature (248)..(249): n is a, c, g, or t
  misc_feature (253)..(253): n is a, c, g, or t
  misc_feature (257)..(258): n is a, c, g, or t
  misc_feature (267)..(267): n is a, c, g, or t
  misc_feature (270)..(270): n is a, c, g, or t
  misc_feature (274)..(274): n is a, c, g, or t
  misc_feature (277)..(277): n is a, c, g, or t
  misc_feature (282)..(282): n is a, c, g, or t
  misc_feature (293)..(293): n is a, c, g, or t
  misc_feature (300)..(300): n is a, c, g, or t
  misc_feature (309)..(313): n is a, c, g, or t
  misc_feature (316)..(316): n is a, c, g, or t
  misc_feature (318)..(318): n is a, c, g, or t
  misc_feature (320)..(323): n is a, c, g, or t
  misc_feature (325)..(328): n is a, c, g, or t
  misc_feature (331)..(331): n is a, c, g, or t
  misc_feature (335)..(335): n is a, c, g, or t
  misc_feature (337)..(338): n is a, c, g, or t
  misc_feature (343)..(343): n is a, c, g, or t
  misc_feature (348)..(350): n is a, c, g, or t
  misc_feature (353)..(353): n is a, c, g, or t
  misc_feature (361)..(362): n is a, c, g, or t
  misc_feature (364)..(365): n is a, c, g, or t
  misc_feature (371)..(371): n is a, c, g, or t
  misc_feature (379)..(380): n is a, c, g, or t
  misc_feature (384)..(384): n is a, c, g, or t
  misc_feature (388)..(388): n is a, c, g, or t
  misc_feature (390)..(390): n is a, c, g, or t
  misc_feature (405)..(405): n is a, c, g, or t
  misc_feature (409)..(410): n is a, c, g, or t
  misc_feature (414)..(414): n is a, c, g, or t
  misc_feature (421)..(421): n is a, c, g, or t
  misc_feature (424)..(424): n is a, c, g, or t
  misc_feature (426)..(426): n is a, c, g, or t
  misc_feature (430)..(430): n is a, c, g, or t
  misc_feature (433)..(434): n is a, c, g, or t
  misc_feature (436)..(436): n is a, c, g, or t
  misc_feature (443)..(443): n is a, c, g, or t
  misc_feature (447)..(447): n is a, c, g, or t
  misc_feature (453)..(453): n is a, c, g, or t
  misc_feature (459)..(459): n is a, c, g, or t
  misc_feature (474)..(474): n is a, c, g, or t
  misc_feature (477)..(477): n is a, c, g, or t
  misc_feature (479)..(479): n is a, c, g, or t
  misc_feature (487)..(487): n is a, c, g, or t
  misc_feature (496)..(496): n is a, c, g, or t
  misc_feature (501)..(501): n is a, c, g, or t
  misc_feature (505)..(506): n is a, c, g, or t
  misc_feature (525)..(526): n is a, c, g, or t
  misc_feature (530)..(530): n is a, c, g, or t
  misc_feature (536)..(537): n is a, c, g, or t
  misc_feature (543)..(543): n is a, c, g, or t
  misc_feature (557)..(557): n is a, c, g, or t
  misc_feature (565)..(565): n is a, c, g, or t
  misc_feature (570)..(570): n is a, c, g, or t
  misc_feature (783)..(783): n is a, c, g, or t
gataccgcaatagaatgagganacagtactttcagagaattatctttaggtgaagaaattcaaactgtnaagagtaatatactgtacataaacatatacataagnngtctaananccaagctgtgacaagggacctagaactganacanaatttgagnaaaacttacttaaaagcatttgtttcctgtaatctctacaaatnattttagangcngagatttctgcnctcaactgtnatgactaatacnnccgngggnntcacttagnggngttnggngtaanggggggggtgnggttggngtgttagtnnnnnggngnannnncnnnngcntttncnnattcngcgannngantaaatagnngnngtgaangcggaggnnaatntttntnagcagtggtttgtgngtgnncttngcgacgnagngngtcngcnncngggaccnctgngttggnatcgcncccgcataattgtgntcncnttcatatnctccttganttggntttnngcgggatcggtgcgcatgnngacngagatnncgtggnccagagtgagcgtntttgtggngtttntcagctgagcttccaagagtattctgagcttgctggtgaggtagaatgcctcacagaacctggttcccaccttctatagtgctcttttcttccctctatatccttttcaaatctcctataaccataaatcttgtcctctgaattcctacagaaggaatctgaggaatttcttctactggaaaaatgtctttctgatttatatggcttttctgntttgcta

SEQ ID NO: 488153 - DNA, 398 bp, Homo sapiens
  misc_feature (284)..(284): n is a, c, g, or t
  misc_feature (322)..(322): n is a, c, g, or t
  misc_feature (359)..(359): n is a, c, g, or t
  misc_feature (379)..(379): n is a, c, g, or t
cttgaatggtcttcaagattgcttgaagaagaaaattatctgaaatatgttgaagaaaatatattacctagctgagatagattctgaaggcagtcactagtgaaattgtaatttgttaaattattttgcaagaagccccctttttttaagcaatcttaaaaaatggtaaacgtaataacattccaagagtttttgactaattgggtgaaggaagtataggaaaattgcaagtacactgagtagggataatgggtcttaggattcttagggaaggattgggctgnatgggggaggatagttaagggtagggctgttacttttnatgtttggcattaggcagggctgtttggaactttttnggaggagttatttccccctnaactttcaccaggcaggac

SEQ ID NO: 488154 - DNA, 234 bp, Homo sapiens
ttctagcagctgtgtgtcatctcacaatcacagattgttgtctccaatcctcacagagacccaattgagcaacaaaagaaaaaaggaaaaaaaaaagtcgtctttttattttgttgttggggacaaatcggttggaaagccccggtggggcttggcacaacggggggaacccacaaggagtgccggggggctttgcatgtgtggtcgacgcccgaggataaaaagggatcagca

SEQ ID NO: 488155 - DNA, 142 bp, Homo sapiens
gatgccgagtcgaagctggactttactgctgccatctcgggtcactgcaacgcggcctgcctgattctcctgcctcagcctgccatatgcctacaactgcaggtgcgcaccgactcccctgactgagtttcgtattttatcg

SEQ ID NO: 488156 - DNA, 356 bp, Homo sapiens
  misc_feature (16)..(16): n is a, c, g, or t
  misc_feature (25)..(25): n is a, c, g, or t
  misc_feature (28)..(29): n is a, c, g, or t
  misc_feature (85)..(85): n is a, c, g, or t
  misc_feature (87)..(87): n is a, c, g, or t
  misc_feature (112)..(112): n is a, c, g, or t
  misc_feature (132)..(132): n is a, c, g, or t
  misc_feature (182)..(182): n is a, c, g, or t
  misc_feature (197)..(197): n is a, c, g, or t
  misc_feature (201)..(201): n is a, c, g, or t
  misc_feature (250)..(250): n is a, c, g, or t
  misc_feature (269)..(269): n is a, c, g, or t
  misc_feature (315)..(315): n is a, c, g, or t
  misc_feature (319)..(319): n is a, c, g, or t
  misc_feature (335)..(335): n is a, c, g, or t
  misc_feature (337)..(337): n is a, c, g, or t
cttgccgagcagaatnagctctgcnccnnacgccccggtagctgcttccgcatctgcatttcatctggagcagggcaggtaaccncnggaggaggcatgcccgaggcagccnggactgggcgggaaggtgcncccgggatatactctgtgaaccgtctggaaggctgctggcagtttttccnttttgtccaccaccnggcncgttttaataattgtacataatccgtgtatttgttttacctgctcatcntctaaaactggcgagcccnatagttcgttctcattgttagattttgccgtttacaagtgtccccnaccngcaataaacttttccngngtgaaaaaaagtaatcggg

SEQ ID NO: 488157 - DNA, 226 bp, Homo sapiens
caggaggatcacttaaggccaggagtttgagaccagtgtggccaacatggtgaaaccctgtctctaccaaaaatacaaaaattatccaggcatggtggtgtgcacctttaatcccagctacttggaagctgaagtcacaagaatcacttgaacccaagaggccatctgggcaacatagtgaagtaaaaaaaaaaaggaaataatacttagatgccttaaaatctgt

SEQ ID NO: 488158 - DNA, 399 bp, Homo sapiens
catacaatagtgacaacttaggtacataaacagaactgtctgacttcaaagttgaaacttcctccaccatactatgctccccgcaccaacgagaatatttagtgtaattaaactattgaagacaacaacaggtaaacgagaaaatccttggaaaagaacaccgttaatttacaatagtatatgtctctctctggccaacgtactttgtttcatgacactactggcatcatccatcccaaatactttcggtcgctgtgtgtttcagactctgaaaaaccttcaaataacacaataaaacctgctcctcttttcctttaatcttacataaaggcagttctcttaagtctatagtcaaagcagattataaaaagaaaacaaatcactttgcgtgtgtgtgtg

SEQ ID NO: 488159 - DNA, 176 bp, Homo sapiens
gtcaaaggacaatgtgttttctggtatgacaagagaagtagaattgttgttaagggaagccgagtaccaaaaagatcccggtgtcacagatttgtgtagggtgtttaaagctaaaccacaaagttttattttatcacatagagagagagagccacacagagagatttccatattat

SEQ ID NO: 488160 - DNA, 383 bp, Homo sapiens
  misc_feature (76)..(76): n is a, c, g, or t
  misc_feature (158)..(158): n is a, c, g, or t
  misc_feature (366)..(366): n is a, c, g, or t
aagcctcctgccttgaaaggaaattttggcctacaaaggaccgctgttaaatcagattggacaggaggtgatatcnaagaatatgcaggtagtaagggtataagacaaaacttctaatgcatgaaggggaatactgctctagaattcaaatttattcnttcagttagtcacttattcactcacacattcatcatgtggtcattcattcaatcaacaaatacttatattaagcatctactctgtaccaagcactgggctagctataggatatgcagtagtagtgacaaaaattcagagttccagccctcattaagtttcctgtgtaagggaagtgagattccatgtgctttcatgaaaagcagactntttgtttcttaaaaaaa

SEQ ID NO: 488161 - DNA, 468 bp, Homo sapiens
ccacaggaatgtagagtcaggctggagtgcagcggcatgatctcggctcactgcaagccccactcccaggttcacgccattctcctgtctcagcctcccgagtagctgggactatatgcgccctccaccatggccggcttattttttgtatttttagtagagacagggtttcactgtgttagccaggatggtctccatctcctgacctcgtgatccgccagccggggcctggcaaagtgctgggattacaggcatgagccaccgtgcctgacctattctacacttcttttccttggcctttttctcttcttccattttcttcctttttttttttttttttttttaaacacaggggatttcttttaatctcggggaattttcctggggggaaaaaaaggcttaataagtaattatctaaagggaatttgaccaattgagatttagaggggagagatatggcctcggtgt

SEQ ID NO: 488162 - DNA, 386 bp, Homo sapiens
ggcagtaggggagagagcagttaaagcacacagagcaccagcgttctcctgcctgaagatgtgtccaccaaatttgggcagatctgctctactcttataggattatccttaactccatctaccagtggcctgagcacagtgaactgacaactctgggcgtggatgggaaggagttcccagaggtgcacttgggccagtggtactttatcgcaagggcagcttccaccaaggaggagttggcaacttttgaccctgtggacacacattgtcttcaatatggctggtggctctgtcccgatgcagatccaccttcgtgctaccatacgcatgagatgggctctgtgtgccccggtggatctaccacctggctggagggagcacagtct

SEQ ID NO: 488163 - DNA, 302 bp, Homo sapiens
  misc_feature (203)..(203): n is a, c, g, or t
  misc_feature (238)..(238): n is a, c, g, or t
gtcgacctttacaacccaaaatggagcggaaactgttctttctctagtttaagtcccgaaaaaacggcgtccttttattttttgctttcttatgcgttttttggctggggtcattctcagtctttcccgtatcagttcttttaatctttgaggaactgggacccctgtatttaattggcctggtaggaagatgacacgagctntgtgggcttacatttggcctctgctgtaaaagctnttgttttctttggcctattaaagcgctggtggtaaaagcctgctgtgtatgttatgagtcgacg

SEQ ID NO: 488164 - DNA, 240 bp, Homo sapiens
gatcccccggttgtcagtgacgcgttgtcagtggactggaacacgacttggtctattcagccatgacaattctgtccctgctgtcttagctttgtttgcagctagaggtgcactggtagctggctcgggcaaagtgcatctaagtaaagctctgcagcgggagagagcaggaaacagacttctgacgagttttcactttctgatagaaggtgccgggtccagcttagtttgggcccattc

SEQ ID NO: 488165 - DNA, 295 bp, Homo sapiens
tcgtcgcggactgactcttcgccagcctcgatcttcaacaggcgtgaatacgagaccacctaccatcagcagcatgatcgcgatgatgaccgcaaagctcgccaatatccgttggcgcaaggtccagttcttcacagtaattcctcgagggccattcaaatggaggggagtatagctgagcgggtgccatcattaatcaacgggttgtgggatctgggtcacgcgcaggggggaaagttttcttgggggggcatatccgttgctgcggtaacggctgctgacggttcgtcgacgc

SEQ ID NO: 488166 - DNA, 304 bp, Homo sapiens
tacgactagaggatcccgaagcatcctaaccaggtaggtggaggttgcagtgagccaagatcgggccactgcacacaagcttaggcaatagagcaagactccatctcaaaattatgaatacataagtaaacaaaatctgggtttcaggccaggtgtggtggtgcattcctgcactccctgcactttggaaggctgagctgggcagacagcttgacctcaggaattcccgactagcctgggcaacatggcgaaaccccatgtctacaaataatacaaaaaaattagctggttacgggactgctgt

SEQ ID NO: 488167 - DNA, 219 bp, Homo sapiens
agctcagttttgaagtgagggtatttaaagcttctctgcgggggctgccttttaaagggatgatagatcatttgaacccaatgccaatttttaaccagaaaatttaattggacctgaatcaccctttcagcctaggacgaagtttaggcccaagtcaaagtattaatgttcatgaaaattgtgtgctgaaccagtaaacgagtttcccttttgatggta

SEQ ID NO: 488168 - DNA, 398 bp, Homo sapiens
tacaaggcccgcggagactggtcttcactctcaatgcagccgccacatagatctcgtgccagctgtctgccacagacactggcatcccctgcacactctgccagtgttcagggcactcagcgccagtgttggtggcatgtgaggtgccctgcctagtgtgcttcccgcatgtgtgtgcagctaggtgcagcttataggtagaccatgggcttgcgtctcgtggctgctggcgctatgcatccactccgcagagcaactgtcctgcttgcagtgccccctgccctggtgcctgccatgcccagctggcccagcccaggagactgctgcagcagtgtgactggatgatggttccatgaggtggctacaagcccagggtccagtgtgggacggtgtggcat

SEQ ID NO: 488169 - DNA, 229 bp, Homo sapiens
gacatgtgtaggcaacccaccttctggaggacgggagatctctgggtaaaaagcatgtccccaggacagtagaggagaaagtccctgaagagactagctaccaaaaaggtctctccgtgacactattaagacaactgctcttgccatctgattgacacctattctccctctgagagggccccagctgcagagcacagcctgcggcacccctgagaactaatctgctgtc

SEQ ID NO: 488170 - DNA, 139 bp, Homo sapiens
tccaacatctcattgctctttccaatatctcataattccttccaagatctcatgtctccttccaacatctcatgcgcgccactaataaaattaattaaccactcattcatcgactaccccaccccatccaacattgggt

SEQ ID NO: 488171 - DNA, 741 bp, Homo sapiens
gcttgtatttagagcgcagcggctgacgggccggatcgccttcgaccgtcgcgcgcccggaaatcttcgtgcgcggcccgtctcgccccggctggcaagcagaccgtcggacaggggataatataagcacgcatggatgggcttctgtgagtatcactcgtatatactcgagtcaccgggtccacgcaagtcattcatgtgggtcaggaactggcaggtacctgaggggcctggcaagcgagagtaagaagaagaagatcaatggacaggaatagcggagtgaatccagaaacgaagacagagagacgcacgtgtcaagacaggcactagagaaacgagccgacacgtggaccctcgtataaccgtagtaacaggaaggtgcaggtacgaccctagagaaggaagccatgaggagacctgagagagtctagggaagaacacacaaactcgcgcggagagcgactggggacgaaaccgacaggtggaacccccaagtgtcaagaaaaagaagggaaagccctactatgaaacaattactaaagagaatcagctcctgacgaggacccacaatgaagggggcatccaaggagatcctttcgacaataagtagcttggttgatgaccgaataggtagccagagaatcgggaatctaggccagaatgtgagcaaactggcacacgggcactatgcatgcatggaagatgaagcagaaaagcaacgtacaaagtaatgaagaacaa

SEQ ID NO: 488172 - DNA, 1003 bp, Homo sapiens
  misc_feature (184)..(184): n is a, c, g, or t
gccggcatcaaaccccactgagtggatgccatcttctcgggaatcttaagtgcagcagaagaatggaccgccacatcgctctcgactggcattgaaatctgtgcaattgaagtaaataaggttccaatcatcagctccaaaagccccacagcactgccaatattcctgggtgaagtctatgagngcaaatcaatgtcatcccgatatgctctgatgttgttgtttataaagaaatacagctggtctttgatccagtctttgaaaacaaatgctagaactccggcagtgagctccaggaagaaaataattcccaggaacacagaaacaaacttgagaaggaaagtgttttcccgtagcgctccaatgcaccctgcaaatcccaaaatgaacatcactcctcccaccacaaggaagagccaaactgggtcaaagccgccgagatcggtgatggaagagatgttggacagaactcctttttcattccatgcccacagtccaattccaagaaatgttattcccaaaaaccaaaatatgacattgaagccaaatatgaagtatttgatgcaacaactgacttcaggacccttgtagtgcttcccggacatcctctgggttcatgaagacacttgccccggcagcccgagtttggagctccgaagcaccgttgctcggagcagcccggcggggagcaggagctcagggacaccgcacggggccgcggcgctggcggcctgggctcagccgcgcggggaccgaccggcggagagcggctcccgcacctccagcccctcgcgcgccgaggccgccggagccggggtggccgcgagaaagcagggaagccgcgcgctgcaagctcaagcctcgccgacgctagccccgaacacaaagcgagcgcccgcgtccgtgcgccaggcggtcggtccgtcggttcgtccccgggcttcgggcaaaggcggccgcggcagatgctggtggagacgccgctcgcttgctcgcccccgct

SEQ ID NO: 488173 - DNA, 242 bp, Homo sapiens
cgaatctcgacacgtgtgccacatcatcaccagtccacttcagaactttatatcatctcaaatagaaactatgccatgacagagtatctacccccttcgtcctatttcctggtccctgtgacctctattctgctttctgtctatatggatatgcctatttggatatacatattaatagaatcaacagtgggtcactctttgtgtacagcttataacagttggcataatgttgtcaaggttca

SEQ ID NO: 488174 - DNA, 828 bp, Homo sapiens
  misc_feature (184)..(184): n is a, c, g, or t
gccggcatcaaaccccactgagtggatgccatcttctcgggaatcttaagtgcagcagaagaatggaccgccacatcgctctcgactggcattgaaatctgtgcaattgaagtaaataaggttccaatcatcagctccaaaagccccacagcactgccaatattcctgggtgaagtctatgagngcaaatcaatgtcatcccgatatgctctgatgttgttgtttataaagaaatacagctggtctttgatccagtctttgaaaacaaatgctagaactccggcagtgagctccaggaagaaaataattcccaggaacacagaaacaaacttgagaaggaaagtgttttcccgtagcgctccaatgcaccctgcaaatcccaaaatgaacatcactcctcccaccacaaggaagagccaaactgggtcaaagccgccgagatcggtgatggaagagatgttggacagaactcctttttcattccatgcccacagtccaattccaagaaatgttattcccaaaaaccaaaatatgacattgaagccaaatatgaagtatttgatgcaacaactgacttcaggacccttgtagtgcttcccggacatcctctgggttcatgaagacacttgccccggcagcgggtggccgcgagaaagcagggaagccgcgcgctgcaagctcaagcctcgccgacgctagccccgaacacaaagcgagcgcccgcgtccgtgcgccaggcggtcggtccgtcggttcgtccccgggcttcgggcaaaggcggccgcggcagatgctggtggagacgccgctcgcttgctcgcccccgct

SEQ ID NO: 488175 - DNA, 1060 bp, Homo sapiens
  misc_feature (184)..(184): n is a, c, g, or t
gccggcatcaaaccccactgagtggatgccatcttctcgggaatcttaagtgcagcagaagaatggaccgccacatcgctctcgactggcattgaaatctgtgcaattgaagtaaataaggttccaatcatcagctccaaaagccccacagcactgccaatattcctgggtgaagtctatgagngcaaatcaatgtcatcccgatatgctctgatgttgttgtttataaagaaatacagctggtctttgatccagtctttgaaaacaaatgctagaactccggcagtgagctccaggaagaaaataattcccaggaacacagaaaatacttatctcataccttctgttcgaagattattccaggcaagtttttattgtttgtcaaacttgagaaggaaagtgttttcccgtagcgctccaatgcaccctgcaaatcccaaaatgaacatcactcctcccaccacaaggaagagccaaactgggtcaaagccgccgagatcggtgatggaagagatgttggacagaactcctttttcattccatgcccacagtccaattccaagaaatgttattcccaaaaaccaaaatatgacattgaagccaaatatgaagtatttgatgcaacaactgacttcaggacccttgtagtgcttcccggacatcctctgggttcatgaagacacttgccccggcagcccgagtttggagctccgaagcaccgttgctcggagcagcccggcggggagcaggagctcagggacaccgcacggggccgcggcgctggcggcctgggctcagccgcgcggggaccgaccggcggagagcggctcccgcacctccagcccctcgcgcgccgaggccgccggagccggggtggccgcgagaaagcagggaagccgcgcgctgcaagctcaagcctcgccgacgctagccccgaacacaaagcgagcgcccgcgtccgtgcgccaggcggtcggtccgtcggttcgtccccgggcttcgggcaaaggcggccgcggcagatgctggtggagacgccgctcgcttgctcgcccccgct

SEQ ID NO: 488176 - DNA, 104 bp, Homo sapiens
tctaatgatgtattggggggtccagttcctctacctctttgtgactctagccatcccaccaggtgttatgtggtcatctgatttatttattttattttctattt

SEQ ID NO: 488177 - DNA, 446 bp, Homo sapiens
ggcataagcccggcgagcatgttcgtcaatgcacgagcgtatacagtagtatggttaagaggtagtgcgcgctgtcggtaatctcagtgctcatgccagactcatgtcccagccgtgacttatcagctagacctgcgcgctcagtgatttcccaggtcttgccatccagtggcacagataccgtgatgagcgtgctggagatcagggcttacctgttcaaccatgcatttatgagagctgtcgctcaacgtctggcagggtaccgtcgcctgacctctcaggcatgctatggcggcaggtctgcctgccagcgtcacatctgttgggactcgggtcccgagctcagcaggccagtgccttggtgagctctgggtaaacgcggatcgtcggccatcatcccatccagtgcttcctggctatccagtggctcatacacatcttaggag

SEQ ID NO: 488178 - DNA, 968 bp, Homo sapiens
  misc_feature (4)..(4): n is a, c, g, or t
  misc_feature (26)..(26): n is a, c, g, or t
taanccctaaagataccttagggaanggaaacccaatctgtgatataatatgccacaaaaccctcccatggatggcatggtggggtggtgggggtggtgttgtaccttattaaggaggcacaactgggaatcagggctagagagctctctcaaaagaaaataatgaccctgggccctactttggccagtgccctttggtacagctcactgtcttgcctgtagatagggtgacctcctgatggaaggtaaagttttggctctcaatctgagagtagagagtgtaatacttacaaacttgagaaggaaagtgttttcccgtagcgctccaatgcaccctgcaaatcccaaaatgaacatcactcctcccaccacaaggaagagccaaactgggtcaaagccgccgagatcggtgatggaagagatgttggacagaactcctttttcattccatgcccacagtccaattccaagaaatgttattcccaaaaaccaaaatatgacattgaagccaaatatgaagtatttgatgcaacaactgacttcaggacccttgtagtgcttcccggacatcctctgggttcatgaagacacttgccccggcagcccgagtttggagctccgaagcaccgttgctcggagcagcccggcggggagcaggagctcagggacaccgcacggggccgcggcgctggcggcctgggctcagccgcgcggggaccgaccggcggagagcggctcccgcacctccagcccctcgcgcgccgaggccgccggagccggggtggccgcgagaaagcagggaagccgcgcgctgcaagctcaagcctcgccgacgctagccccgaacacaaagcgagcgcccgcgtccgtgcgccaggcggtcggtccgtcggttcgtccccgggcttcgggcaaaggcggccgcggcagatgctggtggagacgccgctcgcttgctcgcccccgct

SEQ ID NO: 488179 - DNA, 206 bp, Homo sapiens
tcatcagtatcagagcttcggagagatcccagacatgctcatgaagaccgaggagcatgtggcccctgtagcaagactgagagttacctgtacagcatcaaagctgcaatcaccaacaaaatcagacagaatactgaggagtccaacaatggcgtcgctcatatgaagtccttcccctggagcagcagggaaagacaggggagggt

SEQ ID NO: 488180 - DNA, 901 bp, Homo sapiens
  misc_feature (184)..(184): n is a, c, g, or t
gccggcatcaaaccccactgagtggatgccatcttctcgggaatcttaagtgcagcagaagaatggaccgccacatcgctctcgactggcattgaaatctgtgcaattgaagtaaataaggttccaatcatcagctccaaaagccccacagcactgccaatattcctgggtgaagtctatgagngcaaatcaatgtcatcccgatatgctctgatgttgttgtttataaagaaatacagctggtctttgatccagtctttgaaaacaaatgctagaactccggcagtgagctccaggaagaaaataattcccaggaacacagaaacaaacttgagaaggaaagtgttttcccgtagcgctccaatgcaccctgcaaatcccaaaatgaacatcactcctcccaccacaaggaagagccaaactgggtcaaagccgccgagatcggtgatggaagagatgttggacagaactcctttttcattccatgcccacagtccaattccaagaaatgttattcccaaaaaccaaaatatgacattgaagccaaatatgaagtatttgatgcaacaactgacttcaggacccttgtagtgcttcccggacatcctctgggttcatgaagacacttgccccggcagcccgagtttggagctccgaagcaccgttgctcggagcagcccggcggggagcaggagctcagggacaccgcacggggtggccgcgagaaagcagggaagccgcgcgctgcaagctcaagcctcgccgacgctagccccgaacacaaagcgagcgcccgcgtccgtgcgccaggcggtcggtccgtcggttcgtccccgggcttcgggcaaaggcggccgcggcagatgctggtggagacgccgctcgcttgctcgcccccgct

SEQ ID NO: 488181 - DNA, 1025 bp, Homo sapiens
  misc_feature (4)..(4): n is a, c, g, or t
  misc_feature (26)..(26): n is a, c, g, or t
taanccctaaagataccttagggaanggaaacccaatctgtgatataatatgccacaaaaccctcccatggatggcatggtggggtggtgggggtggtgttgtaccttattaaggaggcacaactgggaatcagggctagagagctctctcaaaagaaaataatgaccctgggccctactttggccagtgccctttggtacagctcactgtcttgcctgtagatagggtgacctcctgatggaaggtaaagttttggctctcaatctgagagtagagagtgtaatacttacaaacttgagaaggaaagtgttttcccgtagcgctccaatgcaccctgcaaatcccaaaatgaacatcactcctcccaccacaaggaagagccaaactgggtcaaagccgccgagatcggtgatggaagagatgttggacagaactcctttttcattccatgcccacagtccaattccaagaaatgttattcccgaaaatgcaacttttgaaggacatgtctagatacagtggacccgaaatgttaacagcaaaaaccaaaatatgacattgaagccaaatatgaagtatttgatgcaacaactgacttcaggacccttgtagtgcttcccggacatcctctgggttcatgaagacacttgccccggcagcccgagtttggagctccgaagcaccgttgctcggagcagcccggcggggagcaggagctcagggacaccgcacggggccgcggcgctggcggcctgggctcagccgcgcggggaccgaccggcggagagcggctcccgcacctccagcccctcgcgcgccgaggccgccggagccggggtggccgcgagaaagcagggaagccgcgcgctgcaagctcaagcctcgccgacgctagccccgaacacaaagcgagcgcccgcgtccgtgcgccaggcggtcggtccgtcggttcgtccccgggcttcgggcaaaggcggccgcggcagatgctggtggagacgccgctcgcttgctcgcccccgct

SEQ ID NO: 488182 - DNA, 614 bp, Homo sapiens
  misc_feature (4)..(4): n is a, c, g, or t
  misc_feature (26)..(26): n is a, c, g, or t
taanccctaaagataccttagggaanggaaacccaatctgtgatataatatgccacaaaaccctcccatggatggcatggtggggtggtgggggtggtgttgtaccttattaaggaggcacaactgggaatcagggctagagagctctctcaaaagaaaataatgaccctgggccctactttggccagtgccctttggtacagctcactgtcttgcctgtagatagggtgacctcctgatggaaggtaaagttttggctctcaatctgagagtagagagtgtaatacttacaaacttgagaaggaaagtgttttcccgtagcgctccaatgcaccctgcaaatcccaaaatgaacatcactcctcccaccacaaggaagagccaaactgggtcaaagccgccgagatcggtgatggaagagatgttggacagaactcctttttcattccatgcccacagtccaattccaagaaatgttattcccaaaaaagggagcgctttccagctgaagaggagagcgtgcaggaaacgttatttacgtgcaattacaggaccatataccacggcatctgcatcctacacaaagcccgagatggtgctcactgacagaatta

SEQ ID NO: 488183 - DNA, 176 bp, Homo sapiens
acaagagacagctgtaaactaccatagaagctatccatggattgatgtctcaggttattaaaggataaacctggttaatccaaatttaacatcttctttaaacagtctcttgagaagtacttttacctgaaaggacaggtatggagaaaaaatattcaatgttaacaactttaaaa

SEQ ID NO: 488184 - DNA, 337 bp, Homo sapiens
atagtcaagcctgtattagcaaaggctacaatgaggataaatccagtcagtcaccattgtcaaaggaaaataaatttgacaaagtagcctcacagcaaagatttgaaaggatggcttaaaaaatccaataatgatacaaaaagttacacaggcgtggtggcacatgcctgtgatccaagctactggggaggctgaggcaggagaattgcttgaacctgggaggcaaaggttgcagtgagctgagatcatgccattgcactccagcctgggcaacaagagcaaaaaactctgtctcaaaaaaaagttgaaggttgacaagtttaacatgtttcatgtc

SEQ ID NO: 488185 - DNA, 413 bp, Homo sapiens
gggctcggctattattatatcactgattattattattatccatgctggggtatagagtgtcaggacagagccctttcctctgaatgctttgtaaacatcagatccgtcttctttatatttatttatttatattatttatttttgagatggaattgcgctctgtctcccagctggagtacagtgtattttgagtagagacagggtttaaccatgttggtcgggctggtcttgaactcttgacctcaaatgatccgactgtctcggccttccaaagtgctgggattacaggcgtgagccaacgagtctggacattatatcatctttaaacacggctttcactgtgttattacacttctcagaaattgttacgcttccccgtcaattacaaatgtcatatcttatttgtcacctat

SEQ ID NO: 488186 - DNA, 110 bp, Homo sapiens
ccggacccaccccgggttgctccttttgggtctacctggacgtctgactgggggactcctctacgacgtcgacgctgcacggcctgaacggcttggacctggcctgtcgt

SEQ ID NO: 488187 - DNA, 401 bp, Homo sapiens
accagagatcaactggccccgatgggatggcaggcccgagagtgccgtcactccgcatgacgtagagcatgcgaagtgaggattgtagacaggcttgtgatgacatgaacctctcggagttccctttctccggtggcatctacgcgctatggtttctggggaagccctgctgccgatcgcagacaggcgagccaattctgaccgttgtaatcaaggcgttcagtgactgtgagttgctcaagcccaattctgggactgggaaagacggccatatttggcatatcgattctgcagcacggattgacattagatcgtaaagagcctagcccaggcctctggggcctaggctatcgccagagtcgagcaattgggctcaggcgagatacagagaggtggtcatg

SEQ ID NO: 488188 - DNA, 321 bp, Homo sapiens
  misc_feature (49)..(49): n is a, c, g, or t
  misc_feature (198)..(198): n is a, c, g, or t
ggacccggggaaaaaaattaaagaaccagccccctcgggttggagttcnggggggctttttttctttataaaaagccccccgggggcaaaaaaaggggggcgcagggggaagtttttttattctccctgaaggatgagggtttggccaaccccttcccccaaaaaagcctttcccttttcccggggtaattaattggnggggggggaaaccccccctccccggggtttttgggttgcccgaggatttttgggggggaccccgttttaatattttcccgggcccccggatgggaataaaggccccccccctgccctggggga

SEQ ID NO: 488189 - DNA, 163 bp, Homo sapiens
ggtgttcaggaggaggtcccttcccctctgagatcacacctggtggaaatggggtctgcctgattgctgttccctctgcgccctgcacaggtcctgggatgtcatggcgtaggtcacaggagacatttgctggctgatagatcaattaactacatcaagtgaa

SEQ ID NO: 488190 - DNA, 262 bp, Homo sapiens
aaggcgggcagtgagagagagacagagagagagagacagagacggagacagagagaaggagacagacagacagggaaagagacagacagagaaagacagagacagacagagggagaaagagaaacaggcagagagagagagagagagagagagagagagagggcgagagagaaacagaaagggagcactgggagaagaagggaccccaggtcagagagtggagccagtacttcgagatcatcgaggacctgagggctcagat

SEQ ID NO: 488191 - DNA, 370 bp, Homo sapiens
cacggtggcgggtgcctgtactcccagctacttgggaggctgaggtaggagaatggcatgaacctgggaggtggagcttgcagtgagcagagatcgcgccactgcactccagcctgggcgacagagtaagactccgtctcaaaaaaaaaaaaaaatacagttagccgggcgtggtggcacacacctgtagtcccagctacttgggaggctgaggcaggagaatcgcttgaacctgggaggcagaggttgcagtgagccaagattacaccactgcactccagcctgggtgacagagcgagactccgtctcaatgcactctattatgtgccaagcaataggactcagataccaaggagtgagacagtcactc

SEQ ID NO: 488192 - DNA, 249 bp, Homo sapiens
acctaggtcgcagtgtacaattggtgtgcgtatatggaactttacctgcaccttctcctggcagtatggttcaagtttaggtgtctggtcagctcattctcaccaatcctctccgtgacctcctcgggcacctaccgctgtgttgccactacccaaatgggccgtgcatcctgttatctgaccctctcggttaccgaaccctcccaaggtcgagtggccggagtctctgattggggtgctcctggtgcg

SEQ ID NO: 488193 - DNA, 146 bp, Homo sapiens
agagtgtgagattctgagcaaatgagggcaggtttgtaaagccctcggtaccggggagcagtcagacaacacaaggcggcggttattagagtagatccaggaggttgagttcagcccaatgtggactccgtccaagtgtggcgttg

SEQ ID NO: 488194 - DNA, 707 bp, Homo sapiens
  misc_feature (279)..(279): n is a, c, g, or t
ctcatccatgcttggagaaaggacaatgtccttcggagcccaaccaaccggctgcttctccttccagagccacgggtccaagggtggcctggcgttggcttcaggaatccaactatcaggcctacctcctgatgcttgggtgtgcttccctccccgtgcccgggggggtgcccatgcgtgggaaactgtgaagtgtgacggacctgcaccctgggggcactgccacctttccagctgttgcattctgtggctaccagctgcagggagaggagaccctcnatctggcgctcaaaattggggcgcaaccacacctaggtggcccaatgtccccccggtgtgtgcaacaacctggttgttcgaaaaaataaactccccccacgcgaaaggccttattggcccacttttgtggccacatttcacaatttggaattgtgatgtgggccaacccataatttccccaatcaacatattgcggctaatgcgccccttggtggtggtccccttggctaatctttctcgacttggtttcactctcgatgtggaatatggcgcctattggtggcgtggcggactggcccttggataacgtggggggctccacaattaggcccttttcgaccctttggtccccgtgattctcgcgggggtccaacttttggacaaccggccaatagccttagaccaggcggtgcctgccctgggctttg

SEQ ID NO: 488195 - DNA, 208 bp, Homo sapiens
ctttccggtatctatttttgccatacatattgctgtgttgcaaagtttgtataagacacacataccactactgagttataaagaattcaatcataaaggtcaaaatatattcacataatatggtttagtggattcattcacatttattaattcacagggcaccacattttaattaaattgggtaaggtatatatgcaaaaaaaaaaaa

SEQ ID NO: 488196 - DNA, 534 bp, Homo sapiens
  misc_feature (54)..(54): n is a, c, g, or t
  misc_feature (454)..(454): n is a, c, g, or t
acgcagtaaggagaagattgggactgttgactcccgcaggctcagtgcactgtngtctggtcctctgtgggcggacgggcaggaggcagtggttgctgggtgtactcagtgtgttggactgtatggaggagttggggagctaatgggtcataagtgtttgcatttctatcttttctgcaaatgaacaggccaaggtcctccaagagggagtgagcgggaataaggggctcagtggaaagcagttcagtggaggggcggtcctgtgagtgtgcaggaaagggagcagctcgggggcacagcaggattggcctagtgagcttgagccattagcctccgagtgctgttccccagcatcttgggaacatgcgtggagaggcggaaacagtgtctgttccacaacaggtgtttccaacctgtagatcataaacccctcacagcggcgcttgtctggggncagctcgtacccggtggtccagctgcacttgtagcttgcccatggtgttaatgcaccgctgctcacagtccccggccgtg

SEQ ID NO: 488197 - DNA, 400 bp, Homo sapiens
  misc_feature (30)..(30): n is a, c, g, or t
  misc_feature (72)..(72): n is a, c, g, or t
cagataactgaagtggagtgatggactccngattcggagagtagtaagacgtgaaaggaatacacttgctcnaagcaccatgaactccatgttcactgttggggagaagaaacaagaaaagtaactggctgtcacctatgagacccttacgtgattgttagttaagcttttattcaaagcaccctgcaattcacgacaataacacaattactgacccaaaaaaatcgttttaatggcctcaactgccctcaaccgacagaatccgacgttcttttttttctccgcgaggagaacatccatgaaccacccacaccgactcccccccaccacacccatcgccctagcgcccccccaacaaccccgccccccgctacatcccaaacactccccacaagaatac

SEQ ID NO: 488198 - DNA, 419 bp, Homo sapiens
  misc_feature (139)..(139): n is a, c, g, or t
attgtctgagggacagtgcggcatgccatgctacgcctactttggcctacttaaatctgtggtgtgaacgggtgcagaaacatgttatggttcatgcatcagtgtgagctgtggagcacagtcgtggggcatattgcanagctcaagggctgcaaagttgttggagcagtacggtctgatgaaaaggttgcctaccttcaaaagcttggatttgatttcttcttaatttatgcagagggtgagtcttaggaagaaaccttgaagaaagccgtctcctgatggttatgattgtaatagggataatgtaggtggagagtttcaaacactgttatcggccaggatgaagaaatttggaaggattgccatatgtggagccatctctacatataacagaaccggcccacttcccccaggcccaa

SEQ ID NO: 488199 - DNA, 326 bp, Homo sapiens
  misc_feature (176)..(176): n is a, c, g, or t
  misc_feature (198)..(198): n is a, c, g, or t
  misc_feature (202)..(202): n is a, c, g, or t
  misc_feature (206)..(206): n is a, c, g, or t
atgtaaaatttgtaaagtataaagtatataaagtagatctaaatcagacattcaatattttgttgaagctattgactgtcaattaaacattttcaaaaagtgtaatttattaaaatgtctcttttggtaaaattatgtgacttttaaagctaaaaataaacttaataagcttagtnaaaaaaaaacaaaaaaactttnaagnagtnatttttttaaaacatgggctggctttgtttaaagatgcaagtgttacatatggctttgtacattaaagttgaaaggggttttacattttccattaaaaggactttatcaaaaaatgaaaa

SEQ ID NO: 488200 - DNA, 496 bp, Homo sapiens
aggagaggagagcataacacctgccgcaagatggatgtgggcagcaaagaggtcctgatggagaggcccgcggaactactccgcagctccccggggccgatattggcataccctgacatgaaccagtgaccacctgaaaacgcacttcttatcgattgggtggtggtggatggtcctcatcgatcgtggtgattgtgggagccctgacctcatgggtctccacatgagccagaaacaacaccgcgcagaactggggaaccagggagactgaagccatcaggggggagcccgggcaggcccacagcaaaagcgccagggcacgcgagatagagcagcacatggagtacacacacggcaaacagtatacagatagagctcacagagagcataagcgggctgctgatgaaataacgcagaacgcgtgcatgcatcggaccaacgcaacaagccccgagacacctgccagaccacaccaagcaaatagtccaaaaacatc

SEQ ID NO: 488201 - DNA, 1159 bp, Homo sapiens
  misc_feature (1125)..(1125): n is a, c, g, or t
gcgcggcgggtcgccgcgccggcgtgtgtcttgttctgttgttgctgggccccctattcgttgctcggattctctgtgtggtcttcccttggtcttcgtgcctgaatgttctgtcgagtgccctccttgcttgtgtcgtttccgcttcggaagctccgggtgtgccaacgggttcttctgccggtgtctcctacggacctctcttgtgtgcactcttcggcgtgctccggggtctggactctttcttcgcggcggtgctggcagtactcgtggcactcatacgcgatgtttctggtgtgtgtgtgcgacacgcggctctcgctggtcaccaggtggggtctccggctgctgcgccatcaaccaggtcgctgtcatgttcgcctgtctgaggagatagacccgctggcgcgggttcatcttgcctcgcagggcactagggctcctcggtgcgggcgctcaaccagcagcggacgttctttgcgacgctacgagggtgcttgcttcgcgctcaaagagcaacgcatctccagaagcccttatagacaggggggctgcagctgcgtccggcgacgagctccagatgagtgcagaagggaccagacgcggcggtctatcctcgcgagacagtagccagagacgttgtatcctgcgggctgagccaccatcgtagatacgctggtgagacgggaggatcgtcgcaccctgaaggaggcacacgcgtcttggcgatcgtccgccgctcctacgcgagaagggtcgtccgagcgctgcaacagcctcgtttgaggtagaggtcgcgcccaggtgcatgactcctttcagctgctgggtaggagacacagccgccctaccactccctctctggaatggtaagataataaagtcacgctttctccccaccctcctgtgggccacacgagcacttgctacaacaccacacacacacacacacacacacacacacagacacacagacacatacgcacacacgtgcacacatgtacaacacggatacacacacatacacacacacacacactgcatatctgagcgcgcccctcgcactgggtctcacctgcaccttcttcaggattttatatgtgaagagatttttatatagccttnggtcctttttcaactttccttctttcctcgcact

SEQ ID NO: 488202 - DNA, 131 bp, Homo sapiens
gagagaagagaaggagggaaggatttaggatggtaaaagttaaggtacaagagacctccctgttcaaggcccctgacaagctgtccctgcccttacttccccttccctgctgcaggggttattgtggaagt

SEQ ID NO: 488203 - DNA, 252 bp, Homo sapiens
ctcagtaccgaggcacttcgccaagcctgacattacgcacttcccgttgtggtatccgggctgaggcgctggccacagcagaccatctatgtacggacttagtgaggaagaatggcatagagcagcggtcctctcaagagatgtgcaaagtcacattttcataataatcctaaaacctcatttgtcttcctcgctgattgtctcttttttttccagtgtagctttggcagatctggacttctaatttggaag

SEQ ID NO: 488204 - DNA, 194 bp, Homo sapiens
acattgatggctgctgactgcttagggtggtggttgctgaaggttgggtgacagtggtaattcagtgattttggttttgtttggtttctttaagagacaggatctcattctgtcactcagggtggagtgcagtggtacgatcatagttcactgcagccttgatttcccgggctcaagcaatccttctgcctcag

SEQ ID NO: 488205 - DNA, 519 bp, Homo sapiens
  misc_feature (514)..(514): n is a, c, g, or t
tgaggctacttagaggacccgcaggtggtggtgggtagctttcaatagatgtcaactcaacagaaaccacggcagaaacaggtccagttcactggcagcaatcagaggggagcagggtctcctccttgcaacttttcttcccattaggaaaataatttccagtccaagcaaggcagtctcagctcctgggccgcccatgagcccagcctgctgtttgaggcttctgatcacctacaatgcggtcttcagtttatctggctcgctacgggcagcaccctctctaccacttacctctaaaaacaccctggggccagacgtgttaaccccattcaatgaccacccagacagcaaacgttaaaatgtggctttggagagcacagccggtggcccccccgggggtgcagggggaggatggacatggcagtcaagctgccggactgggcaaatctccacccactgcacacccgtttccttagctgctgccctgcaaggaacgtgtccccctaaccacaancactg

SEQ ID NO: 488206 - DNA, 407 bp, Homo sapiens
aaaacagaaaatgtggtacatatacacaactgattactatgcagccataaaaatcaacaaaatcatttcctctgcaggtgtccatcaatggcagactgaaaaagaaaatgtggtacatatatgccatggtacactatgcagccacatatataagaatgaaatcatgtcctttgcagtaacctggatgcagctggaggccattatcctaagtgaactaacacagaaacagaaaacaaaatactgcatgttctcactttaaaatgggagcaaaacattaggtcatccatggacataaagcatgagaacaatagacactgtggactactagagagaggcaaaagcaagtggggcaaggcactaaacagctacctcattgggtactctgctcacagcaggtagacaggtgc

SEQ ID NO: 488207 - DNA, 478 bp, Homo sapiens
tccaagagagtgccaccccatccgtggggccatcattctggccaagctttccattgtccccgtgggcaaagggtaatgggggaacaagatcggccagcccccccctgtccccttcaaggggacaggccccttcgggtttgtgttggtacccctcatccctgcccccaggggccctgggattgtttccgcccctgtgcctaaaaaactggtcatgatgggtgggatcgatgactggttcccctcaggccgggggtgccctgcccccctggggaaatttgcccaggccaccttttattgccttttttaaggcctacaggtacctggcccccggcctctggaaggaggctggtttcccccagtttccccatccgggggtccctggccccctcgtccagacccccccccaagtttccgtgcagcgggctccgggtccccctgggggtcccacataggggtttttttccaaaaaaataaagtg

SEQ ID NO: 488208 - DNA, 602 bp, Homo sapiens
  misc_feature (98)..(98): n is a, c, g, or t
  misc_feature (104)..(104): n is a, c, g, or t
  misc_feature (107)..(107): n is a, c, g, or t
  misc_feature (142)..(144): n is a, c, g, or t
  misc_feature (155)..(155): n is a, c, g, or t
  misc_feature (158)..(158): n is a, c, g, or t
  misc_feature (176)..(176): n is a, c, g, or t
  misc_feature (180)..(180): n is a, c, g, or t
  misc_feature (215)..(215): n is a, c, g, or t
  misc_feature (273)..(273): n is a, c, g, or t
tggcattaaccacagttttttaattggggccctcacccttctggggtgaggccttgttttaagccctgacatgtgcttgggcactggggggcctgggnttttanggnggcctccgccctgatcagggaccctccccgctttnnngggcctttcgntgnacaaagcagcaaaacaanggcngttttatatgaaagattagaagcctggaataatcnggctttttaaatgatgtaattccccctgtaaaagcatagggattttggaaccagctgntggtggcttgggacatcagtggggccaagggttttttgtccctggttcaactgtgatttggctttcccgtgtttttcctggtaaacccttgtttggggttttgtgggtttgggtgggaaaagggccatttgcctgaatgtaacctgctagctttccaaaggccctgcgggcctggtttgtgtaagggtgtggacaatggtggccgccctgtgcctgcttgtgttgccaaaatgtccctgggtgttgagggggtgtttcagcctgcccccctcccttgttttataaaggctccttttgcccttttcaaataaaaatggagggcaagctca

SEQ ID NO: 488209 - DNA, 179 bp, Homo sapiens
cacttaatacattaactacaaagatactttcatcattagctaatgaaccaaatacaaagctaactccctccttagcataatctataaccgattgtactcccagagcaaccttgcttaaaacgtacttaccaacgctccactttaaaacagctaatgcaaagccaaattgaattaaaaat

SEQ ID NO: 488210 - DNA, 372 bp, Homo sapiens
tcaggtcataccgtgtcagaacctgtgtgggaatgtaaaaggtgagtataaaacctaaagcaaggagcccagacgcctggctttctgcagccagatcgtagttacatctgacgtcggtccgattaagctatctgacttttgcagagaacattcacaggaaagacacattcacaggtgaagacacattccctttcccaggaatgtgccgccgcccgatttttaagttagaagactctaagggaagtccggaccgctgcctactttccgagtggggctcacaagcggaatagagtcgggggcacacgcagagtggagctggctctgccacctaatttttagaggtggaggaagatattagaaacaaggccaggg

SEQ ID NO: 488211 - DNA, 894 bp, Homo sapiens
gaggagatatccatcaatagtcaaggtgaatatgaagaagcacttaagatggctaacattaagcaaggaaatcagctacagatgcaagtccacgaagggtaccatgttgtagatgaagcactccccaaaaatgtggtagaaaaccaagcggctgccaggacagggaagaagccacttgcacattattcttcactggtgagagtcttgggatcagacatgaagaccacagaggagcctgcaccagagcaatgttcttctgctccttgtgacacagaccagcctcaagacaagcccccagattggtttacaagctacctggagatgttccgagaacaagtggttaaggaaacggtggagaaacttgaacagaggttgcaggagaagcttgtcctccagaagccactcctgagttcctcacccacagaagtctcaatgcctatttcagaggaaaccctgtttttgccagagaaccagttcagctggcatattgcttgtagccactgccagaagaggatcgttggagtgcgctaccagtgtagcctatgcccatcctacaacatttgtgaagattgtgaagctggaccatacacccatgacactaaccatgtttgttacagctgcggagacctgtgtgatatcctctgaggccatttttcttactccaagtattccgctccctcgtctgctgtgctttggaaccaagtcaggctccaagaaacaggtggaccagaaccctggtggaagccgaaaaggcaggttgcgggtgagaacaaccgggaaggccagtccagaacttaaacccgtttaactccacaggaatcttgggaatcaacaggataatccaatcctgggcacgaaattgtgataaccgtgttttggacgtccttgcctcgc

SEQ ID NO: 488212 - DNA, 386 bp, Homo sapiens
agcgtcacttctcctgctgctcctgtttgtccgatgtgcacaaggccctctggaggcctggtggccacgaggtcaaagaagctgcatgttaagtgccactactcctgtacacgcaccatcgcctctgtctcctccgtgtctcgcgcgactgagaaccgtgccatcagcgcagtgtttcgcccttcctaggttcaaaagaagccgtagtctcatcaggcatcccataccttgtttttaatctcctgtttgctgagtgcactgactgtgacaccttcaccttttttgttgttcttgccaagctgcaggtttctaatgcacaaggctgattactgaaatttaagaaaaaggttcttttttcaataaatgctttattttaggaaagctca

SEQ ID NO: 488213 - DNA, 200 bp, Homo sapiens
tcgaagatggccggttgggtggtgtagggggtggtgatcatggcagcaggcctgctggaagactgggaggggcaccgttcctgccctcaccgccgccacctccggctaccactgagtgtcgcttgtgtgtggccctcgctcacccatgggggggcatctactccggcaagtcttcgaagcacggtcggcaatttggcctg

SEQ ID NO: 488214 - DNA, 413 bp, Homo sapiens
ctcgtgatccacccgccttggccttccaaagtgctgggattacaggtgtgagccaccacgccccacctattaatttatttattttgagacagagtctcactccatcatccgggctggagcgcaatagtgtgatctcgacttattgcaacctctgcctcccgggttcaagtgattcttctgcctcagtctcccaagtagctgggattacaggtgcccgcctccatgcccagctaattttttgtatttttagtagagacagagtttctccgtgttggttatgctggtcttgaactcccgacctcaggtgatccgccagcctcggcttcccaaagtgctggggttacaggcatgagccaccgcgcccggcctctcatattctttttatagtaggttgttgtgttggacttagttga

SEQ ID NO: 488215 - DNA, 137 bp, Homo sapiens
gggatgcatttctgtatacctgatctagtgtactggttgcataggtgagttctgtttgtgaaaatccatcaagcagcacacttaggatagatgctctttaatgcatgaaggttatactccaattccttaaaatgttc

SEQ ID NO: 488216 - DNA, 816 bp, Homo sapiens
acgacccaccgacggacgctgtactttcctcgaagacccctggagaggttcatcacggtatctatcctgcagatggcctcattagttctaagatgatgacttcgcaagattcgtgtacggtccccagccaagaattgagtgcgtaagagccaatacggtgacgactatgcctattaatagtagtgctaatgcactcagggagttttgacaatagtgactgaaggtgtgcggaacgtgaatgagtcacgtacgctgtccgtcagagatgcgctcgactgtgactagcgaagaatgcagcttaggcctagagtccaatgtatcgcagtgcttgaggcctggcaaatacgctgtaaacaccgataagactgcttaattagtcagtgggacatctgctattggttaaggtgccatgtgggtcgaatttctgtgggttccgtactattatcttcacatgagagttggaccacacatccaagtagaaattagaccaatagacaggggtatcacatgtttagtgcaatgtagtatgaagtgtaccaaaaagagttacctccttgggtctacgttatcaaatccttaccttccttatgtacgcagtcacattacaatcgccttccgaatagcaggtgtagcatggggggcatcatcaagtggaaacctggtaacagccaaattgttggttgcgtcgaattgcgttccccaagtagtgggaaaaaatggtcacgcggcactgtggagaaattcaccccggaagaagatcccactacggtgaatgggacgtgcataatgaaccacgtcggtcagtttcaaaagacg

SEQ ID NO: 488217 - DNA, 389 bp, Homo sapiens
caagcgataatgcggggggcggaaagtccctgggtgcctgccaggaacactcagctcataataacctcgcggaaaacaccgcggcctcggcctccagaaaccccgggcttgcgcaatcccctgcgggctgtgcctccctgggccccacgcagtgcactcaccagccctgggggttttccctctcttcccctcaggttcctgcacttggccatcatccatgaagagaaggcactgaccatggaagtggtccgccaagtgaagggagatctggcttttcttaacttccagaacaacctgcagcaggtgcgctgcttgcccgccccgtgcctcttgggttctgcctctctgaccccttgatggagctggatctagcacagttatttccaatg

SEQ ID NO: 488218 - DNA, 134 bp, Homo sapiens
atctgaggatcccttatggctcccaggtggtccagtgtgcagtggtctgaacttggcctgagggagaggatgggaaggcacaaagactggtgatcagaaagaccatgttagtggcctcccatggtcgctgggac

SEQ ID NO: 488219 - DNA, 840 bp, Homo sapiens
  misc_feature (840)..(840): n is a, c, g, or t
tacaggcggaactgccgggccatttttgtctatatggtgctctaccggcttattcctgtgtcggatcttcatcgggagagtgcgccaactgagatgtttgtgactccctcttgcttcctccgtgcttgtctcttccctctcgtttagtttgcctggggagcttgtactggagtagggctgcgtgcttcgcccgggatgtcccttcttgtcttgctgtccattgatgagtgcttgtaccgccatgagtcgcattgatctcctcccttcttcctcccgtactatattgggcatgaagtcgagtatgcgcattttgatggttggattggatgctgctgggcaagacaaccatgctgtataaacgtgaagtccaggggagatagtcaccaccattcctaccattggttggaaatgtggaaacaagtaagaactatgacgaacattttgtttccacccgtatgggatgtcggtggtcaagatagaataaggctctctggaagcattacttccagaatacccaggtcttatttggtcggtagcatagcacacgatcgtcggaaagaatcaggaagtagcagatggagctgcagcacaatgcttctggtcaccatgggattgcgaggatgccagtgctgctactttttgtgccaaccaaaccaggattggccaatggctagggcgctccgtgggactggccgattaactaagggcttcgggctcctcgtgaccggaccctggttttgtttcagggccctgtgtgccccaggactgggtctctgtgtttgcgcgcctcgcggggtgtcgttgaggctcccacggtgggggcgcggtttaccgggcgtn

SEQ ID NO: 488220 - DNA, 545 bp, Homo sapiens
attttgagacaatagttgcagaaagcactggaaataataaacttgatcttatacaaatcttctattgtgtggaaaatgttgtgaagggtgtgtaggtgtggtacatgtgtatgtcactaacaagtggcacatggtgacaaagtggtcactatgcttttgtctctcataggcactgactttttgttattatattatggtagctttcatttcctttactctttaacagtgcaggtggtcagtgacatcagtgtcactcagaagtgactgatttatcaatacatggacacaagtaaatcattgaccaaagctatgacatgtttcacaaagttttcctcttttgcataacacatgtcactggatgtacattcagccttgttctttgaatttggtgacactttcatggtcagaccgctgaggctggcatctcttgtgacattttctcttttagtttagatttcacgattgggccttagttgatcttcagcacagctgtctacttctctttattcctgggccccttgggtaattgtgacattcctgttttc

SEQ ID NO: 488221 - DNA, 318 bp, Homo sapiens
ttgtccgcaaccatgatcctccgaatctggttgggcatccagcatacgaccaatgtcacaacaatcagccctgggcagacacgtgcaggagggcgagactgagaaaagaaaaacaccgcctgtgaacacagtaaataaataaaaccctcaattagttagcccctctattctgtgcttactgcccaggaaatggtaccaatttttcagtgcttgacttgaccgcttcttttcccacaagcaagagagaatttaacactgtttcaaacccgggggagttggctgtgttaaagaaagacctataaatgctttcgacagtga

SEQ ID NO: 488222 - DNA, 1035 bp, Homo sapiens
agcgggcgcatttgtatcgcggcgaagcgcgactccaacatggtgtcgcagtcgcaaccgttctccacggagggaacgtaggccgttcccggtgccacactcgccgggagaagagaaacggacgcgccgaagaatagggtccgacggtctcgggagagagatcggaggaaggaggacgcatcgtagattccctcggacaacgacaggatggctccgcggagctcacaggaccgaacatagactccaggatcgtcacgtgtccccgttcgtcgagctgcacaggaagacgacgacgatgacgggaaaccgaaaacgaagcaactcgaaatagagaccacgcaaaggcaaccggcgacggatatactcgaaagggaaaccaccttacgagggcgctaataaccactgacggaacgatacttctggacattgcttgaagtaagactgggattctggccttcctgttcgacttccacaaaagaagggtataccacaggtgtgcatggccgtcttggtgccatggtgacgcgtgattgccctataaagatggtcgtcctcaagaataggagaggacagctacgacggcaggtacgactgcacagtcggaacagaagggtggaatgtccttgctagagagcacttctggcgagttatcgactttgctatgcatcaatactagcaagttagatcttgcatatggcagtggatttctatgtttattccacccgccttccgaggtccttgtgtgggtccatgtaaggcaaagatgtggaatttgtcggctattttattgatacctttttaaaggatttgaccatttgccaataggccacccacgtggcaatccttcgaggtatttctatcacctttgccgttgtgtacacctgtctgagagaaacctccttcgtcacttaccactggacttatttttgccgggctaaaaacgtttatgccgtagcctcgttcacaatccagatccgaacccgggtttaaccaatctttaccctgtcctgcattcgtttcaccgcaaatctagtc

SEQ ID NO: 488223 - DNA, 271 bp, Homo sapiens
  misc_feature (8)..(8): n is a, c, g, or t
  misc_feature (31)..(31): n is a, c, g, or t
  misc_feature (42)..(42): n is a, c, g, or t
  misc_feature (55)..(56): n is a, c, g, or t
  misc_feature (90)..(90): n is a, c, g, or t
  misc_feature (93)..(93): n is a, c, g, or t
  misc_feature (100)..(100): n is a, c, g, or t
  misc_feature (130)..(130): n is a, c, g, or t
  misc_feature (157)..(157): n is a, c, g, or t
cccgggcnccgcctcctgcccccgcggcggnccagaggggcntcggcagcggtgnncagggcctcggtcggagggaaaagctggctgcgngcnccgcggntaccccgcggcgggcctcccggcctccctngcaaggctgccgaggcgcccggggtcntggcgggggtcgggggcccctgcgggaggacgcggctgctctgctccctcaggaagttcaacaggaacggtacgaattctttccgcagggcccggagtgagctcagcgcggccg

SEQ ID NO: 488224 - DNA, 407 bp, Homo sapiens
tccgatctggcaggcttagatgtactcagtcacatgccaaacaacatacctccccatgccactttctcagattgctctctcctctggtctaattggtttcttctcacacagttccatagtgcttatggctccaagggaagatacgtctccagagagccatggaccagagtgctggaaaagcttggggcagacaggggtctccagttggaaggtcagggtttgaactggggtttaaactgaacccaaaagccaggaggaaggccaatgcctggcatgagagggtgcgcggcatcttttgcctgagttgagaacctgccttggtacctaaacggtgggttccacccttaagaattcccgcaaagcaactagtggccctacctggccatgggatgcggccaagcatgcca

SEQ ID NO: 488225 - DNA, 219 bp, Homo sapiens
gcggagctactctatgaggatcccccgtgtactccagcactttgggaggcgaggcaagaggattgcttgagtctagaagttcaagaccagcctgggcaacatagcaagacctcatctctactaaagaaaaaaaaattagctgggcgtggacaccccacaccgtgtagtcccatgttactccatgcaggctgaggctggtagggattaacttgatgccca

SEQ ID NO: 488226 - DNA, 299 bp, Homo sapiens
  misc_feature (45)..(45): n is a, c, g, or t
  misc_feature (115)..(115): n is a, c, g, or t
  misc_feature (132)..(132): n is a, c, g, or t
  misc_feature (136)..(137): n is a, c, g, or t
  misc_feature (139)..(139): n is a, c, g, or t
  misc_feature (144)..(144): n is a, c, g, or t
  misc_feature (147)..(150): n is a, c, g, or t
  misc_feature (155)..(155): n is a, c, g, or t
  misc_feature (170)..(170): n is a, c, g, or t
  misc_feature (175)..(176): n is a, c, g, or t
  misc_feature (188)..(190): n is a, c, g, or t
  misc_feature (241)..(241): n is a, c, g, or t
  misc_feature (252)..(252): n is a, c, g, or t
  misc_feature (261)..(261): n is a, c, g, or t
  misc_feature (264)..(264): n is a, c, g, or t
  misc_feature (270)..(272): n is a, c, g, or t
  misc_feature (277)..(277): n is a, c, g, or t
  misc_feature (286)..(286): n is a, c, g, or t
  misc_feature (291)..(291): n is a, c, g, or t
gcactgatacgcagagtcctcaaacatgccacgccaacttttcanctgaatctcttccagaacaagcactattctataaagaatatgttatcccttatttaaaaaaataaaagtngggggagggggaaaaanattnncntgtgntcnnnnctacnacctttctgtcggcnaaatnnttttggtttaannngatgggttttttcccccattttaaactttttcccccttcccgagtgacctnatgacttgttngagtgatgngtntaacannnaccanagtgggtgnatggntttgtttt

SEQ ID NO: 488227 - DNA, 153 bp, Homo sapiens
ttgggggggggggggggccccccttttttaaaacccggggtttttggggcccccgtttttttttccccttaggggggggttggggggggggcggggtttggacaatttttcatacccccttttttgcccttttacctttttccccccccccga

SEQ ID NO: 488228 - DNA, 412 bp, Homo sapiens
  misc_feature (56)..(56): n is a, c, g, or t
  misc_feature (58)..(58): n is a, c, g, or t
  misc_feature (62)..(62): n is a, c, g, or t
  misc_feature (68)..(68): n is a, c, g, or t
  misc_feature (72)..(73): n is a, c, g, or t
  misc_feature (85)..(85): n is a, c, g, or t
  misc_feature (87)..(87): n is a, c, g, or t
  misc_feature (120)..(120): n is a, c, g, or t
  misc_feature (148)..(148): n is a, c, g, or t
  misc_feature (154)..(154): n is a, c, g, or t
  misc_feature (173)..(173): n is a, c, g, or t
  misc_feature (187)..(187): n is a, c, g, or t
  misc_feature (200)..(200): n is a, c, g, or t
  misc_feature (221)..(222): n is a, c, g, or t
  misc_feature (245)..(245): n is a, c, g, or t
gcggctcaggttcaactggatcagatcctgctgttgatgctgtgaggtcggccgtntntggnctgggngtcnnccgggactgggnanctgagcagatgacaccagcatcttcatgatggncacagttgtgggagagccagccattgtnggggcngctccacaggtaggactcntgtcctgagcagcncacatcatccagnacaatgggtcctgagccctgnncaaaccgggcatttcctggggcngacgtggcccagccacagcccagctgcctgcagaccacattggcatcattggtatcccagctgtcatcacacacggtgccccaggagcctcggtataggacctctactcggccctgacacctgtcacttccattcaccagcctcagggtcaaactggattcagatcc

SEQ ID NO: 488229 - DNA, 819 bp, Homo sapiens
agagtagcagaagatcagttcaccgcaatgagggggcagagaattccggcacagaacgggagtgggatggtagcctccccaagagcagcgacgagctcagggacaccagtgtccctcatgatccggcagaccataccgcatccaagaggcctgctctctgtttccagctcagccaaggctgatggcggaagaagagcagactgacgtacgagtctggggaagacgaggaggatgaggaggaggaggaagaggaggcggaggactatcaagccatccgacggcagtgaaaacggaacatggagacagagcatctggactacgtgtgacagggcccaaggcatgggactacccatgaaaccggaccagacctggatgtactggccgtaatgagggagtccggggactacacacaatatgacaaccacagatgcccgggaatggcccgtacgagagagacctctgaggagaagcactagagatacccacgaccaaacgggatgaacgacttgaacacatacgcaacatgagctgagaccaatgcatgacatggatgcatgccatcaggagtccttgagaggggtcacgagacaataccccaaagggctataccccatggactacggaacaacaccatgaaacaccaagcccaggaaattacagccacagtggagctgtgaacaaccacaacaggcacatcacaggcaatgaaaaacacggtcaaatgcccgtgaaaatgacaccatgtggcaataaggaggaagcacgaagggacaaacaggaacagacaacgcatgtcacaacatgaatgtggaagaagga

SEQ ID NO: 488230 - DNA, 865 bp, Homo sapiens
ggacgcgtgggtcgacccacgcgtcgcgcgagcggcgcctatttatttttttttataaattttttggacatggagtttcactcttgtatgcccaggctggagcccaatggcgcgatctcagctaccgtgcaacctatcacctcctgggtgcacatcgatcttcctgtaggttcagcgaatctcagggggagctgtataaattacagggacagatgcgtacacccattgcctgtgtgcctcatatgttcgtgaccttatagatataacaaaacagtgggtttacaatcaacagatgtggacacggctgtggtctcctccaactctccagaacctcgagggtgattccacccgcgccttcagactccgcaaagagtgtctgcgatcaccgggcgcgcgcagggcgccgcgcgcccggtggcccccaaaagtcgcaaagatgtacagggtgctcaccagcggggcgaggcgcagagcacaagaacacgcacatacaagaggcccgcacgtccacggtaatcgacccacaccgaacgacagcaccagcacagaagagcagagaagcgcgggcgagagacacgcgcaacgagcaagaaaaacaagagcggccacacccgctccagcggatcaggccagccgggcggcgcgagcaccgaagaagaggacagcgggagggaggaagaaagaccgagagacgccacacaggcacgacgctcagcacgagcggcgacagagcacacgaagccgaacaccgccgagtgcgtggcacgacatccggggcaggggaactcagggcggcacgagccacagcccgacgccgcacgccgcacccccgtgacgcgcggcggcccgcacgagtcgccgacaa

SEQ ID NO: 488231 - DNA, 530 bp, Homo sapiens
ccccacaaagggaaagcccccctagaatgcaaaatttgccccaaactttttatgtcccccaaagcccccccaggtttcaaatttccctaagtgtcagttcccacgggaacccctttgcctccaaaatggcgatcgtttattttaaaatggtctctgggttcattctcccttaaacccacagtgaaaatcctttaaaaatttaacccttttaaccggccaaaagtcaccaaccaccatttttttatttccccttaaaaggtgtcaaatcaaaccctgagcttttttttcccggttttgcaaaatttccccgtaaaaaattttaaaccccccctagttaaaatcttttttttttcccaaacggattaattttcaatttctaaggccaatgcccccttcaacaaaaatttttgaaaagctttaaaaccccaaggtttaaaaatgcttttctgaaatcctgttttcaaaaccccccaaaaaacccgtgtttttggatccttaaaaactttatgaattaaccctttttttgggcc

SEQ ID NO: 488232 - DNA, 475 bp, Homo sapiens
ctactactactaaattcgcggcgctcgacgttatgagatgacttttagccacaagattccaaaagttagtcttggcaaaatggacattctttgaatgttgttggagctgaatggctctagatggtgtgctgagcccttcccatgagatgatgttccagaagaatcccagagatatgaggccatcctcttcagctccacaccaaagcaggcatccactcaaggccagctcaacacttcagctccacaccaaagcaggcatccacccaaggccagcccaacagttgaacccttccactagtaaggagcaaagcagcctggatcatggctgcacagttctcgggagaacagttgtctttgttttaatgggctgtctgtggccctgcagcttctctctactggccccaattctgagaatgcagttttaaaaatcactttttggaaagaaaaaaaaaaaatcgacgcgccgaatttagta

SEQ ID NO: 488233 - DNA, 369 bp, Homo sapiens
aaacttttggaggtcaaactgggggagctccccaactggatcttaatgcgggacttcagtcctagtggcattttgggagggtttcaaaaaggttacccccggtcctccaacaagtacatcaatttgaaaaaggggagcatttcggggattaccatggtggtggcatgctacgggctttttagaaactccttttcctacaagcatttcaagcgggagggggtccgcaaataccactgaaaagggccccttttgccccccccccccccccgcccttgggccgagcccctccgtgaggaacccaatttcaatcgttggtgaatccttttatatcctaataggaattaacctccaaataaaacatggctggta

SEQ ID NO: 488234 - DNA, 196 bp, Homo sapiens
gtcgaccttcctgtagagaattagtggccttaaataatcaaaaggaatgtattgaattttcacaagaatccccgacaaaggtctaatatccagatctacaaggaacttaaacaaatttacaagaaaataaaagcacattaaacagtgggcaaaggacatgaacagacacttctcaaaagaagatatttatgtggcc

SEQ ID NO: 488235 - DNA, 401 bp, Homo sapiens
  misc_feature (175)..(175): n is a, c, g, or t
  misc_feature (255)..(255): n is a, c, g, or t
  misc_feature (270)..(270): n is a, c, g, or t
  misc_feature (279)..(279): n is a, c, g, or t
  misc_feature (324)..(324): n is a, c, g, or t
  misc_feature (332)..(332): n is a, c, g, or t
  misc_feature (361)..(361): n is a, c, g, or t
  misc_feature (388)..(388): n is a, c, g, or t
gaccttgagccctcgaaagcgacatggcggttctcttaaagctgggcgttctctgcagtggccaaggagctcgagctctcctactccgaagccgggtggtcagacccgcttatgtgtcagcatttctccaggaccagcctacccaaggacggtgtggtacccagcacattcaccntgtcaccaaagccaccaactctggttccaaggctgcatctctccactggaccagtgagaggggttgtcagtgttctgttnttgggggctgatccntgcttgggnactttggaatcccctgcttctgtggtggaactactcttctggctngcaagccntcaaccctgcaacaagtcaacttgggggnctttggacaaagttgggttacccgacntacggttcaatgg

SEQ ID NO: 488236 - DNA, 195 bp, Homo sapiens
acactctcgcgccctggctaattaatatatgctaaagtgaagaagggggcaatactggagggaggggagaattggggagaccatttccctgtacttccttcacagataatggtaaatcctgggcacctaaggagtaaaagtcaaaccattcacttctcttaccagccttactttgagattcatcagaataggatt

SEQ ID NO: 488237 - DNA, 141 bp, Homo sapiens
ggcgcatttcttctcaattaacccatgcagcacatgctacgcatctgctgagtccgtttagaagcatttgcggtggcttagacttcagtgcagcggcaccaccatggctcactgcaactttgaacttctggctcacgtgat

SEQ ID NO: 488238 - DNA, 152 bp, Homo sapiens
aggagtacactacaaatgggatatggggagtgactcaggaagtgaagaatgcacaagaatggatcacaagatggaatctatcaaaccctagcctggctggtaaatttttttttttttttttttttttttttttttttttttttttttttttt

SEQ ID NO: 488239 - DNA, 1520 bp, Homo sapiens
  misc_feature (1163)..(1163): n is a, c, g, or t
  misc_feature (1192)..(1192): n is a, c, g, or t
ttttttattatctcgcgcggggaggttgacacgccccttttttagatcaggtggtttgttgcggtacacaaacaacgtcgctttctgtggacaacaccaccaatctttggtggggggctctttctcgccagcaggcgtccgcataattgtttggtatgatcgtgctgttgaatcacaactcctgtgcaacaccatctattggtgtgttatagattgaaagcgccgctttgtttcagattcccacgcgggttcccagacgaattttggttacaaaacgcccaccttggggggaggaaattattttacaacagacgtggggtggttgtagcatcgaataaggttggataaggtgagtcattacttgccccacaaacgtgtgttatggtcgcgtggtgatagagccccccaaccaatgtgtgtgaagacaaaaagggggggttgtcccgccgcctaatgaatgttgccatgtcccggacagcattgtttaaaaagggggtaaatagacctgtctttggtctcttggaaagacgatatgggggccctctgttgtcgtgctgttcttccccgccgcggagttaataaaagcctcgttgttcttcttgtggcgcttgggggaaaaaaatacctgcccctgtatcccccgcagagaaggggaaaagggaaaaagtggggaaaagagggagcctcgaagatggaaagacattgggagccccacacggtgatgagaaacttcggttgggaaactctgtggagatccccccacattccacggggaaaaagacccggggcggcccacacgtacacacacatgggagggaaagcgcacatattttggagaggagatcgagatggagaaacacatcatcttgctccacagagagggtgggtggttctacacaggggttctacagaaaccctctgttataatgggggggccacaggtgagatatatacacacacgtgcaccttggcgtgtgcgcacatcttataatcggggccaacgctataggtgtagaatggagaggtgtagagaggagcacgcgctagatatctcacatataatatatggcgtccacactatactgtgtgctctctctgtgtgtttgtgtgttgtttataatataaacctcatatatggtataggtgtgtttgtataaaagagnggtataaagtgagaagagaatatataacngcacacaatatataagaaaggcttctcgagatttgtggcccctcggtaatgtatatgagatgagacttcacagtggtgccacacagagatgaaagtcttataataaccctgtgtaaaactatcacaagaaagttcccctagcacatttttaaggccacaaaccttgtaaattgagcttcacgctaatggaacgtggagcaaagcttagacctgaaaatgctaaggtaataatgtaattgggttcacagtgtatgacccttcattgttaagctatgaaagttaaactctgtatttaactggccatgagggaaaaaaaattttgtagaga

SEQ ID NO: 488240 - DNA, 861 bp, Homo sapiens
gctctttcttcctgtctgctgtggaaagatgggtcccgcaaggaaggtaccggctctatgccacctcttccagctccaccgccggcgcagcagggaacggcaaaggcacaggggctcgggagatcagccgtgaacgcaatgtgcagatagatggccttgtggtataacagatactcaaacgattatcaagacagaaggacaaggaacctgaagtggtcaaggagtgctttggggtctggttgtagaagatcggtttgaaaattaaccaaggttgtttccttttccctcagcacacagaggaattgatgctgacttgggattgaagtccaaattattccagaatggacacatgattgcggacgcctttcggccagttgtacacacctttgtgatccattccttccacgggtgggctggccattcaggtccaaaattactaagttggcctccatttccggtatcaaccggggggacacttcccgtggaatctaccaggtttaaaggtttcaccaaggcagtgacaatttgacaaagacaatcgtgggcgtgctccattatattgatctcccataaaaaaatgtggcccagggatctcttcttgcacataaaggggaatacaagcgtgacttcataaacgtgatggcaatgtgtgtacaaggaaacggattttcccctcgtgaagccatggaaaaagcaaaatattaccttggaggtaacatgtttgaacgaagtggccgatgtgtacattaacaactcgcacattctgatcagtggcctagtgtgggaattggaaaagaagtcacgtggtgggataacattggatttggagagctgcaaggagcactatgtggggagcactac

SEQ ID NO: 488241 - DNA, 404 bp, Homo sapiens
tactgagaggatgctcctaaatagccagaattcattttatattaaaaaaaaatctggacggacgcagtggctcacacctataatcccagcactctggggggctgaggtgggtggatcacctgaggtcaggaatttgagaccagcctggccaacttggtgaaaccctatctctacgaaaaatacaaaaaaaaaaaaaaaaattggcccgtttggggggccccatccccgaggccctagtttttgggggggttgggccagaaaatttgcttgaccccacaagggggggtttgtggggggcaaagatcggcccattgcactcaaacctgggcgacagagggagactttgttttaaaaaaaaaaaagggtaattaaaaaaaagggttgttttttgaaaaggaaaaaaa

SEQ ID NO: 488242 - DNA, 130 bp, Homo sapiens
agagatccttatgtttcgaccgttactaggggacctgtgaatttattacactggtgctggtactagcgttacgcacagaaatgctagtcacgttaatgcccaaagtgagcctggtcctagggtctccaag

SEQ ID NO: 488243 - DNA, 1040 bp, Homo sapiens
  misc_feature (12)..(12): n is a, c, g, or t
  misc_feature (32)..(35): n is a, c, g, or t
  misc_feature (38)..(38): n is a, c, g, or t
  misc_feature (56)..(58): n is a, c, g, or t
  misc_feature (88)..(88): n is a, c, g, or t
  misc_feature (90)..(90): n is a, c, g, or t
  misc_feature (94)..(95): n is a, c, g, or t
  misc_feature (107)..(107): n is a, c, g, or t
  misc_feature (113)..(113): n is a, c, g, or t
  misc_feature (124)..(124): n is a, c, g, or t
  misc_feature (134)..(134): n is a, c, g, or t
  misc_feature (142)..(142): n is a, c, g, or t
  misc_feature (153)..(153): n is a, c, g, or t
  misc_feature (179)..(179): n is a, c, g, or t
  misc_feature (189)..(190): n is a, c, g, or t
  misc_feature (208)..(208): n is a, c, g, or t
  misc_feature (218)..(218): n is a, c, g, or t
  misc_feature (226)..(226): n is a, c, g, or t
  misc_feature (291)..(291): n is a, c, g, or t
  misc_feature (293)..(293): n is a, c, g, or t
  misc_feature (309)..(309): n is a, c, g, or t
  misc_feature (321)..(321): n is a, c, g, or t
  misc_feature (351)..(351): n is a, c, g, or t
  misc_feature (356)..(356): n is a, c, g, or t
  misc_feature (391)..(391): n is a, c, g, or t
  misc_feature (395)..(395): n is a, c, g, or t
  misc_feature (399)..(399): n is a, c, g, or t
  misc_feature (433)..(433): n is a, c, g, or t
  misc_feature (442)..(443): n is a, c, g, or t
  misc_feature (449)..(449): n is a, c, g, or t
  misc_feature (453)..(453): n is a, c, g, or t
  misc_feature (520)..(520): n is a, c, g, or t
  misc_feature (541)..(541): n is a, c, g, or t
  misc_feature (547)..(547): n is a, c, g, or t
  misc_feature (553)..(553): n is a, c, g, or t
  misc_feature (575)..(575): n is a, c, g, or t
  misc_feature (694)..(694): n is a, c, g, or t
  misc_feature (881)..(881): n is a, c, g, or t
  misc_feature (936)..(936): n is a, c, g, or t
  misc_feature (943)..(943): n is a, c, g, or t
  misc_feature (965)..(965): n is a, c, g, or t
  misc_feature (977)..(977): n is a, c, g, or t
  misc_feature (1026)..(1026): n is a, c, g, or t
cgagcctcgcgncccggggcacggcgccgccnnnnccnccccggcagtgcctcccnnncccctgccctccgctgggacatggcctgangncccnnccgccgcccggnaccccncccccacgctncccccggacnctcgcccnaggaccgcggngtctcttcccggccccgccgcccgcnccggcgagannaggcccggcgggcaaggnggcggcagancgagggangcctggcccggcaccggggagaagggtgcggcgcaccgagtttcccaccttttatcctggcccanangcggctggggcggacnggacctctcgcnctctgcctcctcctcttgcttcatggagcnatgcncctgggtgggggctcccgaaaaaagctggcctgcnggcnggcnggacgcgctgcgcggacgggacggggcgaaggangccggcagnngaggangaancggcggggcggcggcggcggcggcggcggcggcggccgagagaagaactaaaggtattccccgggcngctggaggacttaattgagcngggacncgagtnctccggtatcccagcaaccacnggagcagtgaggtaatggaggaagaatgtagggagtcctccggtggaccacactccttctagcgagccgcggaaaccatagagatcagggctcagccggagggccggcccactgctgtnacgtggcctccatccgtgcgctttattggctggtgctggctttacggggttgaattttggacgctgcctgccattcgtgggaccgagtttcaggcagctggaataaagagagatatcgggggaaagccgcgagaaggccagcgtccctcgctgggagcagagctagccgagtagggcgcccgctgtnaaactggccggcgcagtgcacgctgggccgccccggagcgatcgcagaccccgtngggagtngtagtccgggacgggcccgcgnatcgtccgcgangcagctcgggatccgggtcggggtgtcggccgggttgctgccgggcacntccgagcgttacca

SEQ ID NO: 488244 - DNA, 275 bp, Homo sapiens
ggggggggggttttcccctaaaggggtggctttttccctggggcccaaaaaaaaccaaggggcttttttggacctttggccctttttccccccccccctttgggaaaagcccccccattttttttccccttttttggggggggtcccccccccccccccccccccggggtcctttttttgggggttgggacccccccgggggggggggggaggggcccccggggggggccttttttcttttttttttttttgaaaaaggtcccctttttgggcca

SEQ ID NO: 488245 - DNA, 499 bp, Homo sapiens
  misc_feature (17)..(17): n is a, c, g, or t
  misc_feature (200)..(200): n is a, c, g, or t
  misc_feature (223)..(223): n is a, c, g, or t
  misc_feature (240)..(240): n is a, c, g, or t
  misc_feature (277)..(277): n is a, c, g, or t
  misc_feature (281)..(281): n is a, c, g, or t
  misc_feature (324)..(324): n is a, c, g, or t
  misc_feature (387)..(387): n is a, c, g, or t
  misc_feature (399)..(399): n is a, c, g, or t
  misc_feature (466)..(466): n is a, c, g, or t
gtatgatcatctgcttnaatgtatgctgaaagatgcgacgacgacttctgttagcgtcgacagtttcggtttccagtatagcgcactcgtacacacgtagctcacgtccggtgtagtcggtactcgtacgctctgctgtagtatatagagtgacatgatctcgatgtacaaagcacgtgagtgcgaggcacggaagcagnttgtctacgtgagcgtctcgcangatagtcgtgttagtcntgcgatacactgttgattatcgataacaatgtgagcnatcntagtatgcggcggagagcgtgctcacgcactcgtctacgagcnatgcgttaacatagttaaggaacgaggttattgagtagagatatggtcgtgagctgtgtctgntagcgtagaganatacggtctgacggatacatacacaagtgtctcatactgcgatctgtcgcgtagcgtcgcaatgtanctagtcgtgagtcgagtgagtcagatccgagcc

SEQ ID NO: 488246 - DNA, 369 bp, Homo sapiens
  misc_feature (31)..(31): n is a, c, g, or t
  misc_feature (245)..(245): n is a, c, g, or t
  misc_feature (297)..(297): n is a, c, g, or t
  misc_feature (304)..(304): n is a, c, g, or t
  misc_feature (343)..(343): n is a, c, g, or t
  misc_feature (354)..(354): n is a, c, g, or t
  misc_feature (360)..(360): n is a, c, g, or t
gtctaatttataagaggaacacactgtgagnttaaaaaaaattctcatagacataaagtgatataaatgaggatacacatttattagtaatatttaaaaaatcagttcatcccaaagctagcaattactttttatttagaaattttactttaatcataatttgatttttaaggtattttaaaataaatattaaacataaaagaatgattttcagtggctgtagttcaaaactgctgtggaatagnaattagtattgtgacaccatttaagtgccagttttaaattaaatggtgttgngtttccngctctcttagtttttattgtgggccaaccccccccaaancgtggagcttnaaatanccatttatt

SEQ ID NO: 488247 - DNA, 221 bp, Homo sapiens
  misc_feature (24)..(24): n is a, c, g, or t
  misc_feature (26)..(27): n is a, c, g, or t
  misc_feature (34)..(34): n is a, c, g, or t
  misc_feature (51)..(51): n is a, c, g, or t
  misc_feature (104)..(104): n is a, c, g, or t
  misc_feature (109)..(109): n is a, c, g, or t
  misc_feature (130)..(130): n is a, c, g, or t
  misc_feature (132)..(132): n is a, c, g, or t
  misc_feature (139)..(140): n is a, c, g, or t
  misc_feature (169)..(169): n is a, c, g, or t
  misc_feature (174)..(174): n is a, c, g, or t
  misc_feature (191)..(191): n is a, c, g, or t
  misc_feature (200)..(201): n is a, c, g, or t
  misc_feature (205)..(205): n is a, c, g, or t
gtcattactgtagagtgtaagttnanntagtttnaagacagattgttaccnttgctattaatatatatcccctatatttatcaccacaggataataatatttcnggtanacttcctatttataaggtgangntattccnncatcgcgtttttctattagaaattatganccttntgtgaaaatatcccatncaagaattnncccnaagggaaaatataaac

SEQ ID NO: 488248 - DNA, 1290 bp, Homo sapiens
  misc_feature (1290)..(1290): n is a, c, g, or t
gtagatttgtctgcaggacagctcttggttatggtaacaagtggacgctcgagtcccagaatctttcccaggttagccccagaaagaccagaccaactctgtcacagtgtgcagattgtcactggcaatagggaagcatacttcacttatatatgttcttatagtttcattgcaccttcaatgtgcccatgcatcgagcatgttagcgaatagcatggagtactaaattaaaactcacagactgggcattaatgagcatacatggatcatttgacacttaataatcataagctttttcgagtgacttcgtagtctggggaatggactattgaaaagcaatttgtgaagtggggctattccttgttaatcttaagagaagaatgtattgcttagctcgggaggcttggttggagcaaatactaaagtagaaagctcgtcacgacgtatcttcccaaggaagattcaagaatcatatggtctagaagttcaactcgggaggaaatgatcacattttaacgcgtttcaaagattttccaattttctagattggtgtgggccaaaaattatgagcacttcttgagaaacgagtggttaaactttggggaacctttgctgaagcgaagattcggtcccgagtggattttaacgcatctttgtatggcaaatacccagtttttccttttgtctgcacggagacataggggcaatctcagcatttggatagggatccactggcggaccacttttgaagaatggggttcccagtaattacttgacatatatacaaattcgagaaacaaatagggtggtgcaccctttttaacacacgggaagatcctcgggcccgcaatttatattgctgtggggacttacttaacccggtcctcccagaactgggaattcaggcgcgtggaaatttgcaaaacaaggccttatcggagttttggcccttgtataattctgcgagaatagcgccctgcaatttgcttaaagaattcttgcgtccaacccggggatattggtaggttccctggggggaataaagcttccctgaatacaacgcgtcttacctgcgcctgatgcattgtgtccaccttggaaaaacttcggggaggaacaataggcaaggttttaaccagtgtggagttgacttggacgaatccactagagaaagcggggttcacgccatcaagagatgacattttcggggacgggctttatattctttgaactttgtgcttggatggttcggcgaaacacacagattgtttgaactatggggcagcggcn

SEQ ID NO: 488249 - DNA, 285 bp, Homo sapiens
actctagaggacacctacatagtttcatggtatctacccagaagtatatattaattataaaggaaaatagagtaactttacataggaagaagtgacagatacagctattgtttctagagagatcacaattaaatattaccagtgttcatatacactgtaaattctacatacatgtgttagcatgcaatggagaagaacatagcagcatttatggttatattattgggcaaaccgattagagtccagagtctaaccacttagaaaatctaaagaaaagcaacaacg

SEQ ID NO: 488250 - DNA, 336 bp, Homo sapiens
gcccagactattggtctggaagatgcgctgactgccagcctgatgcttaatgcgttgttaattgtgggcgcgctgctgggattagttctgacgcacctgctggcacatcgcaaatttttgctgggaagttttttgctgctggcggcaacgctggtagtcatggcctgtttgccttccggcagttcattaacgctgctgctttttgttctcttcagcaccaccatttcggcagtcagtaatctggtgggcattttgcctgcggaaagttttcctactgacattcgctcgctgggcgtcggttttgccactgccatgagtcgacttggcgcggcggta

SEQ ID NO: 488251 - DNA, 1391 bp, Homo sapiens
  misc_feature (5)..(5): n is a, c, g, or t
  misc_feature (10)..(10): n is a, c, g, or t
  misc_feature (41)..(41): n is a, c, g, or t
  misc_feature (51)..(51): n is a, c, g, or t
  misc_feature (53)..(53): n is a, c, g, or t
  misc_feature (156)..(156): n is a, c, g, or t
  misc_feature (246)..(246): n is a, c, g, or t
  misc_feature (256)..(256): n is a, c, g, or t
  misc_feature (259)..(259): n is a, c, g, or t
  misc_feature (274)..(274): n is a, c, g, or t
  misc_feature (288)..(288): n is a, c, g, or t
  misc_feature (290)..(290): n is a, c, g, or t
  misc_feature (293)..(293): n is a, c, g, or t
  misc_feature (298)..(298): n is a, c, g, or t
  misc_feature (311)..(311): n is a, c, g, or t
  misc_feature (317)..(317): n is a, c, g, or t
  misc_feature (334)..(334): n is a, c, g, or t
  misc_feature (346)..(346): n is a, c, g, or t
  misc_feature (406)..(406): n is a, c, g, or t
  misc_feature (412)..(412): n is a, c, g, or t
  misc_feature (479)..(479): n is a, c, g, or t
  misc_feature (497)..(497): n is a, c, g, or t
  misc_feature (536)..(536): n is a, c, g, or t
  misc_feature (682)..(682): n is a, c, g, or t
  misc_feature (821)..(821): n is a, c, g, or t
  misc_feature (940)..(940): n is a, c, g, or t
  misc_feature (988)..(988): n is a, c, g, or t
  misc_feature (1079)..(1079): n is a, c, g, or t
  misc_feature (1117)..(1117): n is a, c, g, or t
  misc_feature (1391)..(1391): n is a, c, g, or t
ttaantaaanacacacatacaatagtacgctcccaccaggngtgatggggngncgtagcttttggtggcgcgtgtctgtcgttttattggtagggtgtgtgttagtgaccggtgggcgtcgtacaaagtcagggaatcttctagtttgaattatantcttcatcacactcgtgatgcgcgcgcttctcacctggtgctcgcctgtccgcctcgcgccgcgcttcgcgcggtgcgcgacgctcgcgngcgccccgcnacnccgtctcagcgccanacgcgcaccgaccncntcngaganaaagtcgcagacncgcagncacggcacgcgagcgangcgcgcgagcgngtcgcgtagacgagcgcgctcgacgatacacaatgtcgaacgcccaccagacgaccacancgccancacacacgacaccagaagcagccgcagagggcggttggaaggtgcgacgaacagcgacgagcgatantagagaatagaggtagtnctgctccaccgtcatcatgagaacatgtaggtgaagtangtagacttagtgtattgacgtcgtgtgctcgtgtcgtatcattatcactctagttataatttattatttttcatatttatttctgcgcatctttattctcgtagtactctttcattacacttctctgactattctcgtgtatacgngaacgttgtggttgtatcctgctatcgcgtacatgtcctacgcgctttacgttctccttacgtgctcgtagcgtcgctgatgatatgcgtaagtagcagtcgtatcgtcggttagtctgtcaacgtctcgatgagtacntattgattaagcttatttcgtgtatgagtatgtatcattcgtaccgttcgtcgccacttgtaggcatgtcgtctcgatctctgcatcgtccacacgcgagcggacactctcactcatantcactagtatgaagcggtttgaagaggtggtgctgtaatgctagtcgngattaggagtgtgtagtgttcgagggacggttaatgagaatcactcgctgacgacggctgtgcgctggtgttgtactagaatagttgatcnttgttatgatagaggcgtgtgacgtcgtcgcatcgcgntgagcgatggtggtgtatgactctggaccgtatgcggtccgcgctaccgtttgtacttcttagccgaattggatcaactactcatggcatatcttgctgatgcgttgcgcgtgtgtgatcgtctgtagctgctcctccgtgttcgtctactgttagtcgatatctcagtttacaacagttgtggtgcggcttgcgtcattgcgatctgtcgatctcggtctgtctgtcgcgcgacgtgtatggcggtgactgttgttgctatcttctacgctgn

SEQ ID NO: 488252 - DNA, 103 bp, Homo sapiens
tgggaagatggctgaattcagacgggagcgtgcctaccaaaagcagccggaccatctttcaaaacaagaggagggtcctgcggggagaaactgggcaaggaga

SEQ ID NO: 488253 - DNA, 141 bp, Homo sapiens
  misc_feature (7)..(7): n is a, c, g, or t
gcacccnagttccagcatttatctgagcgttctgagcagaatcggagatcagaggaggctcatagagctgaactcttgaccacagaggaggaaggaagagaatgttccaagcagagaaaacggggtgccgatgaatagcga

SEQ ID NO: 488254 - DNA, 97 bp, Homo sapiens
ccccccccccccctttaaaaaaaaaaaaggagccaaacttttgttgctagattctgaaggcacattttgcttcattaatctaaataagtaccttaaa

SEQ ID NO: 488255 - DNA, 887 bp, Homo sapiens
cgcgcacggagggactccggccctgaacctggcccatgccgaaacactcgttatcgaaataagagacaaatgaggatagattcctggcagactcttcactgtccagtgtgcagactgaggccatcggcgagtggcagcctggagccgtccccacagtcccaggcagaggatggcctggagccagtgctgtgcagttggggctggtaccagagggtgcctgtgaaggatactggcccagctccacaagagcgaggaggcggtgagttgtcggacagcgggtgcttgcgtgtattacctcttccagtggccagcgctatatctggatcgagacccagcaatgccttctaccgatgtcatgcctcctggaccatggcctgctcttgttgacgactgtccacctgctccctgccatggccgtcagccctccatggaccaaaagtggtgaggaagggccaatttactggacccaacgtgatcagcataccggtcaaggtcctacccccagcttgctggtggacgaggccacttgaaccccgtactatgggttcccagggccttcagcatcggcgctgtggcttggattgagcaatacttactggtacgcccttgtgcatcttcgctcatttcctccatctccatcgtccctgtcgctggtacaaggaccagaaagcaaagccagactcttatgggacatggtcgagtttgtcaatgcggggtgtgcgttgtgcacggccagtgggggacgaggcaagagtgggttggaactccaggttgacttaggtgcccgtggagacttggccttggtgctgcccgcaaggggggttgagcttggattgcctggtgaatgcgcgccttgtggcatggcgagttgcattggtgaatggaag

SEQ ID NO: 488256 - DNA, 197 bp, Homo sapiens
ccccccccccccccccccggggggggggccccttttaaaggcccccccttttttttgggggggggttttaaaaagggggggcccggggcccccctttttcccttggggggtttttttttctttttttggggggggggggggggccccctaaagggttcccccgggggggattttccccgggttttttttccccccca

SEQ ID NO: 488257 - DNA, 242 bp, Homo sapiens
ggccggctacagctactgatctgagacggtaaggcatagagactaaaatacaaatacctggccggaggcagtggctgatgcctgtaatcccaacactttgggaggccgaggtggatggatcacctgaggtcaggagttcaagaccagcctggccaacatgatgaaaccccatctctactaaaaatacaaaaaaaaaaaacattagccggggcatcgtggcaggcccctgtaatcccagctac

SEQ ID NO: 488258 - DNA, 164 bp, Homo sapiens
tcgtaatagaggatccccctagttctagaaggtaaatagcagcgttttgagaaacagaaagaggtgatcgatgggctaccgaaggaacgaagagtcactgagagaagtgcgtggaggattacctggcaggatcacccaggatggccagaggtaccaatgccctg

SEQ ID NO: 488259 - DNA, 233 bp, Homo sapiens
tcaagatggaaaatctgtcattatcctgtaactcataagtccttttgctggttacaatggacaggcttcctcgtttgggacagaaaaataggtagcagcttgggttgtctagctgtttttcgagtgtcgaagatcatcaaggttacatagctttgtcccctgatattttttgttgaacagcagattaatgcatcttcttagtgaagttattggccttgcctctattcccttga

SEQ ID NO: 488260 - DNA, 338 bp, Homo sapiens
gtccattaggcgcgtctgcgtgcaggaggcacgtaatgtttagaaagagaagtggaggccgggcgcggtggctcacgtctgtaatcccagcactttgggagactaaggcgggcatatcacgaggtcaggagttcgagaccagactggccaacatagtgaaaccccatctccactaaaaatacaaaaattaaccaggcgtggtggtggtgggcgcctgtaatcccagctacttgggaggctgaggcaggagaatcgcttgaccagggaggcggaggttgcagtgagccgagatcacgccactgcactccagcctgggcaacagagtgagactccatctc

SEQ ID NO: 488261 - DNA, 978 bp, Homo sapiens
  misc_feature (29)..(29): n is a, c, g, or t
atacactagccacagacgttgaccctatnaatgtcggtcctctctttatagtccttgcccatcgcttattccgctatgccctgtccccccccgtgggtccaatagggggccacaacatttagaatattggtttgatacaaaccccaacacatttgtcccccctttgataatacacattacggaccccttctgggaatatccccttatgtgcgaataaattttactcatgctacgtggttccttggactaactagcgcttgtcttcgcactgattcatattggttacaactcacgtaatttcaatccttttgtgccaccctttttgggcgcctcaaacccctaggttgtcccccgcccaaaattaattttataattgtcctcccccttaactaatactcgaggtgattgatttctccctaatctagaccttctctagttcgcttgctgccttcgagttccaatgttagtctcataaccccgccctcttcctaaaggtcttctagactactgtaaatcactcaccctactaagcgactgtatttaggtactttgtcaactcccaacttctgtcctttacgcttctactcgtatcatcactccctcctcgtgctctaaaaccccccttggaggaaccgagtctagtagggctacgccgcgtcttctctgggtgtcgcaaggtctggctgtcctgactagtcacggcgcatcggccaacaaatgtgtgcctcggcagaggatttcgcgctgtttcacaatatgtttcccgcggactcccccatagtggggggtcccatcccgcctcccctcccgctcagtcgactctcacgcatggcattacgctccctgctgtatgcgcactcactggagggtcgctcgcacgcctgcttagtgtttaaggtcacctcctacgcccgccgattattggtccagttctcccaccccccaaaactaaccacgggtcttcccttctacaaaaca

SEQ ID NO: 488262 - DNA, 199 bp, Homo sapiens
aagtggtggccctccgacgcctgctatcaccacacttacttgatgtcatcatataatggcaggttatacatagacagcaggtcaggtccaccactgaacacgttggcagtggaggacacggagaggccatgaccagtgacgcttcccgtatcagctcaggtgatgaccttagcccacagaccttggacagcgccaggga

SEQ ID NO: 488263 - DNA, 798 bp, Homo sapiens
gtgtcagcaagctccgcgccgatccctgacgcctgacgcctgtccccggcccggcatgatgcctgctacctgctgcctgctgtcggcgctgggcacggtagcaggctgccgccgttgctgctcaatggactatgtcaccgtgtggggcttgccccagcaaggccaccatccctgggaagacggtcatcgtgacgggtgccaacacaggcatctgggaagcagaccgccttggaacttggccaggagacggaggcaacatcatcctggcctgcctgagacatggagaatgtgttgaggccggcatgcaaaacggacatccgcggtgggagaccctcaaattcaccatgtcaaactgcccggccacctggactttgggctttccctcaaggtctatacctgagacgttctgcaagcaaatatcatttgacccaaggcaggacgcgacgtggcaccattttctaattcaacatacgcgcggttcgtgcatgccgtgctgaccccccacttggatccacctgtattgactggcttccgacgattgcacgtttgcgccgtataacccaacgctatggggatcacctattaacttctatgaccaaaacttgtgctggctggaaccaaagcctggaaacgagcccctacagccaccccgttatcgcgcgggaaatccactccaaaccctcctcggatacccccttgtgtcccaaattggtatgcacagcggcccacacttcagaacatgtggaaccgaaccgtttggtacaccttggccaagaccgatagcaaacggtatcttaa

SEQ ID NO: 488264 - DNA, 477 bp, Homo sapiens
atgattttaagaattagcgttgtacactgttaccccgggaagccgtcatcctataattattattattattactattattattttttgagacggagtctcgctctatctccccaggctggagtctcgctctatctccccaggctggagtgtagtggcacaatctcagctcactggaacctctgccttttgggttcaagcaattctcctgcttcaagctctagagtagctggattacaggtgcacgcccagctaatttttggtatatatagtagagacagggttttgccacgttggccaggctggtgtgaaactcctgacctcaggcagtccacctgcctcggcctcccaaagtgctaggattacaggcatgagccactgtgcccagcctgtttttaaatagtaaatatgaatataaattatatgcctaaactgagatatgagtgttataattttaacattaatgtaagatcagactga

SEQ ID NO: 488265 - DNA, 696 bp, Homo sapiens
  misc_feature (515)..(515): n is a, c, g, or t
ggcgatgtcctaccgcagagcacatagtgtgctgatacttaaagagaggagagctctgccgtcataatgtagtcgtcatcatcgtcgttgtgggccgcgcagcgcgtcctccgtgtggtcaccacctcgtgtgtgagagaacatgataacagccgcccttcgcgtagaagagagcatcgtggcagcccacctcagcgcgcaccagcagatagtaagctgatcatgtataagattaaatatgcgcgcgccacctctctcatcttcgtggtgtactctttcgcctgttgaggaaacaccctctgagggccccacacgtttattaaattatatcagtctcccggatgaaactttgtctcttctccctctctctctctatatataaagaagattatatgggtgagaaatatcaacctatgtttgtgcgtaggagagatctctatataagagaagataatagaaagatatatagatatacccgcctcctttatgagtcgtcgctgtgagtgaatctcgcnctcacacaacgcgtggtctatatacgtgtcttatagtttgcacgcccttttcacgggcgcgacaagataaatgttgtgttagatcatgctgtggcatggtttccatgctgataagccatatgagaatcacgacaattgtactgtgtggtgttctccgccccatcaatagatacaagaagat

SEQ ID NO: 488266 - DNA, 983 bp, Homo sapiens
acgaggacaggatccagtgaggagtgagttgcagagatctattaatgagatgaagtcggtcggaagaaatgtcataatatgttttcatagctctggaattcagcacctagcctccaaaagccaaacagtcccaaatccgaagggaatgacatgattcgagaggcgcaaaagagctagaactggttaggagataatgtgtggatgagatatagaacactacgtttaggctgtaggcggcgccccacacttgacgaggcacgccaccattggagctaggtaccgagattttggggaaccgtactacagtatgtgacactctcgggcaattcttcaagtgttcacgactggtacacaggagtacttgaaaataacctggtgatgccctggttaatcaaaactggtaggtgcatagcagagggcatgtggtcagtggattccgagcgtttcttcactggtgttaacccatatgccttatccaatgtagctctactgggatccaggtagtgatgttcgagcagagtgataagtagtcggcatccaggtaaatacaacaatggcatggtgattggtagtcagcgttgctgtgtggcagcaatccgagtagttgcacgagacgtctactctgaattcgtctacgggtcagaatcatatgatttcccagaagtggtgtatcccgttcgccctacaatggtcatattggatgcagaatggcgttttgactagctttacttagacgatagcaaggtgactaaatccccaatagcggtggtttccttcagcgtacgagcgattaaggaatgacactggggtgtgcccatgatgggcagttgccgagaaatttgccctggaaagaaagcttgcaaaattgggcccactccttgacaaagccaacgaactcattggagatttaccagtaacagggacttacattcttcaggataagccttcgggacaattgagtaagtggaaaggccaaggcaaca

SEQ ID NO: 488267 - DNA, 165 bp, Homo sapiens
  misc_feature (56)..(56): n is a, c, g, or t
ctgcggtgatctcacaggcatcccggccagcagccatcttcaaccacaggcacgtngtgggggcctcaaggtctccacatcacacagtcagcaacacaccaacacattggtggtccatctcttccacacagcacatcgcagcagggtcaccggcagctcgcacat

SEQ ID NO: 488268 - DNA, 325 bp, Homo sapiens
tcccgattacgaagaccctggaagtcacgctgtagaactaagacctaatcgaacaggacatcgtgaccccacttacatgaacaggggcaagataaggccacaaccagcatctcacgtgtttgactccagggtctccagcagcaggagcggaatggtcttgcagtgctcctcccagacaccaaggctgtctacccgcgtgatcttaagcagctccagaagggctcccttccgttcctccactcgctcaatgtgattggacagctcttccagaaggtcagccaccaggtcagaatggacgatgggcacgtctcgaagctgctccatg

SEQ ID NO: 488269 - DNA, 251 bp, Homo sapiens
ttcctccctgacattatttataaaagcatacactgaaacttatcaaaagatgggagcagcatgatcaacatagtgagaacccatctctacaaaacattttttagaaactagcagggtgggccaggcgtggtggctcacacctgtaattccaacactttgggaggccaaggcgggtggatcacttgaacccgggaggcggaggttgcattgagctgagatcgcaacactgcactccatcctggtgacagagc

SEQ ID NO: 488270 - DNA, 237 bp, Homo sapiens
gttctagaggatcccgtgtgttgccgtggcttgtggagttgcgtgcttggattaccgggccttggtgctgagcgagatgaggcagcctatggggagctcagggccatggtgctggacctgagggccttctatgcttgagctttatcatatcatcagcagcaacctggagaaaaattgtcaaccccaaagtgtgacagaaaagccatctactgtactagaacccgtgtacattgggta

SEQ ID NO: 488271 - DNA, 89 bp, Homo sapiens
ccttcctttttccccccctactgcggcccctccgggcctgttgctatagggcctccctgtttgtcaattacccccaggtggggccccca

SEQ ID NO: 488272 - DNA, 793 bp, Homo sapiens
ggcggacattcaggactgagcgtgcctaccaaaagcagccgaccatctttcaaaacaatgaagagggtcctgtcgtgtggagaaagctggcaagggatgaagctcccgacggtactacaagaagcatcggtctgggcttcaagacaccacaaggtaggtgcggcggaacctcagcaagacaagaaggggaacctggcagttcctgcaacgtgtgcgcacgacgagttgccctgcctgcatctaagtggcattctgggagctgctgggaattggtagattgcttaccctgaggccacgcccctggctcttttaaggaaccagcccgtaccaaggctcactcctttagtctttcctatcctttcaggctattgagggcacctacattgacaagaaagtgccccttcactggtaagtgtgtccattcgagggcggatccatctctggcgtggtgaccaagatgaagatgcggaggaccatggtcatccgccgagacgtatctgcactacatccgcaagtacaaaccgcttcgagaagcgccacaagaacatgtctgtaccacctgtccccgcctgcttcagggcacggtccagattcggtgacatctgtcacagttgggctgagtgccgtggctctgagcaagacagtgcgcttcaacgtgctcaaggtcaccaagggttgccggaacaagaacgcaggacgcagaaagttctgagggctggaccatcgggtcgcgctacccaataatgaaactaaagttaattactctcattcccaaaacaaactaatacaacag

SEQ ID NO: 488273 - DNA, 195 bp, Homo sapiens
cacgaggactacctctcaattcaggaaatatttctgttcaagacagctcatccatctgataatttgtcacctgttagcatcaagtatgccatgtacttcatacggcttatcagcacaccaggattggcctcaacatcaacactcagcacagacaatacagctatcttcacagaaacaggagacatctttgtctgg

SEQ ID NO: 488274 - DNA, 303 bp, Homo sapiens
  misc_feature (1)..(1): n is a, c, g, or t
  misc_feature (13)..(13): n is a, c, g, or t
ntcgttgttatcnccttccttgccaatgagacgccctacaaagttattatgggccaggatcttcaggggaacctcgtcagcccttgggaagacaaaggaagaagtggaagacaagagttccttcaattgtgggcttcatgaagactcaatcaccatgccaccccagacttggcatttccaagtaaaacatctcaaaacttatcaaactgcatactttaaaaatatgtatgatttattatacatcaattgaacatcaataaagccatggcctcgttggcctcagcggtggagctctgctggccg

SEQ ID NO: 488275 - DNA, 808 bp, Homo sapiens
gagcagtactgcggctcctctcctctcctaagcctcggctctcgcggctacctttacccgcgcgcctgctcggcgagcagaacaccttccaccaggaccacctcagtcaagttccgcacgttgaaataaaggcatcgaagcaggtgtacatgtcgccgtgccgtcagggggtgagaaagtccaggccatgtattatctgtgatcgagggtacttggagaaggacgtgcgctgcaagacgccggagccttgtgacagtgagccctaatgtgtgtggaagatgttgccatgagtggagatctcagagtggctcacagtacgtttacacgtcgtgacgggttaccaatcagtgacatgtatcgtcgtgcctgcatgctcattgttgtcgggatgctcgcttccgtaaggagcccgtaagcaagtctgtgtgttatgtgaagttcttcaagtacaaatcgaaggcctgcagagaccaatttgaggtcacagccgtaaacggagtaatggacatggtgagcaagcagcagccctggttaggatggagcaggagtataccctcatggggacagatgggcacgccccttgggttggcttccaaacggccttcccagggcccccagggtccatatcaccgtggtgtgggagcgtgacaaagcctagtggcagggagcatagtggatggccaataaccggggctggttgatgcgggcagccagaaggcgggaccaagccgagggaagacggccaaaggaaatccaatggcgctgtaggagaaccacgggagcctcggggggccgcactccaacgggc

SEQ ID NO: 488276 - DNA, 1077 bp, Homo sapiens
gcgccatactcgacgctcggtatggcgtcgctcaccgttgaaggcctatgcttctggggcgagagaggactgcggcgtcgcgagattcagctcggctgtcagtgtctcctgctcgcatgccccgagtcctgcaggcggaggggcctgtaaggactgcggccgagtgtcctgagagactcgcgtagcgaagtcaggcgtgcgtggatgccctggtgtgggccaggtcactgattcctcgcgcgtctgccgggggcatggcaggcattcgcaaggtcagcacttacacgtcgatgaggacgagggtacttggtcgcactttgcccgagtgacggatggagcattggttccattgggcccactgtcgcttatcaggtcggaagggctggacaaatctttcgagacctctaccagttacaggacggaagattcagagtgctctcgggcgggaccgacctcagacacaaggtccgtggttgctcatgggagtgcagccccgggaatactagtggttgcaaccccggcgaaatggtgactccagcgaagtgtgcttgccaagtggggcctcgatgtagttagggacaccctggatagcaaggtgcatgggttcatggccaggagcgtacgagctttgatgtagccgcttatgcgacggcgaaagtggtgcttgcaacctgggggcacaccatgaggcttcggcaattactcgccaggccccctttccgcggcacccttgatcttgcagggcttcatctgcaacaggcctgcatgggctccggaaaagggtgaaacactgggacacgttcgggctggccagggatgggaacactgggggtccatcgagtgaacacttggatccgccagcgtcctacctccgtgcaggggcgaaggccccgcacctttgggcaccacacgggaggacatccagttctggtccatccggacgcgatcccggagtgtgaactttccctgaaggaaccgtcagggcacgcagttgtgacaggtgcacgcataacccctactggagctagaatgatagcaaactcgacaggtggaccaggggtatgaaaagtgaggcgc

SEQ ID NO: 488277 - DNA, 310 bp, Homo sapiens
  misc_feature (30)..(30): n is a, c, g, or t
  misc_feature (96)..(96): n is a, c, g, or t
  misc_feature (99)..(100): n is a, c, g, or t
  misc_feature (104)..(104): n is a, c, g, or t
  misc_feature (114)..(114): n is a, c, g, or t
  misc_feature (117)..(118): n is a, c, g, or t
  misc_feature (147)..(147): n is a, c, g, or t
  misc_feature (167)..(167): n is a, c, g, or t
  misc_feature (182)..(182): n is a, c, g, or t
  misc_feature (184)..(184): n is a, c, g, or t
  misc_feature (193)..(193): n is a, c, g, or t
  misc_feature (212)..(212): n is a, c, g, or t
  misc_feature (218)..(218): n is a, c, g, or t
  misc_feature (221)..(222): n is a, c, g, or t
  misc_feature (310)..(310): n is a, c, g, or t
aaatgttttaaatgtgtggaaaaatgctanatctacacttggttggcttaatcaacctcttcaatggtgggccctgaggaagcaccaccagagggnggnnctcnaccaccaggnaannccccaggcattcctcctggcatgcctccngcactctggtacagcttggngatgatggggttgcnanctttctccngctctttctgttgatgttnaaattnttnnttctcggcagtctgattcttatcaagccagttgataatttcattacacttgtccagaatcttctgtttgtcctcatcgttaatcttgn

SEQ ID NO: 488278 - DNA, 387 bp, Homo sapiens
  misc_feature (10)..(10): n is a, c, g, or t
  misc_feature (12)..(12): n is a, c, g, or t
  misc_feature (229)..(229): n is a, c, g, or t
  misc_feature (258)..(258): n is a, c, g, or t
  misc_feature (300)..(300): n is a, c, g, or t
  misc_feature (322)..(322): n is a, c, g, or t
  misc_feature (356)..(356): n is a, c, g, or t
  misc_feature (387)..(387): n is a, c, g, or t
gggcaaggcnanccacaagctggacgcggacctggtcttcgtcggctacggcaccgtggcgccggaagaaggcggctggaacgacttcaagggcatgaacctgaagggcaaggtgctggtgatgatggtgaacgacccgctgccgaccgcgacggagccgaaccgcttcaacggcgagggcctgacctactacggccgctggacctataaattcgaggaaagcggcgcnccaagggcgccggctgccaatcccttgantccacaccgacaaagtcggcctcgtacggctggagcgttgtncagaacagctgggccaactccnagcgcttccagctcaccgaagcaaagtgggcacnggcctgcagggttggatgaccgatgacaccn

SEQ ID NO: 488279 - DNA, 571 bp, Homo sapiens
tgcataattagcatttaacaagagaattacacactcagtttgtagatattatatcacacttacgctggtaaaatagcatgtctgaaggtaacttcaattctgcagtgaatgtgtagccgatagctccagtctagggttgggaaatactaaaatactgatggatactgtgagagacatacccaataaggtactgactctttacttctaatgagaaccactcaactaaacaaaaccataaaattatatctatatattaaacaaagttctaaagctaacatgtgttaagtttacataagaacacttgaggacttcatatatcatgccacatgaccaagttactgacaagatcacttgtagatgaggtccttacataaatccatttgcctgaagttcaagatagactccccttacactatactgatttaaaaattcagtaacatctgcccatggcggcagacaatgctatatgaaccacttgaccagtgtacaaaaacctagtaaatcataaaggtttatcatacaacatttatcaggcatttcctgtgatcatctatatcagataacaaaagag

SEQ ID NO: 488280 - DNA, 173 bp, Homo sapiens
aggacctgtgcaacgaggaagtattccccaaggacatcactaagtggaactcaaatgacctcatggacaaaatggagaatccagagcctgaggacccacaggacggtatataccaccagagtagccctgagttcagggtggcctccagtgtggagcagctgaacatcatcgag

SEQ ID NO: 488281 - DNA, 174 bp, Homo sapiens
  misc_feature (2)..(2): n is a, c, g, or t
tngctgatgcttctcacggcatcacttgacagcaacactcctgagggagctggttgaggaagggcagacatccggtgagctgcggagagctcatggaaggcgagtgggaacccggctgcctgccttttttttttttttttttttttttttttttttttttataaaaaaaaaatt

SEQ ID NO: 488282 - DNA, 386 bp, Homo sapiens
cccgatgcggccagtgctgcgcccgctctccaggctggacaggaagcacggcagcatctactcggcttctgaggcgtcctcaggaaacctacaatcaaggtggaaggcgacaggggaagcagacatgttttatgtggctggaggaagaggaagagaagtggggggaggtgccacacacttaaacaaccaggtctcttgagaactccatcacaacagcaccacgaggatggtgctaaaccattcatgaaggatccaccaccacagtccagtcaccttccaccaggctccacctccaacactgggggttacaatttgaaatgagatttggtagggacacagaaccaaaccatatcagacagttcttaaaaatctttttcaatttaaaa

SEQ ID NO: 488283 - DNA, 108 bp, Homo sapiens
tcttaaggtggactcgtaatggttaccaatttaacatagtcctgcagaggatttatactgtgaacctgagagggcaagcgggtttccacatgttgctgctaccttatg

SEQ ID NO: 488284 - DNA, 307 bp, Homo sapiens
attctttcttcagttcagctgtatcatttagtggatataacatctcttgtggattatatgtacactacttgatattcagcactattcaggcatcttccatcttcctcactttgtacttaatctctttccaccctccattcagtctggacatcctgggatccctgctctgacccattttaagtccgtcgcattaatctttctctaacctcccattctgttgactccaccaattgcttcaaatctttttccaacaaagctttctgggcagcaccaaatactccagttcttatttgctatgttctcactc

SEQ ID NO: 488285 - DNA, 127 bp, Homo sapiens
cgctcgcgctcgttcccctacggcgacgacggtggactcacggacgaccgacgtgtgggcgcacttacacgggggcaacgggaccgacgctggccccggtcactcgtctgactcctgacttcttcat

SEQ ID NO: 488286 - DNA, 316 bp, Homo sapiens
gatcgtctcatgggcggcatgtagggatctccaggagcatgcagacacaggtagaacactcagcagctcaggttgatgtgcagtggaaggggactgacggcgccgtccaccttctcctgctcctggttgcgctcctgcaggctgcgcagaaggagggcctggccaaaaagctcctcggctcggccactcgactggatgtccagcagggcgttgtgtgcgtccttggtcaggccttgggggaagggcacagatgcccagttgcaccatgggtggggttgtaaaggatctgcactggggggtctgcatgctgaatgtt

SEQ ID NO: 488287 - DNA, 159 bp, Homo sapiens
  misc_feature (102)..(102): n is a, c, g, or t
  misc_feature (108)..(108): n is a, c, g, or t
  misc_feature (140)..(140): n is a, c, g, or t
agctcggtaccagcataacgccattatagctaaaaatgctaacaatcatctcagcaaggctcagcaagtcataatctttttgatggtggagggtctggcttngatgtngatggttgctgactaatcacaggatggtagtngctggaggccacggaggct

SEQ ID NO: 488288 - DNA, 310 bp, Homo sapiens
tctgcgagatttagcaggaagttcctgtgataattgggggaacggtaatgtgcattctcaaaatgggaaccagattcttccaagaaaggaatgacagttaagaaccttatgatgcagagattattaaaggtgcaaagaagttccagctgatagacaatctactttttgttcttgatactgataacgtgctgagtttatgggatatttacattctaactcctgtatggaactggccctctcttcacgtagaagagtttcttcttactacagaagcagactctccttcatcagtcacgtggcaaggaattac

SEQ ID NO: 488289 - DNA, 869 bp, Homo sapiens
aatctcaggagctgtggacttaaccaatagcaaagctaccactgtacttttctcagcagtatctctggcaagtcagcaggtgttagtatggttgcaaagttcacttgtcatcagcaaagttgaactgggctgctctctctacagctgtttcctcagagggaccaaatcttgagaccagatggtggagctctggagtctgaggacatgggtgtcttgcatcacaaacgtctgcttgctgtgaccttcgagaccacttctgacatcctggacataccgagcctggagatgtgtcgtgtgttgatctcagaatcgaaatcactttgatggagataacgtaagtcaaatactgtattgatagtcatgtgattttggctgagcaacagtaaatggaaaagtggccgttgaaggacttctcattttcggagctgttccttccagagtcctggtctgatggtgtgcgctgttacatctgagcccccaaaagtcataattacgtgatactggtcgcaacagtgcaaaaagcgcagactggatggatggtcgctatcaaggcattaagggtacactactgtgttcactgaccatacattttttcttagccctcgagtaatatagcacagagttgtgacatgaaattcccctaaaccattgcctcgtcagaatttggctcttccccttacatccgaaatttgcgaacggtctaaggccctgcgaacaattgggctggcctgtcagactcgtaccgtgcgcttgaagccatctgacctcataaaacttttcagatgaatggtcttatttgccgatgggggaccaactcattactggccggtcactccttctcactctaggggaaccccaggtaaatgtgc

SEQ ID NO: 488290 - DNA, 361 bp, Homo sapiens
gaaatgaggagcatgactaacaattctccgaacatgtttcaaaaaagaagtgtattgtatgcataggcataacagttctttcctttgtaaaagagatgtcgtacttccagaaagacagatatatctatatagacatagggatgtgtgtgtctatacatatacatacacatacagttgcaaatacacatataaatgtcatgaaggatgcagttcgaaaataatcttatgttgccgggcacagtggcctcactcctgtaatctcagcactttgggagggtaattttagattgctcataaggaaaacggtatagttccctgacactcgcatatagtctaaaatactgattaaagggaaaaaaat

SEQ ID NO: 488291 - DNA, 109 bp, Homo sapiens
tttgaactatttgcaattaggagaacacatgtaccgctttcggccaggggtcggtggctcacgcctgtgaagccagtcacttgggtgaggccaaggcgacgaggctcac

SEQ ID NO: 488292 - DNA, 728 bp, Homo sapiens
  misc_feature (7)..(7): n is a, c, g, or t
ggctggnagaggaaaccgggagaggggtccagtgaacatttgtcttaaagggaatcatttgtgtaggacgcatttttcatgataatctaagtagggcactttctcggtccactcttgatgaagcgctgattaattactgggtataacctaggatggcgattctacagttgttatagtggggttcttgcaactggccgtccgcacagagaagacgagaaaacctgcatgttaggtgatagtattaatggacacctaactttttgctaattcagtgtatttttgccccttttaggaagtatgctacatttctggtagcttactagtatttccctggtgttgttttgatttggtacgtctttcgggaacgccgatggaaatacattattatacaaccattttctattggagcggtggctattgtcacataacgaccatataattctagatccccacgacgcaaatctatgtgtcaagaaaacaaaaagtcaccaatgaacttttaacaacttactgtcggtggattaggtcgaacaaacaggcatagcggtttatccaggatacgtccgtggacggcacaggctcgcggatgccttatttttactagcgcctccaccttctctgggaacccgttaacaatagattaggcactttctcccttaagcctccttcggctttagatttcgcctttattgacatcgcacaggaggcatttaagtgattaaacaggg

SEQ ID NO: 488293 - DNA, 277 bp, Homo sapiens
gaaaaaatagggggggtttaattttttttttaaaagatggctcccccgggaatttttggaaaggattccaaaaaatatgggttggatatgtcccaaggtctttttttttaaagccccttggatataaaaatttgggtttttttttttggagggcgggccatttttgttcctttgtggaatgtgttgcctggaccccagggtttggggttttttaattttttttgcctcctgatgatggaaaaagttgggttaattaaaattatttaatgggccggga

SEQ ID NO: 488294 - DNA, 321 bp, Homo sapiens
ttaccatttgagcttccagattgaagtcgggcacgcttacgactcaggaaattgatgtacagttggagtccgaagacaggggaagatccacgtatcagatcatgcagtcaggtggatattccctcttactcagccattttgctctctttacgatctctgtgagctggatgaggtctcgtccttggggaggccccctgctttactaagtccaccaattcacatgccagtgtcatccagaaacaccctacgcacatgcccagaataatgtttggctaaatctctgggtaccctgtggcccagccaagttgaaacacgaaatta

SEQ ID NO: 488295 - DNA, 123 bp, Homo sapiens
taaaagtagatcaaatcagagattgacagcctgtggagggtgcctgaactatacagaattaacacaactatggcgttattttttgtacatactgctcagaataaaaacacttgaaatgtgaaa

SEQ ID NO: 488296 - DNA, 528 bp, Homo sapiens
tccgtttcacagggctataagaacatattatatttctgtttaaaatatgcaaagtataaccattaaatatgtaaacagtacactattaataaaaccatatttaaaagtgattttcagaaagttcagtactgtagactgaattcacaactctccagccatagctagccatgcctcagtttttatgcactactgtctacgtgatatctgcatgtagatattgtacaagaatcttcagtacattcaccatgaaattttcgattttaaccccaaaacttatttcttcctgtttgcctaagtcagtgcattactccaccacatacccaatagctcattccagaaccttggaggttttgtgtgattcctccccgtccctcaactccatctccagtgaggggtaagcccagtagattttacttcctaaaaatatctagaatctgtccacttctctccctctccattgccactgcctgagaatccgcactcaccttgttatagaaccacccaagaaactgcctacttgctgttttg

SEQ ID NO: 488297 - DNA, 125 bp, Homo sapiens
gtggggggcaccgaggttcccggacccgggtccaggtatgctcccagcgtccaccgtgccccagtcgaccacctctgtctagttccagacacctccacgcccagcgtggtctctcccatcgcccg

SEQ ID NO: 488298 - DNA, 242 bp, Homo sapiens
tgagtacccgttctacggtcatatgctctcccttctgcagcccaggccctgatggacagcatgggtgaagctagtgtggttagtgctgtgagcacttgctggtccacctagtcctcgtggcactcccaggagagaggggtgctgctggcacacctagcagcaagggagacaagggtgaacctggtctcagaggtcaaattggtaaccctggcagagattgtgctcgtggtgctcctggtgct

SEQ ID NO: 488299 - DNA, 221 bp, Homo sapiens
taggtgttgttatgcaggatcctcagccatgtacacgtgaagtaagcctgagccagtgctgtggactggtgccatgggagtgcctagtacaaatgtccccctgtgtcccacagctatactcctggcgccggaactgactctggtcttgatcgcattaagccctgatggcgccggtggcgcggtgggcatggttcttcaatgagcgccggctctccttttct

SEQ ID NO: 488300 - DNA, 133 bp, Homo sapiens
ccagttacaaagcttatatgacccccagctttaaggaaataaaccagtcaccaatatccaaattgcatgaagaggaaccacctcagaatatgaataccacaagtcaggaagacgactaagccagttatcaaag

SEQ ID NO: 488301 - DNA, 418 bp, Homo sapiens
  misc_feature (14)..(14): n is a, c, g, or t
  misc_feature (42)..(42): n is a, c, g, or t
ttttaaaaacttcnatttggaatcaaaccttgttgtgaattncccaaagtccttttttaagcatcccctgatttttggtgcctaagcctacattaaaatttccccaacatgtagatctttcaagttttgcccttcctaaaatgcatcatttgggcccctggtgcagtgcctcatgccctgtaatccccagcactttgggaggccgaggtgggtggatcacttgaggcccaggagttcaaaatcagcctggccaacatgggaaaccccactctactaaaaatacaaacattagccaggcatggtggtacaagcctgtaatactagctacttgggaggttgaggtgggaggttgaggctgtagtgagccatgatcatgccactgcactccagcctgggagacagagccagaccctgtctt

SEQ ID NO: 488302 - DNA, 132 bp, Homo sapiens
  misc_feature (44)..(44): n is a, c, g, or t
aggctgcagtagccatgattgtgccactgcgctcaagcctgagntgacagagtgacatcctgtctgcaaaaagtttaaaaaaccaaagaaatagaaaggtggagggttaggattgctataggaaaggggtcc

SEQ ID NO: 488303 - DNA, 224 bp, Homo sapiens
aaatactaaacataaaacctctaagtaaacatgtacctttatacttcccatcaaaaatgcataacaagatcatgctatatagatagacagacacaagaaaaaaaagacaatttatactagcactatttaagtcttgcagtcgcagtgctcacacactccgcagctgtatctagttaacctatttcaatcagcattcatatcatgtgcacatagtcacacaatta

SEQ ID NO: 488304 - DNA, 417 bp, Homo sapiens
ggaatttggaaattggaggggacgctggtggacggattgggtgcaaggagttggtgttgcatgtgaggagcaggacgccagagtcccagccctggaaccgtctcagagtggagcaggcaccacctgtaatctactatgtccctgacttcatctccaaacgaacgaggaggagtatttgcttcgacaggtttcttaatgccccaaagccaagagtggacccagtctctctgcggcagacacacgttacagatactgggcgtgcggcttccctcatccccgacgggactggttcctgcagcggctgcccccatggttccagcgctacgtggacaagtgtcagacctcaccctctttggacgcctcccagtctgtccatgtcctcgtgaaccagtatctgcctggggagggcatcatgcc

SEQ ID NO: 488305 - DNA, 331 bp, Homo sapiens
cacaaggaggatgtgttttagaacctgccccctaaaaacaaaagggaggagaaagttaaaaaacaccggtcagcaaacaaggaaaaaagcaagggttccctccaaaggaagtgaacggtgctgtcctcaggtggccatgcctcagccctgaccctgtggaagcattttgcgatgggcagactcccaacctgaacctaggagggccccctttttttgtaatttaaatgggtgcatcccccccccctttccctgaccctgtatatagcccagccaggccccaggcagggcccacccttttccttttgtaaataaagccctggggtccctgtga

SEQ ID NO: 488306 - DNA, 317 bp, Homo sapiens
gccctgtggtacacaactagggtcagttttgcaggtggtaaagccatttacgatagttgtaggtaaagaagggagatttattagagaaatgtgaaaatatgttgcagtgggcagctcagcagagaaggggctacctgcaaagaggcaagggctggaggaaagttttatagggtcctgctgaagggtgctacgtgtggaatgaggtcattgtgcccgcaggttgttcgtgattagctgtctctaacaattgttcatacaataattgttcattattgttctcaacttggggctctccccaacctggggacccttcctta

SEQ ID NO: 488307 - DNA, 135 bp, Homo sapiens
ccgttagtctaaggactccctatggaactctgggttccagtgccagtgtttcgaaggtgattatgaagaagctggtagcaccatcctgaaaagttttgggtaaagctcctaataacattgtaaactctggggtat

SEQ ID NO: 488308 - DNA, 347 bp, Homo sapiens
atcaacagtgcaggtgtttgaagtgggagccagtgaacaaggtgaacctggcaagagctgtcaagggcaagaagggtgtgctgtttggagtcctggggccttcacccctagatgttccaagacacacctgccagggtttgtggagcaggctgaggctctgaaggccaagggagtcatcgtggtggcctgtgtgagtagtagatgatgccatgtgtagacaagcgagtggggtagagccaaggaggcgtcaggcatggtacggctcctggctgatcccacgtgggcctttgggacggagacagacttataactagatgattcgctggtgtccatcttttgggaatcga

SEQ ID NO: 488309 - DNA, 682 bp, Homo sapiens
gtcagcctcatccaagtagaacaaacagagcttcagcaagaacagcttcaaacagaggttggcacttagcatggttccccagcaccagtcccatcaagtgactggtaaccagcatgagcctcctcagcagaacactggatttccacgtaagctatcagcgcctattacaatagtcgtggtgtgtctcgtggagtgctcccgtggtgctacgcaggcttgatggaatggcataccggggccctgccagtggcatctcagaggaggatatgatggttaccgtccttcattctctacacactccaaacagtggttatacacagtctcagtctcagtgctccccgggattactctggctatcaacgggatgagactatcagcaggaaatttcaagcgaggctctgggcaaagtggagccacggggagccccacgaggtcgtggaggagcccccaagagccaaccagagggatgccgcgaatgaatcactcagacaagtgactcaatctgagttcatcaggatgactgtttaagtcgccatgtaacacagtggccagtgtaccgtaactatgttacccagaaagagtttatccatcatattgtgttctccctgtttcgggcaaacctttatcggtaaaggggactgttttcgtcccagtaatgcactggactacaatcgtcactaca

SEQ ID NO: 488310 - DNA, 537 bp, Homo sapiens
aagaaataataagaatattcacaaatttggcaagagaatcaactttcagattcaagaagctgagtgaaccccaaaaaggataaagccaaagatatatgttccatgacacataattaaacttctaaaaactaaaaaaaaaaaaaaaaaattcttgacagcagcaagaaagaaatcataccttagctatagggtaaaacaattggaatgatagtagatttctcatctgaaaccataaaggttagaaggaagtggcaaaatatttttcaagtgctgaaaaaataattgtcaacccagaatcccatgcctggcaaaaaatatcttccaaaaaatgaaaggcaaatcaaggcattctcagatgacgaaaaactaacagactctgacacaagcagagctactctaaaagaatggttaaaggaagttctctaaacaaaaaggaaaaaataaaacaaaagaaaccttagaacatcaggaaagaaacagcagggtaagcaataggaacccctcctgagtttcctgaatcatgtgtgatggttcacg

SEQ ID NO: 488311 - DNA, 299 bp, Homo sapiens
acaggtattctgacaaagcatactgtaaagcacaaaccacccagccttcgttcacattcagcctccaaagaaagaattacgtggggggaaatgtcaggagtgctgaggttaagacaccctgcgttagttataccaaaccactttatttacagagagaaggggactgaaataaatatttgccgaaaaataattgagatgatcacattggctttgagcatatgctagctttttagaatctgtttctttgtctatgaagttataagggtcacttcataggatacagtagggagagggtaccg

SEQ ID NO: 488312 - DNA, 787 bp, Homo sapiens
atcaaaccaacagacagcagcatggtggtgcgcatctgtcatctcaggctggcggagtcggaggccctaatgctggccctgatggtcttattccatggacaaggtttgtaaggaaaatattaatgataaaaatttctccttctggccttggattgacaccatcctagagctcattaagaagcacctgctgtgcctctggaatgatgggtgcattatgggcttcatcagcaaggagcgagaacgcgctctgctcaaggaccagcagccaggacgttcctgcttagattcagtgagagctcccgggaaggggccatcacattcacatgggtggaacggtcccagaacggaggtgaacctgacttccatgccgtggagccctacacgaaaaaagaactttcagctgttactttcccagatattattcgcaactacaaagtcatggctgccgagaacataccagagaatcccctgaagtatctgtaccccaatattgacaaagaccacgcctttgggaagtattattccagaccaaaggaagcaccagaaccgatggagcttgacgaccctaagcgaactggatacatcaagactgagttgatttctgtgtctgaagtccaccttctagacttcagaccacagacaagctgttcccatgtctccagaggagtttgatgaagatgttcccggatagtgggcccgaatttgacagtatgatgagcccggattaaaccgaaatttctcggggggattttttcccatggggatcccttcgggaggggccttaatg

SEQ ID NO: 488313 - DNA, 183 bp, Homo sapiens
tcgtcggcatacatatcgtcagcgtgcaaaaaaccaacgacatcaccagatgcaagcttcaagcctttattgagtgcatcgtagatgccattgtctggctcgctacgcagcatagcgacgtgatccacgtaacgatgcaatatgtccatcgtgcgatctgtagacgctccgtctatgacgatg

SEQ ID NO: 488314 - DNA, 464 bp, Homo sapiens
caaagttcggttcggtctgagggggagagaaggctgcctcggaggggggttttcttcaagatcggggatacgacggccagctgtgtgtgtgatgctcaatatgccccgggctatgccatagtctgggtcatctcagaggtggtcacccctcggttcctttgttctggaggagtgagtccctatgctgtccccaatgcttgcagaggtgattctggcggccccttgatagttcactagagaagtcgtttcgttcgagttggtgtaatctgctggggagtagtggatgtctgcgaagccagtagcggcttaagcaggttcctgctcacgcccgggtctttctcatcggcctctttctagtgctgccctggctgttggagtaactcctgttgtggttttgggttttctataaggggtttcatgctggacaggggagtggaaataaaataaaacaaaaaaaacaacaa

SEQ ID NO: 488315 - DNA, 319 bp, Homo sapiens
acattcagctcggtacccacaccacctgagtcactgtggtgtaacacatggagacatgtagtcagcccactttgttgttgttgttgttttggagatggagtctcactctgccacccaggctggagtgcagtggcacaatctcggcctactgcaacctgtgcctcctgggttcaagcgattcttctgcctcagcctcccaaacagctgggactataggcatgcaccaccatacctggctaatttttgtatttttagtaaagatggggtttcaccatatcggccaggttggtctcgaacccctgacctcgtgatccaccca

SEQ ID NO: 488316 - DNA, 314 bp, Homo sapiens
gtctcgttgcccattcgcttcgtgcgcttcgaggactcccgagatcagaggatgctatttatggcacaaatggttatgattatagccagtgtctgcttcgtgtggaattccccaggacttatggaggtcgtggtgggtggccccggtgttgattgtgtttgcgccaactacaagaagatctgatttccgagttcttgtttcaggtatgttcctttcaaacagaatgagatgatacatgtaaaatacttaacacagagtctgtcttccaagaaatgatagctgttattcttcagtgcatgggacacgaatgttca

SEQ ID NO: 488317 - DNA, 164 bp, Homo sapiens
tgaatatgtcagtcattaaaagcgacaataagcctaaacgtttatgcccctaatgacagagcttcaaaatacatgatacaaaaagtggtagaattgcaaggagagatggacaaattcacaattatagttggagatttcaatacctctttcttaataattgatag

SEQ ID NO: 488318 - DNA, 92 bp, Homo sapiens
cgggtttttttttcccccccccccccccccccccttgggtttttttttggttttgttggggggggatggtttaattaaggggtttttttcca

SEQ ID NO: 488319 - DNA, 575 bp, Homo sapiens
  misc_feature (489)..(489): n is a, c, g, or t
  misc_feature (575)..(575): n is a, c, g, or t
ttgtgggtggtgaggggacgggcaatggggtcagtgtggcttgcagtgtgcctagagcatggcagctccctctcccgcctcctccccaggtggttcagtgctgcagtggtggccatgcatggcccttcagggcccttatcttgtgcctgtgaagtagtgtgtacatggccagcaggcccatgaaggacagggaatagatgccccacacagagagctgatgtccagagtaagagaagccaccctcccagcacctgcagccactggcctctggccccgtccagcgtcgggcctccatgctggccctcagggatgtcgagcatgctgcttggagctgctggcccacgcgccttgacctccaaatgggccccagatggcggttcgttctcaggcccttggacttcatgccagcaattgcaggccccctgttgtctcagcttgctccaagtgccacttgcccagagcggatggctcctgggtgcattcctctgnaagctcatgccatgtcgctcagtgaggctccctgggcctggttgcagctcctgaggccaggggtgcagctacaggggagtcgacgn

SEQ ID NO: 488320 - DNA, 893 bp, Homo sapiens
gagagaacgcgccaggtgggcaaggggaccagagaaagccggggctggaagtcactgtcgctcgccactgtctggagcgcacggagcgcagaggcccggcagccggcgtgccctcaacggggacggagccagtgatgcaggatcgctgagcggagatccgcgccgagaagtctctcggggccggggctgagacgcaatggctttcgagacgatgccaaagacccggattcggggcgactcttgcgggggacccgggggggccaagggttgcccaagctcaggacttggggcgagtctagcaaggatggtttcttaaggcacggacccggttccccttttccgcgcttccctcggattgacgggcaggggatcttgcgccggggcccccggtggcatttcggtttcccccgggggagccccggctgggtgccttcccgcgggaacaggttcgtgcacggccaccagggtgcggcacgggggaggattgtgggcatacggtacaagggcgcgctggcccgccgtgggctttgcctctggcacccttgtgggggcccaggcctatattggtcggggtgtgtttggcccgagggtcgcctctggtaggtttggccctcgtgggccggcaaggggcctctcaacttcgggcgggccggttggccggagattctccggaacgtcttgttgatgtctgtccctggacacggacgtttacggttcactgcgtggcgagcgggtgccagaccttgccggcccagttgcgggctgccgcggcgcaatacggggcccttgtgggggccctgcggagcacagggtggtttgctgggcgacaccaacgtctattcggcgggaggagtcttcccgatagggaggcggaacactgtgagggggctgca

SEQ ID NO: 488321 - DNA, 347 bp, Homo sapiens
ggatccccttaaagctacccgcggaacgtgagctgggattaagaccgtcgtgagacagtgttacttttaccctactggggatgtgttgtcgccatggctaatcctgctcactacgagaggaaccgcaggttcagacatttggtgtatgtgctttggcctgatcgagcccattgtggcgaagcttaccactctgtggagattctgacgtgaacgcctcgtaagatcagaatcctcgcggggcgcatggtagtctttgtaagcctacctcgcgtgcgccagattcttgcttcacccatggtgtgcgcccaactactgcacctccgcattcccagcgctccgggctccta

SEQ ID NO: 488322 - DNA, 360 bp, Homo sapiens
gatccagactctgtcgatgtaggtgtgctcactctgtaaatagtcaacgaagtgaacattgattatttctgttgtatgttatatgtgaacaactttatttatttttttttggaacatggagtatggcccagcgactatctcgaaatggattcacccaaggacaccccttctaaattccggctcggtttcttctcactatgaacaaaaacaagccccctatctcaatatattatcccaaatctctccctcactaaagtgtagccttctcctcactctctcaatattatccatcatagcaggcagtaaaggtgatttaaacccaaccccagttacggcaaaattctaagctatactcctcaa

SEQ ID NO: 488323 - DNA, 743 bp, Homo sapiens
ttggtcccgctggggcagcaggagcagcaggtgcccatcctgggagaagttttgctatcactccccatcacggaggaggggtgcctgtctagagcgcgctgccctgcaggaggagctgcaactgtgcaaggtggctggtgcaggcactgcaggaccaagggtgacccagcagggtgctgaagatggtggtgccctgtgactggatgggggcccagatcgccccgggagccctcacagcagtgaactgccctggatgttgtcgggctgcctgcgagtgattcagtctcaactgggaacctgcaggcatggagctggcgcattgtgctggcccaggagaggcccaagcttgccaagaggacacctcatgcatcacgcgaggcttccttggactccccggcaactcaaggccctgcatggacacgtgccgtggagaacatgcccagcctgaagatgacggtggtggaggtgctaggttggcacggtacacatggttatacaccgcgcattcccacaatgaggctcttggatcaagaccccacaatacaacatgctatgagagaatagaagactagaagagacagccggaaaggggagagccaccagagcccctggagagcattgcccaggctggagtcctgcaggaggcagagaggttagcccaatggccagaggtggatccagaagaacctgaccgcatgagcgaagaggtaagagcaaggattcatggtgtaaattgtcgtgtg

SEQ ID NO: 488324 - DNA, 163 bp, Homo sapiens
gcagagacagggttttgtcatgttgcccaggctggtctcgaactcctaggctcaagcgatccaactgcctcagcctcccaaagtgctgggataacagatgtgagccaccgtgcccggccacagaggcattatttttagcagggtgggcggtggattgtagccc

SEQ ID NO: 488325 - DNA, 172 bp, Homo sapiens
ccgacgaagtcaccatgacggctgtacagggcgacatggggctgctgatggccaccaacaaatgcgccagccagccggtcatgactgcctacggaacgagaagtcatctctatgaccccaagaaccatatcctgccccctagggaccactcgaccatcagcctcgagatgga

SEQ ID NO: 488326 - DNA, 330 bp, Homo sapiens
  misc_feature (257)..(257): n is a, c, g, or t
aagttcttatctgcccattctgaccagctggagtgaggacaaatgacatctcaggcagtgcatgcatgggacttcccccccatccagtttgaccctgaccccactgcatgaggctccctgctttttcagtcttacaggcagggtttgggaggccgcctcgtgactgtcatgtggatgaaccacgagacaggaaaagacttgtttctagatattctgtcctgattgacagtaaattttaaatagacgtctctcttttnttttggtttggagatggagtcccgctctgtggtctgggctggagtgcagtggcgcggtctgggctcactgaaa

SEQ ID NO: 488327 - DNA, 109 bp, Homo sapiens
gccgggaccgattacgctcatagacgggtgtgctcttttagcgtcttaggtagctcgtcgggtttcgggggtcttagcttgggctctccttgccgtctaggagcgtaat

SEQ ID NO: 488328 - DNA, 294 bp, Homo sapiens
agcactgtaggccaggagttcaagaccagcctgggcaacatagtgagaccccccccccatctctacaaaaaaataaaaaaatcttcccgttgctgtatgtggagcccctctagattgtcagtgatagaaaccacttcaaactggctcagccctaaaatagcgatgattttgtggctcacgtaactgaggattccaatgggcacagctggttgcaggccccgctggacccagctctctgctggccccagggcacttgctggcagcttcccacccactgtcagagcctgtcccccc

SEQ ID NO: 488329 - DNA, 304 bp, Homo sapiens
cggcacgaggtttaaaggtttcatcattatgttcaatgggttagtattgtttagggcaggacattaaactagaagggattctataggatgagtgtgatacatcgaaggtaacatattgtaaggcaaaagagcttagaagaaatggagaaaggatagtaaaaggcatgtcagattaaaggttgataacatgaagatattctcaattctatttctgcctatgtttgcttttctggttcaagcatctgctcgaagagacaaaatgtgacatggttcatcactaagagatgaattatttactctcgga

SEQ ID NO: 488330 - DNA, 892 bp, Homo sapiens
  misc_feature (536)..(536): n is a, c, g, or t
tagaggcgttgttcgtagttacgccgctttgcgcctaattactgggcctcccccggggcgccgggtgtgtcgcacgaccagcttgtctctctttggacgccccggtagggcgccccctctccctcagctgcaaaggtccgtggtttttgccaccgcggtcgctttacagggggttccccctccgctccacgacaattgttttggggcgattcttatattttggtgtgtgtctcccccgcaccccgcccatatatctgtcggggggacacccccagcgcgcctctgttacttcgtaggtctcactcttcgtccgccgcggatcgacggctcgctagagtgcctggtgcgcacttttggtgtgagtcacggacgccccctctcctgttctgtcccccgcccgcacgcacgcaggcagcacctcgctcgggtggggacagaaaaggggggttggtggttctctcttcttcggggtgcttagagttcttgtcttttgtttttttgcttttttttggaacatccattgtggggatcatgcngagccgtggggtttgttggccgcatgcgtgtccttttgtccctcccccagccttacttcccgcgggtgtgttgtccccccttgcgttattgccccctttttcccctctgggcaaccaccccccaccaccgcttgggggcccacccccctcctgcctcgtcccgtgtttttccccccccacccccctcttatgatttggggtgggaaagaaggaccgggcagagggggggggacccccccccccccagcgacttttggggggccccccccccattgggttttcacctttcccgggggttttttccccaacacacaaatttttttaaaccaaaccggaaaacccagattttaaattta

SEQ ID NO: 488331 - DNA, 644 bp, Homo sapiens
  misc_feature (28)..(28): n is a, c, g, or t
  misc_feature (606)..(606): n is a, c, g, or t
ctctgggaaagagggagagggggggggnccccccccttccctcctttccaaaagaaaaaaaaaaagacacccccccgcgggtgtgtttgtgtaaacacacccccttttttttttaaaaaacacaccctgctctcccccaacaaaaaaaaaaaaaaaaaaaaacttttttttttttttttaaacaaaaaaaaaaaaggggggggggggggcggcccccccccccccccccacccaaagaaaaaaaaaaaggggggggggtggcgccccccccccacagaaggggggggggggtttttttttttttttggagggggggggcggctccttcttttttaaggggggggggcccctttggggggttttttttttgaaacccccccaaaaagggcgcgcccaaaaaaaccggcccaaaatttttccccgcgggggttttttttaaaaattttaaaaaaacccggggggcccaaaattattattgggggcgcttaaaaaaaaagggtgttttccccaagaaaaatttttggggggggcccttttcccccctttttcacccggggagaaaaccccttttaacacccctctggggttttaaaagagggtaaaaanccacccaaaggtttggtcgccaaattccggggaaggag

SEQ ID NO: 488332 - DNA, 515 bp, Homo sapiens
aacttctaccagggtttgagctctctaggctcatgcacttccaccgtggcctcccagagtgctgggattatgccactttgcccagcctaattaggaagtttataattactgaatgagtattactgatatactgtgtgttgcaccattaggatttgaggtcttgatatagttccaatcatcatttcttatataacttacacagatgtctttccttatcagtgggaatagacgtggtactgaatgtttgagcctgttgtcacacattgattttaatataataagaaattggtacatttttttcataaatcgtacttattttaaatagttacaagggagcagagtttaaatctcgtctatgtgacgacttttgtcatgattcttcactagaagtttgtgatttaaagtttggtgatgaataaattccactatgcgagtggcatggcttcccagttataaaatctcagctcttgagagggcctcagagctaacttctaccccaggtactgtgccttgct

SEQ ID NO: 488333 - DNA, 135 bp, Homo sapiens
  misc_feature (9)..(9): n is a, c, g, or t
  misc_feature (11)..(11): n is a, c, g, or t
  misc_feature (48)..(48): n is a, c, g, or t
attcgttancngctgcaccatgacgggaactccacccctaacagtttnataccaaatcttaccatccatctgatctcagagagacagcaatgaatgatggcttgaagcaaggtcttaattctctgctgatgggag

SEQ ID NO: 488334 - DNA, 145 bp, Homo sapiens
aggggaattaggaattttggctaaaggataaatcaagctagaatgctaatctggatatcttgaagatcttggcttttctaaagtccaagggggtctttcgaggggttcaccaacattgtagatgtaaagattatttataggcagg

SEQ ID NO: 488335 - DNA, 444 bp, Homo sapiens
aatgaagaacaaatcccattaaccccgtcatgtattggaacaaacacttccagtttgtaattcatcttgtatttccttcccacttgtttcttgttaactaactcgccagatcttcctccgtgtcacctggatggtgtatatcttcttcatcttggatgctggttcacatcttcatcctcagtgatgcctcgctgagggtcattgaatatctcccgaagctcatcatgttctaatgagtcatggccctgcctgtgaccagacattcctggagaagagatatccaggccttgattttctgcctcctttgtttcatcttcggcaattatttcccaccgagtactaacagcttcagcatctgtactcagcaatcgtttcacttctttttcaacatctggagattcaatatatttcttctttgctgtcttccggaaccttctcttcctg

SEQ ID NO: 488336 - DNA, 142 bp, Homo sapiens
aggcggccgtggcggcggtggcggcgtttgggccgaggcaggcggcctcagtggccgaggtggctggacgcgtattagggttaggtagggagggagccgcaggcgcagacccacccgccttgatgccccccgcagcctgtgc

SEQ ID NO: 488337 - DNA, 170 bp, Homo sapiens
attgctgtggctcagcagaaggtgatccagactctgacttttgccaggcagcatgcatcttttcccacagcaaaacacatcgcatttcttcctcatcttcttgtacctcctcagagtctgctgctggtggtgggctgtgtgtctcctcatggagcaccagtggctcgggg

SEQ ID NO: 488338 - DNA, 1254 bp, Homo sapiens
ggccagctcgccgctcgctatagtgtcggtcaccgtgaatgcctaccttctgtgcaatgaggacgcggcgcgcgagattcgccgcttcagacttctgctgcagtcccgagcctgaggcggaagccgaggctgctcgcgggtccgcgggacccgtgcgatgcggcatgcattgagaccgggtggccgctcctgttccccgctgctgcggcctggtcggtgttccatggcgcactaccgcgatgagtgactggtggacttggttgctcttttctcagtgactgagtgaatttgagcagagtggccatgttccttactgtgaagggatgaccatcttccggaatctatcagtttaacacgagtacaaccaagccggttgctcggtggcggtgaccacctgccacacccggttgtgctcaagggaaggactgcctccagtcacaacgattgggtaggcagccacccacattgcttggattcttggcggacttgtcgcttcgccaacttggtgggcccttggttcgcataaggggaaaactcccgggcataacaaacggtttgccaaggccggcttcttgacccccaggaacctcaacggacacttttggttggttacggcgaggttcattgcgcgcacagtgcggcacacaaagctgtgtgcctttaggagactccccaggggtgtgtgagggccagtcaacctcaaagaaagccttacgtgcccaattttacgcccccgagagagattctctctctatttcccggtgggcacacaccccttaggttcccttccgacacgcgggcgccttatcctttccggcgacagccaagaggaccccaggacttagggggactttcccccgggagaacgagggggctccgaacagacagccaatctcggtggaactctaaccctttttaccaggggcgtcgttgaggccccaacggggcacatttgggggcggcagacaacttggcgacggggttaccccagccgccgaaggtggaagaacgaggctttggggtgaaaggtcccccccaagagcaggatatccgcatatccgccattccagtggttggccacaagcttggtgggagagaaaggagggcccccctagggcatcgccttcctttttgtggtgaccgcccacgaaaccgggggtagacaagtgagaaagaacataccagacggcgcgcttttttacatttagtggaattcacccaaaattcccgcggggaacgggggggaacaattcc

SEQ ID NO: 488339 - DNA, 173 bp, Homo sapiens
gtaagtcgaatctagagtatccccctaggttacgaaagttctttcactaggaatgttagacattgggacccaactgtcttcaggacttgtaggggtttctcgctgagaaggcccacggttagtctgacgggcttccccttgtatgtaacctgccctatgtctcagagcagtga

SEQ ID NO: 488340 - DNA, 527 bp, Homo sapiens
aaaaaaaaataagggaagaagaagaaaaatttttaaaaaagccctgggggaacgatccaccttcttttcttggtggattggacctcaggagccacctgctggacgcttcccaaaccttgccttgcttacgtgattcccaatagaagacttggaaagacaccgaggttggaggaggaggaagcctgcaatgtgaacacgatggctggagctccggcagccattctggaccaggaggtgacacttgtaagatgggaaaccacatgttgggatggtgaatccaaaagcatgaggagcctgtgtcccctgtgacaccaaaactggcataccagccctgggatcctacatgtatactgccttggtgtgggaaagaaatattgcttggatcttggtaggcggctgttgcaggcaaacacagtccgaactgatgtagactgagcatgatgacatggagtgcctgaaagacttctacaggagatgtgtcacaatcgagattaataaagtcccggtgcactcaagaaaaaaaaaaa

SEQ ID NO: 488341 - DNA, 280 bp, Homo sapiens
  misc_feature (135)..(135): n is a, c, g, or t
gaccaggctgagggctaatgtctcacataacagtagaaaacaaaatttgttgtcatctcttcaagaatcgagaattgcgtacaaaaaaaaactttaatataatttaaagaagtgaatacatttacaggcgtaaantgcaaaccgcttccaacttcaaagcaagtaaaaaggcccagggtgttcctgggccaaaagaacattcaagcttaaagaaaaggaacactgggtccctacgggtttggacttttccaaacccttaacaagaacccggcaagaaaaa

SEQ ID NO: 488342 - DNA, 147 bp, Homo sapiens
  misc_feature (58)..(58): n is a, c, g, or t
  misc_feature (82)..(82): n is a, c, g, or t
  misc_feature (112)..(112): n is a, c, g, or t
  misc_feature (136)..(136): n is a, c, g, or t
  misc_feature (139)..(139): n is a, c, g, or t
gggattctaggcactggtggcaaattcgaagggaatggagatggagagagcgttccanacagattgtggttgctgcagccgnaagtcgtcttcatcctgggggatatctttnatgaagggaagtggagcacccctnagncctgggcg

SEQ ID NO: 488343 - DNA, 185 bp, Homo sapiens
agaacaccaaatactgcaacggttctcactcaatgagtagggagttgaatattgagaacacatggacacagagagggaccagcacacaccagggcctgttgaggggtggtagggtgaggggagggaacttagaggacagtcaacagtgccgcaaaccacctggcacactatacctttaaacacct

SEQ ID NO: 488344 - DNA, 428 bp, Homo sapiens
  misc_feature (5)..(5): n is a, c, g, or t
  misc_feature (37)..(37): n is a, c, g, or t
  misc_feature (43)..(43): n is a, c, g, or t
  misc_feature (351)..(351): n is a, c, g, or t
  misc_feature (428)..(428): n is a, c, g, or t
ctggnccctccctctttgcccttgtcacctcccttgnaaaaanagatgaaattcctatttagggaaaaaacaggggaagggccattgtcttggtctcccaactcccccctaatccttcacttctggaagaggagaaagggaacaagaaggcctgggtgcagtggctcacccctgtaatccccagcactctgggaggccgaggtaggcagatcacttgaggtcaggagtttgagtttaagaccagcctgaccaacatagtgaaaccccgtctctactaaaaatacaaaaattagctgggcgtggtgacacacacctgtagtaccagctactcagggggctgaagcaggaganatcgcttgaagctgggaggcggaggttgcagtgaggtgagaatttgccactgcactccagcctgggcaacagagagn

SEQ ID NO: 488345 - DNA, 127 bp, Homo sapiens
  misc_feature (116)..(116): n is a, c, g, or t
tttaagaagcgggctcgttgcctgtcatacagcgccgcacaatcttctggctcacgcgggtcagctgggctgatccccactatccgcatgatgcccccggatgccattgcagtggnagctgccggtt

SEQ ID NO: 488346 - DNA, 2312 bp, Homo sapiens
gtcgtcattggatgttgcggctgtcaatcgccaggctataaataagggagtccggcggctcctctatcaggaagattgtgcatgccgtgggtctgacggcttgagtagcgctagggagaatccctgcaggtaatatttgacttttgcttcatattaatctgagtggaaaataaaagggccctcttctcctctcgcttccctgccgggcaggcgccatggcggaagcctcggcgacgggcgcctgcggagaggcgatggcagcggcggaaggctcctcgggcccggcgggcttgactctgggccggagcttctcgaactaccggcccttcgagccccaggcgttgggcctcagcccgagctggcggctgacgggcttctccggcatgaagggctgaggctgcaaggtcccgcaggaggcgctgctcaaactcctggcgggactgacgcggccggacgtgcggcccccgctgggccggggcctggtgggtggccaggaagaggcgtcccaggaagccggcctgccggcaggagcgggccccagccccacctttccagccctgggcatcgggatggactcctgcgtcatccccctgaggcacgggggcctgtcactggtgcagaccacggacttcttttaccccttggtagaagatccctacatgatggggcgcatagcttgtgccaacgtgctgagtgacctctacgccatggggattactgagtgtgacaacatgttgatgttactcagcgtcagccagagtatgagtgaggaggaacgcgaaaaggtaacgccactcatggtcaaaggctttcgggatgcggctgaggaaggagggacggcagtgaccggtgggcaaacggtggtcaacccttggattataatcggtggagttgccactgtagtatgccaaccaaatgagttcataatgccggacagcgccgtcgttggggacgtgctggtgttaaccaaaccgttaggaacccaggttgctgtcaatgcccaccaatggctggataatcctgaaagatggaataaagtaaagatggtggtctccagagaagaggtggagctggcctatcaggaagccatgttcaatatggctaccctcaacagaactgctgcaggtttaatgcacacatttaatgcccatgcggccacagatatcacaggctttggcattctaggacactcccagaaccttgcaaaacaacaaagaaatgaagtgtcctttgttattcataatctgccaataattgccaagatggctgccgtcagcaaggccagtggacggtttgggcttcttcaaggaacctcagctgaaacctctgggggattactgatttgtctgccaagagaacaggcggctcgcttttgttctgaaatcaaatcctccaagtacggagagggtcaccaagcgtggatcgttggcattgtggaaaagggaaaccgaacggcccggatcattgacaagccgcgagttattgaagtcctgcctcgtggggccacagctgctgttcttgctcctgacagttcaaatgcctcctctgagcctagctcgtgagatgaaagaacagaagttgtttggaccttagagccattgtccacaatcacggatggttctcaagagttgattgtaagaaatttccaaagaaggctgcctgcatagtggttccggctgccctttctaggtgattggaatcagcccatctaaagcagtctttatatgcattccgaggccagagtaacattttgaactttggggggatatttgttcatcacttgggtagaagaggagcaaaaatacctctgttttctcttgccaaagtaagatgaagctattccaggttgagggatttttctttgcacggggttgattaatttctgcacagggagtgagattattaaagtaacacacacacaaagtaaattgcaaaatgaaaaaaattagaagcaaatgagttttggaccaatattgttgataaatctaaattgttaagagagatcttataatgcaacatcaaattctttattcaattttactgaagtactggctctttcctgctctggacaagaattgagcaacttgtctgatgactgggaaaggaggacctgcaaccatctgacttggtctctgttaatgacgtctctccctctaaaccccattaaggactgggagaggcagagcaagcctcagagcccaggcctcagtggtcattaagatgttaagtcttttgcggcagattcctggtgatttgatcaataaagagtaatttcttgctaaataaataaaagaaaccttgttgaaaaacta

SEQ ID NO: 488347 - DNA, 2357 bp, Homo sapiens
gtcgtcattggatgttgcggctgtcaatcgccaggctataaataagggagtccggcggctcctctatcaggaagattgtgcatgccgtgggtctgacggcttgagtagcgctagggagaatccctgcaggtaatatttgacttttgcttcatattaatctgagtggaaaataaaagggccctcttctcctctcgcttccctgccgggcaggcgccatggcggaagcctcggcgacgggcgcctgcggagaggcgatggcagcggcggaaggctcctcgggcccggcgggcttgactctgggccggagcttctcgaactaccggcccttcgagccccaggcgttgggcctcagcccgagctggcggctgacgggcttctccggcatgaagggctgaggctgcaaggtcccgcaggaggcgctgctcaaactcctggcgggactgacgcggccggacgtgcggcccccgctgggccggggcctggtgggtggccaggaagaggcgtcccaggaagccggcctgccggcaggagcgggccccagccccacctttccagccctgggcatcgggatggactcctgcgtcatccccctgaggcacgggggcctgtcactggtgcagaccacggacttcttttaccccttggtagaagatccctacatgatggggcgcatagcttgtgccaacgtgctgagtgacctctacgccatggggattactgagtgtgacaacatgttgatgttactcagcgtcagccagagtatgagtgaggaggaacgcgaaaaggtaacgccactcatggtcaaaggctttcgggatgcggctgaggaaggagggacggcagtgaccggtgggcaaacggtggtcaacccttggattataatcggtggagttgccactgtagtatgccaaccaaatgagttcataatgccggacagcgccgtcgttggggacgtgctggtgttaaccaaaccgttaggaacccaggttgctgtcaatgcccaccaatggctggataatcctgaaagatggaataaagtaaagatggtggtctccagagaagaggtggagctggcctatcaggaagccatgttcaatatggctaccctcaacagaactgctgcaggtttaatgcacacatttaatgcccatgcggccacagatatcacaggctttggcattctaggacactcccagaaccttgcaaaacaacaaagaaatgaagtgtcctttgttattcataatctgccaataattgccaagatggctgccgtcagcaaggccagtggacggtttgggcttcttcaaggaacctcagctgaaacctctgggggattactgatttgtctgccaagagaacaggcggctcgcttttgttctgaaatcaaatcctccaagtacggagagggtcaccaagcgtggatcgttggcattgtggaaaagggaaaccgaacggcccggatcattgacaagccgcgagttattgaagtcctgcctcgtggggccacagctgctgttcttgctcctgacagttcaaatgcctcctctgagcctagctcgtgagatgaaagaacagaagttgtttggaccttagagccattgtccacaatcacggatggttctcaagagttgattgtaagaaatttccaaagaaggctgcctgcatagtggttccggctgccctttctaggtgattggaatcagcccatctaaagcagtctttatatgcattccgaggccagagtaacattttgaactttggggggatatttgttcatcacttgggtagaagaggagcaaaaatacctctgttttctcttgccaaagtaagatgaagctattccaggttgagggatttttctttgcacggggttgattaatttctgcacagggagtgagattattaaagtaacacacacacaaagtaaattgcaaaatgaaaaaaattagaagcaaatgagttttggaccaatattgttgataaatctaaattgttaagagagatcttataatgcaacatcaaattctttattcaattttactgaagtactggctctttcctgctctggacaagaattgagcaacttgtctgatgactgggaaaggaggacctgcaaccatctgacttggtctctgttaatgacgtctctccctctaaaccccattaaggactgggagaggcagagcaagcctcagagcccaggcctcagtggtcattaagatgttaagtcttttgcggcagattcctggtgatttgatcaataaagagtaatttcttgctaaataaataaaagaaaccttgttgaaaaactaaaataatacactgcgctataacaaaaaaataaattgcggccgtat

SEQ ID NO: 488348 - DNA, 393 bp, Homo sapiens
aatagtggatgtggtggacatactgtagtccatctattgggagctgacacggaaggacaattaagccagaagtttgatgctgcagtgagctaagaaggtgctactgcactccagcatgggcaagagagcaaccctgtctctaaaataaaattaaaattaaaattaaaattaaggcctggtgtggtggctcacacctataataccaccacttttgaaggccaaggtgggcagattgcttgagcccaggagtttgagaccagcctgggcaacatgacaagaccgtctctaaaaaaataaataaaaataaaaaacacaaaaattagccacggcatggtgccacacacctgtagtccaagctactagggaggctgaggtgggaggatcgcttgagcc

SEQ ID NO: 488349 - DNA, 333 bp, Homo sapiens
tcgatctctaagtgttcacagtgtctgtaaatcaagaccaaagagcctgtcgctgagactgtctattaccagattcacttctgaattggccagaggaaatctgactgtattatcctgtgtgtgtctaggtagagatacttggacggctgccatgggtgctttcgaagtttgcaacctttactaggctaactgatggcaatattcagacacgacgcctgcttttgcaaataacttacaagactgtaaacttccaaagatctgaatggggctttcctgatgttggtatctcaggcttaggcctatagattgatttaccctttgcaattgtgctca

SEQ ID NO: 488350 - DNA, 2258 bp, Homo sapiens
gtcgtcattggatgttgcggctgtcaatcgccaggctataaataagggagtccggcggctcctctatcaggaagattgtgcatgccgtgggtctgacggcttgagtagcgctagggagaatccctgcaggtaatatttgacttttgcttcatattaatctgagtggaaaataaaagggccctcttctcctctcgcttccctgccgggcaggcgccatggcggaagcctcggcgacgggcgcctgcggagaggcgatggcagcggcggaaggctcctcgggcccggcgggcttgactctgggccggagcttctcgaactaccggcccttcgagccccaggcgttgggcctcagcccgagctggcggctgacgggcttctccggcatgaagggctgaggctgcaaggtcccgcaggaggcgctgctcaaactcctggcgggactgacgcggccggacgtgcggcccccgctgggccggggcctggtgggtggccaggaagaggcgtcccaggaagccggcctgccggcaggagcgggccccagccccacctttccagccctgggcatcgggatggactcctgcgtcatccccctgaggcacgggggcctgtcactggtgcagaccacggacttcttttaccccttggtagaagatccctacatgatggggcgcatagcttgtgccaacgtgctgagtgacctctacgccatggggattactgagtgtgacaacatgttgatgttactcagcgtcagccagagtatgagtgaggaggaacgcgaaaaggtaacgccactcatggtcaaaggctttcgggatgcggctgaggaaggagggacggcagtgaccggtgggcaaacggtggtcaacccttggattataatcggtggagttgccactgtagtatgccaaccaaatgagttcataatgccggacagcgccgtcgttggggacgtgctggtgttaaccaaaccgttaggaacccaggttgctgtcaatgcccaccaatggctggataatcctgaaagatggaataaagtaaagatggtggtctccagagaagaggtggagctggcctatcaggaagccatgttcaatatggctaccctcaacagaactgctgcaggtttaatgcacacatttaatgcccatgcggccacagatatcacaggctttggcattctaggacactcccagaaccttgccaagatggctgccgtcagcaaggccagtggacggtttgggcttcttcaaggaacctcagctgaaacctctgggggattactgatttgtctgccaagagaacaggcggctcgcttttgttctgaaatcaaatcctccaagtacggagagggtcaccaagcgtggatcgttggcattgtggaaaagggaaaccgaacggcccggatcattgacaagccgcgagttattgaagtcctgcctcgtggggccacagctgctgttcttgctcctgacagttcaaatgcctcctctgagcctagctcgtgagatgaaagaacagaagttgtttggaccttagagccattgtccacaatcacggatggttctcaagagttgattgtaagaaatttccaaagaaggctgcctgcatagtggttccggctgccctttctaggtgattggaatcagcccatctaaagcagtctttatatgcattccgaggccagagtaacattttgaactttggggggatatttgttcatcacttgggtagaagaggagcaaaaatacctctgttttctcttgccaaagtaagatgaagctattccaggttgagggatttttctttgcacggggttgattaatttctgcacagggagtgagattattaaagtaacacacacacaaagtaaattgcaaaatgaaaaaaattagaagcaaatgagttttggaccaatattgttgataaatctaaattgttaagagagatcttataatgcaacatcaaattctttattcaattttactgaagtactggctctttcctgctctggacaagaattgagcaacttgtctgatgactgggaaaggaggacctgcaaccatctgacttggtctctgttaatgacgtctctccctctaaaccccattaaggactgggagaggcagagcaagcctcagagcccaggcctcagtggtcattaagatgttaagtcttttgcggcagattcctggtgatttgatcaataaagagtaatttcttgctaaataaataaaagaaaccttgttgaaaaacta

SEQ ID NO: 488351 - DNA, 735 bp, Homo sapiens
tggcaaagtgggcttccagagcttcttttccctaattgcgggacctcaccattgcatgcaatggacctattatcgtagtacacatgaagcagaagggaacgaagtaggcagacatgagcagattcgctcctccctgataagagtagtcccaaagggtcgcttaaggaatctgccccacagcttcccacatagaaggatccatgagcagatcaggacacttagcacatgtcaccaataccatctaactctcatttgacaagcagagaaagacaagttacaataccagatcagcttagactaccaggatagtcgcatccccttcctctcacgtacataagatctacatcacgtccaaaacaacaaacacaacacacccacgagcaaccatagacccgcggccagaaaccagcaccacgcaaagccacaagacaaaacagaaccagcccagatacaagacaacaggccacaagacgacacactaggatagaaaaaacgaacccaagacacccggcaagcaaccacaaaccgagcaacccacacaccagacaaaaaaaccaaggataccaagagacacaactagcacacaaaattacaacaacaagcaacataaacacaaacgcacctcgtaaagaaatccagaaagaaaatgaaaataggaacagaatacacaaaacataacacaaaagactacgaatcacaaactaaaacaagcaaaaacagccaataacacacatc

SEQ ID NO: 488352 - DNA, 534 bp, Homo sapiens
  misc_feature (14)..(14): n is a, c, g, or t
  misc_feature (119)..(119): n is a, c, g, or t
  misc_feature (143)..(143): n is a, c, g, or t
  misc_feature (150)..(150): n is a, c, g, or t
  misc_feature (331)..(331): n is a, c, g, or t
  misc_feature (468)..(468): n is a, c, g, or t
  misc_feature (488)..(488): n is a, c, g, or t
  misc_feature (510)..(510): n is a, c, g, or t
aataattaagcatnaaacacaacagcagaacccaggatacttgtctccgggccttcattgggcaggagcctgtggaaagtaggagctgctgatcaccatttgaaagaaggtatctttgnctcttatagaggctactattctgntctgctngctgcgtctgttagcttatattgctttaactactcagaagagcaaattcttttcatcatcctttgtacagcgattgtctttaatgggagcttttgctcagtagcggcttttttcactttatgtgccatgggagtatcatatcttactgttatttattgtaacctgctgctcgttaatacangttgtccactgacattcacctgagcttagtcttcattactgagactgctccgtctatttgtaaaacaacatgttccagattgctagttcttacttgacttttttccctcatttcttacacaaagctctgtgtgacantaagtatccatagacatcanctttgccgtttcgattctatgntcatgagtctagttctgattcttg

SEQ ID NO: 488353 - DNA, 2281 bp, Homo sapiens
gtcgtcattggatgttgcggctgtcaatcgccaggctataaataagggagtccggcggctcctctatcaggaagattgtgcatgccgtgggtctgacggcttgagtagcgctagggagaatccctgcaggtaatatttgacttttgcttcatattaatctgagtggaaaataaaagggccctcttctcctctcgcttccctgccgggcaggcgccatggcggaagcctcggcgacgggcgcctgcggagaggcgatggcagcggcggaaggctcctcgggcccggcgggcttgactctgggccggagcttctcgaactaccggcccttcgagccccaggcgttgggcctcagcccgagctggcggctgacgggcttctccggcatgaagggctgaggctgcaaggtcccgcaggaggcgctgctcaaactcctggcgggactgacgcggccggacgtgcggcccccgctgggccggggcctggtgggtggccaggaagaggcgtcccaggaagccggcctgccggcaggagcgggccccagccccacctttccagccctgggcatcgggatggactcctgcgtcatccccctgaggcacgggggcctgtcactggtgcagaccacggacttcttttaccccttggtagaagatccctacatgatggggcgcatagcttgtgccaacgtgctgagtgacctctacgccatggggattactgagtgtgacaacatgttgatgttactcagcgtcagccagagtatgagtgaggaggaacgcgaaaaggtaacgccactcatggtcaaaggctttcgggatgcggctgaggaaggagggacggcagtgaccggtgggcaaacggtggtcaacccttggattataatcggtggagttgccactgtagtatgccaaccaaatgagttcataatgccggacagcgccgtcgttggggacgtgctggtgttaaccaaaccgttaggaacccaggttgctgtcaatgcccaccaatggctggataatcctgaaagatggaataaagtaaagatggtggtctccagagaagaggtggagctggcctatcaggaagccatgttcaatatggctaccctcaacagaactgctgcaggtttaatgcacacatttaatgcccatgcggccacagatatcacaggctttggcattctaggacactcccagaaccttgcaaaacaacaaagaaatgaagtgtcctttgttattcataatctgccaataattgccaagatggctgccgtcagcaaggccagtggacggtttgggcttcttcaaggaacctcagctgaaacctctgggggattactgatttgtctgaaatcaaatcctccaagtacggagagggtcaccaagcgtggatcgttggcattgtggaaaagggaaaccgaacggcccggatcattgacaagccgcgagttattgaagtcctgcctcgtggggccacagctgctgttcttgctcctgacagttcaaatgcctcctctgagcctagctcgtgagatgaaagaacagaagttgtttggaccttagagccattgtccacaatcacggatggttctcaagagttgattgtaagaaatttccaaagaaggctgcctgcatagtggttccggctgccctttctaggtgattggaatcagcccatctaaagcagtctttatatgcattccgaggccagagtaacattttgaactttggggggatatttgttcatcacttgggtagaagaggagcaaaaatacctctgttttctcttgccaaagtaagatgaagctattccaggttgagggatttttctttgcacggggttgattaatttctgcacagggagtgagattattaaagtaacacacacacaaagtaaattgcaaaatgaaaaaaattagaagcaaatgagttttggaccaatattgttgataaatctaaattgttaagagagatcttataatgcaacatcaaattctttattcaattttactgaagtactggctctttcctgctctggacaagaattgagcaacttgtctgatgactgggaaaggaggacctgcaaccatctgacttggtctctgttaatgacgtctctccctctaaaccccattaaggactgggagaggcagagcaagcctcagagcccaggcctcagtggtcattaagatgttaagtcttttgcggcagattcctggtgatttgatcaataaagagtaatttcttgctaaataaataaaagaaaccttgttgaaaaacta

SEQ ID NO: 488354 - DNA, 2258 bp, Homo sapiens
gtcgtcattggatgttgcggctgtcaatcgccaggctataaataagggagtccggcggctcctctatcaggaagattgtgcatgccgtgggtctgacggcttgagtagcgctagggagaatccctgcaggtaatatttgacttttgcttcatattaatctgagtggaaaataaaagggccctcttctcctctcgcttccctgccgggcaggcgccatggcggaagcctcggcgacgggcgcctgcggagaggcgatggcagcggcggaaggctcctcgggcccggcgggcttgactctgggccggagcttctcgaactaccggcccttcgagccccaggcgttgggcctcagcccgagctggcggctgacgggcttctccggcatgaagggctgaggctgcaaggtcccgcaggaggcgctgctcaaactcctggcgggactgacgcggccggacgtgcggcccccgctgggccggggcctggtgggtggccaggaagaggcgtcccaggaagccggcctgccggcaggagcgggccccagccccacctttccagccctgggcatcgggatggactcctgcgtcatccccctgaggcacgggggcctgtcactggtgcagaccacggacttcttttaccccttggtagaagatccctacatgatggggcgcatagcttgtgccaacgtgctgagtgacctctacgccatggggattactgagtgtgacaacatgttgatgttactcagcgtcagccagagtatgagtgaggaggaacgcgaaaaggtaacgccactcatggtcaaaggctttcgggatgcggctgaggaaggagggacggcagtgaccggtgggcaaacggtggtcaacccttggattataatcggtggagttgccactgtagtatgccaaccaaatgagttcataatgccggacagcgccgtcgttggggacgtgctggtgttaaccaaaccgttaggaacccaggttgctgtcaatgcccaccaatggctggataatcctgaaagatggaataaagtaaagatggtggtctccagagaagaggtggagctggcctatcaggaagccatgttcaatatggctaccctcaacagaactgctgcaggtttaatgcacacatttaatgcccatgcggccacagatatcacaggctttggcattctaggacactcccagaaccttgcaaaacaacaaagaaatgaagtgtcctttgttattcataatctgccaataattgccaagatggctgccgtcagcaaggccagtggacggtttgggcttcttcaaggaacctcagctgaaacctctgggggattactgatttgtctgccaagagaacaggcggctcgcttttgttctgaaatcaaatcctccaagtacggagagggtcaccaagcgtggatcgttggcattgtggtgcctcgtggggccacagctgctgttcttgctcctgacagttcaaatgcctcctctgagcctagctcgtgagatgaaagaacagaagttgtttggaccttagagccattgtccacaatcacggatggttctcaagagttgattgtaagaaatttccaaagaaggctgcctgcatagtggttccggctgccctttctaggtgattggaatcagcccatctaaagcagtctttatatgcattccgaggccagagtaacattttgaactttggggggatatttgttcatcacttgggtagaagaggagcaaaaatacctctgttttctcttgccaaagtaagatgaagctattccaggttgagggatttttctttgcacggggttgattaatttctgcacagggagtgagattattaaagtaacacacacacaaagtaaattgcaaaatgaaaaaaattagaagcaaatgagttttggaccaatattgttgataaatctaaattgttaagagagatcttataatgcaacatcaaattctttattcaattttactgaagtactggctctttcctgctctggacaagaattgagcaacttgtctgatgactgggaaaggaggacctgcaaccatctgacttggtctctgttaatgacgtctctccctctaaaccccattaaggactgggagaggcagagcaagcctcagagcccaggcctcagtggtcattaagatgttaagtcttttgcggcagattcctggtgatttgatcaataaagagtaatttcttgctaaataaataaaagaaaccttgttgaaaaacta

SEQ ID NO: 488355 - DNA, 223 bp, Homo sapiens
tcgatcgccgtcgtgtcgattccgcgccagttgcctgtctcacattcggaggctggcgtccagggcctcagcgcggaggacgactcagagttggggtctcactgtgttgcccagactgggctcgaactcttggcctcaggcgatcctcttgcctcagcttcccagaatgccgagatgatagagacggagtctgactgcgttacccaggctggacttcaactct

SEQ ID NO: 488356 - DNA, 1098 bp, Homo sapiens
  misc_feature (1)..(1): n is a, c, g, or t
ncttgtgttgtgtgtcccccgaacacaagggcgcgcctttctcttttggggtggcgccacagtcagggttgtggctcaacaacggggcacgctatggggtcatcgtcggggtgccccgtgtttcagcttatgtcctcaggttggccctgcttgttattggcctctcacccccctgtgggcggttctcgatgtttttgtcccaaatccacatgtggcgcccaagtgctgtggctggtcgtttctgtgtagtcccccaggtggtcccccctgtgtaggggccgtgggggccgcccgccctcgtgggctacgtcccacggttatttttgtgaggggggtgttttacacggcggctctgcttgtgtatgatatataggggggcccccacactccgcgcttgttgtgccccacacgtttcactctttcacggatgtcgctccccgcttgcgtcgcgtatggtcccccgcgcttttttgggcgcccctctctctctctctggggacactctccaccgggggtttttagggacaccccttgggggcccctccgccaacaggcgccccttggcgccccacaccctggagttgtctgggcccacaaattattgtcgtggtgttctcctcgccttgtccactctgtcacagcttgcttgtgtccccagtgtcactgagaatgtggcgccacttgggctcaccgcggggtgccccctctgctctgcttgttgggactctccctcgtgctccctcgggccacgcgaagttgctctgcgttgaaggagaggttggaagccctctttttgaagggggcgcctttccctgctcaccgctcgttttccccaccacctcggggggctgggccctgcctcccccctgtaccctccctttccctcgcacggcctcggagcctcgtaagggctggaactgaaggttcacaggttctccccccacacctgttctcaccccccacactttgtgccccaccttctagagcccgggagacccctgggggaagaattgtgtctcctcttctgtctccccatggtttttgggtgtttttcttgttgtgtcccggattcccataaaatttaagaaattgcttcct

SEQ ID NO: 488357 - DNA, 2359 bp, Homo sapiens
  misc_feature (1264)..(1264): n is a, c, g, or t
  misc_feature (1270)..(1270): n is a, c, g, or t
  misc_feature (1275)..(1275): n is a, c, g, or t
gtcgtcattggatgttgcggctgtcaatcgccaggctataaataagggagtccggcggctcctctatcaggaagattgtgcatgccgtgggtctgacggcttgagtagcgctagggagaatccctgcaggtaatatttgacttttgcttcatattaatctgagtggaaaataaaagggccctcttctcctctcgcttccctgccgggcaggcgccatggcggaagcctcggcgacgggcgcctgcggagaggcgatggcagcggcggaaggctcctcgggcccggcgggcttgactctgggccggagcttctcgaactaccggcccttcgagccccaggcgttgggcctcagcccgagctggcggctgacgggcttctccggcatgaagggctgaggctgcaaggtcccgcaggaggcgctgctcaaactcctggcgggactgacgcggccggacgtgcggcccccgctgggccggggcctggtgggtggccaggaagaggcgtcccaggaagccggcctgccggcaggagcgggccccagccccacctttccagccctgggcatcgggatggactcctgcgtcatccccctgaggcacgggggcctgtcactggtgcagaccacggacttcttttaccccttggtagaagatccctacatgatggggcgcatagcttgtgccaacgtgctgagtgacctctacgccatggggattactgagtgtgacaacatgttgatgttactcagcgtcagccagagtatgagtgaggaggaacgcgaaaaggtaacgccactcatggtcaaaggctttcgggatgcggctgaggaaggagggacggcagtgaccggtgggcaaacggtggtcaacccttggattataatcggtggagttgccactgtagtatgccaaccaaatgagttcataatgccggacagcgccgtcgttggggacgtgctggtgttaaccaaaccgttaggaacccaggttgctgtcaatgcccaccaatggctggataatcctgaaagatggaataaagtaaagatggtggtctccagagaagaggtggagctggcctatcaggaagccatgttcaatatggctaccctcaacagaactgctgcaggtttaatgcacacatttaatgcccatgcggccacagatatcacaggctttggcattctaggacactcccagaaccttgcaaaacaacaaagaaatgaagtgtcctttgttattcataatctgccaataattccgttgtnccaaanttaanttggccaagatggctgccgtcagcaaggccagtggacggtttgggcttcttcaaggaacctcagctgaaacctctgggggattactgatttgtctgccaagagaacaggcggctcgcttttgttctgaaatcaaatcctccaagtacggagagggtcaccaagcgtggatcgttggcattgtggaaaagggaaaccgaacggcccggatcattgacaagccgcgagttattgaagtccccttttgggccccccttttccgggttgcctcgtggggccacagctgctgttcttgctcctgacagttcaaatgcctcctctgagcctagctcgtgagatgaaagaacagaagttgtttggaccttagagccattgtccacaatcacggatggttctcaagagttgattgtaagaaatttccaaagaaggctgcctgcatagtggttccggctgccctttctaggtgattggaatcagcccatctaaagcagtctttatatgcattccgaggccagagtaacattttgaactttggggggatatttgttcatcacttgggtagaagaggagcaaaaatacctctgttttctcttgccaaagtaagatgaagctattccaggttgagggatttttctttgcacggggttgattaatttctgcacagggagtgagattattaaagtaacacacacacaaagtaaattgcaaaatgaaaaaaattagaagcaaatgagttttggaccaatattgttgataaatctaaattgttaagagagatcttataatgcaacatcaaattctttattcaattttactgaagtactggctctttcctgctctggacaagaattgagcaacttgtctgatgactgggaaaggaggacctgcaaccatctgacttggtctctgttaatgacgtctctccctctaaaccccattaaggactgggagaggcagagcaagcctcagagcccaggcctcagtggtcattaagatgttaagtcttttgcggcagattcctggtgatttgatcaataaagagtaatttcttgctaaataaataaaagaaaccttgttgaaaaacta

SEQ ID NO: 488358 - DNA, 2016 bp, Homo sapiens
gtcgtcattggatgttgcggctgtcaatcgccaggctataaataagggagtccggcggctcctctatcaggaagattgtgcatgccgtgggtctgacggcttgagtagcgctagggagaatccctgcaggtaatatttgacttttgcttcatattaatctgagtggaaaataaaagggccctcttctcctctcgcttccctgccgggcaggcgccatggcggaagcctcggcgacgggcgcctgcggagaggcgatggcagcggcggaaggctcctcgggcccggcgggcttgactctgggccggagcttctcgaactaccggcccttcgagccccaggcgttgggcctcagcccgagctggcggctgacgggcttctccggcatgaagggctgaggctgcaaggtcccgcaggaggcgctgctcaaactcctggcgggactgacgcggccggacgtgcggcccccgctgggccggggcctggtgggtggccaggaagaggcgtcccaggaagccggcctgccggcaggagcgggccccagccccacctttccagccctgggcatcgggatggactcctgcgtcatccccctgaggcacgggggcctgtcactggtgcagaccacggacttcttttaccccttggtagaagatccctacatgatggggcgcatagcttgtgccaacgtgctgagtgacctctacgccatggggattactgagtgtgacaacatgttgatgttactcagcgtcagccagagtatgagtgaggaggaacgcgaaaaggtaacgccactcatggtcaaaggctttcgggatgcggctgaggaaggagggacggcagtgaccggtgggcaaacggtggtcaacccttggattataatcggtggagttgccactgtagtatgccaaccaaatgagttcataatgccggacagcgccgtcgttggggacgtgctggtgttaaccaaaccgttaggaacccaggttgctgtcaatgcccaccaatggctggataatcctgaaagatggaataaagtaaagatggtggtctccagagaagaggtggagctggcctatcaggaagccatgttcaatatggctaccctcaacagaactgctgcaggtttaatgcacacatttaatgcccatgcggccacagatatcacaggctttggcattctaggacactcccagaaccttgcaaaacaacaaagaaatgaagtgtcctttgttattcataatctgccaataattgccaagatggctgccgtcagcaaggccagtggacggtttgggcttcttcaaggaacctcagctgaaacctctgggggattactgatttgtctgccaagagaacaggcggctcgcttttgttctgaaatcaaatcctccaagtacggagagggtcaccaagcgtggatcgttggcattgtggaaaagggaaaccgaacggcccggatcattgacaagccgcgagttattgaagtcctgcctcgtggggccacagctgctgttcttgctcctgacagttcaaatgcctcctctgagcctagctcgtgagatgaaagaacagaagttgtttggaccttagagccattgtccacaatcacggatggttctcaagagttgattgtaagaaatttccaaagaaggctgcctgcatagtggttccggctgccctttctaggtgattggaatcagcccatctaaagcagtctttatatgcattccgaggccagagtaacattttgaactttggggggatatttgttcatcacttgggtagaagaggagcaaaaatacctctgttttctcttgccaaagtaagatgaagctattccaggttgagggatttttctttgcacggggttgattaatttctgcacagggagtgagattattaaagtaacacacacacaaagtaaattgcaaaatgaaaaaaattagaagcaaatgagttttggaccaatattgttgataaatctaaatgtaagaggttccgtcgagctacgag

SEQ ID NO: 488359 - DNA, 316 bp, Homo sapiens
  misc_feature (314)..(316): n is a, c, g, or t
agcaaactttttttttttattaaaaaaaagatatattaacagttttaaaagtcagtagaataaaatcttaaagcactcataatatggcatccttcaatttgtgtaaaaaagcagatctttttaaaaagatacttctgtaacttaagaaatttggcatttaaatcatattttgtctttaggtaacaccccccctttgaaaaaatgttttgtttgtttcacttgtttccctcccagccccaaaccttttgttctctccgtgaaacttacctttccctttttctttctcttttttttttttgtatattattgtttcnnn

SEQ ID NO: 488360 - DNA, 344 bp, Homo sapiens
  misc_feature (90)..(90): n is a, c, g, or t
  misc_feature (131)..(131): n is a, c, g, or t
  misc_feature (171)..(171): n is a, c, g, or t
  misc_feature (195)..(195): n is a, c, g, or t
  misc_feature (211)..(211): n is a, c, g, or t
  misc_feature (267)..(267): n is a, c, g, or t
  misc_feature (290)..(290): n is a, c, g, or t
  misc_feature (334)..(334): n is a, c, g, or t
cagtatatgttccaaaaattgcatgggatatgcttatactaaaaaaaaaaaaaaaatgttgctaggctggacacggtggctcatacccgnaatcccagcactttgggaggccgaggcgggcagatcacctnaggtcaggagttcgagaccaacctgggcaacatggtgaanccatctctactaaaaatacaaaanttagccgggtttggtngtgcacacttattaatcccagctactcaggaggctgagacaggagaattgcttgancctgggaggcagaggtcacagtnagccaagattcacgccactatactccagcctgggtgacagggtntagacttccg

SEQ ID NO: 488361 - DNA, 2258 bp, Homo sapiens
gtcgtcattggatgttgcggctgtcaatcgccaggctataaataagggagtccggcggctcctctatcaggaagattgtgcatgccgtgggtctgacggcttgagtagcgctagggagaatccctgcaggtaatatttgacttttgcttcatattaatctgagtggaaaataaaagggccctcttctcctctcgcttccctgccgggcaggcgccatggcggaagcctcggcgacgggcgcctgcggagaggcgatggcagcggcggaaggctcctcgggcccggcgggcttgactctgggccggagcttctcgaactaccggcccttcgagccccaggcgttgggcctcagcccgagctggcggctgacgggcttctccggcatgaagggctgaggctgcaaggtcccgcaggaggcgctgctcaaactcctggcgggactgacgcggccggacgtgcggcccccgctgggccggggcctggtgggtggccaggaagaggcgtcccaggaagccggcctgccggcaggagcgggccccagccccacctttccagccctgggcatcgggatggactcctgcgtcatccccctgaggcacgggggcctgtcactggtgcagaccacggacttcttttaccccttggtagaagatccctacatgatggggcgcatagcttgtgccaacgtgctgagtgacctctacgccatggggattactgagtgtgacaacatgttgatgttactcagcgtcagccagagtatgagtgaggaggaacgcgggacggcagtgaccggtgggcaaacggtggtcaacccttggattataatcggtggagttgccactgtagtatgccaaccaaatgagttcataatgccggacagcgccgtcgttggggacgtgctggtgttaaccaaaccgttaggaacccaggttgctgtcaatgcccaccaatggctggataatcctgaaagatggaataaagtaaagatggtggtctccagagaagaggtggagctggcctatcaggaagccatgttcaatatggctaccctcaacagaactgctgcaggtttaatgcacacatttaatgcccatgcggccacagatatcacaggctttggcattctaggacactcccagaaccttgcaaaacaacaaagaaatgaagtgtcctttgttattcataatctgccaataattgccaagatggctgccgtcagcaaggccagtggacggtttgggcttcttcaaggaacctcagctgaaacctctgggggattactgatttgtctgccaagagaacaggcggctcgcttttgttctgaaatcaaatcctccaagtacggagagggtcaccaagcgtggatcgttggcattgtggaaaagggaaaccgaacggcccggatcattgacaagccgcgagttattgaagtcctgcctcgtggggccacagctgctgttcttgctcctgacagttcaaatgcctcctctgagcctagctcgtgagatgaaagaacagaagttgtttggaccttagagccattgtccacaatcacggatggttctcaagagttgattgtaagaaatttccaaagaaggctgcctgcatagtggttccggctgccctttctaggtgattggaatcagcccatctaaagcagtctttatatgcattccgaggccagagtaacattttgaactttggggggatatttgttcatcacttgggtagaagaggagcaaaaatacctctgttttctcttgccaaagtaagatgaagctattccaggttgagggatttttctttgcacggggttgattaatttctgcacagggagtgagattattaaagtaacacacacacaaagtaaattgcaaaatgaaaaaaattagaagcaaatgagttttggaccaatattgttgataaatctaaattgttaagagagatcttataatgcaacatcaaattctttattcaattttactgaagtactggctctttcctgctctggacaagaattgagcaacttgtctgatgactgggaaaggaggacctgcaaccatctgacttggtctctgttaatgacgtctctccctctaaaccccattaaggactgggagaggcagagcaagcctcagagcccaggcctcagtggtcattaagatgttaagtcttttgcggcagattcctggtgatttgatcaataaagagtaatttcttgctaaataaataaaagaaaccttgttgaaaaacta

SEQ ID NO: 488362 - DNA, 821 bp, Homo sapiens
  misc_feature (7)..(7): n is a, c, g, or t
  misc_feature (99)..(99): n is a, c, g, or t
  misc_feature (104)..(104): n is a, c, g, or t
  misc_feature (125)..(125): n is a, c, g, or t
  misc_feature (132)..(132): n is a, c, g, or t
  misc_feature (146)..(146): n is a, c, g, or t
  misc_feature (179)..(179): n is a, c, g, or t
  misc_feature (186)..(186): n is a, c, g, or t
  misc_feature (188)..(188): n is a, c, g, or t
  misc_feature (192)..(192): n is a, c, g, or t
  misc_feature (200)..(200): n is a, c, g, or t
  misc_feature (218)..(218): n is a, c, g, or t
  misc_feature (223)..(223): n is a, c, g, or t
  misc_feature (230)..(230): n is a, c, g, or t
  misc_feature (276)..(276): n is a, c, g, or t
  misc_feature (301)..(301): n is a, c, g, or t
  misc_feature (309)..(309): n is a, c, g, or t
  misc_feature (341)..(342): n is a, c, g, or t
  misc_feature (346)..(346): n is a, c, g, or t
  misc_feature (348)..(348): n is a, c, g, or t
  misc_feature (357)..(357): n is a, c, g, or t
  misc_feature (360)..(360): n is a, c, g, or t
  misc_feature (417)..(417): n is a, c, g, or t
  misc_feature (428)..(428): n is a, c, g, or t
  misc_feature (430)..(430): n is a, c, g, or t
  misc_feature (432)..(432): n is a, c, g, or t
  misc_feature (435)..(435): n is a, c, g, or t
  misc_feature (442)..(442): n is a, c, g, or t
  misc_feature (448)..(448): n is a, c, g, or t
  misc_feature (453)..(456): n is a, c, g, or t
  misc_feature (458)..(458): n is a, c, g, or t
  misc_feature (464)..(465): n is a, c, g, or t
  misc_feature (471)..(471): n is a, c, g, or t
  misc_feature (473)..(473): n is a, c, g, or t
  misc_feature (478)..(478): n is a, c, g, or t
  misc_feature (484)..(484): n is a, c, g, or t
  misc_feature (489)..(490): n is a, c, g, or t
  misc_feature (493)..(493): n is a, c, g, or t
  misc_feature (503)..(504): n is a, c, g, or t
  misc_feature (523)..(523): n is a, c, g, or t
  misc_feature (550)..(550): n is a, c, g, or t
  misc_feature (561)..(561): n is a, c, g, or t
  misc_feature (819)..(819): n is a, c, g, or t
ataagtntgttctaatacatgacaccaatgggatattatagcttcttatttaaaaagaatatcatttgtaagtatacagttattataaacagttaattntatanattcattatctgtattcaaanaatcttntaaggactgaacgnattcccatactgcttacattcatagggtttttntcctttntntttncttccttncttttgttggtgcgtggntgttntgtgggntttccctctttgctttttttctttgggcttctctcctgtgtgtgtnctttcttgtttttgtcgggttcttnttgtcttntcctcttggctttctctctttgggtttctctnncttntntctcctttnttntttttgttttgttgtggttgtctttttggcttttgccctttgctttctttgtttggntttctcccttntntnttnttttttntttttnttttnnnntngttgtnntgtttncnttgcntctttntttgnnttntttgtgtttnnttcctgtgtgggtgttttnttgtctttgtgtgggtgttggcttgcngtttgcttttntgctttcttttctttctttgggtttctctcctttgtgtgttcttgcatgtattcaaaggatcttggcagatatgaatgctttcccacaatgcttacattcacagagcttctctcctctgtgcatcctttcatgtatttgcaaagaagagaaattatggaatgcttttctacatttcttacattcacagggtttctctccagtgtgtgtccttttatgagatcgaagatttttgacagatctgaaggctttcccaaatngc

SEQ ID NO: 488363 - DNA, 2253 bp, Homo sapiens
gtcgtcattggatgttgcggctgtcaatcgccaggctataaataagggagtccggcggctcctctatcaggaagattgtgcatgccgtgggtctgacggcttgagtagcgctagggagaatccctgcaggtaatatttgacttttgcttcatattaatctgagtggcctcggcgacgggcgcctgcggagaggcgatggcagcggcggaaggctcctcgggcccggcgggcttgactctgggccggagcttctcgaactaccggcccttcgagccccaggcgttgggcctcagcccgagctggcggctgacgggcttctccggcatgaagggctgaggctgcaaggtcccgcaggaggcgctgctcaaactcctggcgggactgacgcggccggacgtgcggcccccgctgggccggggcctggtgggtggccaggaagaggcgtcccaggaagccggcctgccggcaggagcgggccccagccccacctttccagccctgggcatcgggatggactcctgcgtcatccccctgaggcacgggggcctgtcactggtgcagaccacggacttcttttaccccttggtagaagatccctacatgatggggcgcatagcttgtgccaacgtgctgagtgacctctacgccatggggattactgagtgtgacaacatgttgatgttactcagcgtcagccagagtatgagtgaggaggaacgcgaaaaggtaacgccactcatggtcaaaggctttcgggatgcggctgaggaaggagggacggcagtgaccggtgggcaaacggtggtcaacccttggattataatcggtggagttgccactgtagtatgccaaccaaatgagttcataatgccggacagcgccgtcgttggggacgtgctggtgttaaccaaaccgttaggaacccaggttgctgtcaatgcccaccaatggctggataatcctgaaagatggaataaagtaaagatggtggtctccagagaagaggtggagctggcctatcaggaagccatgttcaatatggctaccctcaacagaactgctgcaggtttaatgcacacatttaatgcccatgcggccacagatatcacaggctttggcattctaggacactcccagaaccttgcaaaacaacaaagaaatgaagtgtcctttgttattcataatctgccaataattgccaagatggctgccgtcagcaaggccagtggacggtttgggcttcttcaaggaacctcagctgaaacctctgggggattactgatttgtctgccaagagaacaggcggctcgcttttgttctgaaatcaaatcctccaagtacggagagggtcaccaagcgtggatcgttggcattgtggaaaagggaaaccgaacggcccggatcattgacaagccgcgagttattgaagtcctgcctcgtggggccacagctgctgttcttgctcctgacagttcaaatgcctcctctgagcctagctcgtgagatgaaagaacagaagttgtttggaccttagagccattgtccacaatcacggatggttctcaagagttgattgtaagaaatttccaaagaaggctgcctgcatagtggttccggctgccctttctaggtgattggaatcagcccatctaaagcagtctttatatgcattccgaggccagagtaacattttgaactttggggggatatttgttcatcacttgggtagaagaggagcaaaaatacctctgttttctcttgccaaagtaagatgaagctattccaggttgagggatttttctttgcacggggttgattaatttctgcacagggagtgagattattaaagtaacacacacacaaagtaaattgcaaaatgaaaaaaattagaagcaaatgagttttggaccaatattgttgataaatctaaattgttaagagagatcttataatgcaacatcaaattctttattcaattttactgaagtactggctctttcctgctctggacaagaattgagcaacttgtctgatgactgggaaaggaggacctgcaaccatctgacttggtctctgttaatgacgtctctccctctaaaccccattaaggactgggagaggcagagcaagcctcagagcccaggcctcagtggtcattaagatgttaagtcttttgcggcagattcctggtgatttgatcaataaagagtaatttcttgctaaataaataaaagaaaccttgttgaaaaacta

SEQ ID NO: 488364 - DNA, 1625 bp, Homo sapiens
gcaccttggcacaagctatgcgccccatcatgtagggatcttctaccaaggggtaaaagtagtccgtggtctgcaccagtgacaggcctccgtgcctcagggggatgacgcaggagtccatcccgatgcccagggctggaaaaggtgggacggcagtgaccggtgggcaaacggtggtcaacccttggattataatcggtggagttgccactgtagtatgccaaccaaatgagttcataatgccggacagcgccgtcgttggggacgtgctggtgttaaccaaaccgttaggaacccaggttgctgtcaatgcccaccaatggctggataatcctgaaagatggaataaagtaaagatggtggtctccagagaagaggtggagctggcctatcaggaagccatgttcaatatggctaccctcaacagaactgctgcaggtttaatgcacacatttaatgcccatgcggccacagatatcacaggctttggcattctaggacactcccagaaccttgcaaaacaacaaagaaatgaagtgtcctttgttattcataatctgccaataattgccaagatggctgccgtcagcaaggccagtggacggtttgggcttcttcaaggaacctcagctgaaacctctgggggattactgatttgtctgccaagagaacaggcggctcgcttttgttctgaaatcaaatcctccaagtacggagagggtcaccaagcgtggatcgttggcattgtggaaaagggaaaccgaacggcccggatcattgacaagccgcgagttattgaagtcctgcctcgtggggccacagctgctgttcttgctcctgacagttcaaatgcctcctctgagcctagctcgtgagatgaaagaacagaagttgtttggaccttagagccattgtccacaatcacggatggttctcaagagttgattgtaagaaatttccaaagaaggctgcctgcatagtggttccggctgccctttctaggtgattggaatcagcccatctaaagcagtctttatatgcattccgaggccagagtaacattttgaactttggggggatatttgttcatcacttgggtagaagaggagcaaaaatacctctgttttctcttgccaaagtaagatgaagctattccaggttgagggatttttctttgcacggggttgattaatttctgcacagggagtgagattattaaagtaacacacacacaaagtaaattgcaaaatgaaaaaaattagaagcaaatgagttttggaccaatattgttgataaatctaaattgttaagagagatcttataatgcaacatcaaattctttattcaattttactgaagtactggctctttcctgctctggacaagaattgagcaacttgtctgatgactgggaaaggaggacctgcaaccatctgacttggtctctgttaatgacgtctctccctctaaaccccattaaggactgggagaggcagagcaagcctcagagcccaggcctcagtggtcattaagatgttaagtcttttgcggcagattcctggtgatttgatcaataaagagtaatttcttgctaaataaataaaagaaaccttgttgaaaaacta

SEQ ID NO: 488365 - DNA, 689 bp, Homo sapiens
gtctttacaaccctgcgtgtgcaatccctgacgcaccgactgtgcatgccccagggcaagcaccagggcgaccgtggcaagtccaacatcacttccattcaagcatccatccaaactcatttggcatgcattcatcctgacacattgtttccatatgttgggcagccagcacacattgtaggtgctcccacagccaggaatgccagccatgcatcactgcccattgtctcctaatctgcagagtgcacaggccatgttgagtatgcttgcattgagtgccaatgcacaccacccattgcattgcatgctacatggcactcatcacctgaatgtgtggcacaccattagtgacacaccagacgcacaacacaccaagcctacctagtgacaagccacacacgttatgcattggcaacgtcccattcattcccggggagtgggacaacaataggtaggggtgctatcttgtatgctttatcgcaccccacaccatgtgccaaggcgcaccctcattcaaaccgtgcacgcaacgtcaacgagggaaccacagtagatttggcatcttggccaccacacattacactgtggattgccccacaggaccttgaccgatgtccccactggattggcctctgggggttggcccccacttattggcaacacccccactggcatctgacacgggatca

SEQ ID NO: 488366 - DNA, 1034 bp, Homo sapiens
ctgctgctattctccgtgacttcgcatgccgactaagagatgagagcaccaagaacgagagctaggctacctcgaggcacagactagacagagcaaccacgctgtactcatgatccgggggtagtggcaagatgaatagagtggtacgcgcgaggcaaccttaccggagcctaggctcatatgaaaggtaggcctcgtgatgacgaattctttagctcatgcattataactcttgtgcccgcaagtaaccctcttaatatacactttttgtaaacaccagcatgtgtggtcgtctcgaagaagaactagccagaatcctgaggctcccttagggccaagagggccgtcgctatgcaagagagctcctataagttaaaggacttattacgtaagcgtggttatacagagagcccaacgagttcaggatagtgtacacccgtcaaatacccaggtatcgtagatgctcccgctgctgttgcatggaatgtcctgcaaatagcgctccaagcagcatgtcatcatcatggcatataagtaagcaattttatgttagtcataccagataaacaatgaaaggggtgctcgtccgaaataagacctgcgtcgggattccaagattggaaactgacccatgttattatgtcgcagcaaagggggccctaatagtgaaggtcgtcattataaagctaggccactggcccgctcgtttaccccacgtcgtagacctgggcacaccttgctacgcctgggcgatcttgggtgaaggaccccttaacttctgtggcgttggaccatactttgcgacaaacctaccctcacggagattaaaacctctaagggtacatctcaccatttaacgcggtaaacgggttacccaactgcatatttcatggcggtggaaagttttggttcccggatgtatatggaattacggaaacacacaacacttagctatatatactaccataacatataatatcacacacagaaccactcttcaactatgaactgatacacccgccatctgacatcaa

SEQ ID NO: 488367 - DNA, 436 bp, Homo sapiens
tatttggcccaaggcccctttttaaagttgggtggcctgaaggttgggttaaggttgtgttttaagcctggtcactgaaatacctaagagcctgaaaaaatgcttggcctgatttgacaaataaagggctggtctgttaatcagactgtataagaggtgggaaggctaaatttgaggaattacgtctgacagaagggaatgataaggctaaactgaagaattatgtctgacagaagggaagaaatgactgtggtggccttctcagaccctgtaggaaaggactctacttatccagtgaaagtgtctacctagactaagaggtgttttagttatcttactcggggcatgttgagtaaagctaatttgccagtccatgggtgggggcaaatcctcgattttgggccccggtcccaatacagcctatcgtgcgccgttc

SEQ ID NO: 488368 - DNA, 1092 bp, Homo sapiens
  misc_feature (619)..(619): n is a, c, g, or t
catcagatggtcccgacagctagcccatgggcctgtgctgtggggcctgaccaagggtggagaggccctgaggggagctgttctgggacgatggagagagcctggaagtgcttggatgcgaggaggcctacactactagtgtcatcttcctggccaggaataacactgatcgtgacatgcatctcggtacagtgtgatcgagtgagggagctggcctgtagctgcagacggtgactagtccgtgggccgtggtcaacggcgcaccgcagataggatccaatctcacaacgggggatcccgatgatcttcccaaaaatatcatacctacatgacccgcgatcagctcaagggtcacctggactattactggtgatcatcagctatgctctgactgagagaagaagcacgctttcctggtgttaaggctgagtgtattatggccgggacaggaagtagttgattgctgtactacatacgcagaaagggaacggccatgggtttccacacaaggggaacaagccacgaagtcgcattgatggtcgccggagcacgtcaagacatggctgatgcggagggcctggcggggtcgtcaatgctggttcatcccatggtgagacanttgttgtgacactttaatgcacagttttttgcataaggccccgggcccgtctactacggcataaggttttaatggcgcaaaaccctagcccttgggcttgcccgtggggggtgccttccttgggggcgcccggccgctttccgaataaaaccgggctggttttctatttgacgcgacgggccaacagggcacaaacggtgtccccgcaattgcgctcctcacctggttttgcgacccgcgcccatttataaacagggccgcaaaaggctttttccgcgccagcgggcgcggcgaaccaacagccgccctctttttaggaagggtgtttctgagcgcccagtcgtgtagaggcaccccccatgtggacaggtgtgtgtgggggccacacccatcttgggcggcaaaatttggggggggcctttagggtttccccttcgggcttggggttcctaaaacataaagacacggcgatg

SEQ ID NO: 488369 - DNA, 355 bp, Homo sapiens
  misc_feature (86)..(86): n is a, c, g, or t
gtcggtatatctcgcactgaaacaagctaacatgactaacacccttaattccatccaccctcctctccctaggaggctgcccccgntacgcggtttttgcccaaatgggcctttatcgaagaatcacaaaaaacaatagcctcatcatcccgcacgattatagccaccatcaccctgttaacctctattctacctacgcctaatctactccacctcaatcacatactccccatatctaacaaggtaaaaataaaatgacagtttgaacatacaaaaacccaccctattcctccccagattcatcgcccttaccacgctactcctactctatctccctttttatagctaataatct

SEQ ID NO: 488370 - DNA, 218 bp, Homo sapiens
tgctggactaggtcgatgaatcaactttcatctgtcacaagacgtaacagaaccagtttgtttataatcaaacgctgtgcgcatagccacatgagataacgcaggatgctggaccaaaaatagcagttattttataaacgcaactggttacaatcattctatctcggatgaaagccgtctctgagagacaagcctgatcaatgaccaacaatttattg

SEQ ID NO: 488371 - DNA, 164 bp, Homo sapiens
cctacatgatgatgatgaagatgaagacatgttagagactgcagatggagacagcatgaatacggaagaatcacatcaaggatctactccaagtgaccaccagccaaacacattacgagttcatagacgagatttgttcaaccactccattgtttgttagatgt

SEQ ID NO: 488372 - DNA, 308 bp, Homo sapiens
  misc_feature (3)..(3): n is a, c, g, or t
  misc_feature (5)..(6): n is a, c, g, or t
  misc_feature (40)..(42): n is a, c, g, or t
  misc_feature (51)..(51): n is a, c, g, or t
  misc_feature (53)..(53): n is a, c, g, or t
  misc_feature (76)..(76): n is a, c, g, or t
  misc_feature (147)..(149): n is a, c, g, or t
  misc_feature (151)..(152): n is a, c, g, or t
  misc_feature (160)..(160): n is a, c, g, or t
  misc_feature (169)..(169): n is a, c, g, or t
  misc_feature (202)..(202): n is a, c, g, or t
  misc_feature (222)..(222): n is a, c, g, or t
  misc_feature (224)..(224): n is a, c, g, or t
  misc_feature (233)..(233): n is a, c, g, or t
  misc_feature (289)..(289): n is a, c, g, or t
  misc_feature (291)..(292): n is a, c, g, or t
ggnanntgcagcatagtagaagcgctatctgggaagctannnttttgcagntntgatatgtctagcttatctactnccaaactaatttttgtttttgctgagactaatgcttattcattttctctaatatggcaaccattataaccnnnanntattattnacatacctnagaagtacagtgttacctctatataccaaagcnacattttaaaagtgccattnanaaatgtatnactagccctcctttttccaacaagaagggactgagagatgcagaaatatttgtganannaaattaaagcatttag

SEQ ID NO: 488373 - DNA, 1011 bp, Homo sapiens
gcgccaactgtgaatcagcgtgactgtgagtactgtcagataccatgtccaggctcagctacaagaagctcagccgcagaagcgtgcaggatctgcagcccaccttctctgagaggacgaattccaacagaagtagcccgcagaggcacacagcctctaagaacggctgtgcccgaaagatggctttaactacgtgatggggtgactatctgcctcgtatgccgcttcaatgcagcagctgtggatcctaagaagaagattcacaccagtctgagtaatctggtagtgaagggacacaatacttgatcatccaggaaacacggaaaaacctcggaataccccagaagagcctgtcttgctctgaggagttcaaggaagtgatggacctgccgacgtgtggagccaggaacttaaagacaacattataaggacaaaagccacaggttcagggattatggggagcccagaacacaggcgatcaaagtccatctcggcctcagacacgtcttgaagcaagcagaagcaggggatgtggagatgaggagaaggcactcagcaagaaataccgaagcgatttcctggagagctcaagtgccccgatggggagccacaagtagggccatcatacatcgaaggaaaggccacgtgtcacagacatcgacggacagggcatccgacgtccccaggctggagggagcccggcagaaggagcccaacatgtggcgaggcgatgcacgagatggagtctcacacgacgagcacccacaccggacaaaacgggagggtagtgaaggcaaaaggtagctgaatcacactaggtacgggggtcctcaaaaaccatggagtaccagcgaaggcctgacggcgggcgagcagctaaaagcacgtcgcaggaaatggggacgaaaggaaacttgccggatgctgaccacaaccgacgccaaggcgagcccagcgaaggcacagacgagccgacaccgcacgatgcctcctgacctgccggcagcaaca

SEQ ID NO: 488374 - DNA, 205 bp, Homo sapiens
gattttttttttcccccccccccccttttttggtattttttcaggcggggcaaaacttaaagaaccaaaagcattttttcattcccatgggggacaggaggcccccaaacggtttaattaaaaaattttcccttttttttcaaacaaggaagaatttaggggggggaggccctttttttcatgacaaaaaaaaggatttttttta

SEQ ID NO: 488375 - DNA, 448 bp, Homo sapiens
  misc_feature (339)..(339): n is a, c, g, or t
  misc_feature (429)..(429): n is a, c, g, or t
  misc_feature (444)..(444): n is a, c, g, or t
ccattacggggtatatacccaaaggattataaatcattctactataaagacacatgcacacatatatttattgtgacactgttcacaatagcaaagacttggaaccaactcagatgcccatcaatgatagactggataaagaaaatgtggcacatatataccatggaatactatggcagccataaaaaaggatgagttcatgtcctttgcagggacatagatgaagctggaaaccatcattctcagcaaactaacacaagaacagaaaaaccaaacactgcattgtaggagagccaggcaaagggattgtggaccaactcaggcattccacttgaggantatttggatccaaacagcaaactgttttattcctggattgcagggtgttggggccaaacttaacttctggttcccgctggcccggagggntttgtttgaagggcnttca

SEQ ID NO: 488376 - DNA, 307 bp, Homo sapiens
cctctgcatattcaatcccatatgcatttcactccaagcagcatattttacacacagctgaaggaaatatctctcagtgcgttcagtgtgtgtgtctatgtgcactctatgtatagggcataggtgtaattaggtgaagggcggaccgaaccacattgatatgtacatgctagacgtccgctcgatggtcggtaacaacagactgttacactgtcctcatattcaaagtcttcacggggatagtcttctgtactttgctgtctgtaagggatctcatccagtaacacagcttaccgttatcggggga

SEQ ID NO: 488377 - DNA, 1403 bp, Homo sapiens
  misc_feature (1403)..(1403): n is a, c, g, or t
ggaagctgaggccgctacgggcaagcgggcagcggaggatgatgaggatgacgatgtcgagtaccaagaagcagaagaccgacgaggatgacgtagacagcaaaaaaggaaaagttaaacgtaaaaaaaacaaggccgccgtgaccctattcagcctcctccgacttcccgtctcagaatcgtaaacggtgggtcaccttcgagttagagaggcccgcccgcgccaccgtagggcagtgccagcccgcgagactgacgacgcgcgtcgtccagccagccaaggccaagaccagtgagaattgtgcaacagggggaggaaaagaactacgaatcgcaatagacgtttcccaatagggccgcttgcgtctgtattgttcgtgtaagagagggtacctgttaacagacgagcgacaactatgtgatatcggggtagtcttgtgtcattacgttgtagcgacttttgaagtaattgttagggtagcacttagtgtgggtataagggcgattcaaggcccaagtatttgtgcatagtggagtccttcggggaattggacgcaaaaacccgaaggcgccgtttcggatgaagggcggttttccttcgtgggtccgcgtaacattttccgtgggaagctgtgtaaccttttgattgcggtgggtgtaagcccaagtggttatccacagtctgacgataagagagtacgttgcacaacaggggtagcaaatctcagaaagaacacctcttttgggttttatgcacatcacatgtagtgaacaagcagattgaggtggtcgtcgagcccagcagaccagatagacaggctaactcaaccgccttgatcagaagggggggggtccaccataagggatattaaacagcggtggtgtaaaccaccaaaggaggtatgattgagtaggtgtgtgaaccacaaaacgggtgagggtcacacacgtatatgatatgtgagggaagaatgatacggactaacacacaatataacggggccatatcgaagcagacatcattttggtgccgcggacgtcaggagtttaacaccacaacagcagcgatcctggtcagcacacatatcgggggaaacaaaaatcctgttgatcgctatgcacgcccatagtaggggaggaaacatcccgttatgagttgttgaaaaatcggatgacagtcacccatttttataaacatgtccaccatggtcatgatggagagtgtgttcgcaacccatatatatcatttgttggagcaccaacagaaacatgctagacgcacttgtaacgtggctactaatgaatgttacaacaggcgaggtcgtttagcatgggtcgttcaaacgtgtagtgtagcagcaatgtgttgttgttaaacagcgagtgcgtatctcacagaacgn

SEQ ID NO: 488378 - DNA, 257 bp, Homo sapiens
tcctaacattatgtctggggctagatacaaacccacgtaatgaaaaagtcagttttacaagcctaattctgtgtcttttttttttatatcaattaaggttaaaaatggcatcaactatttaattcatgaggttctttcattttaaaatttaaccttaagattcaaccgccaggtgcttttatacaggaaacatttttaagaagacgtctgagctcacttttacatgggggtgcctacggccgtcaaggtaagagata

SEQ ID NO: 488379 - DNA, 420 bp, Homo sapiens
tagtcacagaaagatggcacacacacagtctttgaataatgagatcccgcttgttctcattgacaacatcttcacatcaggtaatcacttctctcgttgtaggtaatggagaggtgtttgtctttggcatgtgtgagcgtgtttaacgggatcattctgtgttgggggccagtgccctcatattgtggagaaagagactagagtcatctgcaaaaaggccaaaatatctcttgcgaaacaaaaagtatatgtggcaatctgtagagatcatacggcccgaggtctctctttgtacacatgttccctacaccacctggtataccctttcttgtgatacccggcgcccgctgcggtatattcttagggatcttctcacccgcaaaagtgcgtttcgcgatagagtgctaatctgtgctcacg

SEQ ID NO: 488380 - DNA, 444 bp, Homo sapiens
acaacgtgagtcatcaaattaggaaaaagtgctaaaatatttgttttgaatttagctgaagtaaccaatcagactatcttggagctggaaggaacttggcttatcctcaactcattgactagggatgttaggaatgctggaattgttatagatttcatccttattggcaaatgtacagcctgggcaattgctaatatatcctattgtacttggattaatgactcaggccaaatggaaatctctattaagaaacatgaggaagaaattatccagctctccaaagtagacagcaataatttctttttttatccattacttcaagcatttatcctttgtgttataaacaatcccattatactcttttagttgtttttaaatgcaaaattaaattattttttactatagtcagcctgttgtgttagcaaataaatactaggtcttaaa

SEQ ID NO: 488381 - DNA, 589 bp, Homo sapiens
tcagcgtatcatgtgtatgtcaacttacatatatgagatattctagttatctttctgttgtgaatttctgggttccatgtgtggtctagagagcagactctttatgatttcttttcttttaaatttgttaaagtatagttatagtggcccagaatgttctaccttggtgactattccatgtgaatgtgagaagaatgtgtatactgtggtggtgggatgaaagagagaggtgaattctatccagttgattaataagtagtgtgtcgagttccaagtgcgtcccttaataagcttcttgtctgctggcatcttgtctacgttctgatagagcagtattgaagtctacagctacaaaggtagattcgtctatatcttcttgccgaacctgttagtttatatctcatgtattgggatgcagtgtggtaaagtgacataggcattaaagaactgtgtcgtaggggagaatggagccctttattattatgtaatggcgttcttgatctaataacattatttgcttagaagtctgtactatctgaaatgattcagatacttctatttacttttcattagggttagcatggcgtat

SEQ ID NO: 488382 - DNA, 890 bp, Homo sapiens
  misc_feature (805)..(805): n is a, c, g, or t
gtttcgtgcttttctttcgttcacttctttgtttctgtgtttcttctttgttttttttgtgcctgtttctttttttttttgtcgtcgtcctcgttgttggttctttttgttgtattggtcttttgttctggtgtctctctatcttttacgtttttgttgtccttcaggtaatttgtttttgcttatgtgtttttgtgttttttttttttttcttttttttcttttttttcttgatttccttcctcttttttcgtctttgtcttttttgttgtctttttctctcgtcttcgttttgtccttcgctcttctggttctttggtcttttattccttagtcttttctctcctttattgccttctctttgccatgttttctgtgttgttccttcgtgttgtgatttgccattgttactttgcattagtcacttttcttctgtctcggagctatatattatgtaactaacttgtggaccaactgtagcccttcatggcacatgatagtgatgttaagtcttcagttagtacaagatggtgtctctgttgactccatacattgcagttcgctcatgttcgctctgaatgatgtaagagtctggtagatcaagacatgtttttgaggagtaatctaacaaataatcatctgtgtaatttgcttaagatgccccctgcatttgggaaatattttcttacaatatgagtgttaaattctactaggtggtattaaatgtctcctaggtagatatcttataagtcaaagcagaatagcacatccaggaaccttaatattttaggacaggactttggcnccccccttcttcaccactgatttactttgtgacattgggtaaattagttttcctctctacttttaactaacccggtgatatccta

SEQ ID NO: 488383 - DNA, 181 bp, Homo sapiens
tggggtggggaggaggttatttcatggaggagttatttgcagatgcagagagaaatgagggaagttcgcctacaccgggcatctgcggggtcagtgggggctgctgtatgtctgtggctgccgaagcggggacaggtgacatacggcatcatacgccatagaaggcacgtagcagattagg

SEQ ID NO: 488384 - DNA, 603 bp, Homo sapiens
gcacgccttatcgagcgccgaccaggccttcgcagtcgagtatagccactgggtcaccgtataagccggcgtgagggcctcgctgatgccaccgatgtagcccgcagaacacgggcacactggccgaggctgtaggtcaggccggtttcgaactccacgtgttctacgccgtgcaattccttcaggccgtattggccgctgctgtcgttcaagaacaacgtgccatcgttgagtgtcaccgcttcgtaggaagatgcggtgccgtttgaggaagactttatcgtcgtcttcaccgccggcgacgatctcggtaccggtactcaggcggaaacggtcgtcgcccttgatacccatcccaggaagtctatcgctgtgcaccggactgtagcttgtccgaactgtcggtgcccagcaggacggccggtgtgccgtagtggttggaggtggcggtctgtttgtcgccgacccaggtaaagctgcggctgatggcgtcgaggttactgatgatgatggtgctgtcgcgttcgatgtaatcgtagaacgtcgattgggcgatacgctggatagggtagatgaacatgcttccaggtgcgtccgtaacgg

SEQ ID NO: 488385 - DNA, 200 bp, Homo sapiens
gacacggctacttccagacagagcccctggcttgcttggtaggcaccgcaggacctcagagaacccttacttgagaacactactgtgcaccctctgcaaacctcaatcgggagctgtgaatgccggagagctgtccatcagggtccgtgcacctcctgaatgaacctctcaaagccagccgaacacccgctccagaccca

SEQ ID NO: 488386 - DNA, 321 bp, Homo sapiens
cggggggggggcctttttgggccccctccgggggtttttttactttccctttccgggtgtgcgggcaagggggctgcccctggaacggttcgctccccccccgggttgtgggggggggggttttggcccctttttggcccaaaaattgtttttggcccctttttggcccccaaatttggcttgtggggggggggcccccgccctgcccgtgggcccccccggggggcgggtgggtcccgggcccccgttccccgggccccccggggggtttttccggggggggggtggggggttttttttttttttgttttttttccggta

SEQ ID NO: 488387 - DNA, 287 bp, Homo sapiens
  misc_feature (22)..(22): n is a, c, g, or t
  misc_feature (104)..(104): n is a, c, g, or t
  misc_feature (109)..(109): n is a, c, g, or t
  misc_feature (114)..(115): n is a, c, g, or t
gaaaccctaagagatgggcganaggtaaagtccaccaacccttgggctaatcaggacgaaagagaagggggtgtggggggcagagcgtaaaccaaggcccccangcccnaatcnngcccccaagccatcttcccaatcccagaggccccggcggcctgtgctcctcaccaccctggtcaggggaatagaaggaaatgcaatttccgcctgtctgcccgacttccaaaaactgcctcctcctgcccaggcctcttcccaccaccacctccctccaaagataaccgtgt

SEQ ID NO: 488388 - DNA, 141 bp, Homo sapiens
ctcggatcccagtacaacagctttgaatgagtgttttttcctgttctgtttgaagttatgaatggtactttacagaattcaaatgtatagttatgaatagtatctcagaatagttaccatttatgcaaatgaaacacactt

SEQ ID NO: 488389 - DNA, 139 bp, Homo sapiens
  misc_feature (94)..(94): n is a, c, g, or t
  misc_feature (133)..(133): n is a, c, g, or t
gcggcagtatacagaagccatatcagttgggaaaaactttatcaatcatagagccttttgaagaaaaatttgccaagcgtggttttttgcttgnagacctatatatattacctacaggctgagaaagctttgnatttct

SEQ ID NO: 488390 - DNA, 233 bp, Homo sapiens
atgcactttgtacagtttacaggtgctttttaaatttattttattttattgttttgagatagagtctgctttgtcacccaagctggagtgcagtggtgcaatcatggctcactgcaacctcaacctcccgggctcaagtgatccttctgtctcagcctcctgagtagctggaaatgcaggtgcacactaccacacccagctaattctattttttgtagagacagggtctccct

SEQ ID NO: 488391 - DNA, 242 bp, Homo sapiens
gtccagggctgtgggagatgcagacgactcacgcaggtcactggcttgtcaggagtggatgctgcataagatgagacaacgtccattctgtgcgctgttgcagctgtaaactctcatggtggctctccaggcttcataatcccatgatgaccttgtagtgatgagtgagaagccaagactcgaagtccacagtgccgtgcagcgataacttctggtactgtactcatgccaaccagcgcctg

SEQ ID NO: 488392 - DNA, 193 bp, Homo sapiens
tcctcccgcgagcaggtccaccagaccaacccgctgaggactcagctaccccggccggccacccaggaggcaagggagcagccgccccatctgccccacagtctcacggcctctccagcctcaaccccctgcatcagtccctatccccatgcttccttgccatgatgacaataaagcttgtagactcagcaaa

SEQ ID NO: 488393 - DNA, 240 bp, Homo sapiens
gcacgagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacctggggggggggcccggcccccattcccccttataggggggggaataaaaattcacgggccgtggtttaacaacgtggggaggggaaaaacccgggggttccccaattaaatcgcttggaaaaaaatccccttttcc

SEQ ID NO: 488394 - DNA, 827 bp, Homo sapiens
gccggctgttggtaggctattcagactttgagcaaagcgggctttcggccgcatctaagtttattataagcatgaggtggcacgaggcaggcgttggcgatgccacctgggggtcacattgagtctggagctttcttcatcccaagcgctggcagtgacggggacaaaggtcttaagcccaggtaaaaaggggaggttctagaagcatggccatgtctagcattaacatttggccaccgagcaaaggggaggcaccgacggaggtgtttgttgtgggtatttgtatagatatcgcacacccatttcgtgatcgctacgtttcccttcacgggttaaatagaaccggcaatgtaaatcgacttcagtgccacctgtgagcatttcgatcgaccgatattgtggggtctagttgtgggggattttttaggttatgtgtttagttatcagtaagggtaaatttttattcgtcagggcgggtacaagaagatggtgttgggtgatctatatcgcttgctaattattttaatcctgtattattgaggtagtgggcgtggccggtccggcctagttttgtcccgcggcctgctgagggttatttattttttctcttcttttctgtgttttccgtattggaagaataaaaaaccgccgtatcgcggagattttgagaatgtagttttagtgacggtggtgttctaggagtgttcgtagatattgtgcctcggtatacaagtggtggcaattgcaggaacgatagaagctatttagcgtttttattgttattgatgcgaccccgcggcggttggttgggtggttgtgcggtgggg

SEQ ID NO: 488395 - DNA, 153 bp, Homo sapiens
gaagtaattgttgatggtcaacatacactgggataattatgaaatccagtaaagggccgggcgccaaacgcacatcctgaggtgacaggaaactggcaaatgaaattggcaaattgctaggccccgggtaagggaaagggtacccttcctatg

SEQ ID NO: 488396 - DNA, 1585 bp, Homo sapiens
  misc_feature (714)..(714): n is a, c, g, or t
cgtggtggctcacgcctgtaatcccagcactttgggaggctgagatgggtggatcacctgaggtcatgagtttgagaagagaccagcctggccaacatggtgaaatcccgtctccactaaaaatacaataattaactgggcatggtagcatgcacctgcaatcccagttactcgggaggctgaggcaggagaattgcttgaacccaggaggcggaggttgcagtgaaccaaaattgtgccactgcacctccagcctgggtgacagagtgaaactatgtctcaaacgtaacaaaacaaaacaaaacagtatttattattgtcatcataatataaaagacacagcatcttaacacaaaagaccgaataaaaaacaaggacaatattttaaacatgtactctattctgttttatgaaaaactcaatgcatcgtgcttaattttcttatattgctgtggactattatctcggaccaatgattcatatatggccctggatttcaggatccatgccctttgaacatgtgcttctgcagaaatgcctgcaaactggttacctcacatgattatcagagcctactggagcacgcaaataatatgcggttactaactcatcagattcaaccagtctgcctaatgcacctggaacaaactgctgtccccagtgctgcagggaggccagcattccctgcagattctcacctcacgtgaagggtanaaggccactgttgccccacacagtaccgggcctccaggaggggtagaagacacaccacgttgttgtgcttagtattctattgtattgaacgactaatactactactccacaccgcgagactcgccaccacgacctcatcacagccaaccactcgacctacccacaacgcacacacacaaccaacatagaaaccaccaccacaacacacccaggggaagacgaggagcgcggagacggagagcgcagaacagcgagacgccgcccaccccgactcacacgaagcgacacccaacggcagcagcgagacgcgcagccccaccaccgccccgccggaccacgcgcccaccgcaccgcaccgcaaccaagcagcgcaccgacaagacggcgcgaagcgaccaccagcgacaacgcgggacgggagagcgaggggagggggggggggcggtcgggccccgcggccccgacgagcaccgcagcgggcaggaagagcaggagcacagcgcgcccgcgccgggcacgcaggagacacgccggcaagcggaagcagaggccaggcggagggggagaggagagcacgagggacaggaggacgagaagccggaggggcgcggccggaagaggcgcccacaacgcacccagagacagaccaggagacgacacggaacagcccgaagagcgggcaacaagcaagggagccacaacgacggagcgacgcgaccaccacaagcaagaggaggcaacagagaacaaggacacgagaagcgaggagagaagcaaggagaggaccgccggcgcagaccagacgcgagacagtgcaagcgggagagcacgggaggagcaggagcgagagcgagcaggcagaaacagacag

SEQ ID NO: 488397 - DNA, 882 bp, Homo sapiens
  misc_feature (17)..(17): n is a, c, g, or t
  misc_feature (70)..(70): n is a, c, g, or t
  misc_feature (72)..(72): n is a, c, g, or t
  misc_feature (77)..(77): n is a, c, g, or t
  misc_feature (82)..(82): n is a, c, g, or t
  misc_feature (90)..(91): n is a, c, g, or t
  misc_feature (93)..(94): n is a, c, g, or t
  misc_feature (119)..(119): n is a, c, g, or t
  misc_feature (126)..(126): n is a, c, g, or t
  misc_feature (132)..(132): n is a, c, g, or t
  misc_feature (155)..(155): n is a, c, g, or t
  misc_feature (164)..(165): n is a, c, g, or t
  misc_feature (173)..(173): n is a, c, g, or t
  misc_feature (179)..(179): n is a, c, g, or t
  misc_feature (181)..(181): n is a, c, g, or t
  misc_feature (203)..(203): n is a, c, g, or t
  misc_feature (208)..(208): n is a, c, g, or t
  misc_feature (212)..(212): n is a, c, g, or t
  misc_feature (231)..(231): n is a, c, g, or t
  misc_feature (246)..(246): n is a, c, g, or t
  misc_feature (254)..(254): n is a, c, g, or t
  misc_feature (256)..(256): n is a, c, g, or t
  misc_feature (271)..(271): n is a, c, g, or t
  misc_feature (274)..(274): n is a, c, g, or t
  misc_feature (277)..(278): n is a, c, g, or t
  misc_feature (281)..(281): n is a, c, g, or t
  misc_feature (283)..(283): n is a, c, g, or t
  misc_feature (297)..(297): n is a, c, g, or t
  misc_feature (300)..(300): n is a, c, g, or t
  misc_feature (319)..(319): n is a, c, g, or t
  misc_feature (322)..(322): n is a, c, g, or t
  misc_feature (324)..(324): n is a, c, g, or t
  misc_feature (329)..(329): n is a, c, g, or t
  misc_feature (343)..(343): n is a, c, g, or t
  misc_feature (346)..(346): n is a, c, g, or t
  misc_feature (357)..(357): n is a, c, g, or t
  misc_feature (368)..(368): n is a, c, g, or t
  misc_feature (375)..(375): n is a, c, g, or t
  misc_feature (382)..(382): n is a, c, g, or t
  misc_feature (394)..(394): n is a, c, g, or t
  misc_feature (399)..(399): n is a, c, g, or t
  misc_feature (413)..(413): n is a, c, g, or t
  misc_feature (472)..(472): n is a, c, g, or t
  misc_feature (478)..(478): n is a, c, g, or t
  misc_feature (484)..(484): n is a, c, g, or t
  misc_feature (486)..(486): n is a, c, g, or t
  misc_feature (493)..(493): n is a, c, g, or t
  misc_feature (502)..(502): n is a, c, g, or t
  misc_feature (519)..(519): n is a, c, g, or t
  misc_feature (759)..(759): n is a, c, g, or t
  misc_feature (797)..(797): n is a, c, g, or t
  misc_feature (876)..(876): n is a, c, g, or t
cttgtcccacaatcccnaacctccctcggcagaggggtcttcagccattcagaggagagaagagaaccgngnaaggnaaaantttttttnnannaaaaaaagcaaagtttttttttttnttttagntttttnttcccaggctccctcccccaatnccttaaaannatgaattncagttntnaaaagcagggcagagaaggttnggggnaggnggggggaaggaggaagctntcggggcctcccttnaggctatngntggggagaggggctnttnttnnttntnacaaaccccctttnatngggaggaaaaaggggactngtntnttganaacctggtcgtgtnttnagaacccagtncgaacagaatnaggcctntggactnggagcaacactnccttnacccccaaagattnaggaaaagcaccccaaggacaaggaaaccaatgaggtctgggctagctctgcagctttnggatantagttntngggaagntttttttcntttttaaacagcgtctnactctgttgcctaggatggagcacagaggcaccctcatagctcactgcagcctcaaactcctgggctctggcgatcctcccgcctcagcctcccaagtagctgagaccacaggcacgtgccaccatgctcctagggaaggagcttgagaagaaactgccaggagtggaccagggctggctgctctgtgatgttctctccccacctcccctccagctctcaacttggtggcagggccggcnaccctgctctccctcctaactcccagcctgctgctgcncccttctgggaccctaattttctggactttgagaaatgggctgccctgggggtgcctccaagagccatttgagggattnggtggg

SEQ ID NO: 488398 - DNA, 620 bp, Homo sapiens
  misc_feature (5)..(5): n is a, c, g, or t
gcggngggtggggctggcagggaattagaatttctctctctcttttaatagttttattttgtctgtcctgtttgttcatttggatgttttaatttttaaaaaaaaactttgctgatatttataattttgtatcataagaatgttttcctctacagtatttgtcatgccagtttataacagacagaatttttatttgtatagagtgcttactaatgttaaatagttcagagtatataacatttacattaaggactcatggtaggttttagggtaaggagtttaaaggaaataaatattgaaactgggtctcattgccaattttggtgccaatgagttcgcgtcattccaattacaacgataaatgtatgccatataatctattcatatgaagacttattcttgtcgcgcacatagtacctcatcaagtcttttgacacacgtctatctttaaagaattcatatgtgatgatcccataatgtcctgcctttgtgagacatgactgctcccaagtttcactgcacacacccaccccgaacgacacagtctaccctctcatcactgtcatagctcttccgctctctcatcccttatccgttcacattctctaccctcgtctcct

SEQ ID NO: 488399 - DNA, 131 bp, Homo sapiens
actccctggggactatgggatcactgtccccccacctgtgtggaaggaaggaggaggtgaggggtagggtgagcaaagcggggctgctggcatcaggctgtggctgatctgtggtcagcctggagctcaga

SEQ ID NO: 488400 - DNA, 308 bp, Homo sapiens
tagctgtacggacatagcctgctcactatgacagatacattcggttaactggtactaagataacaggaaaaagacgattaacaaagaaactgtaatcgtccataaactaatgaacataaagcaagtctgttgggaatttaatgaacctttgttaaaaacaccaatattaaaggaagtttattatacccgtcctgggtcgcttaacccggggggtaccatctgatccgagaaatgccttgctaggtaatttcctccttgtgtgagcatcaccgagtgtattacacaacagctacacaggtaagctacag

SEQ ID NO: 488401 - DNA, 779 bp, Homo sapiens
gaggctccatgaatggtgctgggtgcccacggagcgcctgggcaccctgtgagcggctctacgagtggatcagcattgcataagtgatgatggcaggagcaaatgagcaaatgccccctctgtgtccctgatgggagccatgtgatgcccatggtcagtggagccgcaatgccagccttcacagagtgcctcctgccctgctctccagtgttatttgaatgaaccagagaaacctgcaccaacggggaggccccacatgacccagcccgatgcagctccccgggaggatgcccttgaaccccacagtgttgaaagccatgagggatgctcctgaaccatgaaggggtggcaaggactcacccaaacacgaagaataagctatacaaattacaccctgatcgtacctactggtgctatggacgagggtccacgcaaccaagcttgcttgcaccccgggaaggccacaccatcgccatgacaagaggctcccctgttcacaatactgcacacccaaagaaaaccaaagttggaccatatacagttgacaatgcgtcgcgacaagctatgagggatacccagaacggagaacgcccctttccggatgcttgcggaccgatgtgcggaaagtaccttctcgcagacttgatcgggaacgatcatagagaaccgcgcactaactttggcccccacggtcagagaaccacccccataccatacagtaccaatagcatgcacgaaacagtccaccgccgtcttactagcgggcgcacacgaaaaaa

SEQ ID NO: 488402 - DNA, 246 bp, Homo sapiens
ctctacgagcgcaccccagaggttatacttctttcatcatggattacttgcctgttcttgaacttcatataaatgtgaatcatacagtattaatcactatacctgtgataatgcaatattgttgtagtggatatgtaggctaattattcatttatttactttttttggagacggatgttttgctactttattgcccagtgctggagatgcaactggcgctcagtaggcaggggtaccgacgctcgc

SEQ ID NO: 488403 - DNA, 148 bp, Homo sapiens
gttatcaactctcccccgtgtctcatcctgcaaattatgtggacagactccctggcacatgtttggggcttccacctagggccacctagtggtctctctgggtctttccttggtcagatgtttattctacattgttccccaggaacag

SEQ ID NO: 488404 - DNA, 379 bp, Homo sapiens
tgacgatggcttgtgtggccgacgcctgtaatcccacgtcactttggaggccaaggcgggcggatcacctgtaggccaggagttcgagaccagcctgggcaacatggtgaaaccctgtctctactaaaaatataaaattagccaggcgtggtggtgggcacctgtaatcccaggtactttgggaggctgcaggagaattgcctaaacgcgggaggcagaggttgcagtgagtcaagattgtgccactgcactctagcctgggcaacagagcaagactctgtctcataaataaataaataaacaaacaaacagctgttcaccttttccagttattttccatgatctttcttttagctctcctacttctttaattgctgct

SEQ ID NO: 488405 - DNA, 303 bp, Homo sapiens
cgtagaggttcccgtgatgttatcgcccaacactttgattaggcgaagggtgggcggatcacttgaggtcaggagatcaagaccagcctgaccaacatgaagaaaccccatctctactaaaaatacaaaattagccagacgtggcggcgcatgcctgtaatctcagctactccggaggctgaggcaggagaattgcttgaacccgggaggtggaggttgcagtgagccaagatcgtgccattgcactccagcctgggcaacaatgagtgaaactccgtctcaaaaaagaaaatccaacacatt

SEQ ID NO: 488406 - DNA, 361 bp, Homo sapiens
tgcagtggcatgatctgggtttactgcaatctcctcctcctgggttcaagcgattctcctgccttagcctcctgagtagctgggattacaggcctgtgccaccacgcctgactaattattgtactcttagtagagaaagggtttcactatgttggccaggctgggcttgaactcctgacctaggtgatccatctgcctcagcctcccaaagtgctgggattacgggcgtgagcctgagaaaaaaagggcccagcctttttttttttttggcagggtctcactttgttgtcgacgcgggccgcgaattttagatgttatttggcgacacccggaatttctggcccgggcccttgacggcttc

SEQ ID NO: 488407 - DNA, 283 bp, Homo sapiens
gaatgaagcatattttcgtagatgcttcacatgcttcgtaatgatatcagcaaaagaaactgaagatttataatgtgtaacaaatgaaaacaagataaatacgatgggtacagtggtgtgtgcctgtgatatccagctagtcaggaatctgacagctgcaagggagcactagacgaacgagtacaattatgagcctgagcatgggggaccttcatggcaataacaaataggaagcgacagaaagataaaaaaacaagaaagaaaaagaaaaagtacagaacta

SEQ ID NO: 488408 - DNA, 146 bp, Homo sapiens
gcaattaatagaacatcgaccgggcattcaccccggcctgaactcagatcacgtaggcctttactcgttgaacaaacgaacctttaatagcggctgcaccatcggattgtcctagatccaacatcgaggtcgtaaacccatatgtg

SEQ ID NO: 488409 - DNA, 872 bp, Homo sapiens
  misc_feature (300)..(300): n is a, c, g, or t
  misc_feature (346)..(346): n is a, c, g, or t
  misc_feature (462)..(463): n is a, c, g, or t
aagtcactttttcctctctggggtcctgtgtccaaaaggcttaatgagccctttctaatggttctttgattgctttatgagttaggggctgtgaccctagccccagtgccctacaggaaggtgctgacctggacgcccgcaggaccacctgctaaatcaggcccacttggggagcaagccctgaagtgctttattaccttgcctctgagcttagcttccaggttagcctcttagaagcagctcacaaggcctcacagtataattcccataggttagctaactactctcttacctgtgcanaatgaagacaggtcactatccatccctgaagagaaactggggcatnccaggtctgccctctgctctgtggccaaaggccgagcagatccttctctaatctcttcctacgtggaatgctcactgcacttcttcttttctatgaacaggagagtccctggccanngctgccacgttgtcagcacatcatgccacagctgaactaccacagcacacctacatctattccaaccaaagtcttattctgtccaactctttccagtttcacaagtactacgagttcatccatattattaaaactaatttatttttatgcattctttactgcttacgtaacattaaaacacgatgcactaaccccatcggaactagcctttacaagccaaagacttggaactccgcttcctgtacttcagggcatcattttgacctatacgctccttggaactcctgttctcaacaaattttcagatgatagccctggcctctcactccttgcaaggcagtgtttcttttatttcctctcatgttatcccactctctacaaatccgcatacattccgtctgcttccact

SEQ ID NO: 488410 - DNA, 1813 bp, Homo sapiens
  misc_feature (128)..(128): n is a, c, g, or t
  misc_feature (223)..(223): n is a, c, g, or t
  misc_feature (626)..(626): n is a, c, g, or t
  misc_feature (964)..(964): n is a, c, g, or t
  misc_feature (1501)..(1501): n is a, c, g, or t
gattctatatcatatacctagggttctttcagagttagaggaaatagtggcgcttggtaggggttgaagagaaatgtggagtgggatagtgtgggaatacttgtgatcactactatgacatagtagantgttgaccactctaatacttagtgacatataagagtagtgtgattaaatttcattctccctgttagaagtgtattcctaggcaatgtacgatggnctatgtacatgtgttgactcactggtgtgtgccggtgttatagggtagcgatggtggggttgagctattagagattctctgtatattgttgtagcagtggagcataagtggtacggaaacacttaaggtaggtggacatggtctcggttatcccttctcttgaagagtttttaatatatcacatctacgcaaaaggactatgatgctatttatatgtatagttcctgagtttggaccaagctctatagcatggataagaaagtagtatacgactaagaagtttaaaacgctctcactttggatcccatattaaaattcaccctacgaattacatttataagggtaactttttggttagaggtctaggtcacctatatttcggtttatagtaaaacacatcgtngtggaaagaggggcatggtctacgctaggggggtacgtaaggggagaacctaggggacaccaggtttcggaatttggactagcgtaaggtttgtttgcgccaagtgttttggtcacataacctcccaaccggtggatgtagccacaccttaataggcggggtagacaatgccataagggtcttgtggcaattagcgttacaaatacccatgattatatgaaaaaacaccccgaacctaataggcggccggaatttaaaataccgcctaaaggtataccttaggatacaagtcgcggcgtactccacatcggcacttggtggtcgccgcacctccattngtttgaagccgccaatgccggcggtgttttggtggcgacagtgtgcagggaaccccgcgacgaaactacaaggtttccttataaaccgccgcgtaggcggaaaaagtaggctacttccggaattgtgttccccaacaggagagggcgagatatacaccccgggactgtttggtgacgacccgtttcaccaccgaggctaaggccacccggccgagctttttacattcaaaagggggcccacgttgtgcgttgccccatagagggacatatggcctgtcgagacggggttaacacccttgggaataaggagcaaaagcgcgcccacaattgtgttccaatttcgtgggggactcccaggagccgccttcttcgtggggtgtagaacagctataaaccgagggataataaacgggtcacacaacatcatcgggggcgaaacggcactcctcccctcacagcgcattatgagggagcgcacttacaaccccactgtggttctttaggacaaacacacacgtgtgggagattgagacgacnatacgtagggcgcgggaacacccatttatgttgtcaaaacgagtttgggggcggccccctatttaaaacaaccagcgcgatgtattttggcgccgccgactatacttctttcctcgcggggagcaaacaaccttgagaacgcgtcttataagacaaaataccgggggatgagaactacccaccaatagcagacacaaagaaaggaggcacaaaacaagtagctttcgtgcgagcaggttcacacacacaagtggtcggcgccgtagcatagacaagactactcctgcacgcagcggacgaccaaacattgcg

SEQ ID NO: 488411 - DNA, 113 bp, Homo sapiens
atagtggctggtgctcttcgtggcgacatagagattgatcataacccaagtgacatttcttaagaatgttataggaatagatgagacttatgaaggaaagtaaaggtttcaca

SEQ ID NO: 488412 - DNA, 444 bp, Homo sapiens
actccagaggatccccttattcgtgttgcactacccatcaattgaaatcactgtaaggaatataaaaatgatagtttaataacatttcaaatatgaagctatttaaatgtcaactgtgcaggcaatttttaaatatttctagtcaatcataatcactgctttctcagtctttctattcttcctataagcattcgattaaagttgattacacagaattctcttttaatatgcattctgttggggataccaattaagatatctttaacttgtttattttagaaattgattataacgccaggcaacagttgtaaagaggataacattcccagccgatggttttgaaaactactataatatctaattatgtatagatccagactgcttatgtttggcatacaaataattgctgggagttagaatggattgagcaatacatgcaattta

SEQ ID NO: 488413 - DNA, 1657 bp, Homo sapiens
gtattgtgtggttgtgatgatatagtgaatgagtgagtagttttgagtgtgttgtctaccccgtgtattgggactaatcatgaggtgtgttacatgagtagcgcgagctacgtgagtcaagggagtaggtggttgggtggcttcgtctgttcgtttgcttggatttatatgatctgttggtgtaatgataatggtgatcgttcttgtgtctgtgtctgacgaatggagggatataggaattgtgtggtctgttggtctccttctagtgtgtgtaggagacaggtgttttgggttggtgtgtgtgtgggtgtgggtgtgtgtgtttgtcgtggtcctctgctggggtggtggtgggctgttggtggtgggtggtgagtgtagtcgtgttgtgtgttgtgttggtggtgtggtgttgttggtgttgttgtgggcgtctgctgcggtgggggttttttgggtgtgatgagtgtggtgggtgttctcgtgagtgtgtgttgtccgccttccctcctcctgctgttgggtgtgtggttgtggtgggtgtggtgtgtgttttttatgcgtccccctcctccgggctggttgcggactattattgttgtttcttgtggggtgttgttgtgggtcgactacgcgtgcttcttgttttgtggtactacgtgcttgttgtggtggggtgttgttgttgtgttgtcgccgcctgctcctgctgtggtgggtgcgtgttctagcaggagtaggatgagtagtagatactactcgctggctgcttgttggttgttgtggtgtggaagagagctaccatcatcagctctgtgttggtgtgtgtgttctgtgttgtggttgatgtagtttttcttgctgctgttggtggggttgggcggcccaccaacaccacactattgctcgtcttgtgtggtggtgctgtgtggcgcagcagcggcgtgatgtttgtctaaccacgctctgctctgcacagcggcggtgtggtagtgtgtgtttgttgtgggattgtgtttgctctctgtgtagcagaggggggtggctcgccgtctactccgcctgctctggtggtgtgtgtgtttttgtctttggcgggggtggtgtctgctctgcgcgcgcgtgggttggggtgagagagatcttccttccccccggctctgtgggaggcacccgcgctgtgtgtctctctgtgtttgtgtgtgtgctatgaggtagtgtgtttgtggtctcgcgccgccaccccgtcgcgcggtgcgtgtgttgactcttgtgtgtctgtgtgagtgtgtgagaacgacgcgcggtggttgtacatgtttgtatacgcaacgcgagagcatatggggtggtgtacgtgttgtgtggaggatgatatgtgataagaggggttgtgttgtgtgtgtgacacgccacgtctcgtgtgtgcgtgtgattgtgtgtgaagaagaggaagacacacaccccctctgtgtgtgtgtttgtgtgtgttcgtgttgtatgtatgtgtgtgaggacacactctggtgaggctcccctctccctccaccctctcttctggtgtgatagaaggagaaattattaatgtgctccgcctgacaccccacacaaataataataaaaacaaaacatataatcgtacaaagagaaaaataac

SEQ ID NO: 488414 - DNA, 716 bp, Homo sapiens
caaccaccagagctctctcgatctgcttgtggatgatggatggtactgccagtgccgctgtgtgcccattgccaagctgcgagctactgtggtgctggctctgccggtgctggcctgcttggctggcaggagtcatcttcatctgacctggaatgctgcactgtgggtgatagccatcatgtgtcattgtcttgatgtgtctgcccagagccctgctcacccagtgactgtgatgtgtgtcttgggatgtttcactgaagggcaacgatgaaagccgcaattgtgctccatgcttgccccttcagaactgtgtgctgcacttccagtctttgcatgtgcattggcccatgtgttcccagttgtcccctatagtcatgtcctccataccaatgagcttctacttgcaagaatgtgagcgtcgcattcacctcgggggacaaattgtcatggtgctggggtgcttgccccacaatgtgcccactgtgaatgtggctatgacaccaggattgacggtcccaagctcttggcttgacagacgtcctggcacctccaatcgctcaactggttttccctgtgtgcacatcctccgacttgattgggccggtggttgcttggttgacttatcttgctcgtgcagccttggtagtgcgggttgggtgaaccctttgtgttcctgagctctccttcccatcttgcccccatcttttcctccccag

SEQ ID NO: 488415 - DNA, 138 bp, Homo sapiens
tctagaggactcccgggcgtgggggactgattgccaaaggcccgtctcaaagtactcccaggcggtgccagccgtgtaccgaggggcccattcccaaagtagccacacgacgagccgcacgaagagcctcacaatgcg

SEQ ID NO: 488416 - DNA, 237 bp, Homo sapiens
gggagagggggtgggaccaggcatcaggagcgggatgcagcgatttcgtcacatgaccttgtcggccctggccgttcctgtccggcctccagtgggcaccagatctccagccattgcgtgaccacgtcccgtcgccagcaatccgctcagcgagattctagcagaggggagaaagccaggggccgtggggacccagggggtgagaaaggggcgggcagagagcagggagtccaccca

SEQ ID NO: 488417 - DNA, 627 bp, Homo sapiens
ggtaaaatgactagaaccccggagatgacggctacttcgttaaatgggtaggatgaatggctcggaaaaagtgaaacagagatggtactctccttaccgaacgaattgcccattaagtgatcgaggaatagagatgtagtggtcgtcgagggatgtacctctaggaaacgaggaggacttggtgtctagattggggatgggataaccgagaccaaacctgccaagagggggagaaagaggaataaggtcggtgacaccattttcgttacggcctaaccctgaaccctcgtgataacccatttttaacatcatatcataggcaatatcagaataatatgaagaaataagggagtaagagatcatacctgtggacacaggacagacgtcgtatccgtttagctcaatgcccggagcggatgcgagaacagataccaaagttatggaggtaggctctctgaggatggtgatgatcttaccatcgttgatcatcttcaactgttggttggaacgttgaagagaccgctgtgaccttggtgtcgccatgggcatcccagaatgagatggtctggtggttgcatgtccatgacggtgcagtccacgtcgagttgaactccgcaccctttactt

SEQ ID NO: 488418 - DNA, 153 bp, Homo sapiens
gagtgagattctgtttcaaaaaaaaaaaaaaggaaaaaaaaaaaaattgatgggttttcaccatttgtgtttaacattacggccccacccaaaaaaaacccggtatatatgtataatctatttcaaacataagggggggggaaacattgaacc

SEQ ID NO: 488419 - DNA, 106 bp, Homo sapiens
ctggcagtacggatgtggtgtgaaaaatgaggtggccattaccctcccccgcaaacatacaagtatctagctttgaacagtggttccactacatgaaaaacactgt

SEQ ID NO: 488420 - DNA, 125 bp, Homo sapiens
catgggctggtggacttataacgtgctcgtgctgttcacccgttggtagtttggctgcgttgggtggtggcctcggcttccttggacctttaaagccctgttgatgccgttactactcctacaag

SEQ ID NO: 488421 - DNA, 282 bp, Homo sapiens
gtgagtgcagagagaatggcaactatctgccacatccagttgctatgggagcatcggctactgtttggtgtgtcttccccaacggcacggaggtccccaacaccagcaagacgcgggcagcataactgcagtgagtcacaggaactggaggatccgtcttctgggctgggtgtgagcaagcaggatctggggccagtcgccatgtgagagcagtagaggcaggtcttcaacatcctgccagccccatacagctacagctttctggctcacttcagccccctt

SEQ ID NO: 488422 - DNA, 360 bp, Homo sapiens
  misc_feature (76)..(76): n is a, c, g, or t
  misc_feature (96)..(96): n is a, c, g, or t
  misc_feature (104)..(104): n is a, c, g, or t
  misc_feature (127)..(127): n is a, c, g, or t
  misc_feature (200)..(200): n is a, c, g, or t
  misc_feature (315)..(315): n is a, c, g, or t
ttaggcccgggcccctggcaagtcctccaccggtgcctcctttggggaagggaaccagccctccaaagcaggagantggcaaaagctttttgtttnaccaggtnagccccggccactccctgccaantccatgaccaggcccccatttgtaccctgcttcccaaactcccaggacctggaaacaggattgtttggggccnaggggccagggtgtgaggtttcccctccgttgcggctgggctcctgtggataacattgctaacgaaccgcctttggttcccctcaggttggttcctgccccccccctgctgtatnatattaatgtggaaggtcatcaataaaggggaattgtgttggtga

SEQ ID NO: 488423 - DNA, 1049 bp, Homo sapiens
ccctactcggcgctttgtcttacacttgcgctttcctctcgtcttcactcctgcttattgacctccccccaatgatctctacgttagcctgatcgtcctctttctccgtcatgctttctgtcttcggaaacccgctcttggttactctttatcgcgttatcgagcctccaatgctcgtgccctccttagcccgtcttaacttctaactggtcccgaacccctcgcaatcacttatacttacgccggtactccccaatccgttgttgctatcactagattgttcagattgtctttctgcgtaactctgccgttgataatcgtccctttgtgggtccccccctctttctgaatcggggaatttatactttcctttcgagtgtcttgtgtcccctgtcttccgcctgatcttctcttacgggaaatcgtgccaatgggccgtatcccttctgtgtatgtatgcattacactgcgcctcggcaagtggcatcaccagtcgattgttccgtgtcgtacctggttcgctctgttacacactgcggggtggtagtccttggaacgtccatggccatgtctcccgttgatatgtgccacatacacagtcatgctcatctaatgccatcccccacacgtaatctcaccgtggattcagtctcactgcggtgtcaacaccatcgaccgtgtgacgactgcatgcgagtctgctcatcactcgttggtgtccagccctgtgtcctcacagccaagacacctgccagcatgttccaggtctggggcgatcatcaggggatccacggtggctgacctgccactcgtacacaccactgcgctgtggcgtctcacacacgggctcacaggcaccattcctcttcatggtgcatggagctcgctttggggaggcacacaggtctgtggcatgtgcacaccacgattccatggagttaccagccgtgcctacgaggctgcccgtgcatgccccacactcaacccctgcgaggtggcgcgtgcacatgatggggctgggtgctggggatagaatctggtacggagga

SEQ ID NO: 488424 - DNA, 406 bp, Homo sapiens
gtggcataaagcatggggtcatggggtcatggcctcatggccatggggtcatgcgtaaagcagagctgtgggtccagggtctgacagatgggactcactgcagggcccctcctctctgtcctcacctgaagcagttgcatccatcagtccttcgcccatcccagagttttggtgatggcttccctgtgccaggctttccgcaggagactggaggccaagacaagtacaagccacggggctctatcatcaaggacccaacaggcagcaacataggctgtggtgaagaccctgaattctatgttcttgtgggtcttgggagtttctctgttgtctctgctccatgctaattgcatagcatttctttcttcccctatgtaacaccgagaaatacagtatccaaactgct

SEQ ID NO: 488425 - DNA, 320 bp, Homo sapiens
gtggcctactggagacagggtggactcagctacatccgatactcccagatttgtgccaaagcagtgaaagatgccctgaagacagaattcaaagccaatgctgagaagacttttggcagccacgttaaaattgtgaaagtaaaaaaggaataattttccctgactaaagcctgaaatgctacatttccaaggggaaaatgtgtgggcccatgttatggcagatttaaaaggatctccttccatgggaaaaaaaaaaatcctgttttgttcataaattggcaatgtccataaattgaaaaatggttccctgttactcttga

SEQ ID NO: 488426 - DNA, 1049 bp, Homo sapiens
  misc_feature (1049)..(1049): n is a, c, g, or t
cagcttacggctaggtacgaggctgggtttgaatcggccgagggcctgcccggccctgtccatggcccggcgcagaggactccgtgctgcgcagtcccgatagcatcgtcgaggtgaagagcgaatttgactgccgagttccgactgcttcgcgctgcctcgatgcttcggtgagcggttccagtgagttctcgcggttgctttgctgtggctgtgtgcaaccaagatcaccggaacatggacagtgcatacattaggctatacagagaatgctacactgagcagaccctgcatgccaccatcacctaagcagacagacagacatgcaccatggagccctgcgcacaagatgagtgccccacagaacaactagcagcacatatctagcgtgcatacaaaatcagtcgagattgaaggcacggagtgtaacaaagctagagagccaagaccgatccttgataggatgcaaagaaacgccattgaaactctcaatgcagtcgactttgaggcatattattgcacatccaaaaccatacatcataagcaacgacagagcaggcaaaacagacaccagcgaggcacacatcatagcaaacgcagtgaccaacagcagagcaaaccccacattagacaacacacaccccgcggacaaccaaccatatagacataacctcaaaacacaatagacacaccaagaaagaataaacacagaacaaaggagatcaacaaatacaagaaccaaaacgacctatagagaacaataacaaagaaaacagcacgaacacacaaaccagaaccaagggcaagcagcggaattgcacgaaacagcaaatagaaacacacagaacacaagccaacccaggcagcattcataccacatcccaacaaaaagcgaacaaaacagcaagatcagtagtggagaacaacaaaagagcacaattgaactacaaggcggataccaaacgaaacctagtcaaaagtacaccgaccgcggaacagagcaacaacaagaacaaagaagcaaaagaaaagcaaagacaacaaaaaan

SEQ ID NO: 488427 - DNA, 984 bp, Homo sapiens
  misc_feature (264)..(264): n is a, c, g, or t
gtgggcccaagggtgtgcgcgcccccccggggtggggcgcgttctgtttctctgcgggcgtgctatgtggtggccacgagggctattctgtcgggaggcccggcattcgccgcttggggtgacaccgagggagcgcgcttttcgggcggccacgcgattctcgtccccggggaaagctggagaacctttgttcacgggggatgcctttgttgggccgcgtccgacgccctgtggctcagtgccaggtcggtcaggtcaaaccancgctggcctcccctgtaaggcaaactgaactcgcgcggttccctgactggaatactgtcccttaagtcgaatgcttgctccgggaaaaatgatttcccctccagtgtcaagggtaagcaacccccgacttgcagcaggtgcggggcaatttgtttgccccgccctcccgaggttacatgtgggctatggttgaggctccgcactagcgttgtcgcaccgcttctattattggacaagctatcgggccaatatcacaatactttaattgcaggaactgcttgtctacaagtttgttaaagattaagtgggagatgtgaatccaaccagttttgggtataacatacatacgcgagggccccacacacattatgtgggtacacgggtgataaacaatacaaaaagcttaaatttcttgcgtaaggatgattgaagtgcgtggtgcacagaaattttattcgtaagagaagctgcgcccggtagtaaggggggtgattcatccgtgttattatcccacacatgaatagtggggtggtcgcccacggggtaattgctcacctacactttcgtgcgcccgtctgaaggccgaggaagagagatagctcgcatctgtagccccgcagcagtgctgggcgactgcgcgtgacaccagcagctgatcgcccctctggcgcgatgtccacccgcgggacacaaagagaacctccttctctacatagacac

SEQ ID NO: 488428 - DNA, 392 bp, Homo sapiens
agtggcttcacgtggcttcacaacaatcatttgttatttctagtgagatctgtggagttgattgggatcagactgagtagttcctctgtatattctgtgatgtagctgaggatacacccacattcagctgggagcttaaggctggaacatccacgataatctctcatcctcaaaagtctcatatccacatggacctctcatctttcagtaatccagctgagaatctttgcagcatgatggctagcttccaaaaaggaatcacaggacagctgccagtctcttacagcctaggctaggacatatactaaatttcttctgctgcactatagtaagcaaagccatacataaggccagccaaaaatcaagagaaacagactccacttgtagcacga

SEQ ID NO: 488429 - DNA, 344 bp, Homo sapiens
gtttctccatacacataaacaatgtccccctggtcacattcccctcacccccaggcaatcatcattttcttttctgcctctatgatttttactactctaagaatcttatataagtggaatcacacagtatttgtctttttgtgactggctgatttcattgaacatgagctagagtttcatcaatgacggaatgcagaatttgcttcctttttaaaggctgaatactattccaacgtataaatatagcacattttgtatatccctgttcatagcagcattattcacaatagccaaaatgtgaaagcaacccaaacgtccactgccagatgaatggataaacaaaa

SEQ ID NO: 488430 - DNA, 103 bp, Homo sapiens
  misc_feature (19)..(19): n is a, c, g, or t
  misc_feature (59)..(59): n is a, c, g, or t
  misc_feature (79)..(79): n is a, c, g, or t
cgctgcatgcgtcagcgcnacgcgacgacagcgcgcgcgacgcgcgcgacgcacaaaanaaatgcatgccaacacgaanatatgtgcacacaaacgcaaacgc

SEQ ID NO: 488431 - DNA, 288 bp, Homo sapiens
cggcgcgatacgctctagacggggttcgctgttcttggcggctggttacgacactcatgacctcaagttatccagttgcctcagcctcccaataatgctgggattacaggcctgagccaccatgcctgacctaaggtgttacttgggcagtgtaggtatacatacaagggctaccggtatggggtcccaatattatactataagaaccatttaatcaaatggtggcaacaagtcggcaaacactgtgtgtatgctaacgtccacggggcacacatcaaaagcacgaaa

SEQ ID NO: 488432 - DNA, 563 bp, Homo sapiens
tatatgctgtctcatgctttgaccgttgtctgaaaaaaaaaaaagggggggggtcataaacaaggggtctggttaaactagtaaagggtggtaaagggagtcttggtgaaattttcctaagaaaccagaaggtctcctattgggtagaaaagtgacatcaagattataacaagtacccgtactataagagaataacatatatggtccagatgggagatgcaactatgagggcagaagggttatacaatgatccagatggtagtaagcagaaaacctcactagacacaaaaggtcatcgggggtccccatcccagggtgacagctctgcaagaatatgcagcagtcccagtgaaacggctatgattggagctaatatgctggtacagctaaaggagcaatctctttaaaccccgggctaatatatcgggggcactacggcctaatattattaatggaaaggaagacctcctttaatggtgccggttaacagaagggcagatgtgcctagaaagggagtagtcatacacaagttgcactcgggataatctctgaagggcagctaa

SEQ ID NO: 488433 - DNA, 189 bp, Homo sapiens
cgatcctattatctgttcgtgatactaggttagtcattttgattcttcgaggttagtatagcattagtctttgcttgggtcttgagttaaacggttgttgatgagatatttaggaggtggggatcaatagagggggaaatagaatgatcagtactgcggcgggtaggcctaatttctctcggaccaatg

SEQ ID NO: 488434 - DNA, 107 bp, Homo sapiens
ccggtgtatgtgggtacttccggtgatgacacgcgggtcgaacacgcatgtagacatccaatgagtgcagcagcaggccctgtagccaggagtgtgccaacgtctac

SEQ ID NO: 488435 - DNA, 181 bp, Homo sapiens
tggagccggagagttctcttttctttgtgagggcaggcgccttaatggttcgccgaataggggcgtgcctttgaaagcgcctgtgtccggcgtgtctgttgagctctcgttgcccttgaaaatccgtggcagagggtgtaaatctcgcgcctgggctgtacccatatcggcagcaggtctc

SEQ ID NO: 488436 - DNA, 771 bp, Homo sapiens
cccaatgcacacacaattaagccaggaagcagcttgcaaccactagcctggggagggtccgcatgtgtcaagggtgagggcaacagatgctggacccaggagctctctgccacaggtcagtctacaaggcctcagggaccaacttgccaacagctggacttgatcactagctggcaaactgagctcacgtatcgggtggaataacaagcggactttgctctctgctgtgcaaaacgctgtttttagaggatttgccacagcagcggatagagcaggagagcaccaccggagcccttgagacatccttgagaagagccacagcataagagactgccctgcttggtgttttgcaggatgatggtggcccttcgaggagcttctgcattgctggttctgttccttgcagcttttctgcccccgccgcagtgtacccaggacccagccatggtgcattacatctaccagcgctttcgagtcttggagcaagggctggaaaaatgtacccaagcaacgagggcatacattcaagaattccaagagttctcaaaaaatatatctgtcatgctgggaagatgtcagacctacacaagtgagtacaagagtgcagtgggtaacttggcactgagagttgaacgtgcccaacgggagattgactacatacaataccttcgagaggctgacgagtgcatcgtatcagaggacaagacactggcagaaatgttgctccaagaagctgaagaagagaaaaagatccggactcttgctgcaatg

SEQ ID NO: 488437 - DNA, 435 bp, Homo sapiens
  misc_feature (317)..(317): n is a, c, g, or t
  misc_feature (341)..(341): n is a, c, g, or t
  misc_feature (345)..(345): n is a, c, g, or t
  misc_feature (348)..(348): n is a, c, g, or t
  misc_feature (352)..(352): n is a, c, g, or t
  misc_feature (356)..(357): n is a, c, g, or t
  misc_feature (365)..(365): n is a, c, g, or t
  misc_feature (377)..(377): n is a, c, g, or t
  misc_feature (386)..(386): n is a, c, g, or t
  misc_feature (388)..(388): n is a, c, g, or t
  misc_feature (399)..(399): n is a, c, g, or t
ccacacctctgcagagagaatggccagcaggaaggcggggacccggggcaaggtggcagccaccaagcaggcccaacgtggttcttccaacgtcttttccatgtttgaacaagcccagatacaggagttcaaagagccttcagctgtatcgaccagaatcgtgatggcatcatctgcaaggcagacctgagggagacctactccagctggggaaggtgagtgtccagaggaggagctggacgccatgctgcaagagggcaagggcccatcaacttcaccgtcttcctaacgttctttggggagagctaattggacanaccccccgggagccatcctgagtncctnccncatntttnncccagccncaaaggggtgtnacaaggatnanttcagcagctnctccccccaaggagaaatttcctcagctgggtgaca

SEQ ID NO: 488438 - DNA, 164 bp, Homo sapiens
tgctgggtacgtgcttgatcttaaagatgttttacactatccctgcacccctcgtcccagcctctcttcactttcacttggactgaccctgacaccctttaggctcagcaaattacctgggctgtactgctgcaaagcttcacagacagcccccattacttcaa

SEQ ID NO: 488439 - DNA, 280 bp, Homo sapiens
ccacacctctgcagagagaatggccagcaggaaggcggggacccggggcaaggtggcagccaccaagcaggcccaacgtggttcttccaacgtcttttccatgtttgaacaagcccagatacaggagttcaaagagccttcagctgtatcgaccagaatcgtgatggcatcatctgcaaggcagacctgagggagacctactccagctgggaggtagttccagagagagctgacgcatgtgcagagggcagggcccatcacttacgtctctagtcttgga

SEQ ID NO: 488440 - DNA, 128 bp, Homo sapiens
caaggtttctggtcctggcccttcctgctcctgatggccccttcctatgggtgccacgcggacttctttctagggtggcctttcccatctgtggtgtggcagagcccagcacgtgggggatcacacag

SEQ ID NO: 488441 - DNA, 470 bp, Homo sapiens
  misc_feature (43)..(43): n is a, c, g, or t
  misc_feature (84)..(84): n is a, c, g, or t
  misc_feature (90)..(90): n is a, c, g, or t
  misc_feature (397)..(397): n is a, c, g, or t
  misc_feature (401)..(401): n is a, c, g, or t
  misc_feature (407)..(407): n is a, c, g, or t
tgcgggctggttggctttggggctggggtgttggggcgccctnttctgtttttttcttttctgtttttgctccgcttcttgccntcttcntccgctttttgtgttttctgctgctgccttcgttctttgtcctcctttccgctttccgccccccgccgcgccgtttggctctttctttttttccgctcttccccctttccggctccggttttttttgctttcttctgcttctttttttttttctgtttgctttttctgtggtttttcttttttggggctgttcttctttttccctttgttcttttgttcctgcccttctttttcttttctgctggggctggcgcgagtgcttttggttggcgctttgtgtttttggtgcggtttcgccacctatcgntgcngtggcngcggcgccactttcgtgctctgggcttgttctttgcctttttgtttttggcgctatcctcttt

SEQ ID NO: 488442 - DNA, 291 bp, Homo sapiens
ccacacctctgcagagagaatggccagcaggaaggcggggacccggggcaaggtggcagccaccaagcaggcccaacgtggttcttccaacgtcttttccatgtttgaacaagcccagatacaggagttcaaagagccttcagctgtatcgaccagaatcgtgatggcatcatctgcaaggcagacctgagggagacctactccagcttggtgcgtgcaccaccttccaccctgcgcacttgggtacctactctgagcttcttgcggtggagttgcttgggacaagacctg

SEQ ID NO: 488443 - DNA, 245 bp, Homo sapiens
caccctgggttcttgttaaaaatgtagattacaggcctgagccaccgtgcccgggcttttgatttttttgggggccgggggaaaggagtgtcgttgtgttgcccagctggagtgcagtggtgcaatcttagctaactgcaacctctgcctcccgggttaaagtgattctcctgccccagctactcgggaggctgaggcgggagaatggcgtgaacccgggaggcagagcttgcagtgagccaaga

SEQ ID NO: 488444 - DNA, 404 bp, Homo sapiens
  misc_feature (288)..(288): n is a, c, g, or t
  misc_feature (298)..(298): n is a, c, g, or t
  misc_feature (302)..(302): n is a, c, g, or t
  misc_feature (308)..(309): n is a, c, g, or t
  misc_feature (317)..(318): n is a, c, g, or t
  misc_feature (324)..(324): n is a, c, g, or t
  misc_feature (328)..(328): n is a, c, g, or t
  misc_feature (345)..(345): n is a, c, g, or t
  misc_feature (349)..(349): n is a, c, g, or t
  misc_feature (353)..(353): n is a, c, g, or t
  misc_feature (356)..(356): n is a, c, g, or t
ccacacctctgcagagagaatggccagcaggaaggcggggacccggggcaaggtggcagccaccaagcaggcccaacgtggttcttccaacgtcttttccatgtttgaacaagcccagatacaggagttcaaagaagtctctccccacctcccaccttccctagagctggggctgctccaccttaaggccccatcccacaggccttcagctgtatcgaccagaatcgtgatggcatcatctgcaaggcagacctgagggagacctactccagctgggaaggtagtctnagagagagtngagnatgctnnagagcagnnccatantcangttcctagttttggganagtnatgnaanccgagagcatctagtcctcgatttcaccagcgcaagggtgtacagata

SEQ ID NO: 488445 - DNA, 114 bp, Homo sapiens
agtgggcgcgattcggctcagggcgggctcgcctccggggttcacgccattctccggcctcagcctcccaagtagctggtagagccagacagttctgagttcaagagctgggcc

SEQ ID NO: 488446 - DNA, 429 bp, Homo sapiens
ggacctgcttactgggcgttgcaaaaaacatttaactggttcacttacttgagaatttttttttcatttatgggtctaactttactaatgttatatattatgttctccttttcttagtcctatatcccttaaagcagtgacttcatctgctgtgtgacagcacatcaatgagatcacagcagctctgctgttacaagacaaagacttggcggtactgagtgggtaatcacttgcagacacatacatacacgccctggtttcaatggcatttcctagtaattcacttcgacagaaatctccaacagaaatctccactcacaggtgtcacagcccaaagctgtctttgtaatggtgacctcaccctggtatcacagtgactgtcagggaaagaaagcagctgccacttcctggttcactttcaacaccaag

SEQ ID NO: 488447 - DNA, 187 bp, Homo sapiens
taatgtaggattttgagactgtgcatttgtagtttgacacttgacatcagatttactcaggattctaagagattccatgagatctttgcagatctcagacatactctgtaagttgtgatatagactctctaaatgatgacataaagatcagtctaaatgcactttacataaatatattcatcacatg

SEQ ID NO: 488448 - DNA, 375 bp, Homo sapiens
  misc_feature (259)..(259): n is a, c, g, or t
  misc_feature (269)..(269): n is a, c, g, or t
  misc_feature (273)..(273): n is a, c, g, or t
  misc_feature (279)..(280): n is a, c, g, or t
  misc_feature (288)..(289): n is a, c, g, or t
  misc_feature (295)..(295): n is a, c, g, or t
  misc_feature (299)..(299): n is a, c, g, or t
  misc_feature (316)..(316): n is a, c, g, or t
  misc_feature (320)..(320): n is a, c, g, or t
  misc_feature (324)..(324): n is a, c, g, or t
  misc_feature (327)..(327): n is a, c, g, or t
ccacacctctgcagagagaatggccagcaggaaggcggggacccggggcaaggtggcagccaccaagcaggcccaacgtggttcttccaacgtcttttccatgtttgaacaagcccagatacaggagttcaaagaagctggggctgctccaccttaaggccccatcccacaggccttcagctgtatcgaccagaatcgtgatggcatcatctgcaaggcagacctgagggagacctactccagctgggaaggtagtctnagagagagtngagnatgctnnagagcagnnccatantcangttcctagttttggganagtnatgnaanccgagagcatctagtcctcgatttcaccagcgcaagggtgtacagata

SEQ ID NO: 488449 - DNA, 553 bp, Homo sapiens
agcggggtggtctaggcgctgtgaggctgaggcagcgcagccgctgccgcagggtgcgcgatgccttgaacctgggaaactatgtgacgcaacactctggattggaaagacatctatttcatcatgggacaggcaaatttcggatcgagacacagttggttattaacaagtttatcagaaaaagtagcaaaagatgttacgttaggtatcgagagagtggctccttaacttatgaagaattcttgcggagactcgctgagcttcactgattgtacacggctaacagtggcttctggccaggacacaacctcttctctttgaggtacaacctgggtctgattcctctgcttattggaaagttggttgtacgggtgcgtctgtaccaacgacttaacacacaacgcagtgcgcactcgaaggcaggccatccacggactcatgacgttgagtacacagcgtcacttccaactactctcgtgaacgatatcagcaagtcaacccagacaggagctcttggcccagacgcgtccacctactgaagaccctgcatgcc

SEQ ID NO: 488450 - DNA, 501 bp, Homo sapiens
  misc_feature (383)..(383): n is a, c, g, or t
  misc_feature (407)..(407): n is a, c, g, or t
  misc_feature (411)..(411): n is a, c, g, or t
  misc_feature (414)..(414): n is a, c, g, or t
  misc_feature (418)..(418): n is a, c, g, or t
  misc_feature (422)..(423): n is a, c, g, or t
  misc_feature (431)..(431): n is a, c, g, or t
  misc_feature (443)..(443): n is a, c, g, or t
  misc_feature (452)..(452): n is a, c, g, or t
  misc_feature (454)..(454): n is a, c, g, or t
  misc_feature (465)..(465): n is a, c, g, or t
ccacacctctgcagagagaatggccagcaggaaggcggggacccggggcaaggtggcagccaccaagcaggcccaacgtggttcttccaacgtcttttccatgtttgaacaagcccagatacaggagttcaaagaagtctctccccacctcccaccttccctagagctggggctgctccaccttaaggccccatcccacaggccttcagctgtatcgaccagaatcgtgatggcatcatctgcaaggcagacctgagggagacctactccagctggggaaggtgagtgtccagaggaggagctggacgccatgctgcaagagggcaagggcccatcaacttcaccgtcttcctaacgttctttggggagagctaattggacanaccccccgggagccatcctgagtncctnccncatntttnncccagccncaaaggggtgtnacaaggatnanttcagcagctnctccccccaaggagaaatttcctcagctgggtgaca

SEQ ID NO: 488451 - DNA, 230 bp, Homo sapiens
gctatttggttaagcactcacatatatccatttcagccctaaaaaggaatacataatagatgtgtctagcactactagcactgttggtatggcctttccaaaggtcttccactaaagtcccgagaaattcttaatcttgtctacttctcttattgccgtgttaaattttctgagccattagagattttcaaaatcactttgatttttaaaaactcatcaaatgtgaatca

SEQ ID NO: 488452 - DNA, 438 bp, Homo sapiens
cgcgaggatcataccgtagacatcacagaaaagtagagagtccggatcccttatgaatacatgatgtaaaaatcttcaacaaagtagcagcaagaccaatatctgagcaacatataaaagcattatacaccaaaaaaatatggaaaaagggagagtaggaataagccctgtggtactggactggacttaacagtacagatttgggctgttaatggtttttattatatagataaatgcagaaggataaataaatgttcatgtgtataggtctatttgctgagagggcctaaacaaagacactcagtaacaattagcttaccaagcacccagatctcggtttccaaatcctacaagccacacacacacacacacacacacacacacacacaccagtctggaggctcggcgtgtgcaggatggaccctcggcgtgtgcagg

SEQ ID NO: 488453 - DNA, 180 bp, Homo sapiens
ggtcatttttcctcttttttttttaattgggtaggaccccccatataaaaacagtcaatatttggcaatgtggaatttcccaatttaaaaagaatactatgaatggattcatattttttttatattgaataaacaatgtaacatagataaccatataaataaaagtggtatggccagtta

SEQ ID NO: 488454 - DNA, 337 bp, Homo sapiens
  misc_feature (12)..(12): n is a, c, g, or t
  misc_feature (30)..(30): n is a, c, g, or t
  misc_feature (65)..(66): n is a, c, g, or t
  misc_feature (309)..(309): n is a, c, g, or t
  misc_feature (327)..(327): n is a, c, g, or t
gattcggcacgngggggaagattgaggtcnttcttttgcagtgataaaaatgtcctaaaattganngtagcgatggtcacacaactctgaatatgcttaagaccattgaattacacactttacgttggtgaattgtatggtatgtaaattatagttcaataacatagttacaaaagataatcaaaagcatgaaagcactattgatgtggtttggatctgtgtcctcacccgagtctcatgttgaaatgtaagccccctggtgggaaggcgaatgggattatggggcaaagtccccacaaacgggttaanaaccaacccggtcaattnctggtccccc

SEQ ID NO: 488455 - DNA, 159 bp, Homo sapiens
tcaatcgacggttctccaatacacttataactgcattatagttgatatctgtgtgggcgagtgacacaaagagcactctaaaaggctgcgaaaatacagatcatgggggggaattttttttttttttctttttctggggaaaaggttttcccaggggat

SEQ ID NO: 488456 - DNA, 87 bp, Homo sapiens
cagccctgggcttatcttaagaacataaaacctgtctcactggacccaactctctgtcctgttccttattctttctcagtgtcacca

SEQ ID NO: 488457 - DNA, 159 bp, Homo sapiens
tacggtgctacagtgtctagagtctagctgtgatctcgagtcagtactcgtgtgccctctttaagtgtctaacaactaacatttggcgttcaacgttgcgtgtacactcctgccatcggtgttcaagctccagaagtgctctgtcagtgccttcgaggg

SEQ ID NO: 488458 - DNA, 999 bp, Homo sapiens
cccacgcgtccgggggaggggggtccgacccagcgcggacctcgccggagacaccccgcccgccccggcccggtcctgcgggggcatgcgaggcaggggagggggcgcgcccggggctcccaccgacgctcgacccgggcgcaagggccggagcccccgggttcccgagcctcggagccgcgcggctgtgctgccgccctgatggcctggcgtccgcactgcgcctcgggcccggccgcgctccagcgcgtgcaccccggactccgccctgtccctggacctccgctgggccccgagtcttcctgccagacccctcgagccccagggaggcaggggcgggcgccaggggtagacaggcggggccaatgatgggcaaggcatagctcgggagcgagggcggaggtgcgcgcaggctgcagagggagccggggaccccaatggcccaggacgggtcaggggctgcccttgagcgcaagagggaacgcgggcaggtaaccccgatagcgacatcgatgggcatacctggcaggcccatagaaaggaccccacaggacgagggatctgggaaaacgtgaaccctacaaagatcctaaacaagcagacatggcaaagggtgtgcccgaacatcccacgcggcccgatggggcaaagggagggcccatgagcccgcaacgacgaaacagagacacacagaaaggaccaccgtggcaacgcgaccaaaaccacaagagtcacagaacagggaacgggaagcccgagcacccggggcagcccaaacccctcaaggaaccggacgagaagcagggacccacagggggcccacgaaagtgaccgggctcacgcgtaacacccgaggaagcacggcaggccaggaggaaaggcacgccccaggaacaggaccaggacccaggcacggggccggacccagagaggcacacaacacgggagagagacagggccaggaaggaggaagccagcaacgcagcaagacgacagggg

SEQ ID NO: 488459 - DNA, 672 bp, Homo sapiens
taggcacctgtagtcccagctacttgggaggctgaggcaggagaatggcatgaacctaggaggcggagcttgcagtgagccgagatcgcgccactgcactccagcctgggcgacagagcgagactcagtctcaaaaaaaccaaaaaaacaaaaaaacaaaaaacgggctgggtgcggtggctcacgcctgtaatctcagcactttgggaggctgaggtgggtggatcatctgaggtcagaagttcgagaccagcctggccaacatggtgaaaccccatctctactaaaaatacaaaaattagccgggtggcagtggtgcgcgtctgtaatcccagctactgaggaggctgaggcgggagaattgcttgagcctgggaggcagaggttgtggtgagctgagatcatgccactgggctcactccagtcggggtgacagaatgagaccctgtctcaaaaaaaaaaaaaagaaggacattacggtttttaaatgtggcctctaaattggcctgtgaaccaactatgggacagaatggatgaattatttggtcagcgatgataatgtgtgtgactatacagaaaaactttatttttcacttgtgccctggagtatataacggtgtctgaagacatgatggtgtgtctactgagaaatatgtcagataaaacataaag

SEQ ID NO: 488460 - DNA, 117 bp, Homo sapiens
gtgaatatgactcgggtactggaggatctctagagtaaacaaggatcagcaacgatatatggaggtcagcacggtgctcacgtagtccgacgagaactagtacaggagaggcatagc

SEQ ID NO: 488461 - DNA, 1294 bp, Homo sapiens
gtcccagctactcgggaggctgaggctgaagcgatccacctgctttggcctcccaaaacagtgggattgcaggcgtgagccaccatgcctggctgaaattcaccttttaagatgtacaattcagtggtttttagtatattcacacacaaaattgcacaactatcactaacatctaattttagatcattttgtaacttcaccaagaaaccccaggtctgtcagcagtcagttccattcccccttcatcccagcctctggcaaccactaatctgctttctgtcactattgatttggccagacactattcttctgtgcttctcatgcatctcctgtaataccagtgctacaattctcattttatgtggaaaattgaggcactgagaggttaagtaaattgcccacggtcacacagtaatttgatttacaacagtaataacacattagatgagaacacagtaggacacaattttgaattccatttttatgtacctgaaatgaatacacccctcccccaaggtattttccctattgttagcctttgtaccctaggtacaaatataggtattttccctattgtgttatgtacctgaaatgaatacacccttcccccaaggtattttccctattgttagcctttgtaccctagaactgactggatgtagataacatttgttttcagagtaatggaacactgtatcagcagcatctgagaacataagaacagttggacattggaaagaggtttgttgccctcatccctccttgaacctcttttctctcccgcttccaccaccaccacacatatatacccctttttctcagtcttaagcatcaaacaatttctgcctctttctttttaattctcccagagggatggttaatgcatcacaatttaacttgtctattcaggtattaatagtcaagggatgcatctgtttgcttatagtaccagttatattcctaggaccttagagagcagtagtgtgagaatagaatgcctttctatttgggttaaactatgtgggaggaaaaagtaacagagtaaaggctttgccttaatgaagtcaagtgttctgcctggtgggaagtggccacacgctgcactgcgctgctcttgtttactctgttctttcagagcctttgtactttgccatcactgctagtaatttcttggtccttttcaatactccattttaatcttgatttttttctataaataataaatctgtgaaaaatctgtaaaaagatttgtgactattaaatgtgcaactaaaaacactggaaaaagaaaaaa

SEQ ID NO: 488462 - DNA, 594 bp, Homo sapiens
ggcccccagaccggggcttccacccgccgtgttgatgcccctcgtgggttccgcccctccgttgaaaccacgaccgggtgtattccgccctcacggcggttattgcctggcccccgggggcctccccactggtgtgttagtatagtgtccccccgcgcgtggccccgttattctgccgtcccgtggcgtgttcgcgcacgcttgtcaacgggtctgtttatgtttgttccccccctcccagcgcccctcggtgtcttctgcgttcctcccgtccccctatttccgccgggctcctttccgggtgcccaccacatttcttgtgaggcaccaccgcgggtctcccacggcgttctcactcggccttatttgtgggcgccccccttcgcccctccttactggtgttctcctccccccgccctcggtaatgtttccctcttcaccggccccacacccactttcggtttgtaagaacccccgcccggagatacttgcgcgtttttttatgagaagcgtgtgttgaggataatattcttgagtatggttactcctgctttttgtgtgggagggcgcccgccaaacaaatgacaaagaaaa

SEQ ID NO: 488463 - DNA, 6697 bp, Homo sapiens
  misc_feature (263)..(263): n is a, c, g, or t
  misc_feature (301)..(301): n is a, c, g, or t
tttatcttttaagttattgtcacaatagttactctcttttagaccctgaacattttcagtacttgctccaaatggtttagcaacttttgaagtgggattaacaagtttggccaatgaagcttcttccctgcccaccgccagaggtgctggagaaaagtaatcctggagggtcggcgtggaggcagtagagaggtttataaaagtcaaggaagtgggaagaggcttgcgagcagcaggagaggcgcagagtcagaggggcaggngcggcggcggagggagcaggaggttggggcttgagccngtcattccggcgcacgaaaacttgaagtcgctcggtagccggggaagggaaggaagagaggcaggctctttcctagaggtgccgtgatcgagggtctggcactccaagccaactcctgagaacgggaaatgggcgggagtcggtggggtggagagggcagccgtggtcgcgagagcgaaggagcggtctgagaatccggcttgagtgttaaaggctaagcgtgtctagctggacccgtggccccgaagaagcgagacaaggcgacgcggagctgtccctgacaccccgaggaccgagggacagcgaagggccggggccgccggccattgccaggcgccattaggtgacgcggccgtcacgcgatgacgcgctgaccggcagtggcctccacgtcgcaggttccgcaaagacctgtgggagcgacccgggagaaggagggccaagatggcggaagcggaggagtctccaggagacccggggacagcatcgcccaggcccctgtttgcaggcctttcagatatatccatctcacaagacatccccgtagaaggagaaatcaccattcctatgagatctcgcatccgggagtttgacagctccacattaaatgaatctgttcgcaataccatcatgcgtgatctaaaagctgttgggaaaaaattcatgcatgttttgtacccaaggaaaagtaatactcttttgagagattgggatttgtggggccctttgatcctttgtgtgacactcgcattaatgctgcaaagagactctgcagatagtgaaaaagatggagggccccaatttgcagaggtgtttgtcattgtctggtttggtgcagttaccatcaccctcaactcaaaacttcttggagggaacatatctttttttcagagcctctgtgtgctgggttactgtatacttcccttgacagtagcaatgctgatttgccggctggtacttttggctgatccaggacctgtaaacttcatggttcggctttttgtggtgattgtgatgtttgcctggtctatagttgcctccacagctttccttgctgatagccagcctccaaaccgcagagccctagctgtttatcctgttttcctgttttactttgtcatcagttggatgattctcacctttactcctcagtaaatcaggaatgggaaattaaaaccagtgaattgaaagcacatctgaaagatgcaattcaccatggagctttgtctctggcccttattttgtctaattttggaggtatttgataactgagtaggtgaggagattaaaagggagccatatagcactgtcaccccttatttgaggaactgatgtttgaaaggctgttcttttctctcttaatgtcatttctttaaaaatacatgtgcatactacacacagtatataatgcctccttaaggcatgatggagtcaccgtggtccatttgggtgacaaccagtgacttgggaagcacatagatacatcttacaagttgaatagagttgataactattttcagttttgagaataccagttcaggtgcagctcttaaacacattgccttatgactattagaatatgcctctcttttcataaataaaaatacatggtctatatccattttcttttatttctctctcttaagcttaaaaaggcaatgagagaggttaggagtgggttcatacacggagaatgagaaaacatgcattaaccaatattcagattttgatcaggggaaattctacacttgttgcaaaaaaaaaaaaaaaaaaagcaaagggcctctaaagaatcagcctctttggtccctttgtgctgtcacctttttgccatgtttaacagcatcttggttggcactctagtcttaatcttgctccttaactttgaatatgcagtctaaaatgtcagtagtcaacatgtaattttcctttgaaattctgaatattccagtgctggaacttatccaaaaagaagacctcagaaacttagattggtagatctctagtgcatattatcatgtgggcaccttctcttagggtggaatgaggcagtctggatgcagcatagttaaaaggagctgtttaatattctctgtagtctggcctcttaactagaaagtaaagctaaatcagaagcctgtatttaaccatgtgaacagggagggatttagtgttctgatggctgattaatagaacagctagatacttagagcatgacgtgggatgggatgagtttacagctgctgccttttcatggtgagcttagcagttttctcattagatgtgtttttttgggttggggaatagcaatttattttattgattttagactttatcaagctaattagctcccctttagataagtacatgttgcacatgtgcacctacttgtaatctcagatatttatgcacacaagtgtgaaggtttttcagggagcagagcatctgggacaggctgattctgagctaaacagggctcctttaaggcaatatgaactgttgccttctataaattgcacattgaggaactctaatagacaaagattaggtgtcaggcagaaaacactcattgtaaatatactattagttgataaacataggactttcttattccccagtttttctttatcatataatttaaatatttattcattttgtatttaaagactacctacacatagatatatgattccaaagtcatactttctccatccccacattagccaagtgaatacagggccaaatgggttcttggaatgataataacaaagcattacaaagtgggtccccttggttccagccttgtccagagtttttggttatatatttctatttattacaatttaccttttaaattgtaaaataaacctttgtgtggacagagccaatgtttcaatcttgaatgagtaaagaaaatactttggaactgatcctcattttgaaattggttctaaattattatccatttccaatgtctgaaattctcttacttcctgctaaaactctctttctgccaaagttgtttcgtaatctgtctcaatgactataatgtaaaattaaagaagtaaccatgcttctcaagggggaattaaaagtgtttattgaattttactcaggctaattgtttggtcagaaattcctaaggccacagctttggggggttcgtgtagatgtacatggtgggtgggttataaatattgggacttaaggcagcttgttctatgtatttatctttgctcttgggtgacttagggaatgattttatttgatttaaccttctttctgtttgccccgagaatactcgccagtggcgcttgcagttgtagcatttaccccaagataactttgcctacgaaatatttcgcttttattattttcacatcattctagtatatggactttggaaacaaaagacattgttctatttatagcattcttttttttttttagtagcggtatttccatttacaaaatatagtaactcttgattactgaaaatgtcaaatcctagaaaacgtagcatgcctatacatgatgttaacatcattctcgaacagttgttggccgaagattcatttgatgaatccaatttttttgaaatagacaattctgatgttctctttagaaataactcagtttttatcttttttcacattgaaaatcagttagatttgcttaagcctcaaagagaatgtttatgtaaattagcgctggcaatttttttttttctaaacaggaaaagggttaaatgaaggttgataaaatggatgttcaattgtctttctgaaagtgagtggcttgaagggatgaataaatattttcttaatatattcaaaaaagtgcattgctttctgtgatggaagttaagacctaaatgtctggaagttgtaaccctcaacacagcttttcctgatttgctgcaaaggcacatagctgattatagaagtgaagacggcaaggacggggactccaacaaaggaaaccctgttgcaggatttgggaactttcatgcttcagatgaaattcaggcatgtgagcatcactgcagaatgtggtgcatcattgccatcatgagtaatcacttgctgctcctacttctgagaccaagactcttttgtcatattctttagcaataggacgggtaaagactggatttaattgctgttcagagtataaaaactcaattgattccaacatatctgaatgtgcagtaaagtcttaaaagtcaaccgttaatcattaagtcttttgcctctaaagtcttttgcctctgaagaggtttattacatgagttgattttcatattttcattttggtggggttttcctgttgttgggcaaggtggggtcacaggacatgggactagtaagcattttactgtttactatatttgtctttttataaacagtatctcccaaaatgtgattagaaggctaccaagcctgtatttggacatttaattgtgtgctttatataatgtaactactaacagtatttggactgcctgttcattcctggagacaaaaatgaaaatctgtcagttcaagttcttgggtaacatcaagtcattagaatttatctaaagcttatcatgatttgataagacatccattgcatgcagctgttttagctcagtgcaaaacactgaaattgtgattcttagactgtttctgagacatttggatggaaataaatgtataaatgttaattcatgtatataaattagaaacacttttctagattctgtaggcttttgttaaaaatagagaatttcttggggtttacttaggccacagaatggccaaataataataatgacaatgatattactaataataatagctaacctttatttggcacttactgtgtgccaggcactattctatttttttaagaatttttaaaataacagctttattgaaatacactttaccataaacttcacctttttattttttatttttatgagacagggactcacccaggctggagtgcagtggagcagtcatggcacactgtagcctcgacctccctgggctcaagcaatcctcccacttcagtgtcccgagtagttgggactacaggcatgcgtcactacacctaattggctaatttttgtagtttttgtagagatagggtttcgccatgttgcctaggctggtcttgaattcctgggctcaagcgatccacctgctttggcctcccaaaacagtgggattgcaggcgtgagccaccatgcctggctgaaattcaccttttaagatgtacaattcagtggtttttagtatattcacacacaaaattgcacaactatcactaacatctaattttagatcattttgtaacttcaccaagaaaccccaggtctgtcagcagtcagttccattcccccttcatcccagcctctggcaaccactaatctgctttctgtcactattgatttggccagacactattcttctgtgcttctcatgcatctcctgtaataccagtgctacaattctcattttatgtggaaaattgaggcactgagaggttaagtaaattgcccacggtcacacagtaatttgatttacaacagtaataacacattagatgagaacacagtaggacacaattttgaattccatttttatgtacctgaaatgaatacacccctcccccaaggtattttccctattgttagcctttgtaccctaggtacaaatataggtattttccctattgtgttatgtacctgaaatgaatacacccttcccccaaggtattttccctattgttagcctttgtaccctagaactgactggatgtagataacatttgttttcagagtaatggaacactgtatcagcagcatctgagaacataagaacagttggacattggaaagaggtttgttgccctcatccctccttgaacctcttttctctcccgcttccaccaccaccacacatatatacccctttttctcagtcttaagcatcaaacaatttctgcctctttctttttaattctcccagagggatggttaatgcatcacaatttaacttgtctattcaggtattaatagtcaagggatgcatctgtttgcttatagtaccagttatattcctaggaccttagagagcagtagtgtgagaatagaatgcctttctatttgggttaaactatgtgggaggaaaaagtaacagagtaaaggctttgccttaatgaagtcaagtgttctgcctggtgggaagtggccacacgctgcactgcgctgctcttgtttactctgttctttcagagcctttgtactttgccatcactgctagtaatttcttggtccttttcaatactccattttaatcttgatttttttctataaataataaatctgtgaaaaatctgtaaaaa

SEQ ID NO: 488464 - DNA, 6746 bp, Homo sapiens
  misc_feature (263)..(263): n is a, c, g, or t
  misc_feature (301)..(301): n is a, c, g, or t
tttatcttttaagttattgtcacaatagttactctcttttagaccctgaacattttcagtacttgctccaaatggtttagcaacttttgaagtgggattaacaagtttggccaatgaagcttcttccctgcccaccgccagaggtgctggagaaaagtaatcctggagggtcggcgtggaggcagtagagaggtttataaaagtcaaggaagtgggaagaggcttgcgagcagcaggagaggcgcagagtcagaggggcaggngcggcggcggagggagcaggaggttggggcttgagccngtcattccggcgcacgaaaacttgaagtcgctcggtagccggggaagggaaggaagagaggcaggctctttcctagaggtgccgtgatcgagggtctggcactccaagccaactcctgagaacgggaaatgggcgggagtcggtggggtggagagggcagccgtggtcgcgagagcgaaggagcggtctgagaatccggcttgagtgttaaaggctaagcgtgtctagctggacccgtggccccgaagaagcgagacaaggcgacgcggagctgtccctgacaccccgaggaccgagggacagcgaagggccggggccgccggccattgccaggcgccattaggtgacgcggccgtcacgcgatgacgcgctgaccggcagtggcctccacgtcgcaggttccgcaaagacctgtgggagcgacccgggagaaggagggccaagatggcggaagcggaggagtctccaggagacccggggacagcatcgcccaggcccctgtttgcaggcctttcagatatatccatctcacaagacatccccgtagaaggagaaatcaccattcctatgagatctcgcatccgggagtttgacagctccacattaaatgaatctgttcgcaataccatcatgcgtgatctaaaagctgttgggaaaaaattcatgcatgttttgtacccaaggaaaagtaatactcttttgagagattgggatttgtggggccctttgatcctttgtgtgacactcgcattaatgctgcaaagagactctgcagatagtgaaaaagatggagggccccaatttgcagaggtgtttgtcattgtctggtttggtgcagttaccatcaccctcaactcaaaacttcttggagggaacatatctttttttcagagcctctgtgtgctgggttactgtatacttcccttgacagtagcaatgctgatttgccggctggtacttttggctgatccaggacctgtaaacttcatggttcggctttttgtggtgattgtgatgtttgcctggtctatagttgcctccacagctttccttgctgatagccagcctccaaaccgcagagccctagctgtttatcctgttttcctgttttactttgtcatcagttggatgattctcacctttactcctcagtaaatcaggaatgggaaattaaaaccagtgaattgaaagcacatctgaaagatgcaattcaccatggagctttgtctctggcccttattttgtctaattttggaggtatttgataactgagtaggtgaggagattaaaagggagccatatagcactgtcaccccttatttgaggaactgatgtttgaaaggctgttcttttctctcttaatgtcatttctttaaaaatacatgtgcatactacacacagtatataatgcctccttaaggcatgatggagtcaccgtggtccatttgggtgacaaccagtgacttgggaagcacatagatacatcttacaagttgaatagagttgataactattttcagttttgagaataccagttcaggtgcagctcttaaacacattgccttatgactattagaatatgcctctcttttcataaataaaaatacatggtctatatccattttcttttatttctctctcttaagcttaaaaaggcaatgagagaggttaggagtgggttcatacacggagaatgagaaaacatgcattaaccaatattcagattttgatcaggggaaattctacacttgttgcaaaaaaaaaaaaaaaaaaagcaaagggcctctaaagaatcagcctctttggtccctttgtgctgtcacctttttgccatgtttaacagcatcttggttggcactctagtcttaatcttgctccttaactttgaatatgcagtctaaaatgtcagtagtcaacatgtaattttcctttgaaattctgaatattccagtgctggaacttatccaaaaagaagacctcagaaacttagattggtagatctctagtgcatattatcatgtgggcaccttctcttagggtggaatgaggcagtctggatgcagcatagttaaaaggagctgtttaatattctctgtagtctggcctcttaactagaaagtaaagctaaatcagaagcctgtatttaaccatgtgaacagggagggatttagtgttctgatggctgattaatagaacagctagatacttagagcatgacgtgggatgggatgagtttacagctgctgccttttcatggtgagcttagcagttttctcattagatgtgtttttttgggttggggaatagcaatttattttattgattttagactttatcaagctaattagctcccctttagataagtacatgttgcacatgtgcacctacttgtaatctcagatatttatgcacacaagtgtgaaggtttttcagggagcagagcatctgggacaggctgattctgagctaaacagggctcctttaaggcaatatgaactgttgccttctataaattgcacattgaggaactctaatagacaaagattaggtgtcaggcagaaaacactcattgtaaatatactattagttgataaacataggactttcttattccccagtttttctttatcatataatttaaatatttattcattttgtatttaaagactacctacacatagatatatgattccaaagtcatactttctccatccccacattagccaagtgaatacagggccaaatgggttcttggaatgataataacaaagcattacaaagtgggtccccttggttccagccttgtccagagtttttggttatatatttctatttattacaatttaccttttaaattgtaaaataaacctttgtgtggacagagccaatgtttcaatcttgaatgagtaaagaaaatactttggaactgatcctcattttgaaattggttctaaattattatccatttccaatgtctgaaattctcttacttcctgctaaaactctctttctgccaaagttgtttcgtaatctgtctcaatgactataatgtaaaattaaagaagtaaccatgcttctcaagggggaattaaaagtgtttattgaattttactcaggctaattgtttggtcagaaattcctaaggccacagctttggggggttcgtgtagatgtacatggtgggtgggttataaatattgggacttaaggcagcttgttctatgtatttatctttgctcttgggtgacttagggaatgattttatttgatttaaccttctttctgtttgccccgagaatactcgccagtggcgcttgcagttgtagcatttaccccaagataactttgcctacgaaatatttcgcttttattattttcacatcattctagtatatggactttggaaacaaaagacattgttctatttatagcattcttttttttttttagtagcggtatttccatttacaaaatatagtaactcttgattactgaaaatgtcaaatcctagaaaacgtagcatgcctatacatgatgttaacatcattctcgaacagttgttggccgaagattcatttgatgaatccaatttttttgaaatagacaattctgatgttctctttagaaataactcagtttttatcttttttcacattgaaaatcagttagatttgcttaagcctcaaagagaatgtttatgtaaattagcgctggcaatttttttttttctaaacaggaaaagggttaaatgaaggttgataaaatggatgttcaattgtctttctgaaagtgagtggcttgaagggatgaataaatattttcttaatatattcaaaaaagtgcattgctttctgtgatggaagttaagacctaaatgtctggaagttgtaaccctcaacacagcttttcctgatttgctgcaaaggcacatagctgattatagaagtgaagacggcaaggacggggactccaacaaaggaaaccctgttgcaggatttgggaactttcatgcttcagatgaaattcaggcatgtgagcatcactgcagaatgtggtgcatcattgccatcatgagtaatcacttgctgctcctacttctgagaccaagactcttttgtcatattctttagcaataggacgggtaaagactggatttaattgctgttcagagtataaaaactcaattgattccaacatatctgaatgtgcagtaaagtcttaaaagtcaaccgttaatcattaagtcttttgcctctaaagtcttttgcctctgaagaggtttattacatgagttgattttcatattttcattttggtggggttttcctgttgttgggcaaggtggggtcacaggacatgggactagtaagcattttactgtttactatatttgtctttttataaacagtatctcccaaaatgtgattagaaggctaccaagcctgtatttggacatttaattgtgtgctttatataatgtaactactaacagtatttggactgcctgttcattcctggagacaaaaatgaaaatctgtcagttcaagttcttgggtaacatcaagtcattagaatttatctaaagcttatcatgatttgataagacatccattgcatgcagctgttttagctcagtgcaaaacactgaaattgtgattcttagactgtttctgagacatttggatggaaataaatgtataaatgttaattcatgtatataaattagaaacacttttctagattctgtaggcttttgttaaaaatagagaatttcttggggtttacttaggccacagaatggccaaataataataatgacaatgatattactaataataatagctaacctttatttggcacttactgtgtgccaggcactattctatttttttaagaatttttaaaataacagctttattgaaatacactttaccataaacttcacctttttattttttatttttatgagacagggactcacccaggctggagtgcagtggagcagtcatggcacactgtagcctcgacctccctgggctcaagcaatcctcccacttcagtgtcccgagtagttgggactacaggcatgcgtcactacacctaattggctaatttttgtagtttttgtagagatagggtttcgccatgttgcctaggctggtcttgaattcctgggctcaagcgatccacctgctttggcctcccaaaacagtgggattgcaggcgtgagccaccatgcctggctgaaattcaccttttaagatgtacaattcagtggtttttagtatattcacacacaaaattgcacaactatcactaacatctaattttagatcattttgtaacttcaccaagaaaccccaggtctgtcagcagtcagttccattcccccttcatcccagcctctggcaaccactaatctgctttctgtcactattgatttggccagacactattcttctgtgcttctcatgcatctcctgtaataccagtgctacaattctcattttatgtggaaaattgaggcactgagaggttaagtaaattgcccacggtcacacagtaatttgatttacaacagtaataacacattagatgagaacacagtaggacacaattttgaattccatttttatgtacctgaaatgaatacacccctcccccaaggtattttccctattgttagcctttgtaccctaggtacaaatataggtattttccctattgtgttatgtacctgaaatgaatacacccttcccccaaggtattttccctattgttagcctttgtaccctagaactgactggatgtagataacatttgttttcagagtaatggaacactgtatcagcagcatctgagaacataagaacagttggacattggaaagaggtttgttgccctcatccctccttgaacctcttttctctcccgcttccaccaccaccacacatatatacccctttttctcagtcttaagcatcaaacaatttctgcctctttctttttaattctcccagagggatggttaatgcatcacaatttaacttgtctattcaggtattaatagtcaagggatgcatctgtttgcttatagtaccagttatattcctaggaccttagagagcagtagtgtgagaatagaatgcctttctatttgggttaaactatgtgggaggaaaaagtaacagagtaaaggctttgccttaatgaagtcaagtgttctgcctggtgggaagtggccacacgctgcactgcgctgctcttgtttactctgttctttcagagcctttgtactttgccatcactgctagtaatttcttggtccttttcaatactccattttaatcttgatttttttctataaataataaatctgtgaaaaatctgtaaaaagatttgtgactattaaatgtgcaactaaaaacactggaaaaagaaaaaa

SEQ ID NO: 488465 - DNA, 325 bp, Homo sapiens
ttcctacgcttttctttttgttgacctgactgctgcatggggccctctgagaaggccctgatggagggccaccttccacagactggcaaagaggggacagttagctaacagtcaaactaaggactgtgacccggagctgccacttttgggggggacttcagaactggcttctgcctgcatgcatgaggaacgaattttgaggttccaataagcagccagagaaagaactcttgagggtggggttgcagtgggcctcctgcgcaggggcctttttttcacctgctcttagaccggcttgagctacaagtataaagattttggagtt

SEQ ID NO: 488466 - DNA, 7113 bp, Homo sapiens
  misc_feature (263)..(263): n is a, c, g, or t
  misc_feature (301)..(301): n is a, c, g, or t
  misc_feature (6816)..(6816): n is a, c, g, or t
  misc_feature (6820)..(6820): n is a, c, g, or t
  misc_feature (6831)..(6831): n is a, c, g, or t
tttatcttttaagttattgtcacaatagttactctcttttagaccctgaacattttcagtacttgctccaaatggtttagcaacttttgaagtgggattaacaagtttggccaatgaagcttcttccctgcccaccgccagaggtgctggagaaaagtaatcctggagggtcggcgtggaggcagtagagaggtttataaaagtcaaggaagtgggaagaggcttgcgagcagcaggagaggcgcagagtcagaggggcaggngcggcggcggagggagcaggaggttggggcttgagccngtcattccggcgcacgaaaacttgaagtcgctcggtagccggggaagggaaggaagagaggcaggctctttcctagaggtgccgtgatcgagggtctggcactccaagccaactcctgagaacgggaaatgggcgggagtcggtggggtggagagggcagccgtggtcgcgagagcgaaggagcggtctgagaatccggcttgagtgttaaaggctaagcgtgtctagctggacccgtggccccgaagaagcgagacaaggcgacgcggagctgtccctgacaccccgaggaccgagggacagcgaagggccggggccgccggccattgccaggcgccattaggtgacgcggccgtcacgcgatgacgcgctgaccggcagtggcctccacgtcgcaggttccgcaaagacctgtgggagcgacccgggagaaggagggccaagatggcggaagcggaggagtctccaggagacccggggacagcatcgcccaggcccctgtttgcaggcctttcagatatatccatctcacaagacatccccgtagaaggagaaatcaccattcctatgagatctcgcatccgggagtttgacagctccacattaaatgaatctgttcgcaataccatcatgcgtgatctaaaagctgttgggaaaaaattcatgcatgttttgtacccaaggaaaagtaatactcttttgagagattgggatttgtggggccctttgatcctttgtgtgacactcgcattaatgctgcaaagagactctgcagatagtgaaaaagatggagggccccaatttgcagaggtgtttgtcattgtctggtttggtgcagttaccatcaccctcaactcaaaacttcttggagggaacatatctttttttcagagcctctgtgtgctgggttactgtatacttcccttgacagtagcaatgctgatttgccggctggtacttttggctgatccaggacctgtaaacttcatggttcggctttttgtggtgattgtgatgtttgcctggtctatagttgcctccacagctttccttgctgatagccagcctccaaaccgcagagccctagctgtttatcctgttttcctgttttactttgtcatcagttggatgattctcacctttactcctcagtaaatcaggaatgggaaattaaaaccagtgaattgaaagcacatctgaaagatgcaattcaccatggagctttgtctctggcccttattttgtctaattttggaggtatttgataactgagtaggtgaggagattaaaagggagccatatagcactgtcaccccttatttgaggaactgatgtttgaaaggctgttcttttctctcttaatgtcatttctttaaaaatacatgtgcatactacacacagtatataatgcctccttaaggcatgatggagtcaccgtggtccatttgggtgacaaccagtgacttgggaagcacatagatacatcttacaagttgaatagagttgataactattttcagttttgagaataccagttcaggtgcagctcttaaacacattgccttatgactattagaatatgcctctcttttcataaataaaaatacatggtctatatccattttcttttatttctctctcttaagcttaaaaaggcaatgagagaggttaggagtgggttcatacacggagaatgagaaaacatgcattaaccaatattcagattttgatcaggggaaattctacacttgttgcaaaaaaaaaaaaaaaaaaagcaaagggcctctaaagaatcagcctctttggtccctttgtgctgtcacctttttgccatgtttaacagcatcttggttggcactctagtcttaatcttgctccttaactttgaatatgcagtctaaaatgtcagtagtcaacatgtaattttcctttgaaattctgaatattccagtgctggaacttatccaaaaagaagacctcagaaacttagattggtagatctctagtgcatattatcatgtgggcaccttctcttagggtggaatgaggcagtctggatgcagcatagttaaaaggagctgtttaatattctctgtagtctggcctcttaactagaaagtaaagctaaatcagaagcctgtatttaaccatgtgaacagggagggatttagtgttctgatggctgattaatagaacagctagatacttagagcatgacgtgggatgggatgagtttacagctgctgccttttcatggtgagcttagcagttttctcattagatgtgtttttttgggttggggaatagcaatttattttattgattttagactttatcaagctaattagctcccctttagataagtacatgttgcacatgtgcacctacttgtaatctcagatatttatgcacacaagtgtgaaggtttttcagggagcagagcatctgggacaggctgattctgagctaaacagggctcctttaaggcaatatgaactgttgccttctataaattgcacattgaggaactctaatagacaaagattaggtgtcaggcagaaaacactcattgtaaatatactattagttgataaacataggactttcttattccccagtttttctttatcatataatttaaatatttattcattttgtatttaaagactacctacacatagatatatgattccaaagtcatactttctccatccccacattagccaagtgaatacagggccaaatgggttcttggaatgataataacaaagcattacaaagtgggtccccttggttccagccttgtccagagtttttggttatatatttctatttattacaatttaccttttaaattgtaaaataaacctttgtgtggacagagccaatgtttcaatcttgaatgagtaaagaaaatactttggaactgatcctcattttgaaattggttctaaattattatccatttccaatgtctgaaattctcttacttcctgctaaaactctctttctgccaaagttgtttcgtaatctgtctcaatgactataatgtaaaattaaagaagtaaccatgcttctcaagggggaattaaaagtgtttattgaattttactcaggctaattgtttggtcagaaattcctaaggccacagctttggggggttcgtgtagatgtacatggtgggtgggttataaatattgggacttaaggcagcttgttctatgtatttatctttgctcttgggtgacttagggaatgattttatttgatttaaccttctttctgtttgccccgagaatactcgccagtggcgcttgcagttgtagcatttaccccaagataactttgcctacgaaatatttcgcttttattattttcacatcattctagtatatggactttggaaacaaaagacattgttctatttatagcattcttttttttttttagtagcggtatttccatttacaaaatatagtaactcttgattactgaaaatgtcaaatcctagaaaacgtagcatgcctatacatgatgttaacatcattctcgaacagttgttggccgaagattcatttgatgaatccaatttttttgaaatagacaattctgatgttctctttagaaataactcagtttttatcttttttcacattgaaaatcagttagatttgcttaagcctcaaagagaatgtttatgtaaattagcgctggcaatttttttttttctaaacaggaaaagggttaaatgaaggttgataaaatggatgttcaattgtctttctgaaagtgagtggcttgaagggatgaataaatattttcttaatatattcaaaaaagtgcattgctttctgtgatggaagttaagacctaaatgtctggaagttgtaaccctcaacacagcttttcctgatttgctgcaaaggcacatagctgattatagaagtgaagacggcaaggacggggactccaacaaaggaaaccctgttgcaggatttgggaactttcatgcttcagatgaaattcaggcatgtgagcatcactgcagaatgtggtgcatcattgccatcatgagtaatcacttgctgctcctacttctgagaccaagactcttttgtcatattctttagcaataggacgggtaaagactggatttaattgctgttcagagtataaaaactcaattgattccaacatatctgaatgtgcagtaaagtcttaaaagtcaaccgttaatcattaagtcttttgcctctaaagtcttttgcctctgaagaggtttattacatgagttgattttcatattttcattttggtggggttttcctgttgttgggcaaggtggggtcacaggacatgggactagtaagcattttactgtttactatatttgtctttttataaacagtatctcccaaaatgtgattagaaggctaccaagcctgtatttggacatttaattgtgtgctttatataatgtaactactaacagtatttggactgcctgttcattcctggagacaaaaatgaaaatctgtcagttcaagttcttgggtaacatcaagtcattagaatttatctaaagcttatcatgatttgataagacatccattgcatgcagctgttttagctcagtgcaaaacactgaaattgtgattcttagactgtttctgagacatttggatggaaataaatgtataaatgttaattcatgtatataaattagaaacacttttctagattctgtaggcttttgttaaaaatagagaatttcttggggtttacttaggccacagaatggccaaataataataatgacaatgatattactaataataatagctaacctttatttggcacttactgtgtgccaggcactattctatttttttaagaatttttaaaataacagctttattgaaatacactttaccataaacttcacctttttattttttatttttatgagacagggactcacccaggctggagtgcagtggagcagtcatggcacactgtagcctcgacctccctgggctcaagcaatcctcccacttcagtgtcccgagtagttgggactacaggcatgcgtcactacacctaattggctaatttttgtagtttttgtagagatagggtttcgccatgttgcctaggctggtcttgaattcctgggctcaagcgatccacctgctttggcctcccaaaacagtgggattgcaggcgtgagccaccatgcctggctgaaattcaccttttaagatgtacaattcagtggtttttagtatattcacacacaaaattgcacaactatcactaacatctaattttagatcattttgtaacttcaccaagaaaccccaggtctgtcagcagtcagttccattcccccttcatcccagcctctggcaaccactaatctgctttctgtcactattgatttggccagacactattcttctgtgcttctcatgcatctcctgtaataccagtgctacaattctcattttatgtggaaaattgaggcactgagaggttaagtaaattgcccacggtcacacagtaatttgatttacaacagtaataacacattagatgagaacacagtaggacacaattttgaattccatttttatgtacctgaaatgaatacacccctcccccaaggtattttccctattgttagcctttgtaccctaggtacaaatataggtattttccctattgtgttatgtacctgaaatgaatacacccttcccccaaggtattttccctattgttagcctttgtaccctagaactgactggatgtagataacatttgttttcagagtaatggaacactgtatcagcagcatctgagaacataagaacagttggacattggaaagaggtttgttgccctcatccctccttgaacctcttttctctcccgcttccaccaccaccacacatatatacccctttttctcagtcttaagcatcaaacaatttctgcctctttctttttaattctcccagagggatggttaatgcatcacaatttaacttgtctattcaggtattaatagtcaagggatgcatctgtttgcttatagtaccagttatattcctaggaccttagagagcagtagtgtgagaatagaatgcctttctatttgggttaaactatgtgggaggaaaaagtaacagagtaaaggctttgccttaatgaagtcaagtgttctgcctggtgggaagtggccacacgctgcactgcgctgctcttgtttactctgttctttcagagcctttgtactttgccatcactgctagtaatttcttggtccttttcaatactccattttaatcttgatttttttctataaataataaatctgtgaaaaatctgtaaaaagatttgtgactattaaatgtgcaactaaaaacactggaaaaagaaaaaataaaaaaaaaaaaaaaaaaaaaaaaaaaaaaaaaaaaaaaaaaaaaaacaaaaaaaaaaaaagaaaaaanaaanaacaaaaaaanaaaagaaagagagagggggcgcggcgcggaaaccaagaagaatccccgctctgaccgggcgagcgagcagcgcaccgacacgcccccctcggcttattttgactaaaggggggccccccagagggagagcggcagataaagaagcgaggggggggcggggggacgttaacacaaggatgtcggaggggagaacaacacgacgtgggcgggagaagaatgtgagagggcgagcgccacaactcgaggggggaggagagaacaaaaggcggcaagcgaacaacg

SEQ ID NO: 488467 - DNA, 309 bp, Homo sapiens
acgatcctaagctcgcactcttcccagccttgcctttttagaggagattgctgctctatgcttggggcaggtgagatgcagtgctattttccgtctgtgttgctgagtatctgtggctatgtgacccagagtgactcatgccctcctcacagcaggaggggaggtggacaagtaaacaggcagttagatagagtgtcacgtgtgaagatttcagagggcaggaaaccagaggtgtgtgctcaaccagcagaggtctgggtgggggtctcagataggaatgatgtcccaggcgaagaaccagcgacagaa

SEQ ID NO: 488468 - DNA, 7009 bp, Homo sapiens
  misc_feature (263)..(263): n is a, c, g, or t
  misc_feature (301)..(301): n is a, c, g, or t
  misc_feature (6791)..(6791): n is a, c, g, or t
  misc_feature (6795)..(6795): n is a, c, g, or t
  misc_feature (6806)..(6806): n is a, c, g, or t
tttatcttttaagttattgtcacaatagttactctcttttagaccctgaacattttcagtacttgctccaaatggtttagcaacttttgaagtgggattaacaagtttggccaatgaagcttcttccctgcccaccgccagaggtgctggagaaaagtaatcctggagggtcggcgtggaggcagtagagaggtttataaaagtcaaggaagtgggaagaggcttgcgagcagcaggagaggcgcagagtcagaggggcaggngcggcggcggagggagcaggaggttggggcttgagccngtcattccggcgcacgaaaacttgaagtcgctcggtagccggggaagggaaggaagagaggcaggctctttcctagaggtgccgtgatcgagggtctggcactccaagccaactcctgagaacgggaaatgggcgggagtcggtggggtggagagggcagccgtggtcgcgagagcgaaggagcggtctgagaatccggcttgagtgttaaaggctaagcgtgtctagctggacccgtggccccgaagaagcgagacaaggcgacgcggagctgtccctgacaccccgaggaccgagggacagcgaagggccggggccgccggccattgccaggcgccattaggtgacgcggccgtcacgcgatgacgcgctgaccggcagtggcctccacgtcgcaggttccgcaaagacctgtgggagcgacccgggagaaggagggccaagatggcggaagcggaggagtctccaggagacccggggacagcatcgcccaggcccctgtttgcaggcctttcagatatatccatctcacaagacatccccgtagaaggagaaatcaccattcctatgagatctcgcatccgggagtttgacagctccacattaaatgaatctgttcgcaataccatcatgcgtgatctaaaagctgttgggaaaaaattcatgcatgttttgtacccaaggaaaagtaatactcttttgagagattgggatttgtggggccctttgatcctttgtgtgacactcgcattaatgctgcaaagagactctgcagatagtgaaaaagatggagggccccaatttgcagaggtgtttgtcattgtctggtttggtgcagttaccatcaccctcaactcaaaacttcttggagggaacatatctttttttcagagcctctgtgtgctgggttactgtatacttcccttgacagtagcaatgctgatttgccggctggtacttttggctgatccaggacctgtaaacttcatggttcggctttttgtggtgattgtgatgtttgcctggtctatagttgcctccacagctttccttgctgatagccagcctccaaaccgcagagccctagctgtttatcctgttttcctgttttactttgtcatcagttggatgattctcacctttactcctcagtaaatcaggaatgggaaattaaaaccagtgaattgaaagcacatctgaaagatgcaattcaccatggagctttgtctctggcccttattttgtctaattttggaggtatttgataactgagtaggtgaggagattaaaagggagccatatagcactgtcaccccttatttgaggaactgatgtttgaaaggctgttcttttctctcttaatgtcatttctttaaaaatacatgtgcatactacacacagtatataatgcctccttaaggcatgatggagtcaccgtggtccatttgggtgacaaccagtgacttgggaagcacatagatacatcttacaagttgaatagagttgataactattttcagttttgagaataccagttcaggtgcagctcttaaacacattgccttatgactattagaatatgcctctcttttcataaataaaaatacatggtctatatccattttcttttatttctctctcttaagcttaaaaaggcaatgagagaggttaggagtgggttcatacacggagaatgagaaaacatgcattaaccaatattcagattttgatcaggggaaattctacacttgttgcaaaaaaaaaaaaaaaaaaagcaaagggcctctaaagaatcagcctctttggtccctttgtgctgtcacctttttgccatgtttaacagcatcttggttggcactctagtcttaatcttgctccttaactttgaatatgcagtctaaaatgtcagtagtcaacatgtaattttcctttgaaattctgaatattccagtgctggaacttatccaaaaagaagacctcagaaacttagattggtagatctctagtgcatattatcatgtgggcaccttctcttagggtggaatgaggcagtctggatgcagcatagttaaaaggagctgtttaatattctctgtagtctggcctcttaactagaaagtaaagctaaatcagaagcctgtatttaaccatgtgaacagggagggatttagtgttctgatggctgattaatagaacagctagatacttagagcatgacgtgggatgggatgagtttacagctgctgccttttcatggtgagcttagcagttttctcattagatgtgtttttttgggttggggaatagcaatttattttattgattttagactttatcaagctaattagctcccctttagataagtacatgttgcacatgtgcacctacttgtaatctcagatatttatgcacacaagtgtgaaggtttttcagggagcagagcatctgggacaggctgattctgagctaaacagggctcctttaaggcaatatgaactgttgccttctataaattgcacattgaggaactctaatagacaaagattaggtgtcaggcagaaaacactcattgtaaatatactattagttgataaacataggactttcttattccccagtttttctttatcatataatttaaatatttattcattttgtatttaaagactacctacacatagatatatgattccaaagtcatactttctccatccccacattagccaagtgaatacagggccaaatgggttcttggaatgataataacaaagcattacaaagtgggtccccttggttccagccttgtccagagtttttggttatatatttctatttattacaatttaccttttaaattgtaaaataaacctttgtgtggacagagccaatgtttcaatcttgaatgagtaaagaaaatactttggaactgatcctcattttgaaattggttctaaattattatccatttccaatgtctgaaattctcttacttcctgctaaaactctctttctgccaaagttgtttcgtaatctgtctcaatgactataatgtaaaattaaagaagtaaccatgcttctcaagggggaattaaaagtgtttattgaattttactcaggctaattgtttggtcagaaattcctaaggccacagctttggggggttcgtgtagatgtacatggtgggtgggttataaatattgggacttaaggcagcttgttctatgtatttatctttgctcttgggtgacttagggaatgattttatttgatttaaccttctttctgtttgccccgagaatactcgccagtggcgcttgcagttgtagcatttaccccaagataactttgcctacgaaatatttcgcttttattattttcacatcattctagtatatggactttggaaacaaaagacattgttctatttatagcattcttttttttttttagtagcggtatttccatttacaaaatatagtaactcttgattactgaaaatgtcaaatcctagaaaacgtagcatgcctatacatgatgttaacatcattctcgaacagttgttggccgaagattcatttgatgaatccaatttttttgaaatagacaattctgatgttctctttagaaataactcagtttttatcttttttcacattgaaaatcagttagatttgcttaagcctcaaagagaatgtttatgtaaattagcgctggcaatttttttttttctaaacaggaaaagggttaaatgaaggttgataaaatggatgttcaattgtctttctgaaagtgagtggcttgaagggatgaataaatattttcttaatatattcaaaaaagtgcattgctttctgtgatggaagttaagacctaaatgtctggaagttgtaaccctcaacacagcttttcctgatttgctgcaaaggcacatagctgattatagaagtgaagacggcaaggacggggactccaacaaaggaaaccctgttgcaggatttgggaactttcatgcttcagatgaaattcaggcatgtgagcatcactgcagaatgtggtgcatcattgccatcatgagtaatcacttgctgctcctacttctgagaccaagactcttttgtcatattctttagcaataggacgggtaaagactggatttaattgctgttcagagtataaaaactcaattgattccaacatatctgaatgtgcagtaaagtcttaaaagtcaaccgttaatcattaagtcttttgcctctaaagtcttttgcctctgaagaggtttattacatgagttgattttcatattttcattttggtggggttttcctgttgttgggcaaggtggggtcacaggacatgggactagtaagcattttactgtttactatatttgtctttttataaacagtatctcccaaaatgtgattagaaggctaccaagcctgtatttggacatttaattgtgtgctttatataatgtaactactaacagtatttggactgcctgttcattcctggagacaaaaatgaaaatctgtcagttcaagttcttgggtaacatcaagtcattagaatttatctaaagcttatcatgatttgataagacatccattgcatgcagctgttttagctcagtgcaaaacactgaaattgtgattcttagactgtttctgagacatttggatggaaataaatgtataaatgttaattcatgtatataaattagaaacacttttctagattctgtaggcttttgttaaaaatagagaatttcttggggtttacttaggccacagaatggccaaataataataatgacaatgatattactaataataatagctaacctttatttggcacttactgtgtgccaggcactattctatttttttaagaatttttaaaataacagctttattgaaatacactttaccataaacttcacctttttattttttatttttatgagacagggactcacccaggctggagtgcagtggagcagtcatggcacactgtagcctcgacctccctgggctcaagcaatcctcccacttcagtgtcccgagtagttgggactacaggcatgcgtcactacacctaattggctaatttttgtagtttttgtagagatagggtttcgccatgttgcctaggctggtcttgaattcctgggctcaagcgatccacctgctttggcctcccaaaacagtgggattgcaggcgtgagccaccatgcctggctgaaattcaccttttaagatgtacaattcagtggtttttagtatattcacacacaaaattgcacaactatcactaacatctaattttagatcattttgtaacttcaccaagaaaccccaggtctgtcagcagtcagttccattcccccttcatcccagcctctggcaaccactaatctgctttctgtcactattgatttggccagacactattcttctgtgcttctcatgcatctcctgtaataccagtgctacaattctcattttatgtggaaaattgaggcactgagaggttaagtaaattgcccacggtcacacagtaatttgatttacaacagtaataacacattagatgagaacacagtaggacacaattttgaattccatttttatgtacctgaaatgaatacacccctcccccaaggtattttccctattgttagcctttgtaccctaggtacaaatataggtattttccctattgtgttatgtacctgaaatgaatacacccttcccccaaggtattttccctattgttagcctttgtaccctagaactgactggatgtagataacatttgttttcagagtaatggaacactgtatcagcagcatctgagaacataagaacagttggacattggaaagaggtttgttgccctcatccctccttgaacctcttttctctcccgcttccaccaccaccacacatatatacccctttttctcagtcttaagcatcaaacaatttctgcctctttctttttaattctcccagagggatggttaatgcatcacaatttaacttgtctattcaggtattaatagtcaagggatgcatctgtttgcttatagtaccagttatattcctaggaccttagagagcagtagtgtgagaatagaatgcctttctatttgggttaaactatgtgggaggaaaaagtaacagagtaaaggctttgccttaatgaagtcaagtgttctgcctggtgggaagtggccacacgctgcactgcgctgctcttgtttactctgttctttcagagcctttgtactttgccatcactgctagtaatttcttggtccttttcaatactccattttaatcttgatttttttctataaataataaatctgtgaaaaatctgtaaaaataaaaaaaaaaaaaaaaaaaaaaaaaaaaaaaaaaaaaaaaaaaaaaaaaaaaaaaaaaaaaaaaaaaaaaacaaaaaaaaaaaaagaaaaaanaaanaacaaaaaaanaaaaaataaaaaaaagaagaacaaaaaaaaaaaaaaaaaacaaaaaaataaaaaaaaggggcgggggggggccttctcattgaatcgtcttcttcatgggagggcggcgcacgatgtcgcgctcctagtcagttttgttcgggaggcgtacccctttgtgtcttagattaatttataaacgagacgtgttttgtgatgatact

SEQ ID NO: 488469 - DNA, 6637 bp, Homo sapiens
  misc_feature (263)..(263): n is a, c, g, or t
  misc_feature (301)..(301): n is a, c, g, or t
tttatcttttaagttattgtcacaatagttactctcttttagaccctgaacattttcagtacttgctccaaatggtttagcaacttttgaagtgggattaacaagtttggccaatgaagcttcttccctgcccaccgccagaggtgctggagaaaagtaatcctggagggtcggcgtggaggcagtagagaggtttataaaagtcaaggaagtgggaagaggcttgcgagcagcaggagaggcgcagagtcagaggggcaggngcggcggcggagggagcaggaggttggggcttgagccngtcattccggcgcacgaaaacttgaagtcgctcggtagccggggaagggaaggaagagaggcaggctctttcctagaggtgccgtgatcgagggtctggcactccaagccaactcctgagaacgggaaatgggcgggagtcggtggggtggagagggcagccgtggtcgcgagagcgaaggagcggtctgagaatccggcttgagtgttaaaggctaagcgtgtctagctggacccgtggccccgaagaagcgagacaaggcgacgcggagctgtccctgacaccccgaggaccgagggacagcgaagggccggggccgccggccattgccaggcgccattaggtgacgcggccgtcacgcgatgacgcgctgaccggcagtggcctccacgtcgcaggttccgcaaagacctgtgggagcgacccgggagaaggagggccaagatggcggaagcggaggagtctccaggagacccggggacagcatcgcccaggcccctgtttgcaggcctttcagatatatccatctcacaagacatccccgtagaaggagaaatcaccattcctatgagatctcgcatccgggagtttgacagctccacattaaatgaatctgttcgcaataccatcatgcgtgatctaaaagctgttgggaaaaaattcatgcatgttttgtacccaaggaaaagtaatactcttttgagagattgggatttgtggggccctttgatcctttgtgtgacactcgcattaatgctgcaaagagactctgcagatagtgaaaaagatggagggccccaatttgcagaggtgtttgtcattgtctggtttggtgcagttaccatcaccctcaactcaaaacttcttggagggaacatatctttttttcagagcctctgtgtgctgggttactgtatacttcccttgacagtagcaatgctgatttgccggctggtacttttggctgatccaggacctgtaaacttcatggttcggctttttgtggtgattgtgatgtttgcctggtctatagttgcctccacagctttccttgctgatagccagcctccaaaccgcagagccctagctgtttatcctgttttcctgttttactttgtcatcagttggatgattctcacctttactcctcagtaaatcaggaatgggaaattaaaaccagtgaattgaaagcacatctgaaagatgcaattcaccatggagctttgtctctggcccttattttgtctaattttggaggtatttgataactgagtaggtgaggagattaaaagggagccatatagcactgtcaccccttatttgaggaactgatgtttgaaaggctgttcttttctctcttaatgtcatttctttaaaaatacatgtgcatactacacacagtatataatgcctccttaaggcatgatggagtcaccgtggtccatttgggtgacaaccagtgacgagaataccagttcaggtgcagctcttaaacacattgccttatgactattagaatatgcctctcttttcataaataaaaatacatggtctatatccattttcttttatttctctctcttaagcttaaaaaggcaatgagagaggttaggagtgggttcatacacggagaatgagaaaacatgcattaaccaatattcagattttgatcaggggaaattctacacttgttgcaaaaaaaaaaaaaaaaaaagcaaagggcctctaaagaatcagcctctttggtccctttgtgctgtcacctttttgccatgtttaacagcatcttggttggcactctagtcttaatcttgctccttaactttgaatatgcagtctaaaatgtcagtagtcaacatgtaattttcctttgaaattctgaatattccagtgctggaacttatccaaaaagaagacctcagaaacttagattggtagatctctagtgcatattatcatgtgggcaccttctcttagggtggaatgaggcagtctggatgcagcatagttaaaaggagctgtttaatattctctgtagtctggcctcttaactagaaagtaaagctaaatcagaagcctgtatttaaccatgtgaacagggagggatttagtgttctgatggctgattaatagaacagctagatacttagagcatgacgtgggatgggatgagtttacagctgctgccttttcatggtgagcttagcagttttctcattagatgtgtttttttgggttggggaatagcaatttattttattgattttagactttatcaagctaattagctcccctttagataagtacatgttgcacatgtgcacctacttgtaatctcagatatttatgcacacaagtgtgaaggtttttcagggagcagagcatctgggacaggctgattctgagctaaacagggctcctttaaggcaatatgaactgttgccttctataaattgcacattgaggaactctaatagacaaagattaggtgtcaggcagaaaacactcattgtaaatatactattagttgataaacataggactttcttattccccagtttttctttatcatataatttaaatatttattcattttgtatttaaagactacctacacatagatatatgattccaaagtcatactttctccatccccacattagccaagtgaatacagggccaaatgggttcttggaatgataataacaaagcattacaaagtgggtccccttggttccagccttgtccagagtttttggttatatatttctatttattacaatttaccttttaaattgtaaaataaacctttgtgtggacagagccaatgtttcaatcttgaatgagtaaagaaaatactttggaactgatcctcattttgaaattggttctaaattattatccatttccaatgtctgaaattctcttacttcctgctaaaactctctttctgccaaagttgtttcgtaatctgtctcaatgactataatgtaaaattaaagaagtaaccatgcttctcaagggggaattaaaagtgtttattgaattttactcaggctaattgtttggtcagaaattcctaaggccacagctttggggggttcgtgtagatgtacatggtgggtgggttataaatattgggacttaaggcagcttgttctatgtatttatctttgctcttgggtgacttagggaatgattttatttgatttaaccttctttctgtttgccccgagaatactcgccagtggcgcttgcagttgtagcatttaccccaagataactttgcctacgaaatatttcgcttttattattttcacatcattctagtatatggactttggaaacaaaagacattgttctatttatagcattcttttttttttttagtagcggtatttccatttacaaaatatagtaactcttgattactgaaaatgtcaaatcctagaaaacgtagcatgcctatacatgatgttaacatcattctcgaacagttgttggccgaagattcatttgatgaatccaatttttttgaaatagacaattctgatgttctctttagaaataactcagtttttatcttttttcacattgaaaatcagttagatttgcttaagcctcaaagagaatgtttatgtaaattagcgctggcaatttttttttttctaaacaggaaaagggttaaatgaaggttgataaaatggatgttcaattgtctttctgaaagtgagtggcttgaagggatgaataaatattttcttaatatattcaaaaaagtgcattgctttctgtgatggaagttaagacctaaatgtctggaagttgtaaccctcaacacagcttttcctgatttgctgcaaaggcacatagctgattatagaagtgaagacggcaaggacggggactccaacaaaggaaaccctgttgcaggatttgggaactttcatgcttcagatgaaattcaggcatgtgagcatcactgcagaatgtggtgcatcattgccatcatgagtaatcacttgctgctcctacttctgagaccaagactcttttgtcatattctttagcaataggacgggtaaagactggatttaattgctgttcagagtataaaaactcaattgattccaacatatctgaatgtgcagtaaagtcttaaaagtcaaccgttaatcattaagtcttttgcctctaaagtcttttgcctctgaagaggtttattacatgagttgattttcatattttcattttggtggggttttcctgttgttgggcaaggtggggtcacaggacatgggactagtaagcattttactgtttactatatttgtctttttataaacagtatctcccaaaatgtgattagaaggctaccaagcctgtatttggacatttaattgtgtgctttatataatgtaactactaacagtatttggactgcctgttcattcctggagacaaaaatgaaaatctgtcagttcaagttcttgggtaacatcaagtcattagaatttatctaaagcttatcatgatttgataagacatccattgcatgcagctgttttagctcagtgcaaaacactgaaattgtgattcttagactgtttctgagacatttggatggaaataaatgtataaatgttaattcatgtatataaattagaaacacttttctagattctgtaggcttttgttaaaaatagagaatttcttggggtttacttaggccacagaatggccaaataataataatgacaatgatattactaataataatagctaacctttatttggcacttactgtgtgccaggcactattctatttttttaagaatttttaaaataacagctttattgaaatacactttaccataaacttcacctttttattttttatttttatgagacagggactcacccaggctggagtgcagtggagcagtcatggcacactgtagcctcgacctccctgggctcaagcaatcctcccacttcagtgtcccgagtagttgggactacaggcatgcgtcactacacctaattggctaatttttgtagtttttgtagagatagggtttcgccatgttgcctaggctggtcttgaattcctgggctcaagcgatccacctgctttggcctcccaaaacagtgggattgcaggcgtgagccaccatgcctggctgaaattcaccttttaagatgtacaattcagtggtttttagtatattcacacacaaaattgcacaactatcactaacatctaattttagatcattttgtaacttcaccaagaaaccccaggtctgtcagcagtcagttccattcccccttcatcccagcctctggcaaccactaatctgctttctgtcactattgatttggccagacactattcttctgtgcttctcatgcatctcctgtaataccagtgctacaattctcattttatgtggaaaattgaggcactgagaggttaagtaaattgcccacggtcacacagtaatttgatttacaacagtaataacacattagatgagaacacagtaggacacaattttgaattccatttttatgtacctgaaatgaatacacccctcccccaaggtattttccctattgttagcctttgtaccctaggtacaaatataggtattttccctattgtgttatgtacctgaaatgaatacacccttcccccaaggtattttccctattgttagcctttgtaccctagaactgactggatgtagataacatttgttttcagagtaatggaacactgtatcagcagcatctgagaacataagaacagttggacattggaaagaggtttgttgccctcatccctccttgaacctcttttctctcccgcttccaccaccaccacacatatatacccctttttctcagtcttaagcatcaaacaatttctgcctctttctttttaattctcccagagggatggttaatgcatcacaatttaacttgtctattcaggtattaatagtcaagggatgcatctgtttgcttatagtaccagttatattcctaggaccttagagagcagtagtgtgagaatagaatgcctttctatttgggttaaactatgtgggaggaaaaagtaacagagtaaaggctttgccttaatgaagtcaagtgttctgcctggtgggaagtggccacacgctgcactgcgctgctcttgtttactctgttctttcagagcctttgtactttgccatcactgctagtaatttcttggtccttttcaatactccattttaatcttgatttttttctataaataataaatctgtgaaaaatctgtaaaaa

SEQ ID NO: 488470 - DNA, 6731 bp, Homo sapiens
  misc_feature (263)..(263): n is a, c, g, or t
  misc_feature (301)..(301): n is a, c, g, or t
tttatcttttaagttattgtcacaatagttactctcttttagaccctgaacattttcagtacttgctccaaatggtttagcaacttttgaagtgggattaacaagtttggccaatgaagcttcttccctgcccaccgccagaggtgctggagaaaagtaatcctggagggtcggcgtggaggcagtagagaggtttataaaagtcaaggaagtgggaagaggcttgcgagcagcaggagaggcgcagagtcagaggggcaggngcggcggcggagggagcaggaggttggggcttgagccngtcattccggcgcacgaaaacttgaagtcgctcggtagccggggaagggaaggaagagaggcaggctctttcctagaggtgccgtgatcgagggtctggcactccaagccaactcctgagaacgggaaatgggcgggagtcggtggggtggagagggcagccgtggtcgcgagagcgaaggagcggtctgagaatccggcttgagtgttaaaggctaagcgtgtctagctggacccgtggccccgaagaagcgagacaaggcgacgcggagctgtccctgacaccccgaggaccgagggacagcgaagggccggggccgccggccattgccaggcgccattaggtgacgcggccgtcacgcgatgacgcgctgaccggcagtggcctccacgtcgcaggttccgcaaagacctgtgggagcgacccgggagaaggagggccaagatggcggaagcggaggagtctccaggagacccggggacagcatcgcccaggcccctggtgagcttgggatctgcgacaaaagggaccgaggtttgcaggcctttcagatatatccatctcacaagacatccccgtagaaggagaaatcaccattcctatgagatctcgcatccgggagtttgacagctccacattaaatgaatctgttcgcaataccatcatgcgtgatctaaaagctgttgggaaaaaattcatgcatgttttgtacccaaggaaaagtaatactcttttgagagattgggatttgtggggccctttgatcctttgtgtgacactcgcattaatgctgcaaagagactctgcagatagtgaaaaagatggagggccccaatttgcagaggtgtttgtcattgtctggtttggtgcagttaccatcaccctcaactcaaaacttcttggagggaacatatctttttttcagagcctctgtgtgctgggttactgtatacttcccttgacagtagcaatgctgatttgccggctggtacttttggctgatccaggacctgtaaacttcatggttcggctttttgtggtgattgtgatgtttgcctggtctatagttgcctccacagctttccttgctgatagccagcctccaaaccgcagagccctagctgtttatcctgttttcctgttttactttgtcatcagttggatgattctcacctttactcctcagtaaatcaggaatgggaaattaaaaccagtgaattgaaagcacatctgaaagatgcaattcaccatggagctttgtctctggcccttattttgtctaattttggaggtatttgataactgagtaggtgaggagattaaaagggagccatatagcactgtcaccccttatttgaggaactgatgtttgaaaggctgttcttttctctcttaatgtcatttctttaaaaatacatgtgcatactacacacagtatataatgcctccttaaggcatgatggagtcaccgtggtccatttgggtgacaaccagtgacttgggaagcacatagatacatcttacaagttgaatagagttgataactattttcagttttgagaataccagttcaggtgcagctcttaaacacattgccttatgactattagaatatgcctctcttttcataaataaaaatacatggtctatatccattttcttttatttctctctcttaagcttaaaaaggcaatgagagaggttaggagtgggttcatacacggagaatgagaaaacatgcattaaccaatattcagattttgatcaggggaaattctacacttgttgcaaaaaaaaaaaaaaaaaaagcaaagggcctctaaagaatcagcctctttggtccctttgtgctgtcacctttttgccatgtttaacagcatcttggttggcactctagtcttaatcttgctccttaactttgaatatgcagtctaaaatgtcagtagtcaacatgtaattttcctttgaaattctgaatattccagtgctggaacttatccaaaaagaagacctcagaaacttagattggtagatctctagtgcatattatcatgtgggcaccttctcttagggtggaatgaggcagtctggatgcagcatagttaaaaggagctgtttaatattctctgtagtctggcctcttaactagaaagtaaagctaaatcagaagcctgtatttaaccatgtgaacagggagggatttagtgttctgatggctgattaatagaacagctagatacttagagcatgacgtgggatgggatgagtttacagctgctgccttttcatggtgagcttagcagttttctcattagatgtgtttttttgggttggggaatagcaatttattttattgattttagactttatcaagctaattagctcccctttagataagtacatgttgcacatgtgcacctacttgtaatctcagatatttatgcacacaagtgtgaaggtttttcagggagcagagcatctgggacaggctgattctgagctaaacagggctcctttaaggcaatatgaactgttgccttctataaattgcacattgaggaactctaatagacaaagattaggtgtcaggcagaaaacactcattgtaaatatactattagttgataaacataggactttcttattccccagtttttctttatcatataatttaaatatttattcattttgtatttaaagactacctacacatagatatatgattccaaagtcatactttctccatccccacattagccaagtgaatacagggccaaatgggttcttggaatgataataacaaagcattacaaagtgggtccccttggttccagccttgtccagagtttttggttatatatttctatttattacaatttaccttttaaattgtaaaataaacctttgtgtggacagagccaatgtttcaatcttgaatgagtaaagaaaatactttggaactgatcctcattttgaaattggttctaaattattatccatttccaatgtctgaaattctcttacttcctgctaaaactctctttctgccaaagttgtttcgtaatctgtctcaatgactataatgtaaaattaaagaagtaaccatgcttctcaagggggaattaaaagtgtttattgaattttactcaggctaattgtttggtcagaaattcctaaggccacagctttggggggttcgtgtagatgtacatggtgggtgggttataaatattgggacttaaggcagcttgttctatgtatttatctttgctcttgggtgacttagggaatgattttatttgatttaaccttctttctgtttgccccgagaatactcgccagtggcgcttgcagttgtagcatttaccccaagataactttgcctacgaaatatttcgcttttattattttcacatcattctagtatatggactttggaaacaaaagacattgttctatttatagcattcttttttttttttagtagcggtatttccatttacaaaatatagtaactcttgattactgaaaatgtcaaatcctagaaaacgtagcatgcctatacatgatgttaacatcattctcgaacagttgttggccgaagattcatttgatgaatccaatttttttgaaatagacaattctgatgttctctttagaaataactcagtttttatcttttttcacattgaaaatcagttagatttgcttaagcctcaaagagaatgtttatgtaaattagcgctggcaatttttttttttctaaacaggaaaagggttaaatgaaggttgataaaatggatgttcaattgtctttctgaaagtgagtggcttgaagggatgaataaatattttcttaatatattcaaaaaagtgcattgctttctgtgatggaagttaagacctaaatgtctggaagttgtaaccctcaacacagcttttcctgatttgctgcaaaggcacatagctgattatagaagtgaagacggcaaggacggggactccaacaaaggaaaccctgttgcaggatttgggaactttcatgcttcagatgaaattcaggcatgtgagcatcactgcagaatgtggtgcatcattgccatcatgagtaatcacttgctgctcctacttctgagaccaagactcttttgtcatattctttagcaataggacgggtaaagactggatttaattgctgttcagagtataaaaactcaattgattccaacatatctgaatgtgcagtaaagtcttaaaagtcaaccgttaatcattaagtcttttgcctctaaagtcttttgcctctgaagaggtttattacatgagttgattttcatattttcattttggtggggttttcctgttgttgggcaaggtggggtcacaggacatgggactagtaagcattttactgtttactatatttgtctttttataaacagtatctcccaaaatgtgattagaaggctaccaagcctgtatttggacatttaattgtgtgctttatataatgtaactactaacagtatttggactgcctgttcattcctggagacaaaaatgaaaatctgtcagttcaagttcttgggtaacatcaagtcattagaatttatctaaagcttatcatgatttgataagacatccattgcatgcagctgttttagctcagtgcaaaacactgaaattgtgattcttagactgtttctgagacatttggatggaaataaatgtataaatgttaattcatgtatataaattagaaacacttttctagattctgtaggcttttgttaaaaatagagaatttcttggggtttacttaggccacagaatggccaaataataataatgacaatgatattactaataataatagctaacctttatttggcacttactgtgtgccaggcactattctatttttttaagaatttttaaaataacagctttattgaaatacactttaccataaacttcacctttttattttttatttttatgagacagggactcacccaggctggagtgcagtggagcagtcatggcacactgtagcctcgacctccctgggctcaagcaatcctcccacttcagtgtcccgagtagttgggactacaggcatgcgtcactacacctaattggctaatttttgtagtttttgtagagatagggtttcgccatgttgcctaggctggtcttgaattcctgggctcaagcgatccacctgctttggcctcccaaaacagtgggattgcaggcgtgagccaccatgcctggctgaaattcaccttttaagatgtacaattcagtggtttttagtatattcacacacaaaattgcacaactatcactaacatctaattttagatcattttgtaacttcaccaagaaaccccaggtctgtcagcagtcagttccattcccccttcatcccagcctctggcaaccactaatctgctttctgtcactattgatttggccagacactattcttctgtgcttctcatgcatctcctgtaataccagtgctacaattctcattttatgtggaaaattgaggcactgagaggttaagtaaattgcccacggtcacacagtaatttgatttacaacagtaataacacattagatgagaacacagtaggacacaattttgaattccatttttatgtacctgaaatgaatacacccctcccccaaggtattttccctattgttagcctttgtaccctaggtacaaatataggtattttccctattgtgttatgtacctgaaatgaatacacccttcccccaaggtattttccctattgttagcctttgtaccctagaactgactggatgtagataacatttgttttcagagtaatggaacactgtatcagcagcatctgagaacataagaacagttggacattggaaagaggtttgttgccctcatccctccttgaacctcttttctctcccgcttccaccaccaccacacatatatacccctttttctcagtcttaagcatcaaacaatttctgcctctttctttttaattctcccagagggatggttaatgcatcacaatttaacttgtctattcaggtattaatagtcaagggatgcatctgtttgcttatagtaccagttatattcctaggaccttagagagcagtagtgtgagaatagaatgcctttctatttgggttaaactatgtgggaggaaaaagtaacagagtaaaggctttgccttaatgaagtcaagtgttctgcctggtgggaagtggccacacgctgcactgcgctgctcttgtttactctgttctttcagagcctttgtactttgccatcactgctagtaatttcttggtccttttcaatactccattttaatcttgatttttttctataaataataaatctgtgaaaaatctgtaaaaa

SEQ ID NO: 488471 - DNA, 589 bp, Homo sapiens
  misc_feature (21)..(21): n is a, c, g, or t
agtgggaggaccagatagctnctgtatggggcagacaaggtaaagaccattgctgttctgttgacttcgttggctggctcagagacagacaagaactctgagataccactgatccattttctgagtccggctttatgctgtagaacttgtttaaaagatgcagctctcaaggtaggaaggtaggtagctagttgtgactacatgtgcttcctacaaaccttaccacctaacaatctaccactggctttgttgatgcagagtcaagttgtcgtcgatattgttttactcagctttagcttaccaaacccctaatacaaggccccctttttctgttggggcatcctgcccgagacacaacactgccctgtgaaatcctgtttcataggttccgtctagtcaaggcggggttagctagtagctttggctcagagatatcggtagtgtaaacatcaagaattctacagataactctagcttgcattcgccatactgcctccttgccccacctctgcagcacacaaaaacaatatctactctatatctattaaaaatgtaaagagccacacagttaaaaacataaatagtacct

SEQ ID NO: 488472 - DNA, 6828 bp, Homo sapiens
  misc_feature (263)..(263): n is a, c, g, or t
  misc_feature (301)..(301): n is a, c, g, or t
tttatcttttaagttattgtcacaatagttactctcttttagaccctgaacattttcagtacttgctccaaatggtttagcaacttttgaagtgggattaacaagtttggccaatgaagcttcttccctgcccaccgccagaggtgctggagaaaagtaatcctggagggtcggcgtggaggcagtagagaggtttataaaagtcaaggaagtgggaagaggcttgcgagcagcaggagaggcgcagagtcagaggggcaggngcggcggcggagggagcaggaggttggggcttgagccngtcattccggcgcacgaaaacttgaagtcgctcggtagccggggaagggaaggaagagaggcaggctctttcctagaggtgccgtgatcgagggtctggcactccaagccaactcctgagaacgggaaatgggcgggagtcggtggggtggagagggcagccgtggtcgcgagagcgaaggagcggtctgagaatccggcttgagtgttaaaggctaagcgtgtctagctggacccgtggccccgaagaagcgagacaaggcgacgcggagctgtccctgacaccccgaggaccgagggacagcgaagggccggggccgccggccattgccaggcgccattaggtgacgcggccgtcacgcgatgacgcgctgaccggcagtggcctccacgtcgcaggttccgcaaagacctgtgggagcgacccgggagaaggagggccaagatggcggaagcggaggagtctccaggagacccggggacagcatcgcccaggcccctggtgagcttgggatctgcgacaaaagggaccgagggctggagtgcaatggcgtgatctcggtcaccgcaaccttcacctcccgggttcaagcgattctcctgcctcagcctcccgagtagctgggattacagtttgcaggcctttcagatatatccatctcacaagacatccccgtagaaggagaaatcaccattcctatgagatctcgcatccgggagtttgacagctccacattaaatgaatctgttcgcaataccatcatgcgtgatctaaaagctgttgggaaaaaattcatgcatgttttgtacccaaggaaaagtaatactcttttgagagattgggatttgtggggccctttgatcctttgtgtgacactcgcattaatgctgcaaagagactctgcagatagtgaaaaagatggagggccccaatttgcagaggtgtttgtcattgtctggtttggtgcagttaccatcaccctcaactcaaaacttcttggagggaacatatctttttttcagagcctctgtgtgctgggttactgtatacttcccttgacagtagcaatgctgatttgccggctggtacttttggctgatccaggacctgtaaacttcatggttcggctttttgtggtgattgtgatgtttgcctggtctatagttgcctccacagctttccttgctgatagccagcctccaaaccgcagagccctagctgtttatcctgttttcctgttttactttgtcatcagttggatgattctcacctttactcctcagtaaatcaggaatgggaaattaaaaccagtgaattgaaagcacatctgaaagatgcaattcaccatggagctttgtctctggcccttattttgtctaattttggaggtatttgataactgagtaggtgaggagattaaaagggagccatatagcactgtcaccccttatttgaggaactgatgtttgaaaggctgttcttttctctcttaatgtcatttctttaaaaatacatgtgcatactacacacagtatataatgcctccttaaggcatgatggagtcaccgtggtccatttgggtgacaaccagtgacttgggaagcacatagatacatcttacaagttgaatagagttgataactattttcagttttgagaataccagttcaggtgcagctcttaaacacattgccttatgactattagaatatgcctctcttttcataaataaaaatacatggtctatatccattttcttttatttctctctcttaagcttaaaaaggcaatgagagaggttaggagtgggttcatacacggagaatgagaaaacatgcattaaccaatattcagattttgatcaggggaaattctacacttgttgcaaaaaaaaaaaaaaaaaaagcaaagggcctctaaagaatcagcctctttggtccctttgtgctgtcacctttttgccatgtttaacagcatcttggttggcactctagtcttaatcttgctccttaactttgaatatgcagtctaaaatgtcagtagtcaacatgtaattttcctttgaaattctgaatattccagtgctggaacttatccaaaaagaagacctcagaaacttagattggtagatctctagtgcatattatcatgtgggcaccttctcttagggtggaatgaggcagtctggatgcagcatagttaaaaggagctgtttaatattctctgtagtctggcctcttaactagaaagtaaagctaaatcagaagcctgtatttaaccatgtgaacagggagggatttagtgttctgatggctgattaatagaacagctagatacttagagcatgacgtgggatgggatgagtttacagctgctgccttttcatggtgagcttagcagttttctcattagatgtgtttttttgggttggggaatagcaatttattttattgattttagactttatcaagctaattagctcccctttagataagtacatgttgcacatgtgcacctacttgtaatctcagatatttatgcacacaagtgtgaaggtttttcagggagcagagcatctgggacaggctgattctgagctaaacagggctcctttaaggcaatatgaactgttgccttctataaattgcacattgaggaactctaatagacaaagattaggtgtcaggcagaaaacactcattgtaaatatactattagttgataaacataggactttcttattccccagtttttctttatcatataatttaaatatttattcattttgtatttaaagactacctacacatagatatatgattccaaagtcatactttctccatccccacattagccaagtgaatacagggccaaatgggttcttggaatgataataacaaagcattacaaagtgggtccccttggttccagccttgtccagagtttttggttatatatttctatttattacaatttaccttttaaattgtaaaataaacctttgtgtggacagagccaatgtttcaatcttgaatgagtaaagaaaatactttggaactgatcctcattttgaaattggttctaaattattatccatttccaatgtctgaaattctcttacttcctgctaaaactctctttctgccaaagttgtttcgtaatctgtctcaatgactataatgtaaaattaaagaagtaaccatgcttctcaagggggaattaaaagtgtttattgaattttactcaggctaattgtttggtcagaaattcctaaggccacagctttggggggttcgtgtagatgtacatggtgggtgggttataaatattgggacttaaggcagcttgttctatgtatttatctttgctcttgggtgacttagggaatgattttatttgatttaaccttctttctgtttgccccgagaatactcgccagtggcgcttgcagttgtagcatttaccccaagataactttgcctacgaaatatttcgcttttattattttcacatcattctagtatatggactttggaaacaaaagacattgttctatttatagcattcttttttttttttagtagcggtatttccatttacaaaatatagtaactcttgattactgaaaatgtcaaatcctagaaaacgtagcatgcctatacatgatgttaacatcattctcgaacagttgttggccgaagattcatttgatgaatccaatttttttgaaatagacaattctgatgttctctttagaaataactcagtttttatcttttttcacattgaaaatcagttagatttgcttaagcctcaaagagaatgtttatgtaaattagcgctggcaatttttttttttctaaacaggaaaagggttaaatgaaggttgataaaatggatgttcaattgtctttctgaaagtgagtggcttgaagggatgaataaatattttcttaatatattcaaaaaagtgcattgctttctgtgatggaagttaagacctaaatgtctggaagttgtaaccctcaacacagcttttcctgatttgctgcaaaggcacatagctgattatagaagtgaagacggcaaggacggggactccaacaaaggaaaccctgttgcaggatttgggaactttcatgcttcagatgaaattcaggcatgtgagcatcactgcagaatgtggtgcatcattgccatcatgagtaatcacttgctgctcctacttctgagaccaagactcttttgtcatattctttagcaataggacgggtaaagactggatttaattgctgttcagagtataaaaactcaattgattccaacatatctgaatgtgcagtaaagtcttaaaagtcaaccgttaatcattaagtcttttgcctctaaagtcttttgcctctgaagaggtttattacatgagttgattttcatattttcattttggtggggttttcctgttgttgggcaaggtggggtcacaggacatgggactagtaagcattttactgtttactatatttgtctttttataaacagtatctcccaaaatgtgattagaaggctaccaagcctgtatttggacatttaattgtgtgctttatataatgtaactactaacagtatttggactgcctgttcattcctggagacaaaaatgaaaatctgtcagttcaagttcttgggtaacatcaagtcattagaatttatctaaagcttatcatgatttgataagacatccattgcatgcagctgttttagctcagtgcaaaacactgaaattgtgattcttagactgtttctgagacatttggatggaaataaatgtataaatgttaattcatgtatataaattagaaacacttttctagattctgtaggcttttgttaaaaatagagaatttcttggggtttacttaggccacagaatggccaaataataataatgacaatgatattactaataataatagctaacctttatttggcacttactgtgtgccaggcactattctatttttttaagaatttttaaaataacagctttattgaaatacactttaccataaacttcacctttttattttttatttttatgagacagggactcacccaggctggagtgcagtggagcagtcatggcacactgtagcctcgacctccctgggctcaagcaatcctcccacttcagtgtcccgagtagttgggactacaggcatgcgtcactacacctaattggctaatttttgtagtttttgtagagatagggtttcgccatgttgcctaggctggtcttgaattcctgggctcaagcgatccacctgctttggcctcccaaaacagtgggattgcaggcgtgagccaccatgcctggctgaaattcaccttttaagatgtacaattcagtggtttttagtatattcacacacaaaattgcacaactatcactaacatctaattttagatcattttgtaacttcaccaagaaaccccaggtctgtcagcagtcagttccattcccccttcatcccagcctctggcaaccactaatctgctttctgtcactattgatttggccagacactattcttctgtgcttctcatgcatctcctgtaataccagtgctacaattctcattttatgtggaaaattgaggcactgagaggttaagtaaattgcccacggtcacacagtaatttgatttacaacagtaataacacattagatgagaacacagtaggacacaattttgaattccatttttatgtacctgaaatgaatacacccctcccccaaggtattttccctattgttagcctttgtaccctaggtacaaatataggtattttccctattgtgttatgtacctgaaatgaatacacccttcccccaaggtattttccctattgttagcctttgtaccctagaactgactggatgtagataacatttgttttcagagtaatggaacactgtatcagcagcatctgagaacataagaacagttggacattggaaagaggtttgttgccctcatccctccttgaacctcttttctctcccgcttccaccaccaccacacatatatacccctttttctcagtcttaagcatcaaacaatttctgcctctttctttttaattctcccagagggatggttaatgcatcacaatttaacttgtctattcaggtattaatagtcaagggatgcatctgtttgcttatagtaccagttatattcctaggaccttagagagcagtagtgtgagaatagaatgcctttctatttgggttaaactatgtgggaggaaaaagtaacagagtaaaggctttgccttaatgaagtcaagtgttctgcctggtgggaagtggccacacgctgcactgcgctgctcttgtttactctgttctttcagagcctttgtactttgccatcactgctagtaatttcttggtccttttcaatactccattttaatcttgatttttttctataaataataaatctgtgaaaaatctgtaaaaa

SEQ ID NO: 488473 - DNA, 6568 bp, Homo sapiens
  misc_feature (263)..(263): n is a, c, g, or t
  misc_feature (301)..(301): n is a, c, g, or t
tttatcttttaagttattgtcacaatagttactctcttttagaccctgaacattttcagtacttgctccaaatggtttagcaacttttgaagtgggattaacaagtttggccaatgaagcttcttccctgcccaccgccagaggtgctggagaaaagtaatcctggagggtcggcgtggaggcagtagagaggtttataaaagtcaaggaagtgggaagaggcttgcgagcagcaggagaggcgcagagtcagaggggcaggngcggcggcggagggagcaggaggttggggcttgagccngtcattccggcgcacgaaaacttgaagtcgctcggtagccggggaagggaaggaagagaggcaggctctttcctagaggtgccgtgatcgagggtctggcactccaagccaactcctgagaacgggaaatgggcgggagtcggtggggtggagagggcagccgtggtcgcgagagcgaaggagcggtctgagaatccggcttgagtgttaaaggctaagcgtgtctagctggacccgtggccccgaagaagcgagacaaggcgacgcggagctgtccctgacaccccgaggaccgagggacagcgaagggccggggccgccggccattgccaggcgccattaggtgacgcggccgtcacgcgatgacgcgctgaccggcagtggcctccacgtcgcaggttccgcaaagacctgtgggagcgacccgggagaaggagggccaagatggcggaagcggaggagtctccaggagacccggggacagcatcgcccaggcccctgatgcgtgatctaaaagctgttgggaaaaaattcatgcatgttttgtacccaaggaaaagtaatactcttttgagagattgggatttgtggggccctttgatcctttgtgtgacactcgcattaatgctgcaaagagactctgcagatagtgaaaaagatggagggccccaatttgcagaggtgtttgtcattgtctggtttggtgcagttaccatcaccctcaactcaaaacttcttggagggaacatatctttttttcagagcctctgtgtgctgggttactgtatacttcccttgacagtagcaatgctgatttgccggctggtacttttggctgatccaggacctgtaaacttcatggttcggctttttgtggtgattgtgatgtttgcctggtctatagttgcctccacagctttccttgctgatagccagcctccaaaccgcagagccctagctgtttatcctgttttcctgttttactttgtcatcagttggatgattctcacctttactcctcagtaaatcaggaatgggaaattaaaaccagtgaattgaaagcacatctgaaagatgcaattcaccatggagctttgtctctggcccttattttgtctaattttggaggtatttgataactgagtaggtgaggagattaaaagggagccatatagcactgtcaccccttatttgaggaactgatgtttgaaaggctgttcttttctctcttaatgtcatttctttaaaaatacatgtgcatactacacacagtatataatgcctccttaaggcatgatggagtcaccgtggtccatttgggtgacaaccagtgacttgggaagcacatagatacatcttacaagttgaatagagttgataactattttcagttttgagaataccagttcaggtgcagctcttaaacacattgccttatgactattagaatatgcctctcttttcataaataaaaatacatggtctatatccattttcttttatttctctctcttaagcttaaaaaggcaatgagagaggttaggagtgggttcatacacggagaatgagaaaacatgcattaaccaatattcagattttgatcaggggaaattctacacttgttgcaaaaaaaaaaaaaaaaaaagcaaagggcctctaaagaatcagcctctttggtccctttgtgctgtcacctttttgccatgtttaacagcatcttggttggcactctagtcttaatcttgctccttaactttgaatatgcagtctaaaatgtcagtagtcaacatgtaattttcctttgaaattctgaatattccagtgctggaacttatccaaaaagaagacctcagaaacttagattggtagatctctagtgcatattatcatgtgggcaccttctcttagggtggaatgaggcagtctggatgcagcatagttaaaaggagctgtttaatattctctgtagtctggcctcttaactagaaagtaaagctaaatcagaagcctgtatttaaccatgtgaacagggagggatttagtgttctgatggctgattaatagaacagctagatacttagagcatgacgtgggatgggatgagtttacagctgctgccttttcatggtgagcttagcagttttctcattagatgtgtttttttgggttggggaatagcaatttattttattgattttagactttatcaagctaattagctcccctttagataagtacatgttgcacatgtgcacctacttgtaatctcagatatttatgcacacaagtgtgaaggtttttcagggagcagagcatctgggacaggctgattctgagctaaacagggctcctttaaggcaatatgaactgttgccttctataaattgcacattgaggaactctaatagacaaagattaggtgtcaggcagaaaacactcattgtaaatatactattagttgataaacataggactttcttattccccagtttttctttatcatataatttaaatatttattcattttgtatttaaagactacctacacatagatatatgattccaaagtcatactttctccatccccacattagccaagtgaatacagggccaaatgggttcttggaatgataataacaaagcattacaaagtgggtccccttggttccagccttgtccagagtttttggttatatatttctatttattacaatttaccttttaaattgtaaaataaacctttgtgtggacagagccaatgtttcaatcttgaatgagtaaagaaaatactttggaactgatcctcattttgaaattggttctaaattattatccatttccaatgtctgaaattctcttacttcctgctaaaactctctttctgccaaagttgtttcgtaatctgtctcaatgactataatgtaaaattaaagaagtaaccatgcttctcaagggggaattaaaagtgtttattgaattttactcaggctaattgtttggtcagaaattcctaaggccacagctttggggggttcgtgtagatgtacatggtgggtgggttataaatattgggacttaaggcagcttgttctatgtatttatctttgctcttgggtgacttagggaatgattttatttgatttaaccttctttctgtttgccccgagaatactcgccagtggcgcttgcagttgtagcatttaccccaagataactttgcctacgaaatatttcgcttttattattttcacatcattctagtatatggactttggaaacaaaagacattgttctatttatagcattcttttttttttttagtagcggtatttccatttacaaaatatagtaactcttgattactgaaaatgtcaaatcctagaaaacgtagcatgcctatacatgatgttaacatcattctcgaacagttgttggccgaagattcatttgatgaatccaatttttttgaaatagacaattctgatgttctctttagaaataactcagtttttatcttttttcacattgaaaatcagttagatttgcttaagcctcaaagagaatgtttatgtaaattagcgctggcaatttttttttttctaaacaggaaaagggttaaatgaaggttgataaaatggatgttcaattgtctttctgaaagtgagtggcttgaagggatgaataaatattttcttaatatattcaaaaaagtgcattgctttctgtgatggaagttaagacctaaatgtctggaagttgtaaccctcaacacagcttttcctgatttgctgcaaaggcacatagctgattatagaagtgaagacggcaaggacggggactccaacaaaggaaaccctgttgcaggatttgggaactttcatgcttcagatgaaattcaggcatgtgagcatcactgcagaatgtggtgcatcattgccatcatgagtaatcacttgctgctcctacttctgagaccaagactcttttgtcatattctttagcaataggacgggtaaagactggatttaattgctgttcagagtataaaaactcaattgattccaacatatctgaatgtgcagtaaagtcttaaaagtcaaccgttaatcattaagtcttttgcctctaaagtcttttgcctctgaagaggtttattacatgagttgattttcatattttcattttggtggggttttcctgttgttgggcaaggtggggtcacaggacatgggactagtaagcattttactgtttactatatttgtctttttataaacagtatctcccaaaatgtgattagaaggctaccaagcctgtatttggacatttaattgtgtgctttatataatgtaactactaacagtatttggactgcctgttcattcctggagacaaaaatgaaaatctgtcagttcaagttcttgggtaacatcaagtcattagaatttatctaaagcttatcatgatttgataagacatccattgcatgcagctgttttagctcagtgcaaaacactgaaattgtgattcttagactgtttctgagacatttggatggaaataaatgtataaatgttaattcatgtatataaattagaaacacttttctagattctgtaggcttttgttaaaaatagagaatttcttggggtttacttaggccacagaatggccaaataataataatgacaatgatattactaataataatagctaacctttatttggcacttactgtgtgccaggcactattctatttttttaagaatttttaaaataacagctttattgaaatacactttaccataaacttcacctttttattttttatttttatgagacagggactcacccaggctggagtgcagtggagcagtcatggcacactgtagcctcgacctccctgggctcaagcaatcctcccacttcagtgtcccgagtagttgggactacaggcatgcgtcactacacctaattggctaatttttgtagtttttgtagagatagggtttcgccatgttgcctaggctggtcttgaattcctgggctcaagcgatccacctgctttggcctcccaaaacagtgggattgcaggcgtgagccaccatgcctggctgaaattcaccttttaagatgtacaattcagtggtttttagtatattcacacacaaaattgcacaactatcactaacatctaattttagatcattttgtaacttcaccaagaaaccccaggtctgtcagcagtcagttccattcccccttcatcccagcctctggcaaccactaatctgctttctgtcactattgatttggccagacactattcttctgtgcttctcatgcatctcctgtaataccagtgctacaattctcattttatgtggaaaattgaggcactgagaggttaagtaaattgcccacggtcacacagtaatttgatttacaacagtaataacacattagatgagaacacagtaggacacaattttgaattccatttttatgtacctgaaatgaatacacccctcccccaaggtattttccctattgttagcctttgtaccctaggtacaaatataggtattttccctattgtgttatgtacctgaaatgaatacacccttcccccaaggtattttccctattgttagcctttgtaccctagaactgactggatgtagataacatttgttttcagagtaatggaacactgtatcagcagcatctgagaacataagaacagttggacattggaaagaggtttgttgccctcatccctccttgaacctcttttctctcccgcttccaccaccaccacacatatatacccctttttctcagtcttaagcatcaaacaatttctgcctctttctttttaattctcccagagggatggttaatgcatcacaatttaacttgtctattcaggtattaatagtcaagggatgcatctgtttgcttatagtaccagttatattcctaggaccttagagagcagtagtgtgagaatagaatgcctttctatttgggttaaactatgtgggaggaaaaagtaacagagtaaaggctttgccttaatgaagtcaagtgttctgcctggtgggaagtggccacacgctgcactgcgctgctcttgtttactctgttctttcagagcctttgtactttgccatcactgctagtaatttcttggtccttttcaatactccattttaatcttgatttttttctataaataataaatctgtgaaaaatctgtaaaaa

SEQ ID NO: 488474 - DNA, 581 bp, Homo sapiens
tttgagttatattccaaaattcgcgccacaggaaataaaagaccggaacttttcaatattgtttggatgggtttcaccacatgtttatgttttaaaaaaacccgcccaaaaattaattgtacactgtttggaatggtagtcatttatatactcgttggatttcacactatttcacaaaaaaggttagtctgcgaatcctagtcaattttaaacaaaaacatttttagagtaaattcctttacaattggcacacagtgtttttgattttatttacataaggccaaaattgtttaacgcccccccctcttgtttaacgacaaccttatgcgttttcttgaaaccgccccagagattaattctcttcgaaattcactttttcttcttaataggtcatcgcccctagatctggtctacccccctatccagtctttaagatcacatcttcctctaattcactggggagcatagtctatctttgattcttcaagatatttctaacaacagtgttccgatgattatacgcctaaatacaattaaaccctgtggtaatttaacttaaaaactaagcgtctagttctctc

SEQ ID NO: 488475 - DNA, 6428 bp, Homo sapiens
  misc_feature (263)..(263): n is a, c, g, or t
  misc_feature (301)..(301): n is a, c, g, or t
  misc_feature (6248)..(6249): n is a, c, g, or t
  misc_feature (6351)..(6351): n is a, c, g, or t
  misc_feature (6369)..(6369): n is a, c, g, or t
  misc_feature (6412)..(6412): n is a, c, g, or t
tttatcttttaagttattgtcacaatagttactctcttttagaccctgaacattttcagtacttgctccaaatggtttagcaacttttgaagtgggattaacaagtttggccaatgaagcttcttccctgcccaccgccagaggtgctggagaaaagtaatcctggagggtcggcgtggaggcagtagagaggtttataaaagtcaaggaagtgggaagaggcttgcgagcagcaggagaggcgcagagtcagaggggcaggngcggcggcggagggagcaggaggttggggcttgagccngtcattccggcgcacgaaaacttgaagtcgctcggtagccggggaagggaaggaagagaggcaggctctttcctagaggtgccgtgatcgagggtctggcactccaagccaactcctgagaacgggaaatgggcgggagtcggtggggtggagagggcagccgtggtcgcgagagcgaaggagcggtctgagaatccggcttgagtgttaaaggctaagcgtgtctagctggacccgtggccccgaagaagcgagacaaggcgacgcggagctgtccctgacaccccgaggaccgagggacagcgaagggccggggccgccggccattgccaggcgccattaggtgacgcggccgtcacgcgatgacgcgctgaccggcagtggcctccacgtcgcaggttccgcaaagacctgtgggagcgacccgggagaaggagggccaagatggcggaagcggaggagtctccaggagacccggggacagcatcgcccaggcccctgtttgcaggcctttcagatatatccatctcacaagacatccccgtagaaggagaaatcaccattcctatgagatctcgcatccgggagtttgacagctccacattaaatgaatctgttcgcaataccatcatgcgtgatctaaaagctgttgggaaaaaattcatgcatgttttgtacccaaggaaaagtaatactcttttgagagattgggatttgtggggccctttgatcctttgtgtgacactcgcattaatgctgcaaagagactctgcagatagtgaaaaagatggagggccccaatttgcagaggtgtttgtcattgtctggtttggtgcagttaccatcaccctcaactcaaaacttcttggagggaacatatctttttttcagagcctctgtgtgctgggttactgtatacttcccttgacagtagcaatgctgatttgccggctggtacttttggctgatccaggacctgtaaacttcatggttcggctttttgtggtgattgtgatgtttgcctggtctatagttgcctccacagctttccttgctgatagccagcctccaaaccgcagagccctagctgtttatcctgttttcctgttttactttgtcatcagttggatgattctcacctttactcctcagtaaatcaggaatgggaaattaaaaccagtgaattgaaagcacatctgaaagatgcaattcaccatggagctttgtctctggcccttattttgtctaattttggaggtatttgataactgagtaggtgaggagattaaaagggagccatatagcactgtcaccccttatttgaggaactgatgtttgaaaggctgttcttttctctcttaatgtcatttctttaaaaatacatgtgcatactacacacagtatataatgcctccttaaggcatgatggagtcaccgtggtccatttgggtgacaaccagtgacttgggaagcacatagatacatcttacaagttgaatagagttgataactattttcagttttgagaataccagttcaggtgcagctcttaaacacattgccttatgactattagaatatgcctctcttttcataaataaaaatacatggtctatatccattttcttttatttctctctcttaagcttaaaaaggcaatgagagaggttaggagtgggttcatacacggagaatgagaaaacatgcattaaccaatattcagattttgatcaggggaaattctacacttgttgcaaaaaaaaaaaaaaaaaaagcaaagggcctctaaagaatcagcctctttggtccctttgtgctgtcacctttttgccatgtttaacagcatcttggttggcactctagtcttaatcttgctccttaactttgaatatgcagtctaaaatgtcagtagtcaacatgtaattttcctttgaaattctgaatattccagtgctggaacttatccaaaaagaagacctcagaaacttagattggtagatctctagtgcatattatcatgtgggcaccttctcttagggtggaatgaggcagtctggatgcagcatagttaaaaggagctgtttaatattctctgtagtctggcctcttaactagaaagtaaagctaaatcagaagcctgtatttaaccatgtgaacagggagggatttagtgttctgatggctgattaatagaacagctagatacttagagcatgacgtgggatgggatgagtttacagctgctgccttttcatggtgagcttagcagttttctcattagatgtgtttttttgggttggggaatagcaatttattttattgattttagactttatcaagctaattagctcccctttagataagtacatgttgcacatgtgcacctacttgtaatctcagatatttatgcacacaagtgtgaaggtttttcagggagcagagcatctgggacaggctgattctgagctaaacagggctcctttaaggcaatatgaactgttgccttctataaattgcacattgaggaactctaatagacaaagattaggtgtcaggcagaaaacactcattgtaaatatactattagttgataaacataggactttcttattccccagtttttctttatcatataatttaaatatttattcattttgtatttaaagactacctacacatagatatatgattccaaagtcatactttctccatccccacattagccaagtgaatacagggccaaatgggttcttggaatgataataacaaagcattacaaagtgggtccccttggttccagccttgtccagagtttttggttatatatttctatttattacaatttaccttttaaattgtaaaataaacctttgtgtggacagagccaatgtttcaatcttgaatgagtaaagaaaatactttggaactgatcctcattttgaaattggttctaaattattatccatttccaatgtctgaaattctcttacttcctgctaaaactctctttctgccaaagttgtttcgtaatctgtctcaatgactataatgtaaaattaaagaagtaaccatgcttctcaagggggaattaaaagtgtttattgaattttactcaggctaattgtttggtcagaaattcctaaggccacagctttggggggttcgtgtagatgtacatggtgggtgggttataaatattgggacttaaggcagcttgttctatgtatttatctttgctcttgggtgacttagggaatgattttatttgatttaaccttctttctgtttgccccgagaatactcgccagtggcgcttgcagttgtagcatttaccccaagataactttgcctacgaaatatttcgcttttattattttcacatcattctagtatatggactttggaaacaaaagacattgttctatttatagcattcttttttttttttagtagcggtatttccatttacaaaatatagtaactcttgattactgaaaatgtcaaatcctagaaaacgtagcatgcctatacatgatgttaacatcattctcgaacagttgttggccgaagattcatttgatgaatccaatttttttgaaatagacaattctgatgttctctttagaaataactcagtttttatcttttttcacattgaaaatcagttagatttgcttaagcctcaaagagaatgtttatgtaaattagcgctggcaatttttttttttctaaacaggaaaagggttaaatgaaggttgataaaatggatgttcaattgtctttctgaaagtgagtggcttgaagggatgaataaatattttcttaatatattcaaaaaagtgcattgctttctgtgatggaagttaagacctaaatgtctggaagttgtaaccctcaacacagcttttcctgatttgctgcaaaggcacatagctgattatagaagtgaagacggcaaggacggggactccaacaaaggaaaccctgttgcaggatttgggaactttcatgcttcagatgaaattcaggcatgtgagcatcactgcagaatgtggtgcatcattgccatcatgagtaatcacttgctgctcctacttctgagaccaagactcttttgtcatattctttagcaataggacgggtaaagactggatttaattgctgttcagagtataaaaactcaattgattccaacatatctgaatgtgcagtaaagtcttaaaagtcaaccgttaatcattaagtcttttgcctctaaagtcttttgcctctgaagaggtttattacatgagttgattttcatattttcattttggtggggttttcctgttgttgggcaaggtggggtcacaggacatgggactagtaagcattttactgtttactatatttgtctttttataaacagtatctcccaaaatgtgattagaaggctaccaagcctgtatttggacatttaattgtgtgctttatataatgtaactactaacagtatttggactgcctgttcattcctggagacaaaaatgaaaatctgtcagttcaagttcttgggtaacatcaagtcattagaatttatctaaagcttatcatgatttgataagacatccattgcatgcagctgttttagctcagtgcaaaacactgaaattgtgattcttagactgtttctgagacatttggatggaaataaatgtataaatgttaattcatgtatataaattagaaacacttttctagattctgtaggcttttgttaaaaatagagaatttcttggggtttacttaggccacagaatggccaaataataataatgacaatgatattactaataataatagctaacctttatttggcacttactgtgtgccaggcactattctatttttttaagaatttttaaaataacagctttattgaaatacactttaccataaacttcacctttttattttttatttttatgagacagggactcacccaggctggagtgcagtggagcagtcatggcacactgtagcctcgacctccctgggctcaagcaatcctcccacttcagtgtcccgagtagttgggactacaggcatgcgtcactacacctaattggctaatttttgtagtttttgtagagatagggtttcgccatgttgcctaggctggtcttgaattcctgggctcaagcgatccacctgctttggcctcccaaaacagtgggattgcaggcgtgagccaccatgcctggctgaaattcaccttttaagatgtacaattcagtggtttttagtatattcacacacaaaattgcacaactatcactaacatctaattttagatcattttgtaacttcaccaagaaaccccaggtctgtcagcagtcagttccattcccccttcatcccagcctctggcaaccactaatctgctttctgtcactattgatttggccagacactattcttctgtgcttctcatgcatctcctgtaataccagtgctacaattctcattttatgtggaaaattgaggcactgagaggttaagtaaattgcccacggtcacacagtaatttgatttacaacagtaataacacattagatgagaacacagtaggacacaattttgaattccatttttatgtacctgaaatgaatacacccctcccccaaggtattttccctattgttagcctttgtaccctaggtacaaatataggtattttccctattgtgttatgtacctgaaatgaatacacccttcccccaaggtattttccctattgttagcctttgtaccctagaactgactggatgtagataacatttgttttcagagtaatggaacactgtatcagcagcatctgagaacataagaacagttggacattggaaagaggtttgttgccctcatccctccttgaacctcttttctctcccgcttgcagcacaanntcggctcactgcaacctttgcctcttgggttcaagccattcctcccacctcagcctcccaaggaactaggatttcaacaaagacaacttttggatcttttcntcagagagatcattattnccaaggaacagggtttgacccttcttttaaagggggttgttcnggggctgatgagagtt

SEQ ID NO: 488476 - DNA, 390 bp, Homo sapiens
  misc_feature (172)..(172): n is a, c, g, or t
  misc_feature (295)..(295): n is a, c, g, or t
  misc_feature (365)..(365): n is a, c, g, or t
gacttttttcatggccaacctcgactggattcccacaggaaagggaaatctgggaaacatgttcccacgtagctaagtcaacacaatagaaaaccactgcagttggcttaggaaacccgagctggaagtggcaggatggaacgtgggcacgttggggcaggagactggggtngtatgatagggtgttagcctatgtacagtggtaaagcagcaatgatgaccttgaggagttttatcctctgtatatcaatggattaaaatggcggagtaacttgataaaatagattttctttanaaaaattaataaatttaaaataatcaaattttttaaaaaatttaaaaaatgttaaatgtcagagtagttnctcaaactttttggtatccgtaccc

SEQ ID NO: 488477 - DNA, 325 bp, Homo sapiens
ggagggtcaaggctgtaatgagccgtgattatgtcactgcatgccagcctgggcgacagaggcagacgctgtctcaaaaaacaaaccaaaaacaaaaacaaaaaaaaaattatggagtgattgcttgctttaaaataagttccttgggccgggtgcggtggctcacgtctgtaatcccagcactctgggaggctgaggcaggaagtcaaagctgcagtgagctgagatcacactactgcactccaatctttgtgacaaagcgagatcctgtctcaaaaaggatgtgtttgtttccaggagtgagtttgtttttaacctgtcagtt

SEQ ID NO: 488478 - DNA, 873 bp, Homo sapiens
  misc_feature (33)..(33): n is a, c, g, or t
  misc_feature (180)..(180): n is a, c, g, or t
  misc_feature (204)..(204): n is a, c, g, or t
  misc_feature (210)..(210): n is a, c, g, or t
  misc_feature (213)..(213): n is a, c, g, or t
  misc_feature (215)..(215): n is a, c, g, or t
  misc_feature (220)..(220): n is a, c, g, or t
  misc_feature (223)..(223): n is a, c, g, or t
  misc_feature (228)..(229): n is a, c, g, or t
  misc_feature (245)..(246): n is a, c, g, or t
  misc_feature (252)..(252): n is a, c, g, or t
  misc_feature (259)..(259): n is a, c, g, or t
  misc_feature (276)..(276): n is a, c, g, or t
  misc_feature (278)..(279): n is a, c, g, or t
  misc_feature (286)..(286): n is a, c, g, or t
  misc_feature (295)..(295): n is a, c, g, or t
  misc_feature (299)..(299): n is a, c, g, or t
  misc_feature (304)..(305): n is a, c, g, or t
  misc_feature (313)..(313): n is a, c, g, or t
  misc_feature (315)..(315): n is a, c, g, or t
  misc_feature (340)..(343): n is a, c, g, or t
  misc_feature (346)..(347): n is a, c, g, or t
  misc_feature (372)..(372): n is a, c, g, or t
  misc_feature (376)..(377): n is a, c, g, or t
  misc_feature (402)..(402): n is a, c, g, or t
  misc_feature (435)..(436): n is a, c, g, or t
  misc_feature (442)..(442): n is a, c, g, or t
  misc_feature (449)..(449): n is a, c, g, or t
  misc_feature (467)..(467): n is a, c, g, or t
  misc_feature (475)..(475): n is a, c, g, or t
  misc_feature (483)..(483): n is a, c, g, or t
  misc_feature (491)..(491): n is a, c, g, or t
  misc_feature (580)..(580): n is a, c, g, or t
  misc_feature (604)..(604): n is a, c, g, or t
  misc_feature (787)..(787): n is a, c, g, or t
  misc_feature (865)..(865): n is a, c, g, or t
catgggggggggggtgccccttgataggatgcncttaagcatggtcaattcccccttcccccaaaggaaatggagaaaaggggccaagaagtcaatgaatccctggaatattgtcccagaatccttccagggatggtatacgactggccaccagtccacaaatgtgactggtaaggggtntagtaacagggggtggggttgggnggggtnttntnctggntgntttgnncccagctctagttttnncctttntttgggntggggggagctggcgtngnnttcgggnagggtacangggnggggnntttggttngngcattttctcataacaggggtgggnnnnttnngcaccattattgttaaataactgtnactnnccaaaacacatacaggcttctttantggagttaataaaactatggcacattgggaatnngggggnggggttntgttcccagatggaaaantgggttanagggagcnatgctganagggccttattcacagtctaggttgttagaaaggtgccctagctagaaatgacagcaaatagccataatcattatgtggggctgaaccngaggaggccaggctgagccaagangctggaagtatcttgaacggctctccaaatccaaagattatccatactctttatccctccagcgatgtgtaaaaccagaaagtatgaaacactggaggtggacatctggtttttatttctgggatatcttgatacatctcattacatttcacaatctgcatgggaaggaaaaggatggtaganaacatggacatcctgtctcccactgcaagggcgtggaacatggtaaggatacccagctgtgacaggacgtggcaaggnacaagatg

SEQ ID NO: 488479 - DNA, 194 bp, Homo sapiens
  misc_feature (177)..(177): n is a, c, g, or t
cctggatcattatgattagctgaagaagacatgccccatctaaaggaagtagctaccactcaactgttgctcacttaggctatgagggaatatgggctaaggctaccagatcctcagttttttcgagagaagccttgaatacagatttgctaaaatagaaattttaatgtagaattnacttatcattgatggtg

SEQ ID NO: 488480 - DNA, 741 bp, Homo sapiens
  misc_feature (45)..(45): n is a, c, g, or t
  misc_feature (107)..(107): n is a, c, g, or t
  misc_feature (119)..(119): n is a, c, g, or t
  misc_feature (147)..(147): n is a, c, g, or t
  misc_feature (197)..(197): n is a, c, g, or t
  misc_feature (215)..(215): n is a, c, g, or t
  misc_feature (263)..(263): n is a, c, g, or t
  misc_feature (323)..(323): n is a, c, g, or t
  misc_feature (331)..(332): n is a, c, g, or t
  misc_feature (336)..(337): n is a, c, g, or t
  misc_feature (362)..(362): n is a, c, g, or t
  misc_feature (366)..(366): n is a, c, g, or t
  misc_feature (415)..(415): n is a, c, g, or t
  misc_feature (417)..(417): n is a, c, g, or t
  misc_feature (427)..(427): n is a, c, g, or t
  misc_feature (438)..(438): n is a, c, g, or t
  misc_feature (447)..(447): n is a, c, g, or t
  misc_feature (466)..(466): n is a, c, g, or t
  misc_feature (557)..(557): n is a, c, g, or t
  misc_feature (645)..(645): n is a, c, g, or t
  misc_feature (649)..(649): n is a, c, g, or t
  misc_feature (673)..(673): n is a, c, g, or t
  misc_feature (711)..(711): n is a, c, g, or t
tgaagggagaaattcgggagcgctcccgggtcagactccccctangctgggtgtgggttatattcagagggccaaacccacactggggtaggttaggtatggtttanttagccacaggnccccgggggcaggagacagagtgggggnccgaagctccctgtcctggaagagttaaaagttttggggtagccctggcnccgtgggggcagttaganatgagggaggttactccttagcccaggagtggttagagaaagtggggntggtagagatgcttgtttaagccttggcctctaggaggtgttagagatttgttggggttnggggccanngttnntgggacccagttttggggagggagntgtnagagattgggggatgttctgagctccccagacaagaactgctggttaananggggccatgnccggtttgggntcagctgtncctgaggagcttggcatcncgcctgggagatgcagctgttactggggtttctctctctttgttgtcttggtttgtccttggcaggtggtggggacttattgggggaagcngaagtgctggggttggggaccccgcccccgactgggcatctatgctggcgtgctccctccggacaaggtcctccagctccttcttccntccnaggagctcagcaagggccacgcanccctggtcgcattcacccagccaggccacgtccctgtnggccttcttggagtcaaagtccatggctcc

SEQ ID NO: 488481 - DNA, 100 bp, Homo sapiens
gacagatccgaggttacctcactatattggtacgaggctagagtgacagtgagtcactattcacagagtacgaacatagtaaccttgattagaactccaa

SEQ ID NO: 488482 - DNA, 470 bp, Homo sapiens
  misc_feature (340)..(340): n is a, c, g, or t
  misc_feature (362)..(362): n is a, c, g, or t
  misc_feature (367)..(367): n is a, c, g, or t
  misc_feature (383)..(383): n is a, c, g, or t
  misc_feature (406)..(406): n is a, c, g, or t
  misc_feature (437)..(437): n is a, c, g, or t
  misc_feature (442)..(442): n is a, c, g, or t
  misc_feature (470)..(470): n is a, c, g, or t
gaactgttctcaagggcaatctctagaaatgatgcatacctcggagatacacgttcaagcgaaaaaaggaaaaaaaaaggctacacccaacaaccacactgtatttataatcacgttcctaaacactataaatattataactaatgtgatatatgttttgtgattaaatggattaaaacattgaatttaaaaagccacaaagaaaaagagattatcttctattatgccacttacaagttttgttccattggcacaaatacaaatttgacaactgtatcattactgaacgcagtgactaaaatgccagggatattagctttgtaattttcacctggaaatncattgtatgatgcatactggcntgctnaaccttctttttattnaaatggatttttttttcttggcnctgcactgtaattaaggtaatttaatggccnttttncccactttccatttttattttgggtatn

SEQ ID NO: 488483 - DNA, 583 bp, Homo sapiens
  misc_feature (181)..(181): n is a, c, g, or t
  misc_feature (279)..(279): n is a, c, g, or t
ggtctggggccttttgtaagaggcttctgcctccttcacgccccaacggaggccgggtgggcggcccccacagtctacttctctcgacttttttttttcttgctttctcgaggccacgcgcggccgccctcgtttttttttttccccaacccccagggcaaaggggtgtccccttttttcnccatgggggggggggggggcctgcccccccttttttttttcaccccaggggggggttctcccccgggggtgggggggggggccgggggtttttttctnacacgggtttttaggggttttccccccccccccccctggtccgcccccttacttttttgggtttttaattttttgggccgggggccccccctttcccccaaaaaccccccggtttttttttggcccccccttttaaaaaagatttttttgggggggggggggggtggggcccccccgggggtggggttccgccccctggggcccccccctttttcccggggggggggggccccgggcttcgctttttttcccgggggttttgcgggttttttttttgggccaataaacgcccccccccgtttta

SEQ ID NO: 488484 - DNA, 790 bp, Homo sapiens
  misc_feature (663)..(663): n is a, c, g, or t
agcggggtggagcgagctagagctgggagaaggcagtgagcgagcaggcggcagcacggtccgtgcggagcacggcgatgcgacgcgggaagacgcagccaccttcctcaccagccagcccacagcggtttgttccccattctcgggagtgcgccaagtgcctgggtccgacccaaagccctgtcctcaaagtggcgagaacgagcaatcgacatcatccaggataactaacgggtaccatcattcctttccggaagcagcacatgtgcgcggggagcgttcctacagttggcggaatggcggtcaatgtgtattctacctcgataacccaagagactatgagcagacatgacatcagttgcatgggttaatgacatagtatctttaaactacacaagaagtggaacagctttgttcaggagcggcctattgccaattcactggacatgctcttccctggctgcattagtttgaagaagagtacgaatgttcaagcaccagctggacacatgaatatattcacaattttaaacttctgcaagcatcatgtaaagcgaactgaacgttgatagaggtaacttccagtggagaagctagtgaattggacggttccaaggacaaacctggatgccattcaagtggtttaagacattctatgatgcntactacgatgggaagagagtatgatcctgtacgaggcacgacaagggctagatgcaaattcctccttctgaccctggtgaacagatcttcacctgccagaaaagtctcaccatgcaaactcccccaa

SEQ ID NO: 488485 - DNA, 258 bp, Homo sapiens
ccccgactagcagacaggtggatgcagctggagctggtggggctggcgcgggaggataaagagaacgagagcacctgtgtcgcagatccatgtcggtgccatataacccagatgagcgtcttcatgccaaacaaaattgtctttcaaggactgacctctgaccctaccccttgccttcctcttgcgttgggacccatgtccttctctctttaccctccctttcccagacttttgcccgggttctagctggccaaggtc

SEQ ID NO: 488486 - DNA, 1681 bp, Homo sapiens
ggggtacgggagctgggaggcgggggaagccccagcatgggaccctagcagctttggaccacctgcccagccctgcctctcacgctctgtcccccagacatggtggcccaggcgctggagctctctcggaaaccacacgtggtcatcgccacgccggggcgcctggcagatcacctgcgcagctccaacacttttagtataaagaagatccgcttcctggtgagttcgccccgcccctgcagacctcaggagctgggctcggagcctccaggcccaatgtcagagcctggggcgccatctcatccatttaggaaacgtatgtccgttagactgtccagtaaaacgctaggaacagtgacagggaccgttcaaggaccaacaagagggggcccagtcctagcaatgttattcgggggtagggccttgctgagacttgggtgaggggcaggcctcccttggaaggagggtactccagggcctagggtccatgtccatgcctctcaaagaggcctgcttcaggggtggccaagacccggggccatggacggcaccctcacccctgcccccattggcacggcaggtgatggatgaggcagaccggctgctggaacagggctgcactgacttcaccgtggacctggaggccatcttggcggctgtgccggcccgcaggcagacactgctgttcagcgccacgctgaccgacacactccgggagctgcagggtctggccaccaaccagcccttcttctgggaagcacaggccccggtgagcaccgtggagcagctggaccagcgctacctgctggtgcctgagaaggtcaaggacgcctacctggtccacctgatccagcgcttccaggatgagcacgaggactggtccattatcatcttcaccaacacgtgcaagacctgccagattctgtgcatgatgctgcgcaaattcagcttccccaccgtggctctgcactccatgatgaagcagaaagaacgctttgccgccctagccaagttcaagtccagcatctaccggatcctgatcgcaacagacgtggcctcccggtgagcagcccccagtctcctgccaagggcactccctcttttactacaaggccccacagatgagaaggctggcctcaggcatgtcaggcagccctagcatccctgctgagtgaccctgggtgagtccttgcctcggtttccccacatggacagtggagctgaccagccacctctgcctccaggggcctggacatccctacggtacaggtggtcatcaaccacaacacccccgggctccccaagatctacatccaccgagtcggccggacggcccgtgcaggtgagcagtggagggggaggccgagccttgggcctctgtccctccagcctgcccagcaaattcaggtggtaggacgtgggtagggtgcagcccacagatgagagctactcagggccatgtttgcaagttggggagttgtcctttctaaagcaaaggtgaatcccagctactcgggaggctgaggcaagaagatcacttgaacccgggaggttgcggcaagaagatcacttgaacccgggaggttgcggcaagctgagaatgcaccattgcaccccagcctgggcaaaaagagcaaaactccgtctcaaaaaaaataaaataaaataggccagaaaaaaa

SEQ ID NO: 488487 - DNA, 487 bp, Homo sapiens
gtgtgtaattgatgatagacatctgtccgtgccgcacagcctgaggatgctgggccttctggggccccccaggccatcaggtttcttggtcctggaacctacaaacgctctgtgactcgtggggttctgcacatgtcccatggtctatgagcgtgatgtctcatgcatggttgctaccccagtcctggattagccctcttgatggatgaacgacacctggtaggacctcagagaggctgagtcacttacctgaggacacccagccaggcagagctgggattgaaggacccctatgagagaagggcttggcccccatggggaagacacggatggaaggtggagcaaaggaaaatacatgaaattgagagtggcagctgcctgccaaaatctgttccgctgtaacagaactgaatttggaccccagcatcagtggctcaacgcctgtaatcccagcactttggcaggccaatgcctggaaggatcactt

SEQ ID NO: 488488 - DNA, 1498 bp, Homo sapiens
ggggtacgggagctgggaggcgggggaagccccagcatgggaccctagcagctttggaccacctgcccagccctgcctctcacgctctgtcccccagacatggtggcccaggcgctggagctctctcggaaaccacacgtggtcatcgccacgccggggcgcctggcagatcacctgcgcagctccaacacttttagtataaagaagatccgcttcctggtgagttcgccccgcccctgcagacctcaggagctgggctcggagcctccaggcccaatgtcagagcctggggcgccatctcatccatttaggaaacgtatgtccgttagactgtccagtaaaacgctaggaacagtgacagggaccgttcaaggaccaacaagagggggcccagtcctagcaatgttattcgggggtagggccttgctgagacttgggtgaggggcaggcctcccttggaaggagggtactccagggcctagggtccatgtccatgcctctcaaagaggcctgcttcaggggtggccaagacccggggccatggacggcaccctcacccctgcccccattggcacggcaggtgatggatgaggcagaccggctgctggaacagggctgcactgacttcaccgtggacctggaggccatcttggcggctgtgccggcccgcaggcagacactgctgttcagcgccacgctgaccgacacactccgggagctgcagggtctggccaccaaccagcccttcttctgggaagcacaggccccggtgagcaccgtggagcagctggaccagcgctacctgctggtgcctgagaaggtcaaggacgcctacctggtccacctgatccagcgcttccaggatgagcacgaggactggtccattatcatcttcaccaacacgtgcaagacctgccagattctgtgcatgatgctgcgcaaattcagcttccccaccgtggctctgcactccatgatgaagcagaaagaacgctttgccgccctagccaagttcaagtccagcatctaccggatcctgatcgcaacagacgtggcctccggggcctggacatccctacggtacaggtggtcatcaaccacaacacccccgggctccccaagatctacatccaccgagtcggccggacggcccgtgcaggtgagcagtggagggggaggccgagccttgggcctctgtccctccagcctgcccagcaaattcaggtggtaggacgtgggtagggtgcagcccacagatgagagctactcagggccatgtttgcaagttggggagttgtcctttctaaagcaaaggtgaatcccagctactcgggaggctgaggcaagaagatcacttgaacccgggaggttgcggcaagaagatcacttgaacccgggaggttgcggcaagctgagaatgcaccattgcaccccagcctgggcaaaaagagcaaaactccgtctcaaaaaaaataaaataaaataggccagaaaaaaa

SEQ ID NO: 488489 - DNA, 1348 bp, Homo sapiens
ggggtacgggagctgggaggcgggggaagccccagcatgggaccctagcagctttggaccacctgcccagccctgcctctcacgctctgtcccccagacatggtggcccaggcgctggagctctctcggaaaccacacgtggtcatcgccacgccggggcgcctggcagatcacctgcgcagctccaacacttttagtataaagaagatccgcttcctggtgagttcgccccgcccctgcagacctcaggagctgggctcggagcctccaggcccaatgtcagagcctggggcgccatctcatccatttaggaaacgtatgtccgttagactgtccagtaaaacgctaggaacagtgacagggaccgttcaaggaccaacaagagggggcccagtcctagcaatgttattcgggggtagggccttgctgagacttgggtgaggggcaggcctcccttggaaggagggtactccagggcctagggtccatgtccatgcctctcaaagaggcctgcttcaggggtggccaagacccggggccatggacggcaccctcacccctgcccccattggcacggcaggtgatggatgaggcagaccggctgctggaacagggctgcactgacttcaccgtggacctggaggccatcttggcggctgtgccggcccgcaggcagacactgctgttcagcgccacgctgaccgacacactccgggagctgcagggtctggccaccaaccagcccttcttctgggaagcacaggccccggtgagcaccgtggagcagctggaccagcgctacctgctggtgcctgagaaggtcaaggacgcctacctggtccacctgatccagcgcttccaggatgagcacgaggactggtccattatcatcttcaccaacacgtgcaagacctgccagattctgtgcatgatgctgcgcaaattcagcttccccaccgtggctctgcactccatgatgaagcagaaagaacgctttgccgccctagccaagttcaagtccagcatctaccggatcctgatcgcaacagacgtggcctccggggcctggacatccctacggtacaggtggtcatcaaccacaacacccccgggctccccaagatctacatccaccgagtcggccggacggcccgtgcagcaaaggtgaatcccagctactcgggaggctgaggcaagaagatcacttgaacccgggaggttgcggcaagaagatcacttgaacccgggaggttgcggcaagctgagaatgcaccattgcaccccagcctgggcaaaaagagcaaaactccgtctcaaaaaaaataaaataaaataggccagaaaaaaa

SEQ ID NO: 488490 - DNA, 737 bp, Homo sapiens
aacacaggcaaggacgagccgggtagatcggacgaggcggcacagtcacctatgcggagatactcagctaccccaggagcaagacctactgagcccgccaatgcgcggacgcacggccctacggcacgcgatggcactagaaggactacgcgctagagaaggaaaaggtataagaagtactatacagagagtactaccaggatagatagaactacgggaagaagcagttcaagtatagggaaccagtaggtaacggctaggctacatacgtggaacatggtaggctactagtatagtaggacctaggcacgacgtaagcccgaggatagaccccgagctatggtggactacaatctacgtagagaatagccatggcgctaacgcggaagctactaatgctagatagccggtaacaagaagctagctagcctacagtaacacaggacgagggacagtaggtaaaataaaagatagtaacctagggacgtaataaccatattgagcatacggctaaatagcataggcagcatgcgtgagtaccgggaaaccctgcgtgataggtaccgcaagtccgccccagaaacccgatgtaaccccatagcttgcactctaccattagccgctagaatatggacagctggcaataataacaaacggccccctaaagccagctaacacaaaagacctacggagtaggatacccggggaaaagtagccgggggctagactactagtag

SEQ ID NO: 488491 - DNA, 3493 bp, Homo sapiens
ggttaatgttgctatcttaagcactggcatttgggcaaaacgtgactgtgttctgtgggagaatccaaaggcattattcactctagttgagatagaattgggtggctaaacagggtgtgtggtacccaaaagattaaatgttacatgtccttttagtccttgaccaggtctagccttggcagaagcaagggagccactaagccaaactccctgtgcagacagaccatgtttcaaggctggaagtagtgccctggcaacacacaaaaggaacggtgaaatggtaggcaaagtgaacttggctctgctggcctctttggggtcacagaaattgctccttgtggtaatcttatatttctgtcaggcacagggccaagaagctgtgtaacagacattactttgcttgcatctctttttcataccttttccctctgaggcagcttttgcttagaaaacagtcccttcactctgcctttcctcctaacttcctgtgcctcttcatgttctgctcaagctttttaaagcaacgaagctgttggagaacttaaatccttgcaactgagagataagctacttaaaggcggtagagatcttttttttttttttttttgagatggggtcttgctgtgttgcccaggctggagtgcagtggtgtgatctcagctcactgcaacctctgctttctgggttcaagtgattctcctgcctcagcctcccaagtagctgggattacggctagctactcctggctaatttttgtatttttagtagagatggggtttcaccatgttggccaggctggtctcaaactcctgacctcaaacgatctgcctgccttggtctcccaaagtgctgggattataggtgtgagccactgcgcctggccatgtagatgacttttgaccaaaatgtttcaccttctcattcagatattcttagtaaccaaaacagtgactcatgcagttgagagagcctttgggctgtcagtttacagtacatcaggcttgctgaggctaagcaaatcagaaaggtgccatgtttataacagaggtcaaagctccttacttctgaaacattagctgtggttaaaaacaaaaactcttccttcttgtattgcttgtctatcaaagccaggaaagtgggggatcactgtagttaaattttttttttttttaattagagacagagtcttgccctgtcgcccaagctggagtgcactggcgcaatcgtggtacactgcagccttgaactcctggactcaagcagtcctcctgcctcagcttcccaagtagttgggagtaggtgcacaccaccatgcccagcgaattttttgtagagacagaggtcttgctatgttgcctaggctggtatcaaaattactggcctcaagcgattctcctgcctcggcctcccagatgttgggattactggtgtgagccaccacgcccagctcaaaaacaatttttttaggggcacttctacaaatcatgaaagggggataaaagcactgactttaaaaagccatgtttaagatgctataaatgttctccccttttcattgattggagagttgtagaggaccttagagatcattttgtctaactccctcatcccaaagataaactgaggcctagagatcgttcagggtgttgtaactgggaacatctgaatgctgaggcctagagatcgttcagggtgttgtaactgggaacatctgaatgctgaggcctagagatcgttcagggtgttgtaactgggaacatctgaatgctgaggcctagagatcgttcagggtgttgtaactgggaacatctgaatgctgaggcctagagatcgttcagggtgttgttgtaactgggaacatctgaatgctgaggcctagagatcgttcagggtgttgtaactgggaacatctgaatgctgaggcctagagatcgttcagggtgttgtaactgggaacatctgaatgctgaggcctagagatcgttcagggtgttgtaactgggaacatctgaatgctgaggcctagagatcgttcagggtgttgtaactgggaacatctgaatgctgaggcctagagatcgttcagggtgttgtaactgggaacatctgaatgctgaggcctagagatcgttcagggtgttgtaactgggaacatctgaatgctgaggcctagagatcgttcagggtgttgttgtaactgggaacatctgaatgctgaggcctagagatcgttcagggtgttgtaactgggaacatctgaatgctgaggcctagagatcgttcagggtgttgtaactgggaacatctgaatgctgaggcctagagatcgttcagggtgttgtaactgggaacatctgaatgctgaggcctagagatcgttcagggtgttgtaactgggaacatctgaatgctgaggcctagagatcgttcagggtgttgtaactgggaacatctgaatgctgaggcctagagatcgttcagggtgttgtaactgggaacatctgaatgctgaggcctagagatcgttcagggtgttgtaactgggaacatctgaatgctgaggcctagagatcgttcagggtgttgtaactgggaacatctgaatgctgaggcctagagatcgttcagggtgttgttgtaactgggaacatctgaatgctgaggcctagagatcgttcagggtgttgtaactgggaacatctgaatgctgaggcctagagatcgttcagggtgttgtaactgggaacatctgaatgctgaggcctagagatcgttcagggtgttgtaactgggaacatctgaatgctgaggcctagagatcgttcagggtgttgtaactgggaacatctgaatgctgaggcctagagatcgttcagggtgttgtaactgggaacatctgaatgctgaggcctagagatcgttcagggtgttgtaactgggaacatctgaatgctgaggcttagtccagtgttctctctcccttaccactcctcttccccttccctctataatggcagtacccagggcccggtccatagactactatcgagtgctcctatgtgcatcttagtacgtatcattttcccttgcctttttccttctatcctttcagtggtagcaactgcccttgctaatcaccgtaacctcggctgagaaagaagaggaagcgaaatccaagatgcagctcagttcatcaaagcctagcaggtcccctcagctgccttttcatgcctgccacagactacagtaggacaaaacctgacctggtctttgaagttaagagctaagaaagcttcctatagtagtatctcccatggcacttaccacattctatctggtattacaattatttgtatgcaattaatcactcttagattgtatgttcctggagggcagaatatgcccattcatatttgtatcttcttccttctgctcttggcacctaacacagtgccttgcacacaaacaataaatgattgttgagtgaataagt

SEQ ID NO: 488492 - DNA, 97 bp, Homo sapiens
actgaagacagtgccacttactactgtgccttttcaagggtcgtcatgcgatggggggcctctacggtggtgggtcctggacaccgataaactcact

SEQ ID NO: 488493 - DNA, 137 bp, Homo sapiens
aggtttttcccctcaaagctacattcatccagtcttcacatttagctgattatcttgcctgtctacatcgtggatatctcgaaagagaatccttcagggattaagcctacctacctatccagtctgcgtatcactat

SEQ ID NO: 488494 - DNA, 353 bp, Homo sapiens
ttcagcacgagattgctcgaaactgggccagtcaaagatcagctctgggaagtgcgctagatccacttgctgattactcaccagtatctatatatgtcagctagacctatgcatatcttattccagttgcacttacttacatgatcatttcgagagatgtaacgatgatagctgatgtgaattatgccagataccgtactatgccaacaccacgaacacttgccaagtatatcaatccttgctatgccactgctaggttaacttcattggcagctccagttgtctatgctgacagcatatatcttcagatcctaaggagatatacagctttgcataggatgccatagcttatg

SEQ ID NO: 488495 - DNA, 710 bp, Homo sapiens
  misc_feature (1)..(1): n is a, c, g, or t
  misc_feature (327)..(327): n is a, c, g, or t
  misc_feature (340)..(340): n is a, c, g, or t
  misc_feature (347)..(347): n is a, c, g, or t
  misc_feature (438)..(438): n is a, c, g, or t
  misc_feature (442)..(442): n is a, c, g, or t
  misc_feature (464)..(464): n is a, c, g, or t
  misc_feature (468)..(468): n is a, c, g, or t
  misc_feature (470)..(470): n is a, c, g, or t
  misc_feature (525)..(525): n is a, c, g, or t
  misc_feature (533)..(533): n is a, c, g, or t
  misc_feature (537)..(537): n is a, c, g, or t
  misc_feature (561)..(561): n is a, c, g, or t
  misc_feature (581)..(581): n is a, c, g, or t
  misc_feature (595)..(595): n is a, c, g, or t
  misc_feature (605)..(605): n is a, c, g, or t
  misc_feature (687)..(687): n is a, c, g, or t
ntgatggatttctttccccttctcacaataagatatatctgtttattctcctaaaaatgatgcatttatttatgctacttttataagaacaatccctttgcgatcccaaaacctgggcagagaatgaaaagagataaacagaaccttcttcaaaatggtagttctcacaacagaggtgtagtgcaagatatatataaaatggcagctcttgagaggagtgtgttcacacccagcggggtaggcagctcctagctgcggagtgtggtcagccgggacttcatgggctccagagcctcttcctcctcctcctcatcctctgaggcagcnatcgctcctggangttcttnctctggaagggcattagttactttactgggtgctttgcccaaggtcccttctgttatttcaaagagaattctgttaatttccatttctgcntctncctccatttcttcctgatcgtncatncnttcaaaagttttctctaacatcttctctattatcccagcctttatcatttctttngacaactncctnatggtggcctgaatctctggaatnttcacaagaattttcatggnctttatcacttctnttctcttctncagggaaccagccacttgcaagaacgcgagctggttcttcatccccatgagccctgagttcatgttttctttggatgcatanagcttgctcacagcctttcttga

SEQ ID NO: 488496 - DNA, 103 bp, Homo sapiens
tctggaaaagtttgggtagattgcaggagctttcttttatgtaaatgggataaatacacacaccatacactatccacagatatagccaagagcgactgagagg

SEQ ID NO: 488497 - DNA, 311 bp, Homo sapiens
gcgctgcgacctggggccatgtactccactgtccgcacaaagacaggccttcttctcgggcaatggcctctttgctcagccaaagcagtgaattgatgtgccctcctcatccagaaggatgcctcaggcttgaggctctgtaacgatacccaggctgtcaggtgatccagcccagagccagctcggcaggtaaaacttacatcctcctccggaacatcacctttttgagaccggtgaagaggccccccacgcaggaagccagatgagatgagcttccctcggctggaaggcatatgagcttaccacgatgg

SEQ ID NO: 488498 - DNA, 657 bp, Homo sapiens
cgggctcggtggctcatgcctataatactttgggaggccgaggcaggtggatcaattggggtcaggtgttcgagaccagccaggccagcttggtgaaaccccgtctctactaaaaatacaaaaaaaaaaaagaaaaagattagccggatgtggtggtgcacatttgtagtcccagctactcgggaggctgaggcaggataatcgcttgggcctgggaggcaaggttgcggtgggccgggatcgcaccgctgcactccagcctgggtgtcgggtgaggctcaattctcaaaaaaaaaaaaaaagggggggggggagagctatttccaaaaattttttaagtaggcggggcacgggggcctaaatgcccttgtggtcctacccctttggggaggccgacatgtgggcagatcacgagggccgggaattttgagaaccattcctggccagatggggtgaaaacccccgttctctgctaaaggtccaaacaaatttttctggaaccttgctggcgtgcccctgtggtcccggctgctggggaaggcctaaaggcaggaagagtcgctggacccggggaaggcggaggttgccgtgacctgatgttgtgctagtgcacccagccggggcgacggctgaaaccggtctcaaaaaacaaaagag

SEQ ID NO: 488499 - DNA, 122 bp, Homo sapiens
  misc_feature (59)..(59): n is a, c, g, or t
  misc_feature (73)..(73): n is a, c, g, or t
  misc_feature (79)..(79): n is a, c, g, or t
  misc_feature (84)..(84): n is a, c, g, or t
  misc_feature (91)..(91): n is a, c, g, or t
aagatgatctcctcgcaagaggtgggcaccctgatcaccgcgctgggctgcggcatcgnccgcgaagagtacnacatcnacaantgcgttntcacaacatcatcatcatgaccgatgctgac

SEQ ID NO: 488500 - DNA, 165 bp, Homo sapiens
gtcttattgaaggagcgctcaccgcaacagattgggcatggacaccatttacgagctgctgacccggatggccagcctgggtctcaccctgctcatcttttactactacctatcgccatcgctgggtcatggagttcttcttgctggatcgtcttccccaactgg

SEQ ID NO: 488501 - DNA, 488 bp, Homo sapiens
cacgaggggtcggccagcgtgcgcggcgtgccgtgctgttcaaggtaggcacggctggcgcagttgaactgttcgaagcgcccgagcggcaccgcgatcaggctgtggtcgccgaccgcgcccacgcgcagcacgcagtcgaagccctcgcgcaccagatcgacccgccggtcggtgctgctcacctcgatttccagctgcgggtgacgcgccaggaattccggcaggcgtggaatgaccagatcccgcgcgaacgcgagcggcagatcgacgcgcagccggccccgcagatccgcctgtccgccggcggcaaacagcgcattcagttcgtcgaagtcggcaatcaggtcgcgacagcgctcgtaataggcctggccgtcctgggtgagctgcaccttgcgcgtggtgcgatgaaacagtctcgtaccgagcgcgctctccagctgctgcaccgcattcgacaccgtcgatttgagcagtcccaggtt

SEQ ID NO: 488502 - DNA, 447 bp, Homo sapiens
tcagatatccaaattatatcccagacccaggctatattcgccaaccctaggagggttgacatccacatagatatctcaaaggcaatctcaaacatcaacaagcccaacaatgagctcacgtacttccttccaaacccggtcctgtgccagtcaatgcttacattgtccagccagaacatgaggcattgtccttgggccctctctcttcctcaccccctgaccagtcatcagcatgaactgtgaacttgaactcctaaatctctctcatgtatagtctaagccttcccatctcaggcactgccactaccttagtctcaacaacacaatactttaacctagacaactacagtgtaatcttaattgactatactatgcatcccactcttattctcaaaccaaccttggagccctaagtctacacatagctcttaaattatcttttaaaaa

SEQ ID NO: 488503 - DNA, 964 bp, Homo sapiens
gcagagagtcttcagtgggtctctacaacggaggtgaatccgtgcatcacactagtgagtgtgtacaccgtgacccacccggtgcccacaccccggcctggagcgtgcatcaccaacagtgcccgggaaaggaatatcaactcatccctgacagactcccgagacgccgcgtgactgagagcttcctcaaggtaagccacttcctgatggacagggcgagagtcctgaagcgcaggcatgacctgcatgctgcaagacccacaaggcatcttctaccagcgcgttggctgtacaaccgcgtcccctggaccatgcaaccacacctacgatgtcctcttcctgggcactggctgacaggactcgtggctccaactaaggtcagtagagccgtgaggcccccgtgtgtgcaacatcattgaggagtctgcagtatcttctcgatcgtggacagcctcggtgacatgaatctgctcctgagacacccatcatgggggctgctgtagtgcgtgctctacatctcgggcgtagtccagggtgtcccatggtgcaactgctaggctgtacaggagctgtggggactgcctcctcgcccgggacccctactgtgcttggagcggtccagctgcaagcacgtcagcctctaccagtctcagctggccaccaggtcgtggatccaggaccatcgagggagccagcgccataaggacctttgcagcgcgtctctcggttgtgtccccgctcttttgtaccgacaggggagaaaggcatgtgagcaagttccggttcccagcccaacaccgtggacaactttgggctgcccggtcctctccaacctgggaccgactctggcttcgcaaggggccccggtaatgcctcggctcctggcacgtgcttccacttggggactgttcttggggggcccacagctggggagtccacgctgtctacaggggggtccccctgt

SEQ ID NO: 488504 - DNA, 141 bp, Homo sapiens
tccaggtattaaagctcatcggatcacgacaggcaggtgcgaggtggattatcaggaaggtctggaaggctcgcgtatcgtgatcaagaacctaatgccaccacgacattgtggtatgcgggtcttcgttctcgatctgat

SEQ ID NO: 488505 - DNA, 283 bp, Homo sapiens
  misc_feature (1)..(1): n is a, c, g, or t
  misc_feature (215)..(215): n is a, c, g, or t
ntgtacttgtggtacgggggctcctggtgccgcacggttccctggacgcgacggttctcctggcgcaagggtgccgtggtgcgaccggccgtgaccccctggtgctcctggtgctcctggtgcccctggccccgttggccctgctggccagcgtggtgctcgtggtgacactgacgggcccgggggaccctgacggcccacaccgcactggtacnccttactgcctctgtcgccctgttcgcctgtctcccccttgtaccaccgggggccttggggtccggcg

SEQ ID NO: 488506 - DNA, 266 bp, Homo sapiens
cgttatgcttacaaacgtagaagctaactgcaatcacagacgccctataggaagatggtcaatgcacttatcttctcaggtgaactagacctccataactaccctctcctcatgcacatttttttaacggtttcgcaataggtttatcaacatttctatgtaaaaagtctcccttaacccatttctgtagttcgtctatataaagacagaaagaagacatactggctataacttatgcacatctagaggcccctttccttaaggcc

SEQ ID NO: 488507 - DNA, 185 bp, Homo sapiens
taactgtgacccaactggtcatttactatgttcagcatcgcaatgatcttggtgaaggacacctgtgcacaggtgatgcaacttcacacattaggacatccagctgaagtgaacttaaaaaacaaaacaaaacccctaaatattgcacaattttaaacagcacaaatttggaaattgaaacctta

SEQ ID NO: 488508 - DNA, 410 bp, Homo sapiens
  misc_feature (112)..(112): n is a, c, g, or t
  misc_feature (143)..(143): n is a, c, g, or t
  misc_feature (156)..(156): n is a, c, g, or t
  misc_feature (161)..(161): n is a, c, g, or t
  misc_feature (166)..(166): n is a, c, g, or t
  misc_feature (215)..(215): n is a, c, g, or t
  misc_feature (329)..(329): n is a, c, g, or t
tccaacctccaaaaggggtgctgatgtatgggcccccaggacggggaaagacctcctggcccgggcctgtgcgcacagactaaggcaccttcctaaagctggctggccccantggtgcagatgttcattggagatggtgcaanctagtccgggatnctttncctgncaaggagaaagcgcctctatcatcttcattgatgagttggatgcatcgnccaagcgctttgacagtgagaaggctggggaccgggaagtgcagaggacaatgctggagcttctgaaccagctggatggcttccagccaacacccaagttaaggtaattgcaancacaaacagggtggacatcctggaccccggcctcctccgctcgggccggcttgaccgcaagatagagttcccgatgccaat

SEQ ID NO: 488509 - DNA, 113 bp, Homo sapiens
  misc_feature (89)..(89): n is a, c, g, or t
  misc_feature (111)..(111): n is a, c, g, or t
gcggccgcctactactactactgctcgaattcaagcttctaacgatgtacggggacatgattctccagtatatttgtaaaaaataaaanaaaaacttaaacccatcaaaanaa

SEQ ID NO: 488510 - DNA, 350 bp, Homo sapiens
gccttcactggaggaacagtgatagtgtactactagaatactatagagcatagttagcatcacaaatctagatgacataatgtaataatggatagatcttataaacagtattgagttaataatgttcaaaaattatgtcaattaataacacgggtttgattacacacaaaaaaagttaaacccaagcagacacttgcacacccacgttcatagcagcattattcatgatagacaaaaggtggaaacaacctgaagtgtccactgacagattaatgaacaaaatgtggcatatacatgcaatgaaacatcatttagacctaaaaaggaaagaaattctgacacatggctac

SEQ ID NO: 488511 - DNA, 628 bp, Homo sapiens
tgcagacacagggccctcagacagcttggctggccgccgccggacccgcccctcccgccccggggagaactggagggccgactcataccccgcgcaccacttgggacaacctccctggggcccacccggggccaaaaagggggttttcccgagccacgcgataatgcgctacacatccggcacaggaccactgtggtcccccagcgaggttccttttcgcaacaccccccccgcgattgtcgctgcccccctctggcccccatgtcatgtttccgcgacttgtatcgctccccacatttcttctagtggtttcctcccccaggaaggacctctggggacccccccgcccccgggagacggtgagcattttcgcccccgaccatacaagaatcaattcgggactttccgggggcgccgcccaatctgtcccgcaaacccggtgagtcgccccaatgttgccccgaagaatcaccacaggtttcctccatcgcccccgggcgatccacccgctacattggctttcttggtttcgcgctgctgggattatctcccccccccaacggtggtctacccaacacgttcttacagacgcacccgatattagagaacgcggccccacatagcagac

SEQ ID NO: 488512 - DNA, 156 bp, Homo sapiens
taaaaaaaaataaaaaattagagaacccaggtgtagtggtgcatgcctgtggtcccagctacttggaaggctgagacaggaggattacataagcctgggaggtcaaagttgcaattagacgtgattatgcctgggtgacccagtgaaaccccttca

SEQ ID NO: 488513 - DNA, 139 bp, Homo sapiens
ctcgcctgctgaagggtcctttcttgacagtcaactgatgactaatctggaagaaactgtctattctcttaggagaataaaatattccccacctaatagtcgcagctaccattaacaaaaaagaaagaattagcaaagg

SEQ ID NO: 488514 - DNA, 327 bp, Homo sapiens
cctactactactaaagtcgcggccgcgtcgaccactctgtcgcccaggctggagtgaacctctgcctgccgggctcaagcgatcctcccacctcagcctcccgcatagctgggactacaggtgcacaccaccactcccagctaattttttattttttttgtcaagacagggtttcaccatgttgcccaggctggtctcaaactcctggtctcagacagtccacctgccttggcctcccaaagtgctgggattatagatgtgagccatcacacccagccaggtacaagtttttaatacaagttttctctctagctttgttactggatt

SEQ ID NO: 488515 - DNA, 81 bp, Homo sapiens
ggtgaggacactgccgtgtattactgtgcgagagagactcagtggtaccagctgctaccccttgcttactggggccagggc

SEQ ID NO: 488516 - DNA, 548 bp, Homo sapiens
taaaggcgccgggcacatgatccataggcttaatgggtcacgagggtaaatagcacttcgcttacataggcatgtgatttcagagtatagcgtacgtgagaacattgagatatcagttggaagacaccctgaaatcttatgagtagcataccccaaccaccctctaatagctagcttgtctgtataggtagaatgattcatctctccattttagatggctagatgttttgtggaagatcttagaattgcctgcctcatttgctgggaaaaatcagataggaagtggcctttaggggatacttttacttggaaagttacaacactagtacaagtcttaacacatttaacatttgcttgttgaaaagcaatgcgaaagtcaaataaaattaaacatgttttacttttttcctcacaagaacataaaaattatggaggggaacttaacagggaatttaaaaaaagtaacacaatttttccttttagtagtccttgggtagttatgatagaatagtttccactttttgtttctttgagctgggatttttgtc

SEQ ID NO: 488517 - DNA, 229 bp, Homo sapiens
gggggggctgtcctggttttgctgtcccccaaaagggtgctttgagggtgaggacttttttggaaaggcctggagacctagctccatgttcctcctcctttttccccacttgaaccatgaagtttccaaaaattttttttttttttttcccttcttttttcggttggtttttagataaaaattttgagaaaaaaaatgaaaaaattttaataaaagaagaaaaatggaa

SEQ ID NO: 488518 - DNA, 236 bp, Homo sapiens
accgttccccggaggttaacagccggagaaggggcttaaggagcattccccggattgccagaccaggctcatgtcgcgcctgccgggcggccagtgcagggccggcccaggttgccttccccggctcccccctcgcgggtagcttcacccggcccgcccgcttccccgggcccagaagcccacccctccccagctgtcctgagggcgcccgctgtactggagctttagtcgttgac

SEQ ID NO: 488519 - DNA, 305 bp, Homo sapiens
ccgctctcttactgctagtttgtcacagtttgtcatgaatagatgtgatttgtcaaatcttttttgtatctgtgatcgattttttttttctttagtctcttgacatgatagattacatcaactgattttcaaatgttgaacttgccttgcatacctagaagaatcccacggggtcatacggtataatggttttatgtatggtgggattcaattggctaatattttattgagacatatttttcatctgtgttcatgaggcatagtggtctatggttttcctttctggtaatgtcttggtctggttt

SEQ ID NO: 488520 - DNA, 782 bp, Homo sapiens
agatctctggatccatgaccatccttttccttcagctcagcaaacttgcatgcaatgtgagccgtgtgggatccaggacaggggatagcggcgcataggctggatggcggattccgagatgaacggagatgtgggccagcgtagtacagcatcggagacgcacttcgacgggatgaagctacacgcagtgacggctatgagatgaaagctctacctagagaacaaagtgagggggaaatgacaaaaaatgtggacaaacaaggagagacaagacgaggacaataaagaaggagaaataaaaagaaccacaacaataaaacgacgcagaacaaaagaaaacagacaaaagaggcacacaaaaaagtgcaacatacgcgcagaaaggaaaaacgctaaaagggtacgacaaaagacggaaatagacgtacacacgaacggcgcacgacacggcagccgcctgacaccgacatcaccccagctgacaaaccaagtaccaggaaaacgaagaacacgcagcaaccagcctaggagacaatgagccagcaaatcaacgcacaagacaggaaaaaaaccccacgaacgaagaaacataagaaaacaggcacccaagggatactaggacaccgcacacatggccgagacccacacacggaacacaacacagaaggacccaaatacgaacgaaacaaaacaagcaaagaaaaagagaagacaagcaaagaatggcagaaacaagaaacgacgaaaaaccaacaacgaaacgaaaaaagacggaaaaacaa

SEQ ID NO: 488521 - DNA, 223 bp, Homo sapiens
ttaccgaattacaaagcataagtgcataaggtaggaaactggccacacagcgaggtggctcacaccttaagtcccagtacttagagaggccaaggcaggaggatgcttgagcccaggagttgagaccagcctgggaaacatagggaggacttgtctctaccaagaaaaaaaaaattagttgggcatggtggtgcacaccactgtggtcccagctactatggag

SEQ ID NO: 488522 - DNA, 263 bp, Homo sapiens
aaccacttcctagatgttagtctgccaacccatgtttcttcccaggatacatctctcgtaagtacctgagaaacaaaccggaaacagcaattaaagggagagcaaggaaatggcactacatatacaaagggtatacaattccctgtgcacatgccctctattctttaaggcctaagtacaacaacttataacgaacatgatttcacatgaactatgacacctctctctagtagccattccacaatctcccatttcccccaact

SEQ ID NO: 488523 - DNA, 978 bp, Homo sapiens
  misc_feature (257)..(257): n is a, c, g, or t
  misc_feature (375)..(375): n is a, c, g, or t
tcttattacagcgggggttcaaaacaagtgagtacacttttccggaaaaagttattggaaaatggtttcccaaggtgatagggctttttaagaaagaagatgtttggacaccaatttgatttctagggtatggggtattaaagatgggttatacacagggcaatggctaaagataaaatactggtaaacagcaaaaataatgtgagaagtggcaaaagggaaattggagttatagtagaatccaagagaaaagaggnatataagaggtggggagggtctctgggtgtggccgaggcttgaagaggggagaaatactcatacttgagaagaaaaaagagcaatttccctaactggggcataaaggccataaaaaangcaaaccgctgggtttttcttaattgtctcacatttaattaaatgtgtggagaagacaatctggggtggggacttgtgtgaaagatattaaggggggaatataaaaccacccatgtggtgccaaaaagaagtgtctataatttatgggtgttgaacccttatcttaaaagcgcgggacctcttttctaatatattctgagagagcggccacagaacaagagggggtgggtaaaaacagttttcacatcggggtttggggcccctaaaaattaaaaagctcgggttggttaagaaaaccttttatatgcgggaaagaaggcccctataaaaggcggctcgggaggtgtggtgggcggggggcggcctccaaaacaacatctgtgttgaatatcacccgcgaagggaggcccttatggggggaaagggggtctaaaaaagggggcacagaggaaggaaactccccgtcttgtagaagaaagggcccccacaggaaatttgctcgccagaagaaacaccacacgccccaacgaagagagaaacacacccacaatgttgtgcctcgacaagatggggtcagagtctcataacaaaaccctacgaaag

SEQ ID NO: 488524 - DNA, 172 bp, Homo sapiens
  misc_feature (167)..(167): n is a, c, g, or t
cgtagaggtagacctgtggtctagccagagccagagagatgtccaagtctagcaaaccgagttctccaaggcttatcaagaactgggattagcttgcaagatgaatgagggaggaggtcccatggacttctaagaagatcaacccagagtcttccaactactcactngctaa

SEQ ID NO: 488525 - DNA, 378 bp, Homo sapiens
  misc_feature (35)..(37): n is a, c, g, or t
  misc_feature (85)..(85): n is a, c, g, or t
  misc_feature (107)..(107): n is a, c, g, or t
ctggctttgagcccctcacacccatggattccttnnnacctactagtgccattactgctgtgatgaacaaccccaccagacagcnctttgggccctaaactgttgcnatcacatggctgctgcttgcaggattcttggctgcacggactggttcctgccaggttccagtgcggtatcactgaccccgtgtgagccgctggcaactttagagtacacacagtcatgaccctagaacagcaggacatggtctgctatcacagctcagactctcgtccgaactccttcgtccaacacttgcgttggtgccctcttacggacagatcctttggccaggagggtgatgccagctatcttgcttctgaaatatctactgggatg

SEQ ID NO: 488526 - DNA, 621 bp, Homo sapiens
tagacacttacggatagagtgataggacaactctctaccgagagttaacccatatgttctgccctgtcagaatctaccaagaactgccctagggctcaatcccaagacaatagtgcttcacacagcaagagcgactcctacaaagaccctcagctctgtcatcctgaagggtaacctctcatgcatgaagactgcctgcttctctggctccttctgatttgcaaaagctaaaaggttggttcgattttcattctgcccccttcaccctcccatctgttgtacagaaggctgctttccgtcagctggtggcagaccatgccttgctcattcccgggccctcacaggaaatcctggtgggcacgcagcaaggatttcaagggagaaggcagtaaccgaagtcgaactgtttctaagagtatgcaagtgcccggtgattgacgtgcacaacatcagcatcctgcaattgacatttcaacatcacaggatgatgcgtcaaaagaagaaaagtgagggcctgtgccctcgatttcttctgaaattgtgctgtttgtgaaattcactcgtccacgaagagtctgctaatcactaatgtgaggaactatggttgttggcctatgggca

SEQ ID NO: 488527 - DNA, 374 bp, Homo sapiens
aacacggcttgtaacaaaaataaataggcttttaaacaaaacacggcttgtaacaaaaataaataggcttttaaaggaacacggcttgtaacaaaaataaataggctttaacgaaacacggcttgtaacaaaaatattttaaaaaatagcagtaaacagcctaccaagaaagtcattggtcactatcttcctcctcctgtgcactgaaaccactgaagtcatctccttcggtgtcggagttgaatagcgtcagaattgcatcctcctgcagatctgcccctaagtcactccagctcatttgtcaaagtggttattatacaatactgtattatgtgtctggtcgacgcggccgcgaatttagtagtagtaggcgg

SEQ ID NO: 488528 - DNA, 913 bp, Homo sapiens
ggaggggccaggctctgagctccacaggtctgagctgggagcagtcatgccccaccaagcctgcgtcagggaacttgagtgaggggcgtgtgcaatttgtgacaaggtggccagctggatgcctgggtccagtatttttagcccaaacgagaagtgaaaagtgcccagcggggtgaatcatcatcctggtgaagaacccaagcgcctgaccccagctccgggaagcaggcactggcggagggggcttcaacggagggagtgcgccctcagactcccatgtcttcccttgaagcgttcaggaagcgtcagctcagccttcaggcctgagcaagtgcagggcggagctacagccaggctcagatgttggggtgtgaaagcctcaagtgactcagcctggttggagaactggcccaccagtatcttctgtgccatggttcccacattcgactccatggcctctgtcctggaaccaacgtcttgcaaggaaaagcataggaccatggatacctctgtgattcacgctgagcgcaagtccccacacttgtaaaactgagaagtggccagctgtgtttccctgggaaattctccccttatcttccttgaagtgccgagcatgttgtcaagaaggaaagctgaagcgctgtcctagaggattctcttcaggagccgcagttgcccatactatgattaggtttaacaatccccgatcgtggaagctccttatctagtcatgatatgagttcatccttcgaaatcctggacagactaatttatatgatgtcgcagtgctaaaacatgccggcggccctgaccattgaccaggaggacataagtacactaccgaccctaacaaacgttgacgtccttcggaatagatggatccggtacacagagatctttatttttcttaggc

SEQ ID NO: 488529 - DNA, 330 bp, Homo sapiens
taccactgtgctcctgcctgttttgacagagagagaccctgtctcaaaaacgaatagaaaagaaaagaaaaaaatggtagcggtaagggcagtgagcagagcgtgtgactggctataggggctgcggcaggcggtgaggaggtcgggggcagcagccagcacagtgcctcaccttgatcctgtcaagccgtcgctctatggctcgactgtttctatctagctcctctaacatcttatagggcttgaagcaaagcggtttctcgcggaccacaaagttttcccagcagtcagcaaactctgagagtgtagagggaaaccagctcaggcccc

SEQ ID NO: 488530 - DNA, 574 bp, Homo sapiens
cgagatttatagaacaaatacaactacaccttagcaaagaaatagacagccatgttatactagtggaggacttcaagcatcccactgacagcactagacagatcactgaggcagaaacctaacaaggaaactttggacttcaattggactcttgaacaaatgaacctaatagatgtctatagaatactctatccaacaaccacagaatatacattgtcctcatctgtgcacagaacattctctaagattgaccacatactcagtcataaagcaagtctcaataaattttttaaaaaatgaaattatatcaagtatcttctcagacaacagtagaataaaagcagaaatcaatgccaagaggaactctcaaaaccacacaaatacatggaaactaaacaacagaatcatttttgggtaaacaataaaattaaggcagaaataaaaaaaaattgaaacaaatgaaagtagagacacaatgttgcaaaaactctggaatatagaaaagcagtgttaagaggaaagttatagcactctatacctaccttgaaaagatagaaagatctcaaatttacaa

SEQ ID NO: 488531 - DNA, 953 bp, Homo sapiens
gatatttatgtattgaagtgcattgttctacttcttattataattgttctattgacacagtttattatcctatgtctgcttaacgttggcttttctaaagactgaaggagcattaggttatgcgtattgggtctgcacaacattgcaagataaaagcaacagagaaacagagctgtaccagtacaacatcctccagatgaatgctattccagcagcacaagttatttggaataaatatgtagacagcaattcagaattatgccccagccttgcacaatgtcgggttacttaaaccgaacatctacaacctgacaccaggaagcagccaaatgcataccaaagggcaactccccgtcgtcacagactgcacgaagaccaagaatacttacaactgttgcaataagaaattacggcagatcgtcatgtaaccacctggtgacactatgcactcacagctatccaggcttctaagtccaacacccctttgacgttgtccagcaacgacctcactacggctctcgccctcgggcccccatctcatgcacgggggctccactcaacagcagagcagcaaagcctatgccgagaacccttgttcttatcgtctgaatcggcagccacgacgaaagccccataatctttgccgagcttctgggcaataaactggacttattaaacgacgtgacaacacgggattgttggccaaagaacattggccactctagccacgtgctctcatcttaaaggggaaccaaccccagcacaaggccctgcaaggcccccgcaggtggcaccaaaggagttgggaaaaggcagagatccctaccactggtcaaaacgcagcaatcaaaggacgtaacccacccacacacccaaacagcaagaacggaatcatctccgaaggtggcccatgccctcgaaggaacacagacaccacagcccggcctcgtggt

SEQ ID NO: 488532 - DNA, 115 bp, Homo sapiens
gacagtgggctaccattggtaaaacatatcaatatatcatgtaaaacaatagctcactaaagtcacgccaatctatgctacagcgggctacttttctcggcctttagcattctcc

SEQ ID NO: 488533 - DNA, 283 bp, Homo sapiens
  misc_feature (33)..(33): n is a, c, g, or t
  misc_feature (53)..(53): n is a, c, g, or t
tgaaacttctaaaactactagttttagaagttncaatagctgcttctgctatngaaacttctaaaactcctagttttagaagtttcaatagcagtagagatggggttgctcctgaaggccaggcatggccaccacgtgacgctgttcttagttcactaatgttagccttatttaggacaatagcattatgtatataaaaacagcataatcactaatacttaattgctattgaaacttctaaaactaggtattgaaacttctaaaactagggggtaccgagctc

SEQ ID NO: 488534 - DNA, 970 bp, Homo sapiens
ggactatgagaactcgaacccagtccctgagaatccaaaattcttccgttgccactcgtatcacacccgcattcctaaagataaggtcgagctatagatatagctgatcgggcccataccccgaaaatgttggttgatacccttcccgtactaattaatcaccctgaggcaccgagacgccgctcgatcgtacattctactcgagtactcttgtccaagggcagcgaactcactcagccagacgcctcaagtcatccgacaacttgaattcttcttgaccctggaaggtaggccctagaaaatagaagcagtggctaggcgtgtgtgagtttcccaagatgtcagtaaagcccgaaagagagagagttaaagccccctccgatttcccagcgagaacgtcttgccccaagtcaaaggtatgttcgctacaacgccagaggccaaaccctgcaaagttccaagttagattcgcgttgtcgttaagttaggccttagttcccttcctttccaaaccaaattagtcaccatccttccccgggcaacacaagtggaaaacgcaattaaagcaccaaaagttatgcgttacgccaaagttcgaggacgttatcttccagttcccactttacagttagtagttcactttaagaattggggcgttacattaaaggccgcaagagtttaaaagagaagcgtttaaggaggaaacaattaagagtgccaccgccgcccgttcgtcacccaaccgcttttgtccattggactaggattcctccccaaatggaaacggggatataaaagcccccgaataaagggggcgaaggaacggccgctgtttccctaggaaacgcaagttacacccctgggcgggacacccgttgggacacttgtgccgttttgcgtttacgaagcaatagcagtcggtagcagaattcacgtacaacgacccctgtgaaagggtgccccgcccggc

SEQ ID NO: 488535 - DNA, 287 bp, Homo sapiens
ataattattacattttgactaccacaactcaacggctacatagataaatctaccccttacgagtgcggtttcgaccctatatcccctgtctcgcgtccctttcttcataatattcttcttagtagctattaccttcttattatttgatctagaaattgccctccttttatcccttctatgagccctacaaacaactaatctgccattaatagttatgtcatccttcttattaatcattcatcctaacctctaattcttccctatgagtgactacaaaaaggattaga

SEQ ID NO: 488536 - DNA, 143 bp, Homo sapiens
gttgaatgaactcaattgccaaagtttaagactggggtaaatcaagcttgacttaagtgtgattgttacggttatatccagcctatacgtgctagcagcgtgctcatacgtgcagtcaacttacgtggaaggcgtgatatatt

SEQ ID NO: 488537 - DNA, 500 bp, Homo sapiens
  misc_feature (9)..(9): n is a, c, g, or t
  misc_feature (169)..(169): n is a, c, g, or t
cctgggggngccaacttaaggtttttttccttttccacttttgggtggttccagacccctgggagcaaatggagactgtccaaaaaggccattggtggccccacacttggccacagggaagtgggacagggcatggccaggtggccactcaaaacccctggtttttcantggtgggggccttaaaaccttttttacattaacagtttgcttggaaagccccttgtttttttctttgggtcttgttttttttttccccttagaaattgcatttcctgacagaaggactcaggttgtctgaagtccttgcccagtgcatctcagcccccaaagtgatggttcccctgttcactttacttagcatgtccccaccgagttttttttcccctggatggagaaaaaccaaaccgtggttttccgttaagccctccctgcccctccctttaaccattccccatgggaaatgtcaacaagtatgaataaaaaccccttttgagtggca

SEQ ID NO: 488538 - DNA, 517 bp, Homo sapiens
cacaggaaattccaagggatttaggagttgtatgccaggaaacagggacaaaaaccacatatgtatttcaccatatcacagtacctcatataagtggaattgttcagtttttatccttttgaaaagcagattatcttatttcatttaacataatgtcttcaaggttgaaccatgtgtcagaatgcattctgtcttaatggctgcgtgacattccatattgcatgggtgtgccatagtataattagcaaatttgctattaacggagttttagggtatctcctatcatttgcagttatcagtagtgccacagtagacttttgtctatatgtacagttgtttgtcagatcaattcctaaaagtgaaattgataaaacagggaatatatattcattttaaatatagttattgccagatttccctctaaagaggctgtactaatattattcttccactgacaaaacactgtcaaagcattaaaacaaccttccagcacttacctttagaatatgattttaag

SEQ ID NO: 488539 - DNA, 257 bp, Homo sapiens
gatctgcgtgattagaggatccccgccgcatcttcatggccggcagcaggagatgtctgctggtggagggggtgctggaccgcggcaatcatgcgatgatctttggcggccgcgggacaggcaagacgtcgctggcgcgcgtcttcgccaatgttgccgataatcgcggctatctggtcttctacatggcatgcgagcctgggcaggattttaccagcctgatcgcaccgttcctcgatgccgcccgcgggaacctg

SEQ ID NO: 488540 - DNA, 371 bp, Homo sapiens
tttggtccgtacaaggttgctgcaccctcataccagctggctccctcctgccctcctctgactgttttatccactgactgttaaaatgccgcccatacatatttgggatgcaaaactgaagtcttttaaaagaaataataataataatataagcaacacaaacacatatgacagcaaccttcaagatccttggcacttgggttctcagctttctacggctttggttttactgaaatgttgaatctacttgtctgagggtaaagggaccgctttgtcacaaatgctatagcttccagttggacagttggggcatttcgaggtctagcctttagaaatttcatttttgttttactttttttttccaatttaga

SEQ ID NO: 488541 - DNA, 396 bp, Homo sapiens
attcttgatggtatccctgtaaccactcgagacacgccactatattcggtactgactcatctcattttttgaactagggagtggtctacattcctctagaacgaaccacaatcagtatgtacgtgtagaagctgggattccagcccggtccatccaaaggttcagccatatgtctcttctctggacctctctggaaatgcttctcaactttgatgatggctccagtgacaggcagcagccaccaggactgtgatctccctgggatttaaagtgggaggttaaaccaggctccacgccactgcggaattgtgcaattgtaagtcaagtctcaattgtgagccaagcttctcccagggtcagaggtggagttagaaaggccccatgtgaccctgagca

SEQ ID NO: 488542 - DNA, 708 bp, Homo sapiens
agcgggggcggcggcggtggctgcgcgggcagagcaaggacacggtggatcccactcgcacagcagcgcactcgtgtgcaccgtgcagggtcgcgatgctgcccggtttggcactgctcctgtctggccgcctggacggctcgtgcgctggagtgtacccactgatggtaatgctggcctgctggctgaaccccagattgccatgttctgtggctgcactgaagcatgcacatgactgtccagaatgggaagtgggattcagatccatcagggaccagaaacctgcattgataccagaggaaggcatcctgcagtattgccaaggaagtctaccctgaactgcgtcatcagcaactgtggtagaatgccaagcaaccatggtgaccatccacgaactggtgcaatccggtggccgcaaggcagtgcaagagccatctcccactttgttgattccctacctgctgcttacgtaggtgagatagtaagtgatgcccttctcgattcctgacaaagtgcaacacttcttacacccaggactaggatggcatgttgtgcgaatagtcatcttcatctggcacaccgtcgccaaagagacatgcagtgagaagagtaccaacttgcttgactacgggcatgtgctgacctgcaggaattgacaagttccgaggggtacgagtaatgtgtggtgcccaactgggttgacgacac

SEQ ID NO: 488543 - DNA, 133 bp, Homo sapiens
caagagcagtgtgtggcgacaagccggaaccctggcagcgggactgtcactaccattaagatgagcattgcccagtgcacatcctcccacccaaatcatccgccagatccgccagcaactgagacaagccagg

SEQ ID NO: 488544 - DNA, 184 bp, Homo sapiens
attggatagagacagcagcaaacagaaaactagcacaggcagctacgtgctaattctcatcttacctgaggtgggagtacaatacccctgcgttagttgggaagctgaaacaattctctaaatgctaatactgaaattgtcaggtcggggtaactgtgacagtccggaagcaatggaggcttca

SEQ ID NO: 488545 - DNA, 153 bp, Homo sapiens
gacatttccacgagtcaccacggaagtacctttagaggaggatctgatggatatggcagtgcctcgtggaaaatgtccacgtggacatttccacaagtcacgggttccacatttatgaactctgtatgccatgactcgatggggtaccggagc

SEQ ID NO: 488546 - DNA, 327 bp, Homo sapiens
  misc_feature (105)..(105): n is a, c, g, or t
  misc_feature (121)..(121): n is a, c, g, or t
  misc_feature (239)..(239): n is a, c, g, or t
gataagtaattctggaatcaaagactattggatacatttggcattgggctgagtgtggtggctcatgctgtaatcccagcactttgggaggctgagacaggcggntcatctgaagtcaggngttaaagaccagcctggccaacatggcaaaaccccatctctaccaaaaatacaaaaattaaccatgcgtggtggtacagtctgtcatcccagcagctcttaaggctgaggcacaaganttgcttgaacccgggaggcagaggctgtagtgagccaagatagcaccactgcactccagcctgggagacagagtgagactccgtcttc

SEQ ID NO: 488547 - DNA, 525 bp, Homo sapiens
cccaaacaccgccaggggccagtgaactgctttcagaccctagcaaagggttgaggtgctggcccagtataaaaggagaaggctgggttctcatggatcgaagtgaccttcaagaaccccctggtatgggttcacgcatcccctgaacacgtggtggtgactcggaacccaaaaagctctgcgtacaagtggaaggaaacgctattctcagttatgcccgggccagttttaccaggaggtgctttggggatctccaacagcatcaaattacggcaaacgcccccttagggttcagggcaattaccccttttcccccagaaagcgcaggctggatttccaggaggggcccccgggagtggaaatttccttctggtttgtggaactgtagtttttatggaaggaactgtgccccccctgtacacttggcttccccctgcaactgcagggccgcttttggggcctggacccccatggggaggaaaagtcccccccctttcaaataaaaaaaggtggtgtgagcctgga

SEQ ID NO: 488548 - DNA, 368 bp, Homo sapiens
gaccatcgcgagccagctcgttcccatagggatagattcagcctttcttctgcgcgaacagcgcatcgagcttctgctcgaagctgtggtaatcgatgcgctcgtacagttccatgcgggtctgcatggtgtcgatcacgttttgctgggtgccgtcgcgacggatcgcggtgtagacgttttctgcggccttgttcatggcacggaaggccgacagcgggtacagcaccagggaaacatccacggatttcaactgttcggtggtgtacagcggggtggcgccgaactcagtgatgttggccaggatcggagctttcacccgatcggcgaagatcttgtacatttcgagctcggtgatggcttccggg

SEQ ID NO: 488549 - DNA, 585 bp, Homo sapiens
  misc_feature (246)..(246): n is a, c, g, or t
tgggtccgaatttttgaaaaggttgggggggtttgggggtttattctccgagtttcgaaaggccgcccaagggacgaacaaaaaaaaaaaggacccgtggaaaagttcggccaaaaaagaacaaagacccgaggtgacacaaatctcgcggggaccagaggcacaaaaaaaaaagaggtggctccaagaggcaaagttcgcgggacagaccctcaaataacttatactcttgtggtgtggtgccanaaagagcctccacccttattgtatattaacactctcgtgtgtagaggaaagttctccccaacttatataacacttatatatatcaccccagagcgtgtgtgtgcgctctctctgtagaagagacacgtgaaagaaactctaagagggctctcctgcgggcccgcgggggggacgcctctctctcgggagagctctcctttgtgtagagggcattttctccaaagcgggtttctcaaaagccacaagaagcttccagttatttttcccaccaaagaaatcccaagggggtgggaaaatcctctccagaggtgtggcggggataaaaaaggcatgtgaaaa

SEQ ID NO: 488550 - DNA, 203 bp, Homo sapiens
aggcgttgtcagtgtggaggaatgggtggtttgtattcaactgtcattttatttttacgttgttagaaaatggggaggaagtgtgattgaggtggagtagataaggcgtaggtagaagtagaggtcaaggagggtgatggtggctatgatggtgtggatgatgaggctattgttttttttgtgacttcactgacaacggctgt

SEQ ID NO: 488551 - DNA, 929 bp, Homo sapiens
agggcagccattgatgcaatcacctgaataaaggcatcgcgaatgataaacatacgtccgcaggaatgggaatggaaggcatatggattcggaataaagtaaatatgggaggaatggaggggccctttggtggtggtatggaaaacatgggtcgatttggatctgagatgaacatgggcaggataaatgaaatcctaagtaatgcactgatgagaggagagatcattgcgaagctcggggtggcggtggcggtggagtgaagcgtccctgggatcgagaggatgtggtcctggcgattgactcgcctcggtggtgccggcgatggtgctgcctggtcgctgggcctgggccatggctggatcgcgtgagctccgagatctagcgcgtggtcctggtcttggaccgcatggtctccgtggagcgcatgggctccggggattgtgcgcatgggccctgctggggctcgaccacatggctccagtcattgaagcgcctcgggcagcagcatggagcgcgattggctctgagcgtggagcgcatgggtgtcgcgtttggggttcagcttgagcggcatggccgtgtcccatcgaccgtggtgggtcaaacattgagcgcgatggtcgtctggcgttgaatgcgcatgtggcccgtgtgcaccgagcgcgattgcgccctgagcatgtgggcgcatgtgtgcccgcggggtttttgtagcctgccctggagcgctgtgggcgccgcgactggttctggctggcccccggacctggaagcggatttggcccccgaaccccttggcggggagtgtgctttagcgacattgcgccaataggagttaactgctcgctttagactggtgcaccttcttaggtgtcccgcatggggcggtcggggtttcgcagcatgccactcgttggtcacatacaccc

SEQ ID NO: 488552 - DNA, 525 bp, Homo sapiens
  misc_feature (457)..(457): n is a, c, g, or t
  misc_feature (497)..(497): n is a, c, g, or t
cgaccctaccttctcagacatggtcagaccagatcctcatactcatcccagatcctacctctgcagacatggacagacccagatcctcatactcatgccagatcctacctcctcagacatggggagacacagatcctcataccagggccagatcttacctcttcacacatgacagacccagatcttcatgcctataacagatttctaccatctcagacatggagagacccagatactcatacctgtactagattcctaccttctcagatattgacagactctgatcctcataccagggccagatcctaccttctcagatattgaaagatccagatccttatatctgtgccagatcctacctcctcagacatggacagacccagatcctcatactcatgccagatcctacctcctcagatatggacaggcccagatcctcacacttgtaccagatccnacctgctcagaatagagagatccagatcttcacacttgtnccacatcctacacctgaggcatacaaga

SEQ ID NO: 488553 - DNA, 515 bp, Homo sapiens
  misc_feature (18)..(18): n is a, c, g, or t
  misc_feature (79)..(79): n is a, c, g, or t
  misc_feature (84)..(84): n is a, c, g, or t
  misc_feature (108)..(108): n is a, c, g, or t
  misc_feature (117)..(117): n is a, c, g, or t
  misc_feature (153)..(153): n is a, c, g, or t
  misc_feature (164)..(164): n is a, c, g, or t
  misc_feature (166)..(166): n is a, c, g, or t
  misc_feature (417)..(417): n is a, c, g, or t
aagatgcctgcccgccgntttccctttatcccaccccagagacatcggctgcaacccagcacaccagctgcccggtggnaaacnctgctgcccgagcctgggtggganctgggcctnctgccagttgccccatgctgtgtgctgcgaggatcncagcactgctnancggctggctacacctgcaacgtgaaggctcgatcctgcgagaaggaagtggtctctgcccagcctgccaccttcctggcccctagccctcacgtgggtgtgaaggacgtggagtgtggggaaggacacttctgccatgataaccagacctgctgccgagacaaccgacaggcttgggcctgctgtccctaccgccaggcgtctgttgtgctgatcggcgccactgctgtcctgctggcttccgctgcgcancaaggggtaccaagtgtttgcgcagggaggccccgcgcctgggaacgcccctttgaaggaacccagccttgagaaaagctgctgttaagggaaagtag

SEQ ID NO: 488554 - DNA, 98 bp, Homo sapiens
ggatttgctggtgcagtacaactaggcttaatagggacatgtccctattagctcgaattcgagctcgaattcgagctcgaattcgagccaagcttcta

SEQ ID NO: 488555 - DNA, 1527 bp, Homo sapiens
tctgccatcaaccacagcatttgcaggacagatggcggcatttgtgttccctggagatgacattccatcggctagcttctggtcgctacacaccgtcagcatgatacctgggactggccagtcgaggcaccttgcttgatgccctgatgcggctggagggccggttggcgctgtgccagaaccgcgtggtgtcaccaaggtcgtccagtcgctggcgcctttccttgggcgcatgtttaccctgtgaacgccgtggggtcctccgcttgccttgcttggccctttccttgtcggtcggaccctcctcttgattacttgcgttcgggagctccgcttccgcattgcacggctttgcttggttccaggccttggggcttactgtccttcttagcgccttctgtgccattgaccagcttgcttgacctggcagcgcggggcaaacgcttgctagcacaagccccttgcaaggcgttggtcagagcttgccctttccagtaagacaagcgcctgggatggggattttgcacaagcgactatgcgctccagagcccttttggcgcccctttgatgaagtgacccttggtgcaatggccccccattccccatgggcacaggcgaatagcatagccgggtggtccaatttcccgattccggggggccatactcgatgcgcgcacgcccggcggcggggtttccccatttgccaagggcccggcaaagaacaggtggccagctcgtggggcacggggaaaaaacgcggccagatgcaccaacagagtaacacacggcggaacacggaggcaatcgcgttcgcgggggccccaccccaaggtcttacaacacgggcacgactacaggcctttgggccccaaaggggcgtctttcacaaagcccaatgggccttaaaccggcccacccctgtgggttggcaccgacggcccgcccaatgacatggctgtccaacgtccgggcgccagcgggccccttttataaccccgtgttcccccatttcccgtgccccaagagggggcagcctttctacgcgggggccccattgagggcgccgaacggcgcgtcccctctcgggcgggcgggccccctttgtgttgttgtcgcccaacctgtgcggcgccccaatcatttttgggggccgtttacactactcgtttggctatgttgtcaagccgcaaaacggccgattttggaggggaactagccgcacaggaccccttggtggccccaaaagagaagggggcacaacaaccgttgtggtgggcgccccatagggggagccgctttgctacgcccacagcagtttgggcgcttgtgggagccccattaatgagcacccggtcatctgtggcgcccacctcatcaatcagttgggcgagcagctctgtacgtctgatggagggcacggatctctcccagtacttcatcattacacactctgagcttggatatacgtcaggaacaaccacatcagtcgggcccacaaccaacgctgccgcggctttcacaaaagcg

SEQ ID NO: 488556 - DNA, 146 bp, Homo sapiens
cgacacagtagaagactacatacttccgggggttgagatgatatctatctcattttacgtatggttgcatttctctgatggtcaatgatgttgagcaccttttcaccttttcatatgtgtgtttgacattcgtatatcttctttgg

SEQ ID NO: 488557 - DNA, 256 bp, Homo sapiens
gaggcgggcgggtgactcttcccccttgctctgctgtctcttctccttcctctccttcttgctcctagggttgttctccttgaagggtgcggtttgctatctatttcctgagcagtctcctggattgggtgaggatggctctttattttgtcttgcttttctacacctttctctgtattgtaatagcttagtgaagtgcagttacatacgtcaggcttccttctcttgagatgtcctcattacattgccaggggta

SEQ ID NO: 488558 - DNA, 687 bp, Homo sapiens
gttctgtctgcgctgttacgtattacctacacttctgggtttttttgttcttgtcctcagcctctctttaagagttcttgggccttccttttccctctttctattttaacagttttaattttagaaccatttacattccagtaggtaattcactatgcgctttatatgccttagggcatccaaataaaaaacaatagggtaaacatccccaaaacccacctttaaaaaaaaaaaaaaacccatacagatttccttttgtattaaaaccccgttgttctgggaatagatattttaattaagggttgtatttcccaaacgggtgacattaactccggtgagggataagaatgtgtctgcttatagtaataaccattcagaaacctcttggtgaaaatggcggcctttaattgtacattttcattgaacggggtgcataagtattggtacaggggtctggtaaacgtcttcaaaattggctatgaactctaatggccattggaagctacggatgggcagggctctactctaaaactgctttttagcaatggtttattttccctgattatattctaatgtacttggatgtaatgcggaggagtttaatgtacttgggggatgttccagcttatgtactcttctgacgtcgaaaagtcccctggttgttgcgcctattggtatcagctacgg

SEQ ID NO: 488559 - DNA, 322 bp, Homo sapiens
  misc_feature (115)..(116): n is a, c, g, or t
  misc_feature (135)..(135): n is a, c, g, or t
  misc_feature (137)..(137): n is a, c, g, or t
ctctgcttctgtcacctctgtgtgtccctcagcctcttctaccctgctgggtccttgtgctcctgttgcctccatttcactcacactcacaccttcttcttccatcttaaactcnngttttttcaactttatcgngnaagggctctacttcatctttttttatacaccactgctggtgctcaggaagcccagagcaaaggcatcgacctcctctgcctctcctgccagaaactgggctgaattcccagggcctgagtgaaggggagagaatacaggccggagacgcagcaggccaaggctgcatagctcacagaagggtaaa

SEQ ID NO: 488560 - DNA, 449 bp, Homo sapiens
gataaattacacgatccttcatgttataaaactctcaataaactaagtattgatggaacatagctcaaaatagtaagagccatttatgacaaaaccacagctaatatcatactaaatgggcaaaaaactggaagcattccctcttgtaaaactgtcataagacaaggatgccctctctcaccacccctattcaacagagtattggaacttctagccagggcaatcaggcaagagaaagaaataaagagtattcaagacaaagagatgacgtcaaactgtctctgcagatgacatgttcctgtatctagaaaaccccatcgacccatcctgaaagcttcttgagctgataagcaacttcagcaaagtctcaggatacaaaatcaatgtgcaaaaatcacaggcattcctatacactaatagtagccaaatcatgaatgaactcccattca

SEQ ID NO: 488561 - DNA, 185 bp, Homo sapiens
atgaagtctcactgttaccccggtaattgcattgggtctttacagcacgatcataggaaacgccgcttcaacctactggctcaggggatcttcgctgtctcagcctctcgagtatcctgtatgttgctgatctcccctactgacaaccttggatttgtgcccatcacataagttagaacagtcct

SEQ ID NO: 488562 - DNA, 610 bp, Homo sapiens
  misc_feature (531)..(531): n is a, c, g, or t
gaatatgttcgactttcactggttttataaccattggactccaaactgcaaaataagccatacgaggcagggtttcctggttgtgagacatgtccttggtctatgccaatataaaagccatctccctagctttgtttgtattcaggtaaatgaagtttatcttggaaaaatccaaaaaggcaaaaataaatggattttttttcttgctgctgaacagaagtagggtgaatgggttgggaaagggtacttaaagttggtcgcagagtgatgagagggtgtgtctctctatgtgtgttctcttatcctagtgtgctatccttattatgtgtgtgagaaaacctcaaagatggatatggctactcccttttaaaaaaaaaagctaataatttaagctttctaataaaaaaaaggcttgaaaacctgatttccagaatttttaatctggaaatggttttcgagtttctggtagaactaaaccatttttatcatggacattaaggtttgaacccaaatctatggtatctcttcagncaccattagggaaacaaatttattttacaagtaggctattagaaaaagacctgtattcgtgcatagagtcctcagaaat

SEQ ID NO: 488563 - DNA, 241 bp, Homo sapiens
gggagtgagtgcgagttcagtgccagtgctctatcatagctttatggcatggcccatgatggctgtgtgcatggcctgtgaaggatatgcgtctgagtgcctggcactgaaggtaggatggcgccccgatcagggtctataatgaggcatgatggtatgagatgggcatcagagttgttgctccaaggaaaactgacctttatagagcgctctcctctccttatctgatttcatcctcaga

SEQ ID NO: 488564 - DNA, 285 bp, Homo sapiens
ttaccagatgcactcctgctcccctaataagagacacacacacacacacacacacacacacacacacacacacacacacggcaacataatatttgtgggggatgtggcttccaacttcctcttgcagcaggaaagagtgcttgctcacccttctgtcttgcagagtgtgattgtgggagggagtgggagccttcttctcccccacctgtgcagcttctttctggtcaggggtgagacccccaggaatattatgtgggcgtgtgtgtgtgtgtgtgtgtgtgtgtg

SEQ ID NO: 488565 - DNA, 311 bp, Homo sapiens
  misc_feature (279)..(279): n is a, c, g, or t
ttttggcctctgaataaaaacgtcttcaaaacctgttgccccaaaaactaagaacagagagagtttcccatcccatgtgctcacaggggcgtatctgcttgcgttgactcgctgggctggccggactcctagagttggtgcgtgtgcttctgtgcaaaaagtgcagtcctcttgcccatcactgtgatatctgcaccagcaagggaaagcctcttttcttttctttctttttttttttttgagacgggaacgcaactgttgtctgcctgggcttgagtncagtggcgcgatctcaactcactgcaacctcc

SEQ ID NO: 488566 - DNA, 488 bp, Homo sapiens
  misc_feature (483)..(483): n is a, c, g, or t
ccttccttctactctgttgttagatcctcatgatggcccaaaaaaaggcattctttaacctaaagcatccccatggctcaatctctacccccttcatcaccaaggaaaagccagctcttagtggattaagagttttatactgcagggcttgtcttcactgagagctaaataagggtaaagtaagataaacttaaaaatgagggattgaggcccggcacagtgctcatgcctataatcccagcactttgggaggccgaggcaggcagatcacgaggtcaagagatcgagaccatcctggccaatgtggtgaaaccccgtcactactaaaaatacaaaaattagctgggtttggtggtgcgtgcctgtagtcccagctactcaggaggctgaggcaggagaatggcttgaacccgagtggtagaggttgcagtgagccgagatcgcgccactgcactccagcctgggtgacagagcaagactccnattta

SEQ ID NO: 488567 - DNA, 170 bp, Homo sapiens
  misc_feature (100)..(100): n is a, c, g, or t
atgtatcattgcctaagtcaaagctcattatttgctgtttgttttttttttaagaagaaaaaaactgccctgaattaaatggctgttaacagtaggctcnagcattataccacatagtcatttttcatgtccttgtctaacaggcactgaggttctggttaaaattaaat

SEQ ID NO: 488568 - DNA, 240 bp, Homo sapiens
aaaatttgggcccggggggatggggaaaaggtgttttcttttgggtaaaaaaaaatttggggggaaaaaaaagggggggttttagggaccccccatttgaagggccgggaaaaaaaaaggtttaaatgggggaaacccaggttttaacttttgggtacagggaaaaaaaaaacaggtccccctccgcccccccccccccgggtttgtgtcctttccaaaaaaaagttttttcctggggga

SEQ ID NO: 488569 - DNA, 330 bp, Homo sapiens
ataacacatccaggatgtgaagtaaggtatactgtatctggtcattatctcaggcaagaattgtcagggtgtgacagtgctctgtgtaagggatgcgcctagaggtgctccaccctttctgattaaaatgaggtcgttgggttaaccaggacagctgttttctgaaattgttgccacaaacaactcacgtcaactaagagtagaggatgggagccagatttcgtggagcatgaagcacgatgtgggaaattactctagtgcctgatataggcaacagcaaagatctgggcctgtcactggtgtggtgtgtatgcatgtgagaaggcctcc

SEQ ID NO: 488570 - DNA, 140 bp, Homo sapiens
tctggtggtgggggggggctgtgacggaaacagcaataattacctgaccaaggaggagtgctcaagaaatttgccactgtcacagagaatgccacgggttgaccgtgtgccaccagcaggaatgcagcggattcctccgt

SEQ ID NO: 488571 - DNA, 143 bp, Homo sapiens
attaatgatattattatagatgtgcacgaggcctgtataagtaagatgagtacctgttagggcagataggtgacttctcacagtaccctgtgaggtaccttatcatctcctctccattatgtagggagaacaccaaagcccaa

SEQ ID NO: 488572 - DNA, 735 bp, Homo sapiens
cctgatcagacattagaggatgagcgtgacatggaatgaactgggggaggaatgagtcgcaggaagatcagcggggcacggatcgcactgcgacggtcagcgtacggacaatccagagatcagatgcgaacgatccggagaatcacgagacggtgaacacgatgaacgaaaggtcgtgcaaacgaagagatacaggggcgatccctgaggcagtgaggactggtacatcgaacgcaccacggagcgacctaacgagagtgaccgtaggaacccaagaaacggaagcgcaacgcggagattctgtacttagtggtaatgtacagtgcatggagaagataacactggagtacagagactaagacgctctagaccaagttaaatatttagtgtaaggaattggacaacagtgcatcatttaggcggaaaacagtgggtcactcagagtgtgaaaagaaaatacgggtgaagcccgaagaaaagattcttgtcactaagtgatgtggggcagaagaatgtgagtacgacgaggatacatggacatgtatgaaggaactacatggatagaaggtaaggagtgggagataagaacgcagagtgatattgaccacaaaagttgtatgagatcagattgagtacgtggcgtatgaaaagatgcgtgagaaaggaattgtgcggagaattggacttgataagaggaaagggaaatgtcaattttgattgggactgagaatagaa

SEQ ID NO: 488573 - DNA, 611 bp, Homo sapiens
aagcttgcaccatggcggtaggcgcacgggacagtggtcagtctgcaagctaccacggtgtcggcgtgagccaagggctaagcccagctgaccgggacggccgctgcgtgtccaccttacgggccctaagatactcgaggatccgggccctaagaggaacgcccggtaagactcctctggctggctgcctaaggcccttgctggcctatagactcgtactctcctcgagccggccttaccagtatcgcgtaaagccgccggacgcagcggaaccggggccgctttgcaccagcaagcgcccgtgggcaccagccagccactcgcgtccccgtacagtagagcttgatcctggactgctgcgcggacacgcctggcctaagacttggccttcggtgactgaagggcagagttgcgcttgtaaagttcaagactgtgttaaagcgattacgtacaccttgaatcaaggatcttcgaccttgacctgggaagctggttacctgggatcctgtgcaaggatccaagggtcccaaggaattccaagggaattccccttcaggggaatccctggtccaaggttcccaaaaggttccaaattccgttaaaaaaaaaaa

SEQ ID NO: 488574 - DNA, 895 bp, Homo sapiens
cattccttaagtcctaattgggaaaaaaaaaaaaacaaaaatggaacaatagtcggaaaacctctgggggtgtaaccaattggattggtaaccctacacactattcaataagtagtacgaagggagcttcacacagattccaggtctaatctggcccttcttggggggccataattataaccttaacatggtggtgtacggataacacaggttcatttcctttcaagagaagaattacggttagctgtgcccattgggtgttagaagccagtttctaaatgggttgagaacttgggtgttgcgaatgtgtaatactcctaatttatggagaaagggtgatttaaatatttcctctacattctctaaatccttgagaacatatccaggggtttcgggggccgggataatcgggaatctatggggcggaatcccatcggcaaattgttgtcccccaccagttatttttctaaaaggtggggccccaaattttattgggggcacactttccaacgagcaagagggccatataaacggaagtgggctttcacccagtgggaacacttttagaggtctctatacccaggggagggaacgcattacacctggggctcacaataaccacccttctgggccgtgaaatttcaaacacgcatatttacccagtgtctagggaaagggaaacttttagaatcccctttttgggagctaagcaccgggttcccaaaatctattcttgggagaccccccaagttatctcgctacaagaatccctcattatcataagggggttcagcggtggaattgggaattcgaattaccgtttgcacaattgggtcccgccaaattcacgtagaattcttgggcgcaagttaactcttaagcccttttattccag

SEQ ID NO: 488575 - DNA, 564 bp, Homo sapiens
  misc_feature (19)..(19): n is a, c, g, or t
  misc_feature (218)..(218): n is a, c, g, or t
  misc_feature (245)..(245): n is a, c, g, or t
  misc_feature (262)..(262): n is a, c, g, or t
  misc_feature (311)..(311): n is a, c, g, or t
  misc_feature (355)..(355): n is a, c, g, or t
  misc_feature (382)..(382): n is a, c, g, or t
  misc_feature (409)..(409): n is a, c, g, or t
  misc_feature (415)..(415): n is a, c, g, or t
  misc_feature (431)..(435): n is a, c, g, or t
  misc_feature (438)..(439): n is a, c, g, or t
  misc_feature (442)..(442): n is a, c, g, or t
  misc_feature (446)..(447): n is a, c, g, or t
cagtgcaatctgggcgatngcttcctggtcctcgcctcctccgctgtctccctggagttcttgcaagtcggccaggatgtctcaggctgagtttgagaaagctgcagaggaggttaggcaccttaagaccaagccatcggatgaggagatgctgttcatctatggccactacaaacaagcaactgtgggcgacataaatacagaacggcccgggatgntggacttcacgggcaaggccaagtggnatgcctggaatgagctnaaagggacttccaaggaaaatcccatgaaagcttacattaacaaagtanaagagctaaagaaaaaatacgggatatgagagactggatttggntactgtgccatgtgtttatccctaaantgagacaatgccttgtttttttctaanacccgnggatggtgggaattcnnnnnaannccngttnnaccagctactcaaggttgctcaccatacggctttaacaaattaggggctaaaacgattactgccttcccttgagtagtttttatctgaaatcaattaaaagtgtatttgttcctttt

SEQ ID NO: 488576 - DNA, 296 bp, Homo sapiens
ccgagattgcgccaccgcactccagcctgggcgacagagtaagactccgtctcaaaaaaaaaaaaaaaaaaaaagggggtccctccctccaaaggagcgggaacggaaaatggcccccaccatgtaaagcaaattttggggtttggaaaaaaaagggcccaattttttggttttttggcggaggtgggtttggacctctgggtctcaagaaatcttctggcccaagcttccggaggggggggaattatgggagggacccacttttttggactggagaaaattttggggtaggggga

SEQ ID NO: 488577 - DNA, 247 bp, Homo sapiens
cgttgccctggctgtagtgctcggcacgatctcggctcactgtaacctctgctctcccaggtacaagatagtctcctgccctcgtcctcccgcgtatcgtcggattaccggcatgtgccagcacacctggctaatttagtctttttagtccagacggggtttctccctgttggtcaggctggtcttgaattcctgacctcaggtgatccgactgtcttggactccagcgtgctgggggtccgcgctc

SEQ ID NO: 488578 - DNA, 130 bp, Homo sapiens
ctcggtgctctacggctcccctgtagtcgctcttggttgtgcggttgtgtacacttgctgtaggtctgttgaggatctgcccagtccggcggctgccgtcttccagcctcctgcatcagggtggggatgc

SEQ ID NO: 488579 - DNA, 103 bp, Homo sapiens
actaagctcgggagatcctagtggtggtggttatggctctggtggtggaattggtggatctggtagcagaaggttctacaaacagtcagaagagggctacagt

SEQ ID NO: 488580 - DNA, 689 bp, Homo sapiens
aacaatgtatgtattcttgaaaatggtggctgggtgtggtggctcacgcttgtaatcccagctgttgggaggcggaggtaggtggatcacctaagaccaggtgtgtcacgacctcctgacctcaggtgatctaccctcctcggctcccaaagtgccgggattgcaggcgtgggtcaccgctcccggcctacatatttcaaaacatcatgttgtacatggaaatatctataattttgtgaattaagaataattaattggaggccgggtgcggtgcctcacgcctgtggtcccggcacttgtgggaggccgaggtgggtggatcatgaggtcgggagatttgagaccatcctggatagcacggtgaagccctgtctctattaaagataccaaaaaattagccgggcatggtggcgggggcctgtagtcccagctactcgggaggctgaggcaggagaatggggtgaacctggaggcggagtttgagtggacccaagatgtgcaacatgatctcaagcctgggggaaagagtgagactctatctcaaaaaaggaaaaagtaccctggaactaaaattataataatgaattaggaatcattagatgggacatagttgaagagaagattagtataactggaattaagtcagtagaaaatattcagctgagcacagggagagaagagatagaagc

SEQ ID NO: 488581 - DNA, 325 bp, Homo sapiens
acactcctatgatcagtatcagtaagcatcgatagtacaagcaacgaaatgtgtctacctgtaaatttctgcctgtaaaccaaaaggaatcggacatagtttttttgttgttgtagtatttgtttgtttttgagacggagtttcgctcgttgcccaggctggagtgcaatgctgtgatctcggctcaccatatcctccacctccccggttcaagcgattcttctgcctcagcctggatgtagtatttaaagaaaaaacaaaaaactctttactgagaaatactttaaaagacaaaaatcaccaaaactgatctataggagtggtg

SEQ ID NO: 488582 - DNA, 194 bp, Homo sapiens
ttacgtacacggtattggcaccggaatgaccgctgatgcgtcccagattggcggccgataggtaaatttccggggaagtcggtgtggtcgtggtgcgggcgtccgggtcgagcacaccaaccacggtgagggtaatgggcttcgcaccgtttcgggaggggtcgttgacgatgatcttcgatccgatcccggcg

SEQ ID NO: 488583 - DNA, 625 bp, Homo sapiens
gtcgacacggctgcgagaagattacagaagggcagttctcaaaagaagacatgcaaatggccaaaaagtatatggaaatatgttcaacatcactaatgattaggaaaatgcaaattgaaaccacaatgagatactctacttagaattgttcttactaaaaaagataaaaaacaacaaatgctgatgaggatgtggagaaaagaaaactttcactgttggtgaaagtataaattagaacaactactgtggaaaacagtatgtagatttctcaaaaacctaaaaatagaaccaccacatgatccagcaaaccaagtataaccacaggaaaagaaatcagtatatcaaagagatacttgcacttgcatatttatcacagcactattcatgataacaaagatatggaattaacctaagcatccatcagtggacacagggataaagaaaatgtttatgtacacagtggaatactatttggccataaaaaagagtaaaatgttattgctaacaacatggatggaacttgaggtcattatggtaagtgaaataagcaggcacagaaagacaaataccacatgttctcacttatatgtgggaggtgaggtgaaatgaagataaattggtgaat

SEQ ID NO: 488584 - DNA, 295 bp, Homo sapiens
cccctgggcatgacccaggaccaggccaaacgtctggcgcaaaacagcctggatgcacggttggtcaagccttaatcaccgaccggtctggcgagccgggcaatttccagttgcccggcttcactgacctgcagcgaccgggactcattgatcacactgacccagttcgactgcaaacacagctgcaacagcgcgacccccaacgtaccgcccaggtgcttagcttgttcgctccaatcaaaacaatcgcacacgatcggctgaggcagtgcctgggtaaaaatccccagcgctg

SEQ ID NO: 488585 - DNA, 672 bp, Homo sapiens
ccaaagtgctgggattaaacggtgtgagccactgcacccagcctcttcttagaatttaatatttaaataatgatgaatgtacaacattccattattccagctataagcctctgtctgtctgacaatgaggttaacgacaggttctttagggtgaaaataagattctgtacgtagtcatctactatagctgtacagaaatagcagcagaggaccctgtaaaagaaaagaaaagatataagggacagaacatcatgtttaatgagtgaagaacagagctaataaattattataacaccgtgtaggagcatattatttgaagtcaaataacgaagatggaaggctagtcattaaaaaattatataggttttatacaaggtgtgactgacagggtgtctgcagtataaggtcctagtaaggagataaccattcacctcataggcttccttgtcgccttataagtgtactgataacatgaatgattgattagatgtgatggcattattgacatataggaccttaccagcaaagtagtcgatggttatcacttggatgttagacatacttagaggagtgaattacctgggtgaacaaaatcgtactgggacagtactcctaagacccctgtgtgtgtcccgatgagatcatgactgggattcacagccaagcaagata

SEQ ID NO: 488586 - DNA, 318 bp, Homo sapiens
  misc_feature (7)..(7): n is a, c, g, or t
gaggacncttagcctcaggttgtctgcatgctcaggatccatagaattgtccatgctggcagagagaagtccaacccacagacatgtggccatacggctttgtgtcagagtgagtctgactgtctcctccaggctcctggctcatctttccctgccttcccctgagtctcctctggcttgtcgccatccctgcgtgtctcctcaggctggcgcccatcgccctcagctgggtcttttgatccttgcctagaggaaaaggttcttgatcctcatcccactatgctacgcaagcgtgagacttaacccttactcccgaga

SEQ ID NO: 488587 - DNA, 225 bp, Homo sapiens
  misc_feature (221)..(221): n is a, c, g, or t
tggtttgcagctgctgagattcctcgaacctgctgagctttcgcacacccactcaggagttggggcccagctcccagtttacttgtgtttccgcttgttgcacgcctgtggggctctgccctcgtgcacctacaggctcgtgggttcggactctggctgcagcacactgtgctgttcatacgacgtcttatcaccgagcgttgaaccggttccagtgaatngata

SEQ ID NO: 488588 - DNA, 114 bp, Homo sapiens
atatgatggccagattactctgataccaaatccagaaaaacgatactacaatgaaaactacatggccagtatctctgatgaatactagcaatacacacatactactcacatgca

SEQ ID NO: 488589 - DNA, 306 bp, Homo sapiens
ctctagaggatcttcaaacacgcaatctccctaagcttttggatgccttcctctacattaaaccaagagatatcaggcatttccagctccctcacagtgggccatcttttaatgcatatttcagctaaccaagcaaataaactattagaaccttattttaactccccgagctgcaacattaaatgcagagtccctacttagtgggcccaaatcaataaattcagcctgatccaactctatgttccttcaccattatcccatacccttaatacccattcccatgcctgggcctccacatatgcgggg

SEQ ID NO: 488590 - DNA, 1207 bp, Homo sapiens
cctgcgtcctgccccgcgagcacagagcctcgcctttgcctgatccgccgcccgtccacacccgccgccagctcaccatggatgatgatatctgcctgcgctctgtctgtcgacaactgtgctcctgtgcatgtgcaatggcctgtgcttctgctggtgctgactgatgcccccctgtggcccgtcttccccttccatcgtggtgtgctgcccccagtgccaccacgtggcctgtgactggctgtggcactggagctcacaaggacttcctactgtgtggctgacgaggcccaccagcaacgagacggcactcctcaccctgcaccgtaccccactcgatgcacggcatcgtcaccaactggcgacgacactggccgcaaacatcttgcgcaccacaccttctcacacatgacgctgctgtcgtggcctcccgacgcgagcaccccgctgctgcctgacccgacggccccccctgaccaccccacaggtgcccaccccgccgcactcccacgcactgaccccagcattccactcgtcctccgacgcacccttcaccacatccccacgccctctgtctactgttcgccctactcccaggctgctgcctactcccctgtcaccgccctctgccgccgctccccacttggcctccgccgactggaccttccggtgcccccgccctcaccccacacctggtgcccctcctaccgcacgcggtattgcccctcccccctcgccatccctgccgctcctcgcaccctgcgcttgcgcccgccgccctgccttgcctcacctcctcgccgctcctcccccggcccgccgctcccgcctcccccgcccctcccgcccggcccctcgcgcgtgcctcaccgcccctcgtgccgtcccccgcgcctcccccccacctgccccgctcgccccccccccctgccccccccccccgccgccgccgccccccccgccccccgctcgcaccccaacacccccacccccacccgaccggagcacccccccaaacccctcaacccagagcgccacccacccacacccccatcgcccccccccacgccgccaccgccctccccgcccccgcccgcccaggcaccgccaccccccccccccccccccccccccaccgtctccgctcccccccccccccccccccgccccccgccccccccccccgcccaccacccccccccccccc

SEQ ID NO: 488591 - DNA, 385 bp, Homo sapiens
gcgtcgaccatgtcttgacaatataagctgttaggttttaaaaagtagtgggggccgggctcggtggctcacacctgtaatcccagcactttgggaggctgaggcaggaggatcacttgaagtcaggaatttgagaccagcctggccaacatggtgaaaacccgtctctactaaaaatacaaaattggccaggcatggtggcatgtgcctgtaatcccggctactcaggaggctgaagaagaagaattgcttgaacctgggaggtggaggttgtggtgagccgagatcgcaccgtggcactccagcctcggcaacagagcaagaccccatctctaaaaaaataaatagataaaaagtagtggggaggaaattttacttttttttt

SEQ ID NO: 488592 - DNA, 190 bp, Homo sapiens
cggcacgagggtcaggcttaaaatttgttggaggggagtaaccattatgctcctctcgctctcctcctcgtatgcgccgcgtttcagaggttgcctatcagccttgtgatttatttttatatctgcttcttataaagagagaaatatatatatatatatatatatatatatatatatttctctctttata

SEQ ID NO: 488593 - DNA, 1153 bp, Homo sapiens
agcccatcgcgtacgcgctgaccatgcctgtgaccaactgcagtgaaaccatggtctctactaacaaatacaaaaatcagccaggatgtggtggctgggcacctgtactcccagctactcgggaggctcaggcaggagaatcgcttgaacctgggaggtggaggttgcagagagccaagatcgagccacgttcactccagcctgggcgacagagtgagactccatctcaaaaaaaaaaaaaaaaaaaatagggcggtgggggccatggcaccgagcagaccaagccaactggggaaaacaaagggtggaaggagccccccaagccccaggagtctccaaggggtgcgcagggaccccgcggcactcgccccatgtgcattcccacgccgtgggccacaaacgcgtgaaacccatatctccaacacggaaccaaaaaacacgaagcccctgctccactattcaacagcacaccatccaaaatccgtgaccacccccagcccatcgtaggcacatacgcgctaccccttatccgtggtcatctgcaaatacatccgtgcatccataaacaactttcttctatagacaacacactgggaatacacacacacctgatcgttgggccacataagagagagctccatgggacgcatcgtcccccacgctcaaactgttgcggcagatcccctcgaacgagcaggcccaatcaccagcgcccatgtaagaaccccaggggaagccaaagaaacagcccgccaggcggccacagaaaacacaagagggcctacgaacacagcaggcacccccaaaaccgcgaaggatggaaatcgagcgcacaatacaaggcacgagcaaaaaacacaacgcggaaaagagacgacaacagacgaaacgataaacaaacagcaccagagagcaacccccccgggggacaaaaacacgaggggacgacaaacggcccacgcggcgggagacacccagcacgccacgcatagcacggccgccagaacaacacaaggagagtgtagacagggacggggcccacacgggcaacaagaacaggacagaaacgcatagagcggatagccccagaacgggcgacgtccccaaggaaaacccccgccgacgaacaaggcgtaacgtgagagcaggagat

SEQ ID NO: 488594 - DNA, 622 bp, Homo sapiens
gagagagagagagagagagagagagagagagagagtgagtgtgattatcaacgatccattatggttgaaagtcatcactgagcttactattgcttatcaaatcctaaaccttaaactatgtacctgacaaactctctataatggacctatattatcatagtataaactacattgattctgacacaatctattgttcttcaactgtctatctgatgcacttcacaattataccaagctgatccaaattctcccatctcggatcgatcagtatggatacacgatcacagattctgatactgtacatccagttacggaaagttcacctataaccgtacttgacattgccatccatgcatatcggactactatctgcagcattcatgccgtgcacaactctgaagaggaactgcccattgatgtgccacgctgactgcatacccatgtctgtgagttacatcgaacattatctacacatcatcgtattggtccgaatgtttccggttttgcacagatactggctgtatgggtcatgccatgcttcattatcgcttaatgcccattgacatgatgcacctacctgctactgattatcacgtcttgcacttcacattacctccctgat

SEQ ID NO: 488595 - DNA, 1398 bp, Homo sapiens
tgctcttgaaattgctaatgctcatcggaagccattggtcataatcgccgaagacgttgacggagaagctctaagcacgctggttttgaacaggctaaaagttggtcttcaggttgtggcagtcaaagctccaggatttggggacaataggaagaaccagcttaaagatatggctattgctactggtggtgcagtgtttggagaagaggggttgaatctaaatcttgaagatgttcaagctcatgacttaggaaaagttggggaggtcattgtcaccaaagatgatgccatgcttttgaaaggaaaaggtgacaaagctcacattgaaaaacgtattcaagaaatcactgagcagctagacatcacaactagtgaatatgaaaaagaaaagctgaacgagcgacttgctaaactttcagatggagtagctgtgttgaaggttggaggaacaagtgatgttgaagtgaatgagaaaaaagacagagttactgatgctctcaatgctacaagagcagctgttgaagaaggcattgttctaggagggggctgcgctctgcttcggtgcatcccagccttggattcattaaagcctgctaatgaagaccagaaaataggtatagaaattattaaaagagcacttaaaattcctgcaatgacgattgctaagaatgcaggtgttgaaggatctttgatagttgagaaaattctgcagagttcctcagaagttggttatgacgccatgctggagattttgtgaacatggtggaaaaagggatcattgatccaacaaaggttgtgagaactgccttactggatgctgctggggtggcctccttgctaactacagccgaagctgtagtgacagaaattcctaaagaagagaaggaccctggaatgggtgcaatgggtggcatgggagggggtatgggaggcggcatgttctaactcctagagtagtgctttgcccttatcaatgaactgtgacaggaagctcaaggcaggttcctcaccaataacttcagagaagtcacctggagaaaatgactgaagagaaggctggctgaccactgtaatcatcagttactggtttcctttgacgatatataatggtttactgctgtcattgtccatgcctacagataatttattttgtatttttgaataaagacatttgtacattcctgatgctgggtgcaagagccatataccagtgtcctgctttcaacttaaatcactgaggcatctctactgttctgtgagcatcaggactgtagcgctgtgtcaccacatgagagttcagaagcagcctttctgtggagggtgggaatgattgtgtacaaagtagagaagtatccaattatgtgacaacctttgtgtaataaaattttgtttaaagtt

SEQ ID NO: 488596 - DNA, 202 bp, Homo sapiens
cttcagtagactcagttctgaccaagataagataggaggaagaggaaggccagaggttttatgctgggggctcagagagaagtggacagcagtattgtcggccctcccaggaagaaaagtcccaacgagctggtggatcatctctctaaaggtgccaaagagcatggcagctgtagctttggagcgagtgaccaatcttgca

SEQ ID NO: 488597 - DNA, 1921 bp, Homo sapiens
tgctcttgaaattgctaatgctcatcggaagccattggtcataatcgccgaagacgttgacggagaagctctaagcacgctggttttgaacaggctaaaagttggtcttcaggttgtggcagtcaaagctccaggatttggggacaataggaagaaccagcttaaagatatggctattgctactggtggtgcagtgtttggagaagaggggttgaatctaaatcttgaagatgttcaagctcatgacttaggaaaagttggggaggtcattgtcaccaaagatgatgccatgcttttgaaaggaaaaggtgacaaagctcacattgaaaaacgtattcaagaaatcactgagcagctagacatcacaactagtgaatatgaaaaagaaaagctgaacgagcgacttgctaaactttcagatggagtagctgtgttgaaggttggaggaacaagtgatgttgaagtgaatgagaaaaaagacagagttactgatgctctcaatgctacaagagcagctgttgaagaaggcattgttctaggagggggctgcgctctgcttcggtgcatcccagccttggattcattaaagcctgctaatgaagaccagaaaataggtatagaaattattaaaagagcacttaaaattcctgcaatgacgattgctaagaatgcaggtgttgaaggatctttgatagttgagaaaattctgcagagttcctcagaagttggttatgacgccatgctggagattttgtgaacatggtggaaaaagggatcattgatccaacaaaggttgtgagaactgccttactggatgctgctggggtggcctccttgctaactacagccgaagctgtagtgacagaaattcctaaagaagagaaggaccctggaatgggtgcaatgggtggcatgggagggggtatgggaggcggcatgttctaactcctagagtagtgctttgcccttatcaatgaactgtgacaggaagctcaaggcaggttcctcaccaataacttcagagaagtcacctggagaaaatgactgaagagaaggctggctgaccactgtaatcatcagttactggtttcctttgacgatatataatggtttactgctgtcattgtccatgcctacagataatttattttgtatttttgaataaagacatttgtacattcctgatgctgggtgcaagagccatataccagtgtcctgctttcaacttaaatcactgaggcatctctactgttctgtgagcatcaggactgtagcgctgtgtcaccacatgagagttcagaagcagcctttctgtggagggtgggaatgattgtgtacaaagtagagaagtatccaattatgtgacaacctttgtgtaataaaattttgtttaaagttaaaaaaaaaaaaaaaaaaaaaaaaaaaaaagacaaagaaaaaagagcaaaaaaacacaagaaaaaaaaaaaagaaaaaaagacaagtagaaaggcacagaaaaaccctgtacccatgtagatacatccataaactgataaaaactcaatgtgcatgacagcaaaaaccgatgatacggaaaaacttagggtaacccagccatatacccatagatcgacatagccaatcataaaactggagcattagcaaagaagataacgaccgatgccaccttcttaaactctaagagaagaccttggtaaaggaagaattgtgtgagcagatgcaccgtaaaaacatccataagtatccgatacctaaggtactgtatggtcaaaggggcccaccattaaaaaccgtttcccctagcaaaaactccggaaaagcatagaattgccccgtggttaacaagagtgccgaattacaaaccgtacataaagctgaaagacgattgtggcagaggccctttttgccacaaagggaa

SEQ ID NO: 488598 - DNA, 919 bp, Homo sapiens
cgaacgaccccttctgtgccgtccaatgtcctgcaagcggcggcctgtaatgcacggattttgtgcctaaggaaatgcccttggtaaatccagggtttcccttgcaaaggcacagccaagcgcgcgctttcaatggaaacttttgatttggacccaatggaaatgccttggtcaagtcgcgtcccacggggccttcttggggaacgcagcattctagggacgtcaatgctccggcgcaagggtaaccacgcgaagtcctgtgaaacaacaacgcatcccagtactgctgtccttgtccttcccctgtcccactaggctctgcggctacggcggcttacgatgacactgcttggtccccaggaaggtcaccttgccttcgccctggatgtcccctcgttcaagtggccacgcaggaccttggccagggccacacagcatcgccaaggttatgtagcgcggtctccagccatctcctgcctgcgtccttggctctgctgacctttcagcaggcctgagcagcagactcatgctagggccatcccggcgatgctgcaccttctggctggctccctaccagcgcctgttccctgtacctggcagcttctctcttggccccacagtcacagcactgccacttggtcacaaagacttcagagaaacaattgaggcgtcctgagccttcagcgacctccacacggcctgggatatccagggttcagagggtgtgtgctagatgacagacaagacgggtgggctccaccctactgaggctggtcgatcactgaccgctggattggctaagcttggctcaataccgggtactggcctgacagtgttcagtcacaccaggagcgcatggcagactgcagcgtccagctgatgccttctcattgccgggtaggggttgggagttccccta

SEQ ID NO: 488599 - DNA, 106 bp, Homo sapiens
ccgttctgtcccccggtggggtctgtgccctgcactcgggcccctctgtatttatcgctgctgaactgcaacagtatttatatccacggacaaatccacgtctggg

SEQ ID NO: 488600 - DNA, 423 bp, Homo sapiens
ttagcacattacattaagctaatatgtatgtgtgaattgatccgtcatatgatgtggctgttatttgcccgttagtgatgcagattttcctagcatctaggtcttacaattggcatgttttgcagtggtggtactggttttcctttccatatttagtgcttccttcaggagctcttgtagcgcaggcctggtggtgacaaaatctctcagcatttgcttgtctgtaaaggattttatttctccttcacttatgaagcttagtttggctggatatgaaattctgggttgaaaattcttctctttaagaatgtggaatattggcccccactctcttctggcttgtagagtttctgcagagagatccactgttagtctgatgggcttccctttgtgggtaacctgacctttctctctggctgtcct

SEQ ID NO: 488601 - DNA, 104 bp, Homo sapiens
aattcaagcttctaacgatgtacggggacatgtttctaggggtattcatttgctttctccgttgaaacctgttgttaataaagtttttcactctggcaaaaaaa

SEQ ID NO: 488602 - DNA, 131 bp, Homo sapiens
gtttggtgtctttgtcccctccgccaactatcttctctctgagggggtcccgttctctctgcgtctcttatgctctgtctccctctgtctccgtgtccctctctctctagggtctctgtccccctctctct

SEQ ID NO: 488603 - DNA, 150 bp, Homo sapiens
acatgaaagctaagacagtagaaccagaaaatcagaggcggggagtcttttgcaccattattcttcataaccttgtcacctttgaaacttacctcttgcattgccacctaccggaccaaacttttcattgttcttgttttggaccctacc

SEQ ID NO: 488604 - DNA, 204 bp, Homo sapiens
cgctaaccgtgactacgtgtcgagtagtacatgtgtagtgatgagattagctaatacacgcgccagtcaggccacctcacggtgaaacagaacgatgagctcctagggtctcagagcactgtagcagatcatttcatatggcttccgtggagtgtggcgagtcagctaaatactttgacgccggtggggatagcgataattatg

SEQ ID NO: 488605 - DNA, 810 bp, Homo sapiens
agcggcgtaggaccctccgagctaggtgtgggatataatctgctggtgtgtcgtttgttaagcccattggaagagcacagtatcggggtgggagtgacccgatttcccaggtgccatctgtcacccctttctttgactaggaaagggaattccctgaccccttgcacttccctggtgaggcgatgcctcaccctgcttcggctcatgcacggtgcactgcacccactctcctgcaaccactgtccggcactccccagtgagatgaacctggtaactcagttggaaatgcagaaatcacccatcttctgcgtcactcacactggtagctgtagactggagctgttcctattcggccatcttggctctaccccaaaagcaggattttttaatggctgaatggtattccatttgtgtgtgtgtgtgcgcatatatatcatatatgtgtatatgtgtgtgtgcatatatatcatatatatatgatttagaactatatactctgataatatatacatatcacatatagtgcagtatctgcagataaagaataataatcacagtatcatagagtagagaaacgagaaaacatgaagaacggaggaggagggagaggggcacagggctcaaggacgagagaggagaggaggagaggagcaggcgtgctaggaacgcgaggaggaggacgaagaagagaacgaggcaggaaagaagacgaaacgacacagccacgcaaaaaaccaagagaagagacgacggaggaggcatgagagaagagcgcagacacgagaacgagacgagggaggccggagcagc

SEQ ID NO: 488606 - DNA, 1549 bp, Homo sapiens
  misc_feature (1)..(1): n is a, c, g, or t
ncttcggtatgttgtgtgtccaatcgcgttgtgtgtgctcgtcttccgtagtctcgtgtgttgtctagccgcccgtgcgtcggtgcctttatctgctgttcgcctggtgattgttggcaccccccctgtgcttcatcgacaaaatcttcggttttgtatggcccgcctggtgtttttctgtcttggcggcgcggcgctatgtcctcctcgtgtcccttctgtagagttcttttctgccctgtcccctgggaaggagtgtggctcccccccccccagtttgatcacccccccacccggtgtgggggggagagaaattttgcgtccaaggaaattcctctggcccccaattgtgagaagtttcgtcgtgatatggggagagccctttaagaatatcatttcgggtaaccttcagaactcccggctattgcccggaatgctcccaaagtgcgccgatatttcagttgtctgtcccgcttgttttccccgctgttgggggaaaggccggtgtcttttgcccaaggaaaaagggttttttttggggacaataaatccgcgccacaaggctttctttattggtgaaggaccccctttatatcgctccccctgttaaagacaccgtttcttgtcccccgggggggaaaatttgggttctttgggaaacaccccacggcagcccccttgtggtgggaggaaccccccctgtggaaggccctccctaagaaccccctggaagtcgcccttgtgtgtgcgcgcgtgcctaaggacccacatttgtatctcgggaagcacaagaggccccacccgcgagaaaggaagttcacaccggggggcccgcggccacaagccccaccaggggaaggagggacttaccccacaaaagggtggccgcgggagtttgaaaattgagagtgatcgccgagttgtatacgcccccaccagagcgccacataccacacagaggggcgccccacacacagagaaagagagagccccctcttttgagagagagcccaccctggcgaaggagaaagccaccaccccctcgtgtgcctatattgtggagacgctctggccacctgtggagacggtcacacttctggagaatatatatgagacccgcctgtgatcgcaccacacaaaacttttgtaaacgcaagggccgagactcgggcccccccgctcccccccacgcccacattcggctctctatctgtaatgagacccacagaatgtgtgggtgaatgaccacgaaatcacgcttttgtgtaaagtataatggtatatataatagggctcacatggcacatggtggtccacatgttcaataacccgtcttcaaaacgccttttgcacacttctggggaaaaaaggagtaacacattgaaagggagaattggcacacctatatgggctgggaggccttgccacggaaacccacgctggccccgggagagcgctggcacacttaccctttgtcccctgtcttcaatttttggtgagatgatataaactgggccccgcttttataatataaaatataaatggacca

SEQ ID NO: 488607 - DNA, 603 bp, Homo sapiens
atgccataatttattccatagtataaaaaagtcattcttatgtcacaaaatgccctcttagaagacgatctttttatcttaggtcataactaatcggcactcattcaaccgttggcacctaaaagacagccccacactggacttggccatcagtgctgaaaactatcctgctgacaagatattgacagcatggttcagtactcagaaacacaaattgaggcttttggttcttttaggagtacacaatgacatttgtgtaggcagacgcctccacaaaaatcgataaggtttattcttatatgaatatgcgaccatgggaagtgtactggaagtgttgtgaagcacgaggagattctactacagacaggggctagcaaaccagaaaccgtgtcacacactgtgtcctttcttttatgccccatcatgccagacgggcttggtgtacccactatatattggacccgaatgagctgtgttcagcaacagtcttgacgctaagtgatccccatacctgcttagcaccccagaggaactccgttgaagtttaataaataaggaccagccctctcgtgcccctacgagagctattggcttagtactctc

SEQ ID NO: 488608 - DNA, 312 bp, Homo sapiens
  misc_feature (277)..(277): n is a, c, g, or t
gagaccgtgtctcactccgtcgccccaggccggacaggcgatctcaactcactacaacctccacctccctgggctccagcaattctcctgcctcagcctccagggtagtggggactataggcacgcaccaccatgcccagctaattttgtatttttagtagagatgggttttcaccatgttggccaggctgggctcgaactcctgacctcaggtgatccgcccgcctcggcctcccaaaatgctgggattacaggtataagccaccacgcccagccnaaataaattcatttttaacaatcaaaatgttcttt

SEQ ID NO: 488609 - DNA, 382 bp, Homo sapiens
  misc_feature (306)..(306): n is a, c, g, or t
  misc_feature (357)..(357): n is a, c, g, or t
  misc_feature (367)..(367): n is a, c, g, or t
tggagacagagtctcagctctgtcacccaggctggagtgcagtggcgcaatcttggctcactgcaacctccgcctccagggttcaagcgattctcctgtctcagcctcctgagtagctgggattacaggcacacactaccatgcccagctaatttttgtatttttagtagagacagggtttcaccatgttggccaggctggtctcgaactcctgacctcaggtgatccacccggattggcctcccaaagtgctggggattacaggcatgagccacagcgcccgccctgttctattattttattggnttttttccacaagtatttttgatctgcagttgttgaatgcacagaaggtgnaacctgaaantatgggaggggccaa

SEQ ID NO: 488610 - DNA, 467 bp, Homo sapiens
  misc_feature (262)..(262): n is a, c, g, or t
agtgcccccagaacagtacctgggtgttccccatcctgtgggcatcatgcatcagaacaaacaggccactgagaatgcaaaggaggaagtgaggcgaattctggggctgctggatgcttacttgaagtacgaggacttttctggtgggcgaacgagtgacattggctgacggtcacaggttgtcgtgcagcccatgtagtggctctataagcaggttctagagccattctgttccgccaggcctttccgagatagccaatcngcggttcctcgaccgtgtcattaaccagacgccagttccgggctgtcgttgggggaggtgaaactgtgtgagacgatgggcccagtatgatgctaagacagtttgcatgagaccgcaactagaagggacacaccatggcagacgaagggtgcacgggaagagaagcagaagcccaggctgagcggaagggcggtgaaccaaggcg

SEQ ID NO: 488611 - DNA, 206 bp, Homo sapiens
ctgggtaatgatggagagtatactttttcatgagctgtatagaaggatgacgaatgttatgctgaggtctggacctacatgatgatgttcagtcatcgagcgagtcagccccaaccgaagagccagtgcaagaaaaaccctgtgcctgtaggaaagtgactggaaagtggactccagtagcggacaggatgtggtgagcacagtcc

SEQ ID NO: 488612 - DNA, 772 bp, Homo sapiens
agaagagctaaatcgcgaggctggtcgcgcttatgaagtgccatgagcggcaatttacttctgaattgttctgcaaaatggatcttacaggttacaggtgatctacctggatggattatatatgctttaggacgtgtagaagttaccgcgaaaaaaatggtatacactcacgtaactattacgggtcatattcgccctctggacatgctgaaatgacaaggtctctgtgatgagcagagcatccctgtgaattttccaaaggaatgggtgggctgcaattggaactcactccttagaatttggcacagtgtgggacaactttcttgatggaagccacacgctatatacttaacagggcatctatagaatactctggattgttgttcccttctttgtggggtgacggttcagagcgtgaacttcttgtgttcattggagtacagatatatgaggctttgggagacgtaaaaataatgaagagtagaaggggagagaaatttatttttaattataggcggtggtggaagatattattagaattaatgccaaggggaaaactggtgacatctttaacattacctgggtgtgttccctaacattcaaactgtgcattggcatacccttaggaagtggtaagagtagtacagacctcagaaggcttgctggtaacactgaggtagcgtctcttcatcttatttgcgagcggtcctgtagattggccagtaactgattcatcaatgggaggatttatgccatgctgaccgtgtgtccg

SEQ ID NO: 488613 - DNA, 667 bp, Homo sapiens
gtttcagaagcacatgagggtgtgaaaccagtcggtacctttctgtatggtcatagctgtccaagaagtcggaggataagatatatatactcatcagcactcagagtagacagggaagagagtagatcacacttgggcacaccaggatcacataaagatggtatactgctctgtggatgctcaggccttgtgtacaatgaggctttacaaccttcctgttcgtctgggcgtcgggagttacttcctggctgtaataggataatggaagccagtaaccattgtaatagttatgtaaaggccgaggaaatcacgtgtgctacaaaaagtcatgtagtttcatgtagtgtagcatccttggcatcgtttgccaaaattgttccttctcccttttttttctttcggtgtggcatgagtgtgtatctgtgtaaatatgatgtatatgtgttactccgatatgtaatccatttcactggctgagttggccctagccatgtgttaatataaagtaggcagtggcattcccaatggaaatctctgagaatgacagtggagttgtgcaagcattttacattgccacataatagacttgccattttatggtgacaaacggcacattaggcaagttgaatatgacgttaccttgcagactaaaaggttgacggccgaa

SEQ ID NO: 488614 - DNA, 308 bp, Homo sapiens
ccccaatgtggtattgaaagcaaattaaaaattttaaattagggccaggcacagtggctcatgcctgtaatcccaagtgctttgggaggcagaggtgggaggattgcttgaggccaggagtttgagaccagcctgagatatatagtgagactcctccatctacaaaaataaaaaatggaaaaaattagttgggcatggtggcacatatcgttagtcctaggtactcaggaggctaaggtgggaggattgtttgagcccaggagtttgaggttgcagtacagctatgattatgccactgcatttcagcc

SEQ ID NO: 488615 - DNA, 106 bp, Homo sapiens
aacgcgtttctggacgctcctccagacatttcctacaggacgttccacgtgccctctacacgtgagactacgtcggtgtgtacgtaacgactcgacgacccactag

SEQ ID NO: 488616 - DNA, 150 bp, Homo sapiens
tcataagcagcgaccttgtggcatcgtcagaaggagggatttggtttggcaagaacttgtttacaacattttgcaaatctaaagttgctccaatacaatgactagatcacatggggggtttgggcgggcgccatcttacaatggccgacg

SEQ ID NO: 488617 - DNA, 831 bp, Homo sapiens
ggtggagcggaagatcactccctgaggcagtggcgacagcgggggagggcagaggatggaacatatgaagttctgagcagcttggaagatgatgatagaaacgtggggagacacatcgatctaggaatgaagaaataggatggacagagcaaagattgcgtgagacaggaaaaaacgggaacgagataggaatcaggatctaggtagcaagagaaaggctgttggtccacttggacctggtagagcaatccgccatgtgagttaaaaatctaccagctgtatattggtgtaagcttcctaggagaaggacacgcagctcggtccggtacgccattggagacttccaaacagatggacttactagtaatcaaggcaacttatacgaaaccatgaatattggtcagcacttatgactctctagttggtgaacgcaaggttccttggtagcgtgtataattaagtcgaaccattggttaaccgtcccctgggaaggcaaacccgctgaaaccgagggggtccaaacaaggtctcgtaacatataccgagttcctaccttttcaaaagaggaaaagggtaaatgtgaacaaacccctcaatagctaaggggaatgtgaattgacttgccaaacattggagacatactagtctggttgtgtaaagggtagggattaattgcagggtctggcggggaaatggagggatttggtgtccttcgctcaggtattggccttgggtgaagaaagacttgctaatgattgggggtacatttgactttgaggaggaaaacaggttttgacttgggattggggagacggagaagaataatgaggg

SEQ ID NO: 488618 - DNA, 205 bp, Homo sapiens
  misc_feature (43)..(43): n is a, c, g, or t
  misc_feature (111)..(111): n is a, c, g, or t
  misc_feature (144)..(144): n is a, c, g, or t
  misc_feature (174)..(174): n is a, c, g, or t
  misc_feature (193)..(193): n is a, c, g, or t
aggacgtgcccgactggaaggtgggggagtcttgttccacacnaaccgctggtgcccccttgatcggggagctgtacgggtgcgcaccacagaggaggctctccatgccancacggcttcatgtggtacacgtaggcccctttnctccggccacctggatccctgccccgtccnactgggacggaataacatntctgcagacctg

SEQ ID NO: 488619 - DNA, 335 bp, Homo sapiens
  misc_feature (8)..(8): n is a, c, g, or t
  misc_feature (44)..(44): n is a, c, g, or t
  misc_feature (76)..(76): n is a, c, g, or t
  misc_feature (93)..(93): n is a, c, g, or t
  misc_feature (137)..(137): n is a, c, g, or t
  misc_feature (319)..(319): n is a, c, g, or t
  misc_feature (321)..(321): n is a, c, g, or t
  misc_feature (325)..(326): n is a, c, g, or t
atccgccnctggcctccccaaagtgcctggcattagagccggtncccacctgtgcccggccgtcagtccggtattnggaaaagaatttaagancttttaataaatcagcaaaaatatcatgcatttaaaatgtttcnggaagaaatggacaaattcttttgatgaggtgtcaagaaaatagtagattccattaaataaacactttgattagaactgtgaaaacaggtttgtgtgtaaggcatttcaaaagtgaaaactagtcatcatatgacaactaggatcatggaattgtgggctatttttaaaagtgttactgttnanaagnnctataatta

SEQ ID NO: 488620 - DNA, 100 bp, Homo sapiens
atcatatctacctgaaggggtgaaggctgtggaccacaagactggacgggagatccacttacacatttgaggaccgaatcaactattgccgtgtatccca

SEQ ID NO: 488621 - DNA, 113 bp, Homo sapiens
tgtgctgtcgatactgcatcaaagtcccagcatttagatggtccacatagagctgcttctgcgtaaatcctgcttagtttaagcgctaaaaagccattaatttgatgggcata

SEQ ID NO: 488622 - DNA, 760 bp, Homo sapiens
gactagttctagatcgcgagcggccgcccttttcattatttgttatatctgctagcctattaaagacaaataactgggacgctcgtggacaaaccgtgagtattatttctttatgaccgagttatatctgtgaagtgtgcgaggctctaagcgtttatatgtggagacactagacaatacatgggctatctgggcaacattgtggacccggacgtgccttcaacaacaattcaactgtgtactaccagggacccttatagaagaaccgtgtcacacagtggtatatattggtggcgttgaggacagcaattctcccacaggtacctattacgaaatggtgcatcaacgccatgcctggaccacacatggttgaaacccacatctggactacaacatacaccacagcaatatagcgcgtggaccaataggcggcggagctaagcggccacgtgaaaaaattcccccagagagaacacttgcgagaacggctagaacgagccaagggcagcacactcggcaataagaaaacccccgggcaagcgcgaacgagatcagcagcgcaggaaagccaaacagaaaatacacggaccccaacgcgaataccctcacccgcacccgtgggccaccaacacaccgccgcaggaaactcccccacaacttacaaaaacaacacacagagggcaaacgggtgaaataagaaaggcacacactgcaaactcaatcgccagagcggcacacacagcaacaaactcagcagaaa

SEQ ID NO: 488623 - DNA, 1578 bp, Homo sapiens
tgggggcccggggggcctcatcctctctctcttttaaaaaaaaccccgacgccccccaaaaaagtggtgtccccccacaaaaatattttctctctccacaaagagggtctctttgtgtccacacaaaaaaatatgtggaaaatatatatttctttctcccacaaaaataaaaagaggggagggtgggggagtgtgttcacacaccgcgctggaaagagtgtgtgtcccagagatgtgtgttgtgtgtctctctctctgcgctgtgtgttattatatatatatatatgagaggagagagatatatatttttctctctctctctctctcacccgcgcgcgcccgagagagagagagacacacatgtgtgtgtgtgtgtgtgtgtgagaaatgagagaggagaccagagatatatatatatgatgtatcacaagagatgatgtgtgtgatatatgtgtgctctcgagagaagatgaggcgcgctgctgtgcgccactctctcgcgcgcgcgcgcgcgtgtgttatagatgtgtgtgtgctgtgtgtgtgtcgcgcggtgtgtgtatatgtgtgatgatgatgatgtgtatatatatatagcgcgcgcgctgtgtctcccgcgcgcgcgcgcgtgtgcggtgggtggtgtgtgtgagggtatatatctctccacgagaagcatcgcgcgtgtgatgtgtgtgtgtgtgtctataaaacatgttttgtgtgtgtagtgtgtgtgtctccctcccacgtgtgtggaagacaaaatgaggggtaggtgagtgtctgtgatgtgataagtgtctctctctatatatacgagatgtgtgtgggtcaacaaaggtgtgttgcacacccctctgtgtgtctcagtgatggtgtgtagagtatatctctaagaaagagatggtgtcggagccccacataaataataaatgaggttggtcgcgccgcgctgtctcctggtaagtgcgggggtaacataaatcgccgccctcttttgtgagagggagaacaaacgaggcagaaaaaatattattgcgcgtgtgaatgattgttctgtctttgtgttttttctcacacaagaaacccataggttcatgcctgcggagtgattctagcgcacacatgatgggtggtatgtcatccatccgcgcctatgagttagtaactctccgccccgagacctatgttgtgtggtgggacacacccgcactatgggaggtgcgggggcggtcagaaaatctatttagtcggcgggcgggcgcccgcacagacagatcaacagacacgagaaaacagaccccgcgtccgtgtagggcgagccacaaacaggggaagagaagacacccccccgccgttgtatctcttattccaaacaaagaacagcacacacagaagacgcacatgcggtggcggctgaggagtggtgtggtggagcccaccaccgccggggggtgtggtccgcgccgccggtgtgcatgctgcggacgacgggatttagttgaggagaggcacgaaaaacactaactgatgagccccgggggaaggggtgagatgagggagagtcaagcagca

SEQ ID NO: 488624 - DNA, 103 bp, Homo sapiens
tgatatctttacttccaacagtaccgccagttgacaggaaacttgccatggctgttcttggttgtggctgttgtctaacagctggtgcagtatctggtgatgt

SEQ ID NO: 488625 - DNA, 385 bp, Homo sapiens
tagctgttctcatctatggccctttgctcgtgggggggagacaatacttgcaagccaggatgtcaggatggtcagcgaaagggcagtggggtaggccagagcattgctccggaaaccgtgtgtacttatcctggatgatgccagcagtgccctggatgcaaacagccagttacaggtgaggcagtcatcttcttaatggctcatatcccacccaatcttgcttcttttatacatcttctgttagttttcactaacatcatcaattatacaaaccagtccttgggggaggccatcacccagaaaatcctgtgcatgtggcagggtaggagtttctatatttccctgtttttcttctggggtaagacatcatgctcatcacgcggat

SEQ ID NO: 488626 - DNA, 175 bp, Homo sapiens
aaatagcgtcctcccaaaggatgatccctgtagccctcatctaataactgctcaaaaatcatcctccatctgatattaccaagggaactgtctactatggatgacatcttcatctaagtcctgagctgagctgaaggccagcagggccactgacagcagaatcagaagcatcttg

SEQ ID NO: 488627 - DNA, 110 bp, Homo sapiens
tagaggatcccggcatagcatcatgcctggcttgactacaaatatattaataaacattaacctaaatcctgtcagaaattgtcctcttccattccctgatggcatcccta

SEQ ID NO: 488628 - DNA, 331 bp, Homo sapiens
  misc_feature (302)..(302): n is a, c, g, or t
atataggaaaaaaagcccagatttaggtaatgagtggatgagtaaatggtggaggatgggagtccaaatccgaattatagaagaagtatttcccgtaactatagaaagaattatggatatatacatgccgaaatatatatgggtggggggatctgtggatggaaatatggatatctcttcccaaataaatccatagtgggcttattcagaacataaatatggattcagcttgtcttcaaaaacggcccagcagaaaatgttttatattttataaatcatcttttggctctggatttaaattntatgatactgaaaataaaggccttttgga

SEQ ID NO: 488629 - DNA, 672 bp, Homo sapiens
  misc_feature (299)..(299): n is a, c, g, or t
  misc_feature (304)..(304): n is a, c, g, or t
  misc_feature (445)..(446): n is a, c, g, or t
  misc_feature (540)..(540): n is a, c, g, or t
caggccaactacagatgctggccagatatctggagatgaattgtgcggttcggcgtgattaatagaccccacagcatgctgctcttgcctatggctctatacaagagtcagaagtacaagagtcagtggtctgtagtatgaatattgaggtggatggtaacgtgtttgcatatttcttatcactgggagaattctggaagaggcagtattgtgagcgtgagacatccgacaaagtggcggatatctttctataggtgggagaagactttgtaacaggccgtgctacgaggacattgtgnaaggnaggttcaaggagagcaggacaggggctagatggtgactagaagatgaacatgggcacttcagcagggtacgggagaggcgtgcctgaatagaggtctaaatcgtgaacgtctctctcatcatgtgtcgagactgaggatcnnaattatgtccctatcatggacagagtgcgattccgttctggtacgccagagcgattatggaatatgaatagttggacccgatggctcgaatttngaagggcattgtacagctggatctaatgcagagaggaacgtatcgtgtgccatgggcaaaagaggctatgcaagagtgcgagaaggtcagggaagagtggacatcagggagaagtgattgctagtggggtgt

SEQ ID NO: 488630 - DNA, 325 bp, Homo sapiens
aaaaatatccgcaggggtcggattagacccggggttgcttgttccgtttttccagccccgaaaaatgaatttatccctgaagggaatggccttgggcttgttttcaattcaacgggttttgtttcgccagccccccccgtttaaaaccagggtttccgggaatttttgggtgggttttttgttttttaaaaagggactgtttcgccgggttatgaattagattttaaggtttcctgggttccgaaaaaaaatgcccgatgcccctttagacccccttgtggttttttaatgatgccattaaagacctttttttttgggccctcca

SEQ ID NO: 488631 - DNA, 130 bp, Homo sapiens
gctcgtgccgaatccttcactacctattctgacaaccagcctggtgtgcttgattgcacggttttatgacggcgagcgtgccattggcaacggataacaacctgcttgcgaagtttgacctcacacgcat

SEQ ID NO: 488632 - DNA, 129 bp, Homo sapiens
gacaaaaaatgatggaagtagtctaaaagccacaataatgtatgctttggtgtaaactatttattcttacactaaatagtttacaccaaagcatacattattgtgcttttagactacttcatcattttt

SEQ ID NO: 488633 - DNA, 535 bp, Homo sapiens
  misc_feature (21)..(21): n is a, c, g, or t
  misc_feature (42)..(42): n is a, c, g, or t
  misc_feature (132)..(132): n is a, c, g, or t
  misc_feature (279)..(279): n is a, c, g, or t
ccgaaggtgaccctttcaccnaacctgattaattggcaagantttaaatttttccccggggaggaatcctcccgggtgaattcccaaaatgtgaggaaaacttaagcaaagactcagcaaaacctaactacnggacctaaaatatagattggcgcgtagtatataggcccatattcccatatgaataagtttagccttcataaaaatggaaggtgcaggctgacattacattctgtacttactgagtgccgacagccctcacaaacagggaatgtactntggtctcccaatggtcagacggtgttttgaatgtaatcatgttatgttattcatgtgttcaatccattgatgaagagcctttatatccagtagatctacggcaataatgttcatactgatcagaagtacatttgcatagagcagagttttaaaatgaatgtaaatagcgccaaacgatttctttctgccccctgaacagacagatttcttcctgtcaactaacataaacgaacaaatgatagtgccaaaaaaaaaa

SEQ ID NO: 488634 - DNA, 663 bp, Homo sapiens
agccaagatcgcatcactgcactccagcctgggcgagagagaaagactctgtcaaaaaaaagaaaaaaaattaaatttgtaacttatccaaatgtttcctataacatcctatttaggaaagtatagataataactgaaaaagtaagaagatatagttgaggaggcagagcctgaagcaatttgtcgtggcaaaaagtactagaatcgacgtgtagtgaatgggaacagtggacatatttcctgcaagtggcacgggatttacagatgctgacaatacttgggaaccctgaagaacaatttagattgtccagaaattgactttgaagcgtttcttaactctcagaaaagctggcaaagaaacaacgcatggtacacaacccgaaaatctttatctgacagtgaatctgatgacagcaaatcaaagacagaaaagagatgctatgaggaaacgagattgactacaaatcgggttttcgacatatacatcaccattgctcaaacacgaagcagttttggccatggcacggtggctcgcacctataatcccagcaccttgggaaagccaaagcgtggaacatcgcttgagcccaggagttcggatggccatgtttgggcaacataggtgagacccgatctctacaagtgacacacgagaagagattc

SEQ ID NO: 488635 - DNA, 229 bp, Homo sapiens
ggacctggggaaccgaacaccgggaacctgccttccccttccagcccgggagcatcacagaggtgtgcatcacctttgaccaggctgacctgaccatcaagctgccagacggacatgaattcaagttccccaaccgcctcaacatggaggccatcaactacatggcggcggatggagacttcaagattaaagtgcgtggcctttgagtgaagccagccagcctgtagcc

SEQ ID NO: 488636 - DNA, 217 bp, Homo sapiens
  misc_feature (181)..(181): n is a, c, g, or t
ctctagaggatcctccagtgctacctccacaaacagttacaaatagtagaattaataaaacacaatgtggccggggcgtggtggctcacacctgtaatcccagcactttgggagtccgaggtgggcggatcacgaggtcaggagatcgagaccatcctggctaacacaggtgaaaccgcgntctctagctaaaaatacaaagaaaaaaagaaaaaaa

SEQ ID NO: 488637 - DNA, 193 bp, Homo sapiens
gcacgtaccaacgcagatccaggaaaactttgaagccttcatgaaggcaatcggtctgccgagatgagctcatccagatagggtgaaggatatcaagggggtgtcggaaatcgtgcagaatgggatgcacttcaagtacaccactcaccgctgggtccaaagtgatccaaaacgaactcactgtgggggaggg

SEQ ID NO: 488638 - DNA, 474 bp, Homo sapiens
aacttgggaggcggaggttacgatgagccaagattgcaccattgcactccagcctgggcgacaagactgaaactctatctctaaataaataaatgaataaataaataaaatgtggggtataaacccaatggaatactactcaggcattacgaaaagaaatcatgtcttttgtagcaacatggatggaactggaggctgttatcttaagtgagacaagtcagacacagacagataccacatactcccatttataggtggaagctaaacagtgtgtacacatggacatagagtgtggaatgataaacactggagactctaaaggacgcgggagggagggacatggatgataagaggttacttaatgggtacgatgtatattatttgagtaacagatatcttaaaagcgcagacttcacaaaattacacctgtaatttatgcgaattttcaattttttaaaattacattttcccttt

SEQ ID NO: 488639 - DNA, 85 bp, Homo sapiens
cccccctcctattcccttccccccaccccaacagcccccacctcgggtgtaagcgacaggaagaaataataataatttaagattc

SEQ ID NO: 488640 - DNA, 262 bp, Homo sapiens
ctcggagggcacagagatgctactgaaatcagcgtttggaatttttggaaagcgcatgagcggagtccggagagagaatctgaactttcagctgtaaccgggttaaaaccaaaatgctcagcccaggacgtttccatctcagactggctggccaggaattgcctacacactagtacctctgaccttagcagcggagaaagcggagatccccaggcagagaacccaaggacacgagaaatagccacgaccgacacacctttgg

SEQ ID NO: 488641 - DNA, 765 bp, Homo sapiens
  misc_feature (636)..(636): n is a, c, g, or t
taaaagcttttaaataaaataaacaaataaattttctaaacggtataggctacggggacaaggggtagaagctaaagggccagtcttcccggctcaggccctcaagtcccctttagaagagacccgtgctcggggacgtggtatgggggcataggacgtgcttgactggggagaggcggggaagttgaacccggaagtggggtgactcgtgggctctgtgacagccataccctcttggatgggtgataggggaggagagaagaggctcaaagaaagcaagaccctgcaagaggcatcccagtgacccccaaaagtgactggcggtaaggggagcgctatcctaaaaggagggggtggacacggagggggcagtgaacgcagggcggtgagcatggccaggtggggggctacgagccgaggtatcatacctgtggccatctcactctcggacgtagaacccggtgtgcacacaacggttatccgacgtatatggtcaggatcagtcccccttcgtgtcgtcagttctctggtcccgaggtctgtggggccccttcttcccttccaggaagctttcttgttccacaggacgctttgtgattgtctcacttctcccctttttcaccggggttgttacgnggggccccatcaccagtgttggtccctaattctccccacttggatttactctctgtgggcgcccgggtgagaggttcggttacaagtgtcccccctggggattcccctggggtgagctgcacgagtgcc

SEQ ID NO: 488642 - DNA, 123 bp, Homo sapiens
cgtcgtcgttatagaggatccccactacttggtctagggggagccgagattgcgcattgactccagccgggcacaagagcaaactcagtcttaagaaacacaatatagtgccaggcatggtgg

SEQ ID NO: 488643 - DNA, 138 bp, Homo sapiens
ctaatggtaacaggcaccatgtcagacttccagtgtatgtaatgaacgatgtcaatgccaccaaagtatcaccacgactgccactcttggtcatctggcgctgatggtagacagacgaagaggtcctgagaaaccagg

SEQ ID NO: 488644 - DNA, 649 bp, Homo sapiens
ttccgcagcctcctttgccctgtgacctgcaggtactggactggtccctagcagaggataccgtggacgctcctgaagccgctgagatggatgggtcttccatgatactgaagggagagccactatgttgatgcccaggaccagctgcctccttggtctgaacaggcctgatcgaggccaggattggctatgagagctgggaaatgggaccatctttgaagccatgggagagggtgatgagcctagcatcactcatgttcttgaatgggtaacttgcctggacgaccctgtacacgagagaaggatgccttgagagcgaggacacgtgaggaaggctgagccatcccgggaactatgggctaggatgaggccaagccatggagtactgacacccaccagcatagaagtcaccattcaggcattttggacttttctgtggagatcctggtccccgagatcgaaacccttactcgctagtgggtgtatcccagcaggtacgatggtgcttggcagatccaccagctggttcatggtaccactgaatacccattgtcaccaccatcacttctcactgaacctgggtggcagcacaactggaccacgtctcagaagctgcgcagcatggcatggctgaaggcgggtaagcatc

SEQ ID NO: 488645 - DNA, 241 bp, Homo sapiens
  misc_feature (54)..(54): n is a, c, g, or t
  misc_feature (189)..(189): n is a, c, g, or t
  misc_feature (209)..(209): n is a, c, g, or t
  misc_feature (226)..(226): n is a, c, g, or t
caagagaaatatagaccaaaaactataccacaaaccacttcatcatcaaagatncctattttctcattgaaaacctttatcagtgaatagaaccagtatctatcatttactcctttttgactgtcatttacctctgagcaatgaatttccccataaataaatttttaagcacaggcttaaaacctgagnagcactgtaaaaagtaaccnatatgtctgtgataatntttaataagcagatg

SEQ ID NO: 488646 - DNA, 1547 bp, Homo sapiens
tgctggctgctcgccgtcccgagctcccgacgctcagacgcgcctctgagcacggggagaggggacccgggaggaggtcggggagggagtcgtggaagaggtgctctttgagctgaacctggaagaccccggcacaggggatccctgggcagactcccggaggctgcactggcaggaccccctgaaggcctcagctctggcttgccctggagctcagggcctacggacgacgagggacgaggagcccgtgtctctcggatggagtgcgggggggctggcaccagcacccttcttgctgtgcccctggggtggagagcttggggcttccttggtcgcacccaccacctgcctgcccactggtcagccttcagggaccctgagcaccgcctggtctctttcctgtggccagcccctgggaggctgtggcgtgctgggtgtcggcatctggctggccgccacacaggggagcttcgccacgctgtcctcttccttcccgtccctgtcggctgccaacctgctcatcatcaccggcgcctttgtcatggccatcggcttcgtgggctgcctgggtgccatcaaggagaacaagtgcctcctgctcactttcttcctgctgctgctgctggtgttcctgctggaggccaccatcgccatcctcttcttcgcctacacggacaagattgacaggtatgcccagcaagacctgaagaaaggcttgcacctgtacggcacgcagggcaacgtgggcctcaccaacgcctggagcatcatccagaccgacttccgctgctgtggcgtctccaactacactgactggttcgaggtgtacaacgccacgcgggtacctgactcctgctgcttggagttcagtgagagctgtgggctgcacgcccccggcacctggtggaaggcgccgtgctacgagacggtgaaggtgtggcttcaggagaacctgctggctgtgggcatctttgggctgtgcacggcgctggtgcagatcctgggcctgaccttcgccatgaccatgtactgccaagtggtcaaggcagacacctactgcgcgtaggccgcccaccgcccgcttctctgccaaaaggacgcccacggggagatggccgcacccacagctgcctttcccaccaccagcctcggtgctctgccccatgctgggaggagggagggagggacaggtgcctggagcccccggaaccctgtttctggaaggccctggctcaggtggcttcagggcctccggaccccccctgggaggggtggccacgtgctggctgcggaacccagggcaggggtgggaggggcctccagcactttttatatttacgtattctccaaagcagtgttcacacgggagccagcctgtggcccccagcctcctggaaaacaggttggcgctggaggagccgggtcttggcatcctggaggtggccccactggtcctggtgctccaggcggggccgtggacccctcacctacattccatagtgggcccgtggggctcctggtgcatcttaataaagtgtgagcagcaa

SEQ ID NO: 488647 - DNA, 188 bp, Homo sapiens
gagcgagcctgatctatgcgaataggctgcgtctgatggaacgtctcatgtcattgcaatatcactaggcgagacttgataagactcattatgactagtactccgcagactccttcctgtcgttattccggtggcgaattctgacagatagctgtgtcagtcccgttacattttataatagaaaagct

SEQ ID NO: 488648 - DNA, 430 bp, Homo sapiens
ccgcttgacgtttgccgtgacgcagtcgaactaatccggcgtgcgcgcgaaagcgtagcgcaggtagcgggcgagcttcaggctttcgggggtgcgatgcgcctcgaccagttcggcgaaggccgcgcgaatccgcttaccttcggcataggaaaagccgtccaggaagttgccgaaggcgctgctctcggaccagcctagcagctcgtcggcgctgccatgcgtcaccaccagggtccgcagctcgctgcgataatcgacgaatcccgtctgatcgaacaatgcacgcagctcgtcgtcggtcgcggcgtgaacgccatgagcggtcagtcgcccagcgtcgagcccggactcggccaccgcgcgccgcagcaggagtcgggattggtgcggcgccgtcgggtcatgaatggtgagcccgatgcggccg

SEQ ID NO: 488649 - DNA, 1249 bp, Homo sapiens
tttttgagacggagtctcactctgtcgcccaggctggagtgcagtggcacgatgtctgctcactgcaagctccgcctcctgggttcacgccattctcctgttgctgtgccccaactgggaggctgtggcgtgctgggtgtcggcatctggctggccgccacacaggggagcttcgccacgctgtcctcttccttcccgtccctgtcggctgccaacctgctcatcatcaccggcgcctttgtcatggccatcggcttcgtgggctgcctgggtgccatcaaggagaacaagtgcctcctgctcactttcttcctgctgctgctgctggtgttcctgctggaggccaccatcgccatcctcttcttcgcctacacggacaagattgacaggtatgcccagcaagacctgaagaaaggcttgcacctgtacggcacgcagggcaacgtgggcctcaccaacgcctggagcatcatccagaccgacttccgctgctgtggcgtctccaactacactgactggttcgaggtgtacaacgccacgcgggtacctgactcctgctgcttggagttcagtgagagctgtgggctgcacgcccccggcacctggtggaaggcgccgtgctacgagacggtgaaggtgtggcttcaggagaacctgctggctgtgggcatctttgggctgtgcacggcgctggtgcagatcctgggcctgaccttcgccatgaccatgtactgccaagtggtcaaggcagacacctactgcgcgtaggccgcccaccgcccgcttctctgccaaaaggacgcccacggggagatggccgcacccacagctgcctttcccaccaccagcctcggtgctctgccccatgctgggaggagggagggagggacaggtgcctggagcccccggaaccctgtttctggaaggccctggctcaggtggcttcagggcctccggaccccccctgggaggggtggccacgtgctggctgcggaacccagggcaggggtgggaggggcctccagcactttttatatttacgtattctccaaagcagtgttcacacgggagccagcctgtggcccccagcctcctggaaaacaggttggcgctggaggagccgggtcttggcatcctggaggtggccccactggtcctggtgctccaggcggggccgtggacccctcacctacattccatagtgggcccgtggggctcctggtgcatcttaataaagtgtgagcagcaa

SEQ ID NO: 488650 - DNA, 218 bp, Homo sapiens
ttgccgccatggggggaggctggctgcggattcgtccacctggctctcgcagtgtgtgcctgtgtagccatggagcacaggcacattgagaagctggtgatgccatccacgcagcgacccatggtggcatgggtcaggggagcagtcgtccacgtttgcgatcacacaggtgtgccctcaaagccctcggcacaggggcactcgtagccatcgggctg

SEQ ID NO: 488651 - DNA, 1226 bp, Homo sapiens
  misc_feature (38)..(38): n is a, c, g, or t
gagcaggccgtaaagctgcggcggcggttcgcgtttcncgtgtccgcttgactgacagctgcgcggcgggagcgggcggcgcgagcgggaggcggcggcgcagagcttggggcttccttggtcgcacccaccacctgcctgcccactggtcagccttcagggaccctgagcaccgcctggtctctttcctgtggccagcccagaactgaagcgctgcggcatggcgcgcgcctgcctccaggccgtcaagtacctcatgttcgccttcaacctgctcttctggttcttcctgctgctgctgctggtgttcctgctggaggccaccatcgccatcctcttcttcgcctacacggacaagattgacaggtatgcccagcaagacctgaagaaaggcttgcacctgtacggcacgcagggcaacgtgggcctcaccaacgcctggagcatcatccagaccgacttccgctgctgtggcgtctccaactacactgactggttcgaggtgtacaacgccacgcgggtacctgactcctgctgcttggagttcagtgagagctgtgggctgcacgcccccggcacctggtggaaggcgccgtgctacgagacggtgaaggtgtggcttcaggagaacctgctggctgtgggcatctttgggctgtgcacggcgctggtgcagatcctgggcctgaccttcgccatgaccatgtactgccaagtggtcaaggcagacacctactgcgcgtaggccgcccaccgcccgcttctctgccaaaaggacgcccacggggagatggccgcacccacagctgcctttcccaccaccagcctcggtgctctgccccatgctgggaggagggagggagggacaggtgcctggagcccccggaaccctgtttctggaaggccctggctcaggtggcttcagggcctccggaccccccctgggaggggtggccacgtgctggctgcggaacccagggcaggggtgggaggggcctccagcactttttatatttacgtattctccaaagcagtgttcacacgggagccagcctgtggcccccagcctcctggaaaacaggttggcgctggaggagccgggtcttggcatcctggaggtggccccactggtcctggtgctccaggcggggccgtggacccctcacctacattccatagtgggcccgtggggctcctggtgcatcttaataaagtgtgagcagcaa

SEQ ID NO: 488652 - DNA, 146 bp, Homo sapiens
catgatgtggacgacgggactcgttttctcttcttcttcccaaaaaacttcttaaaagttttgaatttagattttttctttcctgtgctgatccatccccaaggccattctgcagccctccccgaaggcttacatgtccactcaac

SEQ ID NO: 488653 - DNA, 1512 bp, Homo sapiens
  misc_feature (18)..(18): n is a, c, g, or t
  misc_feature (20)..(20): n is a, c, g, or t
  misc_feature (22)..(22): n is a, c, g, or t
ggtacggtcggaatttangnanatcctgctctgggcagaagggcaggacagggccctgagtaacggtggcctggggtcagagccaggttcagctgcgaggctgctggtggctgtggagagcttggggcttccttggtcgcacccaccacctgcctgcccactggtcagccttcagggaccctgagcaccgcctggtctctttcctgtggccagcccagaactgaagcgctgcggcatggcgcgcgcctgcctccaggccgtcaagtacctcatgttcgccttcaacctgctcttctggctgggaggctgtggcgtgctgggtgtcggcatctggctggccgccacacaggggagcttcgccacgctgtcctcttccttcccgtccctgtcggctgccaacctgctcatcatcaccggcgcctttgtcatggccatcggcttcgtgggctgcctgggtgccatcaaggagaacaagtgcctcctgctcactttcttcctgctgctgctgctggtgttcctgctggaggccaccatcgccatcctcttcttcgcctacacggacaagattgacaggtatgcccagcaagacctgaagaaaggcttgcacctgtacggcacgcagggcaacgtgggcctcaccaacgcctggagcatcatccagaccgacgtgaggcgtgggcaggtgggcggggtcggcgggtgccccctcccctcctgcctcagcccgacctgagcttgacccccagttccgctgctgtggcgtctccaactacactgactggttcgaggtgtacaacgccacgcgggtacctgactcctgctgcttggagttcagtgagagctgtgggctgcacgcccccggcacctggtggaaggcgccgtgctacgagacggtgaaggtgtggcttcaggagaacctgctggctgtgggcatctttgggctgtgcacggcgctggtgcagatcctgggcctgaccttcgccatgaccatgtactgccaagtggtcaaggcagacacctactgcgcgtaggccgcccaccgcccgcttctctgccaaaaggacgcccacggggagatggccgcacccacagctgcctttcccaccaccagcctcggtgctctgccccatgctgggaggagggagggagggacaggtgcctggagcccccggaaccctgtttctggaaggccctggctcaggtggcttcagggcctccggaccccccctgggaggggtggccacgtgctggctgcggaacccagggcaggggtgggaggggcctccagcactttttatatttacgtattctccaaagcagtgttcacacgggagccagcctgtggcccccagcctcctggaaaacaggttggcgctggaggagccgggtcttggcatcctggaggtggccccactggtcctggtgctccaggcggggccgtggacccctcacctacattccatagtgggcccgtggggctcctggtgcatcttaataaagtgtgagcagcaa

SEQ ID NO: 488654 - DNA, 1199 bp, Homo sapiens
taaccatctttatccaaatttatcatatggatgggtaggactaacaggcttttaaaaaagcgtggcttaaacttggagtctcaagctacaagtgctgtggggcagccgggtcttcccagcgtgagggttataacttggtttattggcctccagttattccaaaagtgcttattaaagtgaaagtcccaggaacagtgttatatttaagttcaccttggcttttaaacaatttggtttggtaatcaaggagtaattcaggatgaatcattttggactaagggatagccgaaggccaggctttaaatctcataaataggataaggtcctctctttgggtcttatggacaacaagtgagaatactcgtggtgcatttcaaattgcactccgattagtgcgtggggttctaattcacataagcacaataaggggttcaatttataacttcataaacaaacttataatataataatttaccttagcagactatgcaaaagcttaatactggggtgacttactttcttaaagctaataatataaaactaaatatgtatcttaaaaatctataataaaacattagaacttcaagatatgggctaaaataagggcagatgagtccattggctattgtaagatgtgtaaaagaagcaaggctacagaaggactgcttgcggcacaccttacgccagtgcacaacagacaagaacgcaagaaataagaaggacaggagaaagacgaagaggcacaaaataacgaaacaccacacaatagcggcaaccacagggacacaggcacacacagcccggacaacccacccgggcaataacacatcacgagtaacgataatacctataggagaaaacacaccaagaagaacaaaaagcagcacaggaagaggacacgaaacagaagaggcgggagccaagacatacatcacagacagagaacacaagagtacacacgcaaacggatggtgacaaaagagcgaccaacggcgcaacaacatacaggacggcagaccaaaaagaagacgcaagtgcgagaaagcaaacgtaatcgagagaacaagcatgctggggcaagacacgaacaagattaacaggtgaaagaaaaaagatatacgaaaaagcaaagaggcatcgtacaacgaccaggtagcgatcttgatagtcgctcgacatgtactgtatgtatgattaat

SEQ ID NO: 488655 - DNA, 2717 bp, Homo sapiens
  misc_feature (3)..(3): n is a, c, g, or t
  misc_feature (6)..(7): n is a, c, g, or t
  misc_feature (11)..(11): n is a, c, g, or t
  misc_feature (266)..(267): n is a, c, g, or t
  misc_feature (289)..(289): n is a, c, g, or t
  misc_feature (301)..(301): n is a, c, g, or t
  misc_feature (304)..(304): n is a, c, g, or t
  misc_feature (316)..(316): n is a, c, g, or t
  misc_feature (342)..(342): n is a, c, g, or t
  misc_feature (363)..(363): n is a, c, g, or t
  misc_feature (366)..(366): n is a, c, g, or t
  misc_feature (378)..(378): n is a, c, g, or t
  misc_feature (390)..(390): n is a, c, g, or t
  misc_feature (407)..(407): n is a, c, g, or t
  misc_feature (435)..(435): n is a, c, g, or t
  misc_feature (441)..(441): n is a, c, g, or t
  misc_feature (487)..(487): n is a, c, g, or t
  misc_feature (526)..(526): n is a, c, g, or t
  misc_feature (554)..(554): n is a, c, g, or t
  misc_feature (576)..(576): n is a, c, g, or t
  misc_feature (612)..(612): n is a, c, g, or t
aanacnnatcngtgcgcaggcgcccatcttagttggtcttctagtccggtaaacagagggcctgcccccgacagcttctgcttccgggtcacgccttgacagcggctttcaacccccacctcagcccagcaattcggcagtttggagcatgtgaacaccttgagccttgatgagttccagtatgtggtatattatgcagagcattcagagcaaatactctctctccgagcgcttaatccgaacaattgctgccatccgttccttcnnacattataatttagattacctnatcatatttttnttntattttaatttnacttattttacacttaatccctttcncttttcttttttttttttatnttnttattttttttntttacttttttnaaaatgattttattttntttctctttatttttatatacctaatanctcttnattatttttcatataaatattattcttttttttatttcctattttntttttttgcaaacctccatattctttttattgcaatatntataccccactttacttttcatcctttnataacaatgtcttatttttttntttctctcctatagattttttcctcttttatattcnctttattacaacaatgatacaccgctcagctgggctgccatgaagggaaatcttgagagtgtcagcatccttctggattatggcgcagaggtcagagtcatcaacctaataggccagacacccatctcccgcctggtggctctgctagtcaggggacttggaacagagaaagaggactcttgctttgagctcctccacagagctgttggacactttgaattgaggaaaaatggcaccatgccacgagaggtggccagagacccgcagctatgtgaaaaactgactgttctgtgctcagctccaggaactctaaaaacactcgctcgctatgccgtgcgccgtagcctgggactccagtatctccccgatgcagtgaagggccttccactgccagcttctttgaaggaatacctgttacttttagaatagccggagaagatgtttgcaccatcgtgcaggcagctctgggtgaggttgtccctgcagtactccttgtcacagaaaacagaaaaacagttgttcctgttgtgtggtttatagatttcgaagcaacatgtcacaacaataacctccatagcacctccccttcccaaaccaaacaacccaacaaaaaaaatccctcacttttgttttctgtttattgcttacctggctttttatattgcattttgcaaaagaagaggtctccctcaatcctcccctttagggaaggagtcaacagtgtaactaaatttctctaggaagatggaaagtacttaaataatgtgtgtgtggttttcctttggggacgtggttaacggtccagaagaatcccttctagaaagcattttaggccagccatggtggctcacgtctgtaatcccaggactttgggaggctgaggcaggtggatcacctgaggtcaggagttcgagcccagcctgaccaatatgatgaaaccccgtctctactaaaaatacaaaaattagctgggcatggtggcatgcgcctgtaatcccagctactcaggaggctgagacagaagaatcgcttgaacctgtgaggcagaggttgcagtgagccaagatcgcgccattgcactccagcctggacaacaagagcaaaactgtctcaaaaaaaaaaaaaaaaataaataaaaccctttttattggcgtctgggaacaaactttagggaaattcccaattttcggttaacagccaattgtggtgtctcccaaagattgaagacattcctatataaccctcaaatgtggttgcaggatctcccagaaaactgtgggcactggattgacaactcccttacgtgtgcccagtgtcttccgtgggggccattttggccaagggaccgggaacctcttttccccctttcatccgaagggggacaccacaggcaaggttctatggccctcctattatctgtgtttggggttttgttcgccccacaagggggtctcaccaaggttaggcctcctggagacattaccccgaaaggagcgctcctgggtaaactacaccgcggtgccatacagataccgtctccttgagatcttacaacagggtccctgaaagagactctccctctttagaaaagtactccctgtggaagacaaaccctcttttctcgctgtggtgacaatgatggccaacgctgattttgattacaccatcagttctcgctgtggtgaagaaacactaccagagtggtggtgtgttccacattacaatggggggagagattaccacccccaagggcgccagaagtgttcgccctatatagacaccatttaaagcgggccttggttggtgtgtactacccccaagcactaggtgggtaagaagagaaacgactcattatagtggagggacctgatgcgaggcttgacccgcatttatctgcccccccaaggtgtgggagatctcattgctacaaatatccccccaggggttgtcacataggatggtttaccacaccttgtgtgagtttaatgatgtaggggaaagatttaatgatttttcttcctgtttcaccaattgaggttccgtggcgaccacccatgttggggcatgttctatattgggagcattttatatacaccaagtcaaca

SEQ ID NO: 488656 - DNA, 1242 bp, Homo sapiens
  misc_feature (38)..(38): n is a, c, g, or t
gagcaggccgtaaagctgcggcggcggttcgcgtttcncgtgtccgcttgactgacagctgcgcggcgggagcgggcggcgcgagcgggaggcggcggcgcagagcttggggcttccttggtcgcacccaccacctgcctgcccactggtcagccttcagggaccctgagcaccgcctggtctctttcctgtggccagcccctgggaggctgtggcgtgctgggtgtcggcatctggctggccgccacacaggggagcttcgccacgctgtcctcttccttcccgtccctgtcggctgccaacctgctcatcatcaccggcgcctttgtcatggccatcggcttcgtgggctgcctgggtgccatcaaggagaacaagtgcctcctgctcactttcttcctgctgctgctgctggtgttcctgctggaggccaccatcgccatcctcttcttcgcctacacggacaagattgacagttccgctgctgtggcgtctccaactacactgactggttcgaggtgtacaacgccacgcgggtacctgactcctgctgcttggagttcagtgagagctgtgggctgcacgcccccggcacctggtggaaggcgccgtgctacgagacggtgaaggtgtggcttcaggagaacctgctggctgtgggcatctttgggctgtgcacggcgctggtgcagatcctgggcctgaccttcgccatgaccatgtactgccaagtggtcaaggcagacacctactgcgcgtaggccgcccaccgcccgcttctctgccaaaaggacgcccacggggagatggccgcacccacagctgcctttcccaccaccagcctcggtgctctgccccatgctgggaggagggagggagggacaggtgcctggagcccccggaaccctgtttctggaaggccctggctcaggtggcttcagggcctccggaccccccctgggaggggtggccacgtgctggctgcggaacccagggcaggggtgggaggggcctccagcactttttatatttacgtattctccaaagcagtgttcacacgggagccagcctgtggcccccagcctcctggaaaacaggttggcgctggaggagccgggtcttggcatcctggaggtggccccactggtcctggtgctccaggcggggccgtggacccctcacctacattccatagtgggcccgtggggctcctggtgcatcttaataaagtgtgagcagcaa

SEQ ID NO: 488657 - DNA, 208 bp, Homo sapiens
  misc_feature (49)..(49): n is a, c, g, or t
  misc_feature (54)..(54): n is a, c, g, or t
  misc_feature (101)..(101): n is a, c, g, or t
  misc_feature (177)..(177): n is a, c, g, or t
gaatcccactttgacatatcgacgatgagaataattaatattcaaatancctgncctatgtcaggcactgtgtcccacaaactagcttacaatggggctanactgttgtgccaccgggttttacatgtgaagaaaccatggtttgcagtgagccaagattgcgccattgcactccancctgggcaacagagcaaaaacttcattttat

SEQ ID NO: 488658 - DNA, 148 bp, Homo sapiens
ccggggatacaaccgccgccgcctcccttacctgccgggcccgacccgggggcaggggcggagaccgggaccgccccagtgggaccagggcccgcgcctgagccgagcggacggcaggaggaggcggcggcggcgaccgcggcggccg

SEQ ID NO: 488659 - DNA, 614 bp, Homo sapiens
  misc_feature (115)..(115): n is a, c, g, or t
  misc_feature (233)..(233): n is a, c, g, or t
ttaacagatgtcattgtaagagccatcaaaaagtcctgacaatctcctaaaggggccgagtgcaccagttctcttggagcagtcatccatctctcagtggcgagtctcgtcaagnaagcttcgtatgtggcgccagatgggtccagaagtaggcccgctccttcagaagtcaggcaggcaaggcagaggtaacagacagtctaagctctcaccctcctcccgtagagcttgancgctcgcctggacttatcccctgccagtctctccttgaactcttacagcgtgactctcactccagtgtcgctctggatctgcagggtcagctctatccctctgtgaatacagtgggctactctttgagagtcttgttccaacagtccacggtacgtcagtgctggggtcaccagctgcagtccactgggctgcagagcgcttctgtcacctgactaggtgttcatgttgcagtcaatagaacaggcttctagcaccttgtcagcccttccaccatctgtgcctttgtagcccagctctgtcagggcctcagacagagccctgcagttggccaccgcctggtgttgatcaactttaaattccagagtcacagcttgcttcag

SEQ ID NO: 488660 - DNA, 919 bp, Homo sapiens
cagcggctgccggtgctttaatactttttagaggccctaaaaatcacaaacatatgctcaactcactgtctacagttcttataactgccaaaatctattttcttcctcatacctgacgcatatagccgggtcttggcatcctggaggtggccgcaatggtcctggtgctccaggcgggcccgtggacccctaacgtacattccatagtgggcccgtggggctcctggtgcatcttaataaagtgagagctgtgggctgcacgcccccggcacctggtggaaggcgccgtgctacgagacggtgaaggtgtggcttcaggagaacctgctggctgtgggcatctttgggctgtgcacggcgctggtgcagatcctgggcctgaccttcgccatgaccatgtactgccaagtggtcaaggcagacacctactgcgcgtaggccgcccaccgcccgcttctctgccaaaaggacgcccacggggagatggccgcacccacagctgcctttcccaccaccagcctcggtgctctgccccatgctgggaggagggagggagggacaggtgcctggagcccccggaaccctgtttctggaaggccctggctcaggtggcttcagggcctccggaccccccctgggaggggtggccacgtgctggctgcggaacccagggcaggggtgggaggggcctccagcactttttatatttacgtattctccaaagcagtgttcacacgggagccagcctgtggcccccagcctcctggaaaacaggttggcgctggaggagccgggtcttggcatcctggaggtggccccactggtcctggtgctccaggcggggccgtggacccctcacctacattccatagtgggcccgtggggctcctggtgcatcttaataaagtgtgagcagcaa

SEQ ID NO: 488661 - DNA, 87 bp, Homo sapiens
  misc_feature (42)..(42): n is a, c, g, or t
gcccttgtgcattatggttgataaaagcattgatttactgcnttaaaatcactttactttatccaatttttactgaaaatattatgt

SEQ ID NO: 488662 - DNA, 633 bp, Homo sapiens
gcactagaatggagcgtggatcggaagtagaagggtgatacttcagggactaaaaagaagtcactgaatcttcaaaaggtggtacatagtaagatgatacaaaaggatcaaaggtataagaattcccggtccgacggagagaggtctatgtcatgagagtagtcagatcaggcgaaagagatcgttgcaagaagtgaagagagaccgaaaatcagacaggaaagacaaaagggttatgggagaagcaggcttgcttagccattctttgagtagaagatgtcttgataagatgaaggtatgagctttccttgtaaggaggatgctggcttaagaatggatgtgtggaagatctgtttggaacatacgagtactgttgtttaccagacattcttggtactttgtgcataacttgtgtacagagtgatctatcagaatgatgtgaggttccaaacatctgtactgaatgatactagattaagatcaagattagcatcccttgtcatctgttttaaaatatgctatactcttcaataagaagctggtattaataggcaaatcttaagtctggtccccttctaatctgttaatacattgcgtggcaaacaaatgggggtctgtcgttaaacaaccggg

SEQ ID NO: 488663 - DNA, 303 bp, Homo sapiens
ccgcgcaacgcgatcgagtttcctgactaccgatacatttctaaaatcaaccccgttcaatgtgcagacaggtcagtgtgggagctggctgctggaatgccggacctcggtctttcagtcaggtcgcggtgatgctatcgcaggcaagccagctcccacatttgatcgagcacattcatacatttgaggccattttaagactgatgaacctgcccttctttgcccggcgcctgctgcgccccttgctcgacccctaccgccgctttcgccatgccaagctgatccacgccgcgcgcgtatcgg

SEQ ID NO: 488664 - DNA, 91 bp, Homo sapiens
agcgcctcggctccagcgcatggccttccaggagttcttcgttggggaactggaggatgaacgggcggagggatgtctgggtagctatgga

SEQ ID NO: 488665 - DNA, 244 bp, Homo sapiens
tatctagaggaccccagcgccgagcaatatagacatagcgaaggttggaaatcttctctccctcagtgatgactcgagcttctcctttcttatagacgtccgggaggggcttgaccgggccgggtcagctgggtggccggtttcagttcttcagcagaactgtctcccttctggggggccgagggctcccgggggaagaggatgagttgggagcgatactccgcggggtcccggagctcgaatt

SEQ ID NO: 488666 - DNA, 192 bp, Homo sapiens
  misc_feature (33)..(33): n is a, c, g, or t
atccaatggaatggaatggaatggaatggaatngaatagaatagaatagagtggaattgaatggaatggaatgctttcaaaccgaatggaatggaaaggaatggaatcaacacgagtggaatggaatggaatggaaaggaatggaatggaatggaatgggtacggaatagaatggaatggaacgaaatggaa

SEQ ID NO: 488667 - DNA, 451 bp, Homo sapiens
  misc_feature (33)..(33): n is a, c, g, or t
  misc_feature (68)..(68): n is a, c, g, or t
  misc_feature (230)..(230): n is a, c, g, or t
  misc_feature (294)..(294): n is a, c, g, or t
  misc_feature (302)..(302): n is a, c, g, or t
agaaaattagctgggtgtggcaccacgcatctntagtctcagttgtacaggaggctgaggccagaggntcacttgagcccaggagattgaggctgcagtgagccatgattgcagtaagatgtgatcacatccagttacatttgattttcagataacagaagtttagtggaggctgggggcagtggctcacagctgtggtcccagcactttgggaagctgaggcaggtggntcacctgaggtcgggagttcgagaccatcctggccaacacggtgaaccccatctctactaaaantacaaaantgagccgggcgtggtggcgggcacctgtggtcccagttactcgggaggctgagacaggagactggcatgaacccaggaggtggagcttgcagtgagccaagttcacgccactgcagtccagcctgggcgacagagcgagactctgtctc

SEQ ID NO: 488668 - DNA, 100 bp, Homo sapiens
gcgctggatgccactgcttcagcatcatggttactccggtacccagcaccccaagccgccagcgtgccatgtcatgcacctttcgtcccagcggctagat

SEQ ID NO: 488669 - DNA, 508 bp, Homo sapiens
ggatcccctgttctcgcccaacactctgggaggctgaggtggaaggattgtttgagcttttgagtttgagaccagcgtgggcaacatagtgagacctctctacaaaaatagaaaattagctgagtgtcgtggcacatgcctgtcatcttagctactctggaggctgaggcaggagcattgcttgagcccaggaggtcaaggctacagtgattgcaccactgcactccaactatgatcatggcactgcacttcagcctgggtgacagaatgagaccctgtcagaaaaaataaataaaaatttaaaaaataggggtgggcatagtgcctcacacctataatcccagcactttgggaggccaaggagggtggatcacctgaggtcaggagttcaagaccagcctgggcaacatggcaaaaccccatctctactacaaatacaaaaaattagctgggcatggtggtgcacgcctgtagtcccagctactcaggaggctgaggcgggagaatg

SEQ ID NO: 488670 - DNA, 451 bp, Homo sapiens
  misc_feature (8)..(8): n is a, c, g, or t
ttatcacncatcgatcacatacgacgaattctggccattgatacacgtatcaatgctctcatcctgttcatcccgtggtagcccccctcaggcatgcaggaggtgtacctcgggacatggcctcttctgctgttgttccaggcgctggggaagcattctcccgctgaggctcacgggaagctctttctgctcccttaacttccattggctcctcagtgaagtggctgggggggatcacgcatccctgcgatcgtgtctaagaatggcatcggtggcctacaggcatgtgctctcatgtagcacctagtacgcctcagtccaattatacgtggtcatgcagctcaccaaggagggattcacccaaaaagacatacaactaattcggccatagataacagcagctaagtccatctgctgtactgcctagcagtgcacgttaagggccaggcaa

SEQ ID NO: 488671 - DNA, 195 bp, Homo sapiens
  misc_feature (104)..(104): n is a, c, g, or t
  misc_feature (120)..(120): n is a, c, g, or t
ctcgtaccgcaaggccttccgccgctcgtcgagtacgacatcgatgccatgccgacggcccgtcgcgctgacgtcgtcaaatggtggatcgaggacagcattcnccgcaattcgtctcgngcctacatcgaaacatgccttcgttcggcaggaatcgactttttcgaacagacgcgcatctggcctgccccgatc

SEQ ID NO: 488672 - DNA, 350 bp, Homo sapiens
  misc_feature (67)..(67): n is a, c, g, or t
  misc_feature (98)..(98): n is a, c, g, or t
  misc_feature (194)..(194): n is a, c, g, or t
gtaatttgatacaatattttaaataattttgtgcatgaaacaaagtttcgactgcattttgactgtnatttctggcatgagatcagttatggaatttnccacttctagcgtcatgttggcattcagaaattttgaaattttggagcattttggattttcagattagggatgctcaacctgtatatatatttttnaatcgacgtgaaattcacgtaacatagaattaaccattttgaagtgaacaatttggttgcattcactgatgttgagcaaccaccacctttaactatttccaaaacattttcatcactccaaaataaatgcctgtacacactagcagtcactcccta

SEQ ID NO: 488673 - DNA, 106 bp, Homo sapiens
agcggatatgatccgctcggattcctgggtctggactgctgccagacccgccgggtgttctgcccgtgtcgtcagccggtggccacacaatggagcgcagttggat

SEQ ID NO: 488674 - DNA, 1380 bp, Homo sapiens
  misc_feature (1)..(1): n is a, c, g, or t
ngggggacgctccatattggggcgccagatgtctttgtggcgcattagtttgctgtcactcctccgcaccactatagagggtttccaaagtggatgtctcttatgagcgcgtctgaacgcgctctccccccaagtgttgccgcctgtggggggcacttatctcatatggggtgtggtgccccaccccaactatattcttctccgctggggtgaaagactgctttctgcggcggggtctcttctttgtagtgtagatggaagacattggggggggttttcctgcccccctggtggttgggtgcgccccctaagcccttggtgtgctctcttggaaaacctgtcctccttgtagtgccccgtttcacacgggggttggatgtccccgcgccccccggccctttcggggggcttccgcccccagaatggttgtgctcgggggggagtttacccacggtagtccgctgttgtgggggcttacgccccagacaataccctccgtcccctcgtggagttggagttttgtcttctaaaaggggcgccccctttgctttatgggaccccctacgaagttttctctgggggaaaaatcttttctctaaggcgcttgtatattctgtgcgcccccccgttctattaatgcgccccctttgtgcgcgctagatctgcgtaatcctttgaatgtccccaccaatatgcgcatggatgacccagttctgtggcgacacaaccgcacacacacttggcttcgtaggagttgacacctcgggtgtccctataggggacaccgcctctgtgacacacgagagagagacttggcctctatacgctaagcagcgagacctcggagtttttttttcttccctcagagttctcggctcggctttcccacaaagtgtgtggtgagacacctctgtggctaagattcacactctaacacgctctgtgtctggattggtccactttccgcgctctttgtaaatataagatgtgggttctgtggtgtaaccacagaataactgttataatacaaaacaccgctggcgcttgcccattccaagaagaatggagatcttgaccgcattctcacactttcttgtgtgcccacgagagagaagaagaagaatccatgggttattagaacccagcgccccatgtgaaagagcctgcctttggtccaagagctggagagcacgctttgctcaaggagaattaattcaccgaaggtgagcccctgtctttttgagcctggcaccacagaaggagaaatgtttggctgtgaaatgtgagcccaatataagaagaagcccctattttttcacgtcaagtccttgaaccccggtaagtaatttaccgagaattaaaatgtgtttgtttaatgga

SEQ ID NO: 488675 - DNA, 1081 bp, Homo sapiens
tacgagaggggggcgggcgagttatctcgcgctcgtcttttgagtgacccgaactgcgtctttcgcaataaccgattttggagtttcccttttggcccacgtgcccaagattggcctgacagttaatcatgccttctgtgccccgtttcgcggtttccccacatgccaccagtcaaaccatctgcgaagactcactattcgtcagggtatattgctataacaggcgcatcattgtgaacacccagcgtcaatacagccgcaccgtacagggcatatggctagataccagtacgtacgcggctgcgtagttcatatctgctcctgggatcttattgaagtttcaaagctttggaagtatactcgtgtgctttgctattgtttacgcttcctggtattggggactcatgagagagcgtcgaggtctagagcttcgtgcaagtgagaagacactacacggttgcagctgccacagtgaagaacccaagctcctgtcaaagttgtgaatgcgactttggatgagattaagaaggcccagtgcacgcgttggtcttgaagatgtggcagtgtgtggatttgaggacctctgcagaccatcagatcaaaggagggagagctcttttggctgttttgctttcttccttgtttacttacaagcattttgctttttcttggaatgtaattttcctatggcatgcttaactggccgcacatcgtgtaacctgtctggtgagcaaccatacaattgggatgagttctaggtacatgtgtgttgctgactttagggggtaaacaactttgcttataatacagtctctgccatcagatgcatgtcgacctcttgcaggggcccagagtggtctgtaggaaggcaaagcgttcaagctggccatgggggtcccaaacagtcattccaggcttagatgatgacatagccctaggtcatcagagcccagactccacagaagattgaaatcagagcttccgtcttcgttatggataaatttcatttgcgtgggaaaagaatgctgaagccagtggatgagaattctaaatcgtcgccaacgggttggagtacgctata

SEQ ID NO: 488676 - DNA, 232 bp, Homo sapiens
tcagaaaggtgacaggcatggattagcagggcctgtgggcaccaggaggatttgtcctgcaggaggtgggagccactggggggtccagggcacaggaggaatgggtcttgacgtccaactgtctttaaaacctaagtcaggccaggcgcatcagctcaggtttgtaatcccagcactttgcggggctgaggcaggaggattgcctgagtccaggaggtcaagaccagcctgg

SEQ ID NO: 488677 - DNA, 356 bp, Homo sapiens
attagaggatccgcccaggtagatttgtgaagagtgctctgcccggcgcgacccgtctgggaactgaggagtgtctctgcccgccgccacccgtctgggaggtgaggagcgtctctgaccggctgcccgtctgagaagtgaggagcccctccgcccggcagccaccccgtctgggaagtgaggagcccctctgcccagccgggtgtggtggcgagtgcctgtaatcccagctacttgggaggctgaggcaggagaatcgcttgaacctgggaggtggaggttgtggtgagccgagatcctgccactgcactccagcctaggtgacagtgtgagactcttgtctaaaaaaaaaggaa

SEQ ID NO: 488678 - DNA, 887 bp, Homo sapiens
gtccccgggaggcggaggttgcagtgagccgagaccgcaccattgcactccagtctgggcaacagagtgagattccgtctcaaaaaaaaaaaggaaaaggaaaaaaaaatagcataatacctcttccttgtttcaaccgccatgaaatttctgaacactccaaatccagtggaataatccaaaacaaaatttctacagtctcaaatacattttactccttatagtactagtatacttaaaaagcctcagggttatatatcttctaacacagctacaattcagtgcagctacattacccacctatgttctctagttgagaacaataggcctatttcactgctgtgtagcctcagtgcctacacatgggtgccaaataactattcgtagaattcccctgatttggtaaaaacccattcgtttttgtttccaatggccaaaaatctcaaaaggctctgcattcatgtaatcctttgaaaactacattatccattgggattccacagtaatgactggctgggtgtgcttagtcacataccgtacccagtattataaaacgctcaatatggacttgatctacacaagcattccttccctttctacagttaattgttacccacttcatgggggtaatgtcccaaaaaggtatatataatagtttgagaagaatgtttcgaatcttgtgctaatcgaacatctggttatattgcccgcaaccttatattgtaagactagtctgcatgaaatatgtaggaggaactaagtggaattaatgtgaggtgcgaggatattgtgtccatgtgatgacatttgttgtgggtaggggtcacataagacaaggatttaaacggaggaggatagtaaaagtagggagagggaagaatgagagg

SEQ ID NO: 488679 - DNA, 173 bp, Homo sapiens
taaattaatattagtttcttgggtgaggaacctttatcagtaaggtaatttagccaccaaacgatccctgggactcgggtttctccatcgttggttccaacgtaatcaccaaaattacggccacatgccgattcttaaatcagatagttgctttgtctctcggttatataccc

SEQ ID NO: 488680 - DNA, 257 bp, Homo sapiens
cttgggtttttttgggcacctttttgggaaaacccagggtgaggttcaccctgtaagggctgggatgggttttgtgggcccaaggccaaacctttttttgggactgtgtggcccaaggagtttccatttagtgacaagtgccccccagctattgctttttgccttcccctggggcccctttccagggtggattttttttttttccctgcagtttcccaactgcaggtccagggcaggcaataaatatttgatggcca

SEQ ID NO: 488681 - DNA, 210 bp, Homo sapiens
ccggctaccgtgagtagtcaattaaaactagagggttaggagacaatacatgaaagcagaccaacaggacccgcgacacagttcgcgcaccaagtgtgaagagtaaaagaagacaggcttatcttagtggatgcgagggaatcatctgtggcagaaaattaattcataaagagcctgagcaaggatattcacgaccaaggaatgagatgt

SEQ ID NO: 488682 - DNA, 128 bp, Homo sapiens
gtattcggtattccccgcctcccgtgtttacccaggaagacactttggccaaaggccccttaaggcccggacccctaaagtccccttttcatggtttttcataggtttctcctctttcccccccccct

SEQ ID NO: 488683 - DNA, 183 bp, Homo sapiens
agatgcagtgagctgagaacacaccactgcactccagcctgggtgacagagcgagatccccccatctcaaaaagaaataataaaaaaaagaaaagaaactgatgaacggtcctctaaatgtgctgtaccagttttgcatccccattatcgatgaatgaaagtcccgtggacgccgtcggggcc

SEQ ID NO: 488684 - DNA, 263 bp, Homo sapiens
  misc_feature (101)..(101): n is a, c, g, or t
agcagtgtggaggttggctaatctgggaatattgtaagagagaggcaaagggaataggcaagaccaaatggccccagaggagagattgtgatgttctgaantagtcccccgctgtatagttggtattcatagctgggagaaggaggcagtgacggagccaaagagcatgatctttaagtgccgggaagattcaatgtccatagacataggataggatcaggcagtgcgttagtgcatccatgccatcatatgagtgatttgta

SEQ ID NO: 488685 - DNA, 1225 bp, Homo sapiens
acatgagaatcgcttgaacccaggaggtggagattgcactgagctgagatcctgccactgggctccagcctgggtgacagaatgagactctgtctttaaaaaaaaaaaaaaaaaaaaaattcacaataagtcctagggtaaagatgggggtacagaaaacaatttaattagaacaaaaacaactgtttcctttgccgtggtgatttcaagaagggcttagatctttctactcagcatccttttactaatgtgccctccatggggctctcaccccaaaattttcctttttatatagcttatttgggtaagtgcctccttaattattcctttaatagaaagccaccgggtgataagctacctacacatcactaccggaagcatttaatattattgccccagagtgtacgtggtttcagggccaaaagggcaaaataattttccaccaaaggtggtgctggtgttccactgtcagaatgcttgccacttaccacacggaatcgctgtgcatccgacagaggctgatggggcccattggggcacagcggattgtcagctcaaacaccgtcacgacagcgttgcccttggaaaggggatttcccagaacagtaaccgtgttctgtccttgatttaccagagtagctacattcctaggaaatccagggaccattaaaagctccccatgtgtaccccaggctgggtctcaagatcccaggcttcagaagcagatccaactggccttggggactcacaagagtgctggagcagtcatacgtggttgagcccacacaggcttggacttaaatgacagtactcattgaccgaattgaccgacctggggaaacattaagcaaggagccccagttttcttaccaagatgtggtatccaattaacaatagcccggggcgttgttggcaaatctcgcggtgaacctagaactactgggaaggcgatagcagaaggacctacttgtgcccaagaggattaagggccaaaaaagcgtagtacgagtcaaggacccacctttgggggtgacaagatagccgtctctcaaaatgatctgccccggaaaaagcgatggctgcttagaaccagcctcactattaaggggagggtgtcactaggagaaagggatggaaacaagccacgaggagcagacatcctacactgcggtagtagagagacaagtatatctaatctcttctgctgtctagagagctaaagagg

SEQ ID NO: 488686 - DNA, 766 bp, Homo sapiens
agcggatcccgtaccgggcctctcgaacgagtgtgcgcgcgaggcatagatgaggacctctggcgcgctctttccaagacctgggtgccaggactctcaggggggcctccaacaatgtactatggctgagagtttcgggcgggaaagatgtccctgaaggggaccaccgatgactcctggataagcggcaaagggctggtgtacattcatgcagacggacgactcgcttattcacttctgcgtggaaggacaggacgtccgggaacgtggaagacgacttgatcatcttccctgatcgactgtgagttcaatgcgggtgccgcatgtgccccagctgggagggtctagcgtgctgaagtatcagggcagggtccaagcaggcttttcttctggcatgcaggaatcccaaagacagaccaggatgaggacgcattgccgggagacgtcaacgagtatctgaacaacaccgccgatgcctggatgcacatggagggccagcggaagacagcggccacgaactctactgacggctagggcggtgagggtggccgtgcatgaggcctgatgggaaatgatgagccacagacatgctcatgcagaacatcggaccatgccggcctcgagaggactggagtagaggctggagggccctagacttggaccttggcctggacaacattaactggaggaagcagatggagcctccaagggaagcatgttcctcctccaagttacgctggatgccacagtcggcaagagagtaacc

SEQ ID NO: 488687 - DNA, 544 bp, Homo sapiens
aattaagggtatctcctagatagcagaacagaaactgagatggagaaggggagagtcaagatgagaacatcgggggagcggcctgggatatcccctctgtagcgaggacggtgtggaaaagatgcacattaccagaatcagagtaagggcgagagtccctggcatggtgaaggaggggggcctgttgaaggcacgtctccatgtactctcagaacctgagatgcagagaagagtagcatctgcaaaacctaaaaagaataggggctaggtacagtggctcacgcctgtaatcccagcactattgggtggcccaagaagggcagatcaccaggtcaggagatcgagaccatcctggctaacacggtgaaaccccgtctctactaaaaatacaaacaattagccaggcgtggtggcgggcgcctgtagtcccagctactcggaaggctgaggcaggataatggcgtgaaacctgggaggcggagtttgcagtgagccgagatagaaccccccctccagcctgggcaacagagcaaaacaatgtctc

SEQ ID NO: 488688 - DNA, 227 bp, Homo sapiens
gtctgatagtctgctcacgattacgttttgacgatgcaagttctcgaagaggaaaacacacagttaactaagatctggggtgaaaagaaggctgttcttgctggagatttaacttctttctgcagcatctatagctctggcacgaatttggaaatacaactgtttatattcttttttaacccaagtttattgaagactttgagtgcgtgggtgaactttcgttcagt

SEQ ID NO: 488689 - DNA, 150 bp, Homo sapiens
cgcggcacctgtactccggggtggcgctggggttggctccatgatcaagatctatgggggacgtcagagaaacggcttcatgcccagccacttcagccgaggctccaagagtgtggccgccgggtcctccaagccctggaggggctgaaa

SEQ ID NO: 488690 - DNA, 389 bp, Homo sapiens
gcccaattaactgataaggtactggaacaaacaatgtatgaagttcccaggatttttctcaaagagataacaacataaagccttgagttcatgcccagcatagcatcatatctaactataatgaaggatttagagccctgcacctggtaacgttgctttttgtaaccatttgtcttttaaattgtttatctctctgtaaccatttgcttcttttgattcttgcatgtttttacttctgtagaattattgtatttgagttcccctccccttcctaaaccaagatataaaagttaatcaacgcccttcctcggggccgagagaattttgagcgttagccatctcttcggcagccggcttaaataaaggactcttaatttgtctcaaaaaaa

SEQ ID NO: 488691 - DNA, 433 bp, Homo sapiens
  misc_feature (369)..(369): n is a, c, g, or t
tgaaactgagtctcgctctgtcacccaggctatagtgcagtagtgcgatctcggctcactgcaaccctgcctgctgggttcaagtgattctcctgcctcagcctcccgagtcattgggactataggcacccaccaccatgcctggctaattgttttgtattttttattagagatggggtttcaccatgttggccaggctagtcttgaattcctgacctcaagtgatccgccggccttggctcccaaagtactgggattataggcatgagccactgcacccagcctgggaattacattttagggcactgcaacgtaggcacagttactctttttcacagaagtttttctctcactttcaaacagataggntaatggattttcagtttatttaaggttaggggttaaaacttgccccatagggtgtgttcatgag

SEQ ID NO: 488692 - DNA, 125 bp, Homo sapiens
tcctcctgcacctccatcctgtggctgctattacctgcatgtgcactactgggcagggcaggagcaccgcaacatcgctaagaagtcacccgagtgaccttcagtgaatgcccagtcctcaggat

SEQ ID NO: 488693 - DNA, 362 bp, Homo sapiens
  misc_feature (304)..(304): n is a, c, g, or t
tgctctctctgtctccctgtgaggccgggcctcgggggtgcggggtctgggatgctccagtaccttgtgcgcgtgcgtttccggtggctgttggttccaggggtgtgctgtgtgacgcgcagggctaggtgcctccagcagggccttgctccggctgtttctaaactgccccacaggatgccaactgtgtggtgagcacgcacacacacccacgctcactcgccgcctcctcgcagaggaagggtccctcccaggttgggctttcctgagaagctggcaggaatcgcgaatatgcttgaaaatnataaaacctatcttctggaaattactgctacccactcagcctccctggcggctctcct

SEQ ID NO: 488694 - DNA, 204 bp, Homo sapiens
gaaagtctttcatcgtggaccacaacagtcgagctaccacttatcattgacccccgaatccctcttcagaacggtcgtcttcccaactcatctacactcacctgacagcacctccatgaggctccgacagttacagctgctgagagaggcctcagcaagtttctagcaaacagcaggagcctcatttacatggccatggccagg

SEQ ID NO: 488695 - DNA, 430 bp, Homo sapiens
  misc_feature (102)..(103): n is a, c, g, or t
gacagaggtgtggtttgggggccacgagacaaagccgagagccagaaagcgcaccacgcatggatgttcttggtccattcttctcgcaggtgctagtgaagnngttggtagagagtgcgatggccaggttcgtgatttccgctggccaccctgtgcgtgtttgtgagcagtaaagtgaaggagccttcatgtactgtgaggagaatgcttgcggccacaacaatattctcttcgatgtacgcgaagtattttgcttttgctataaatagaagatgatttatatgtatgtcaagtgtcaatagttcatagaaggtgtgttgacagtactagtctatattagatgtacaagtagttacccccctcgtgtactttcgtgagatagaagtgtgacaaatataatggataattaaaaaaaaagaagaaaagaaaa

SEQ ID NO: 488696 - DNA, 389 bp, Homo sapiens
gtcaaatacacttagtgagagtacttcagctccagtcgccacagattaaatccctaactctcaccaactgtctcacagatatgtgtgctgggttattggaggccaggtgagagtgtgtgaatgggtcagcacaaagctttaccgccaccaaggacaaaaacaaaacagatgtcctgttgacatccctgtagtttgtgtgaatgcttatgaaggagagagcacgctgctgccatgtgaactaattcacaaaacaaatacagcaagccaaatttctctaatttttgaagagaatctgatatcatttcacccataatgtaacacatgttgtggtgtaatttacaaaaataatgcaaattttaagaagcatattaaaaaaatctgcaaaatga

SEQ ID NO: 488697 - DNA, 635 bp, Homo sapiens
gctccagcattattctttttcatgaggacatccaattttcccaatactatttgttgaaaagactatcctttcccatgaatggtctggtgccctgtcaaaaatcatttgaccatatatgtgagaggtttcctacgtatagtaaacgtattgtttctttctgggcggtcatttgacattttacaggttcaagttcagagtttcatcatttctcagtgatattgcacacttcctaactattgtccctaattcaagtatcatttcaagatacattttctactctggcattctgatctatgtcacctaggtttcgcctgctcttctatttaccctctctcgattatgagtccctggacgggcacgggacttctagtctctcggagaccctacgtggccttaatgcgtcattggtactgaactactgtgtccagtctggatgaaattaacctttaccagcctacaacaccccacgcaaaagcacactcagccacgcagcacattccaagtctcagggctccctccacgcaagctacctctcactcccacattacattcattccacaacctaacttcacctcactgggcctctactgaagccacttcttcaacggggacaactctctgctcctcatcctccc

SEQ ID NO: 488698 - DNA, 1517 bp, Homo sapiens
ggtaccgcgaacggtgcgttacttacctcgactcttagcttgtcggggacggtaaccgggacccggtgtctgctcctgtcgccttcgcctcctaatccctagccactatgcgtgagtgcatctccatccacgttggccaggctggtgtccagattggcaatgcctgctgggagctctactgcctggaacacggcatccagcccgatggccagatgccaagtgacaagaccattgggggaggagatgactccttcaacaccttcttcagtgagacgggcgctggcaagcacgtgccccggggctgtgtttgtagacttggaacccacagtcattgatgaagttcgcactggcacctaccgccagctcttccaccctgagcagctcatcacaggcaaggaagatgctgccaataactatgcccgagggcactacaccattggcaaggagatcattgaccttgtgttggaccgaattcgcaagctggctgaccagtgcaccggtcttcagggcttcttggttttccacagctttggtgggggaactggttctgggttcacctcccctgctcatggaacgtctctcagttgattatggcaagaagtccaagctggagttctccatttacccagcaccccaggtttccacagctgtagttgagccctacaactccatcctcaccacccacaccaccctggagcactctgattgtgccttcatggtagacaatgaggccatctatgacatctgtcgtagaaacctcgatatcgagcgcccaacctacactaaccttaaccgccttattagccagattgtgtcctccatcactgcttccctgagatttgatggagccctgaatgttgacctgacagaattccagaccaacctggtgccctactccccgcatccacttccctctggccacatatgcccctgtcatctctgctgagaaagcctaccatgaacagctttctgtagcagagatcaccaatgcttgctttgagccagccaaccagatggtgaaatgtgaccctcgccatggtaaatacatggcttgctgcctgttgtaccgtggtgacgtggttcccaaagatgtcaatgctgccattgccaccatcaaaaccaagcgcagcatccagtttgtggattggtgccccactggcttcaaggttggcatcaactaccagcctcccactgtggtgcctggtggagacctggccaaggtacagagagctgtgtgcatgctgagcaacaccacagccattgctgaggcctgggctcgcctggaccacaagtttgacctgatgtatgccaagcgtgcctttgttcactggtacgtgggtgaggggatggaggaaggcgagttttcagaggcccgtgaagatggacatggctgcccttgagaaggacttatgaggaggttggagcagatagtcgctggacggagaggatgagggtgtagagtatgaacctgtgtgcctgtacttttacacatcctttgtgcttttacgtgtcgattt

SEQ ID NO: 488699 - DNA, 1728 bp, Homo sapiens
ggtaccgcgaacggtgcgttacttacctcgactcttagcttgtcggggacggtaaccgggacccggtgtctgctcctgtcgccttcgcctcctaatccctagccactatgcgtgagtgcatctccatccacgttggccaggctggtgtccagattggcaatgcctgctgggagctctactgcctggaacacggcatccagcccgatggccagatgccaagtgacaagaccattgggggaggagatgactccttcaacaccttcttcagtgagacgggcgctggcaagcacgtgccccggggctgtgtttgtagacttggaacccacagtcattgatgaagttcgcactggcacctaccgccagctcttccaccctgagcagctcatcacaggcaaggaagatgctgccaataactatgcccgagggcactacaccattggcaaggagatcattgaccttgtgttggaccgaattcgcaagctggctgaccagtgcaccggtcttcagggcttcttggttttccacagctttggtgggggaactggttctgggttcacctcccctgctcatggaacgtctctcagttgattatggcaagaagtccaagctggagttctccatttacccagcaccccaggtttccacagctgtagttgagccctacaactccatcctcaccacccacaccaccctggagcactctgattgtgccttcatggtagacaatgaggccatctatgacatctgtcgtagaaacctcgatatcgagcgcccaacctacactaaccttaaccgccttattagccagattgtgtcctccatcactgcttccctgagatttgatggagccctgaatgttgacctgacagaattccagaccaacctggtgccctactccccgcatccacttccctctggccacatatgcccctgtcatctctgctgagaaagcctaccatgaacagctttctgtagcagagatcaccaatgcttgctttgagccagccaaccagatggcgagggtcacatttcaccatctggttggctggctcaaagcaagcattggtgaaatgtgaccctcgccatggtaaatacatggcttgctgcctgttgtaccgtggtgacgtggttcccaaagatgtcaatgctgccattgccaccatcaaaaccaagcgcagcatccagtttgtggattggtgccccactggcttcaaggttggcatcaactaccagcctcccactgtggtgcctggtggagacctggccaaggtacagagagctgtgtgcatgctgagcaacaccacagccattgctgaggcctgggctcgcctggaccacaagtttgacctgatgtatgccaaacgtgcctttgttcactggtacgttggggaggggatggaggaaggtgagttttcagaggcccgtgaggacatggctgcccttgagaaggattatgaggaggttggtgtggattctgttgaaggagagggtgaggaagaaggagaggaatactaaagttaaaacgtcacaaaggtgctgcttttacagggaagcttattctgttttaaacattgaaaagttgtggtctgatcagttaatttgtatgtagcagtgtatgctctcatatacaattactgacctatgctctaaaacatgaatgctttgttacagacccaagctgtccatttctgtgatgggttttgaataaagtattccctgttttaaatg

SEQ ID NO: 488700 - DNA, 1452 bp, Homo sapiens
ggtaccgcgaacggtgcgttacttacctcgactcttagcttgtcggggacggtaaccgggacccggtgtctgctcctgtcgccttcgcctcctaatccctagccactatgcgtgagtgcatctccatccacgttggccaggctggtgtccagattggcaatgcctgctgggagctctactgcctggaacacggcatccagcccgatggccagatgccaagtgacaagaccattgggggaggagatgactccttcaacaccttcttcagtgagacgggcgctggcaagcacgtgccccggggctgtgtttgtagacttggaacccacagtcattgatgaagttcgcactggcacctaccgccagctcttccaccctgagcagctcatcacaggcaaggaagatgctgccaataactatgcccgagggcactacaccattggcaaggagatcattgaccttgtgttggaccgaattcgcaagctggctgaccagtgcaccggtcttcagggcttcttggttttccacagctttggtgggggaactggttctgggttcacctcccctgctcatggaacgtctctcagttgattatggcaagaagtccaagctggagttctccatttacccagcaccccaggtttccacagctgtagttgagccctacaactccatcctcaccacccacaccaccctggagcactctgattgtgccttcatggtagacaatgaggccatctatgacatctgtcgtagaaacctcgatatcgagcgcccaacctacactaaccttaaccgccttattagccagattgtgtcctccatcactgcttccctgagatttgatggagccctgaatgttgacctgacagaattccagaccaacctggtgccctactccccgcatccacttccctctggccacatatgcccctgtcatctctgctgagaaagcctaccatgaacagctttctgtagcagagatcaccaatgcttgctttgagccagccaaccagatggtgaaatgtgaccctcgccatggtaaatacatggcttgctgcctgttgtaccgtggtgacgtggttcccaaagatgtcaatgctgccattgccaccatcaaaaccaagcgcagcatccagtttgtggattggtgccccactggcttcaaggttggcatcaactaccagcctcccactgtggtgcctggtggagacctggccaaggtacagagagctgtgtgcatgctgagcaacaccacagccattgctgaggcctgggctcgcctggaccacaagtttgacctgatgtatgccaaacgtgcctttgttcactggtacgttggggaggggatggaggaaggtgagttttcagaggcccgtgaggacatgcctcgccctagatgaatggattatcaggcctccgtgccctggactctgtgttggctggcgcgtgaca

SEQ ID NO: 488701 - DNA, 212 bp, Homo sapiens
ctcaccttctatgtgacagcgtctggtgtctcctgattgtagctcctcagtctaagcgaacacaatggcgctcggaagcccgggggtcccaccagaaacttgcactcttcgcggggtttcgcgggttccccaggaaaatctctctccacccaaccgcgggaatattaggcactactggcagggaccctctctatttcgttctgcagcagagg

SEQ ID NO: 488702 - DNA, 2525 bp, Homo sapiens
  misc_feature (1709)..(1710): n is a, c, g, or t
ggtaccgcgaacggtgcgttacttacctcgactcttagcttgtcggggacggtaaccgggacccggtgtctgctcctgtcgccttcgcctcctaatccctagccactatgcgtgagtgcatctccatccacgttggccaggctggtgtccagattggcaatgcctgctgggagctctactgcctggaacacggcatccagcccgatggccagatgccaagtgacaagaccattgggggaggagatgactccttcaacaccttcttcagtgagacgggcgctggcaagcacgtgccccggggctgtgtttgtagacttggaacccacagtcattgatgaagttcgcactggcacctaccgccagctcttccaccctgagcagctcatcacaggcaaggaagatgctgccaataactatgcccgagggcactacaccattggcaaggagatcattgaccttgtgttggaccgaattcgcaagctggctgaccagtgcaccggtcttcagggcttcttggttttccacagctttggtgggggaactggttctgggttcacctcccctgctcatggaacgtctctcagttgattatggcaagaagtccaagctggagttctccatttacccagcaccccaggtttccacagctgtagttgagccctacaactccatcctcaccacccacaccaccctggagcactctgattgtgccttcatggtagacaatgaggccatctatgacatctgtcgtagaaacctcgatatcgagcgcccaacctacactaaccttaaccgccttattagccagtagtatgtgtgtccttaccatctacgtgcgttccgctgaggatttgagtggagcccatgaatgtttgacccttgacaagatattacacagactcaatagcgctcggatggcctcatactcaccactgacaatctcaacattctcacttcttgagctcgactaatatagctcaccttggtcatctctgctgagaaagcctaccatgaacagctttctgtagcagagatcaccaatgcttgctttgagccagccaaccagatggtgaaatgtgaccctcgccatggtaaatacatggcttgctgcctgttgtaccgtggtgacgtggttcccaaagatgtcaatgctgccattgccaccatcaaaaccaagcgcagcatccagtttgtggattggtgccccactggcttcaaggttggcatcaactaccagcctcccactgtggtgcctggtggagacctggccaaggtacagagagctgtgtgcatgctgagcaacaccacagccattgctgaggcctgggctcgcctggaccacaagtttgacctgatgtatgccaagcgtgcctttgttcactggtacgtgggtgaggggatggaggaaggcgagttttcagaggcccgtgaagatatggctgcccttgagaaggattatgaggaggttggtgtggattctgttgaaggagagggtgaggaagaaggagaggaatactaattatccattccttttggccctgcagcatgtcatgctcccagaatttcagcttcagcttaactgacagacgttaaagctttctggttagattgttttcacttggtgatcatgtcttttccatgtgtacctgtaatatttttccatcatatctcaaagtaaagtcattaacatccaaaaaaaaaaaaataannaaaaaaaaaaaaaaaaaaaaacaaacaaaaaaaaaaaaaaaaagaaacaaaaaaaaaaaacaaaaaaacaaaaaaaaaaacaaaaaaaaagaaaagcaaaaaacaacagaacaaaaaaaggagaagagaggggggggcggggcccgctaaaacattcctccgcgccgggggcgggcgcaccaacaccgcccccgcacgccggctctgatggacaggagaggcgccgcccccatacgaatgatgagagacataatatcaaacacgaccaggcgggcgcggcgcatgccacaaaccacaaacaccgctggagaggaacaaaaccaaacaaggaggagtgacactctcagctggaacgacgaccaccacccactttgtgtggcgggacgccaaacacggcgacacaccacccccacaacaaaatacccagcggcgcggagaaacaacaaaccgcacggcgagctagaggatgcaacaacaccaacacgttatctgtgcggagcgacagaaaatagcgacaagaggagacgagagaaaaaaaataatcgacgggcggcttgatgaaataaaccacgcgcagcgacagccagagcaacgacacgagaacgcccacgaccacagcccacgcccacccaccccaacgccacggaacaccgaaacgagaagaagcagacagacaccgcagcaccaccagaaccgaacaccgccgacacgacagcagcagagtacacccgccacacgaacaagcacgccaacgcagaacgaccgacagacaccaccgagcacggaacgaccggcaccacaagcaggagacaacc

SEQ ID NO: 488703 - DNA, 154 bp, Homo sapiens
atgcacccggctgagcctcccaaagtgctggcattacaggcatgagccactgtgcctggcgtagaaagtggggcttataatggaaaacaacacccagtctaactggtataacacctaaaaaatttcagatctgattttagatagacgcacagga

SEQ ID NO: 488704 - DNA, 435 bp, Homo sapiens
agaaagtgatgtctagctgacaactgacaatatggcacatatagatagtagtattttagatatctaaaataacaaaaagtctcacctgagaaatgtccaggcagcctgatatccctaagataacagcaaacactactgagcgctttctagataccggggacacttcgcgggactttttccacctctctatggcagagacagtttttcctattatcatcatgacccacatttcagaggagttggaggcatggaaagaggaaacaacttgcccgttccctctccgtgctataatttgtatacatcatcttttaaaacggacttttcggccaggcgcggtggctcacgcctgtaatcccagcactctgggaggccgaggcgggcagatcacgaggtcagatcaagaccatcctggtaacacgccaaaccccgtctcta

SEQ ID NO: 488705 - DNA, 1230 bp, Homo sapiens
gccgggcttccgcccggtctgccggcaacgctgcggccccgcccacgtcatggcgcccgaggagaacgcggggaccgaactcttgctgcagagtttcgagcgccgcttcctggcggccgctcactgcgctccttcccctggcagagcttagaagcaaagttaagagactcatcagattctgagctgctgcgggatattttgcagaagactgtgaagcatcctgtgtgtgtgaagcacccgccgtcagtcaagtatgcccggtgctttctctcagaactcatcaaaaagccctcgggaggctcggtcacactctccaagagcacagccatcatctcccacggtaccacaggcctggtcacatgggacgccgccctctaccttgcagaatgggccatcgagaacccggcagccttcactaacaggactgtcctagagcttggcagtggtgccggcctcacaggcctggccatctgcaagatgtgccgcccccgggcatacatcttcagcgactgtcacagccgggtcctcgagcagctccgagggaatgtccttctcaatggcctctcattagaggcagacatcactgccaacttagacagccccagggtgacagtggcccagctggactgggacgtcgcgacggtccatcagctctctgccttccagccagatgttgtcattgcagcagacgtgctgtattgcccagaagccatcgtgtcgctggtcggggtcctgcggaggctggctgcctgccgggagcaccagcgggctcctgaggtctacgtggcctttaccgtccgcaacccagagacgtgccagctgttcaccaccgagctaggccgggctgggatcagatgggaagtggaagctcgtcatgaccagaaactgtttccctacgaagagcacttggagatggcaatgctgaacctcacactgtaggactcacacacgactccaacgggattgtgagaatcaagtcactctcatgggaagaatttttatatgggaaagcggataaaactttcattggactggaatgtttggagaatgttaatttccaaatcaggaaccacaaactgccctctaataagacatcggctatctaagcgtgtgggtgccccctttctgccagcagttctggttcttaagaaaatcaccataaatcagacatgaaaattctggctccaaaaatagcattttctttgtgcaaataaaaacgtgtgtatcaag

SEQ ID NO: 488706 - DNA, 1152 bp, Homo sapiens
  misc_feature (1050)..(1050): n is a, c, g, or t
ggtaccgcgaacggtgcgttacttacctcgactcttagcttgtcggggacggtaaccgggacccggtgtctgctcctgtcgccttcgcctcctaatccctagccactatgcgtgagtgcatctccatccacgttggccaggctggtgtccagattggcaatgcctgctgggagctctactgcctggaacacggcatccagcccgatggccagatgccaagtgacaagaccattgggggaggagatgactccttcaacaccttcttcagtgagacgggcgctggcaagcacgtgccccggggctgtgtttgtagacttggaacccacagtcattgatgaagttcgcactggcacctaccgccagctcttccaccctgagcagctcatcacaggcaaggaagatgctgccaataactatgcccgagggcactacaccattggcaaggagatcattgaccttgtgttggaccgaattcgcaagctggctgaccagtgcaccggtcttcagggcttcttggttttccacagctttggtgggggaactggttctgggttcacctcccctgctcatggaacgtctctcagttgattatggcaagaagtccaagctggagttctccatttacccagcaccccaggtttccacagctgtagttgagccctacaactccatcctcaccacccacaccaccctggagcactctgattgtgccttcatggtagacaatgaggccatctatgacatctgtcgtagaaacctcgatatcgagcgcccaacctacactaaccttaaccgccttattagccagattgtgtcctccatcactgcttccctgagatttgatggagccctgaatgttgaccgttcacctaggaatttccatggaccagagcctggatgtcgccgtaacccccgcattccatctatcgccctctggcccacaatagtgcgcccttgttcactcgtcatagctgatgaatatgccttacccactgagatcaaagccttgacctgttaggcgatgaggatcgacgaaaaatggcgtatgcnttgtggacgtcagctcgaacaccagcatcggttgacacattgtggacgccctccgcccaatgggtaaaatcaccattggcgtttgcctagccctgtctgtac

SEQ ID NO: 488707 - DNA, 2507 bp, Homo sapiens
  misc_feature (864)..(864): n is a, c, g, or t
ggcacgaggagtaatcgttctggtcactgggacacagctgcgctcgcccattctaaaaagtcagcgccctcaggcccgcgggtaaccacctcctcctgagcgcggtgaccagagcttagaagcaaagttaagagactcatcagattctgagctgctgcgggatattttgcagaagactgtgaagcatcctgtgtgtgtgaagcacccgccgtcagtcaagtatgcccggtgctttctctcagaactcatcaaaaagccctcgggaggctcggtcacactctccaagagcacagccatcatctcccacggtaccacaggcctggtcacatgggacgccgccctctaccttgcagaatgggccatcgagaacccggcagccttcactaacaggactgtcctagagcttggcagtggtgccggcctcacaggcctggccatctgcaagatgtgccgcccccgggcatacatcttcagcgactgtcacagccgggtcctcgagcagctccgagggaatgtccttctcaatggcctctcattagaggcagacatcactgccaacttagacagccccagggtgacagtggcccagctggactgggacgtcgcgacggtccatcagctctctgccttccagccagatgttgtcattgcagcagacgtgctgtattgcccagaagccatcgtgtcgctggtcggggtcctgcggaggctggctgcctgccgggagcaccagcgggctcctgaggtctacgtggcctttaccgtccgcaacccagagacgtgccagctgttcaccaccgagctacgcctgtcctagcagccccacacaatacgctcatgtcctgtccccaaacaccgccatcntcaaacacatgtgctctgtttccaggccgggctgggatcagatgggaagtggaagctcgtcatgaccagaaactgtttccctacgaagagcacttggagatggcaatgctgaacctcacactgtaggactcacacacgactccaacgggattgtgagaatcaagtcactctcatgggaagaatttttatatgggaaagcggataaaactttcattggactggaatgtttggagaatgttaatttccaaatcaggaaccacaaactgccctctaataagacatcggctatctaagcgtgtgggtgccccctttctgccagcagttctggttcttaagaaaatcaccataaatcagacatgaaaattctggctccaaaaatagcattttctttgtgcaaataaaaacgtgtgtatcaagtatgatgttcccccaacgtggacacactcgttcctcacaaagccaagcccgctgcagctgccacatccctgggcttatggtgcagcaggtgcttttttcaagacaggaatcaaagtgttaggaacacggcagaaaggtgacacctggagaccaaatgcaggatgaggagtactgcagaggtcacagggaagtcacagaacagtaatacgctagcaggggcatggggcatgaagaacagaagacaggaagcgtttcagagactccaaagaagaaatcagggccaaccacagcttcccgggtcacagaacaattcattcaccaggtggcaccactgccgtcatttcagcttctggccactgggaggcgctgctcgaaagggtttgccctgagactccaagaagaagctgcgggaaggacagcaggggccctggggttttagcctctggcccaggagttatgtgtccataaccaaagggagcacagtctgcacccagctctcatcccatcagagctgctgcgactcccgcaggttcttccggaactggtttagcttgcctgcaggatcaggaaagtttgagaaaagcatctgcaaaatactaaagagcagagcttacctcattgcctgtccccaccccatcccaggtcaccacctggctgaccccaggtccccgacccaacaacaacccctcccaagtccctaactccctcacttggactcgagacccttcacaccccagcagcactccgcctccaacttgacatcacagtttctggaaacttccccgcatgtcccactttcccacacttggtgccctggagcacctcccggcctctacgtgctgcccattcccctgtgagcaccctcctctcggcctctggccaacacagtcccacccatctgtgggtaacaagggggtgtcggtgttcttttcagccttgctaaactgtctgaatcaaggatcacaaactacagcctgcaggccaaatccagcccacagcctgtgtttgtaaataaagctttattggaacaaagccacaccccttaatctacagatgatctgtggctactttcacaccacaacagagtaccatggttctgacagagactgggggaccctgtctaaatgacttctgacctggacctttactgaaaatcctcccaatcattctgttgacaagaatgatgtattactttttgcaataagaaacaagtaacctttgcaaaa

SEQ ID NO: 488708 - DNA, 2467 bp, Homo sapiens
  misc_feature (1651)..(1652): n is a, c, g, or t
ggcaggttcgcttacatcgaccgcctaagagtcgcgctgtaagaagcaacaacctctcctcttcgtctccgccatcagctcggcagtcgcgaagcagcaaccatgcgtgagtgcatctccatccacgttggccaggctggtgtccagattggcaatgcctgctgggagctctactgcctggaacacggcatccagcccgatggccagatgccaagtgacaagaccattgggggaggagatgactccttcaacaccttcttcagtgagacgggcgctggcaagcacgtgccccggggctgtgtttgtagacttggaacccacagtcattgatgaagttcgcactggcacctaccgccagctcttccaccctgagcagctcatcacaggcaaggaagatgctgccaataactatgcccgagggcactacaccattggcaaggagatcattgaccttgtgttggaccgaattcgcaagctggctgaccagtgcaccggtcttcagggcttcttggttttccacagctttggtgggggaactggttctgggttcacctcccctgctcatggaacgtctctcagttgattatggcaagaagtccaagctggagttctccatttacccagcaccccaggtttccacagctgtagttgagccctacaactccatcctcaccacccacaccaccctggagcactctgattgtgccttcatggtagacaatgaggccatctatgacatctgtcgtagaaacctcgatatcgagcgcccaacctacactaaccttaaccgccttattagccagattgtgtcctccatcactgcttccctgagatttgatggagccctgaatgttgacctgacagaattccagaccaacctggtgccctactccccgcatccacttccctctggccacatatgcccctgtcatctctgctgagaaagcctaccatgaacagctttctgtagcagagatcaccaatgcttgctttgagccagccaaccagatggtgaaatgtgaccctcgccatggtaaatacatggcttgctgcctgttgtaccgtggtgacgtggttcccaaagatgtcaatgctgccattgccaccatcaaaaccaagcgcagcatccagtttgtggattggtgccccactggcttcaaggttggcatcaactaccagcctcccactgtggtgcctggtggagacctggccaaggtacagagagctgtgtgcatgctgagcaacaccacagccattgctgaggcctgggctcgcctggaccacaagtttgacctgatgtatgccaagcgtgcctttgttcactggtacgtgggtgaggggatggaggaaggcgagttttcagaggcccgtgaagatatggctgcccttgagaaggattatgaggaggttggtgtggattctgttgaaggagagggtgaggaagaaggagaggaatactaattatccattccttttggccctgcagcatgtcatgctcccagaatttcagcttcagcttaactgacagacgttaaagctttctggttagattgttttcacttggtgatcatgtcttttccatgtgtacctgtaatatttttccatcatatctcaaagtaaagtcattaacatccaaaaaaaaaaaaataannaaaaaaaaaaaaaaaaaaaaacaaacaaaaaaaaaaaaaaaaagaaacaaaaaaaaaaaacaaaaaaacaaaaaaaaaaacaaaaaaaaagaaaagcaaaaaacaacagaacaaaaaaaggagaagagaggggggggcggggcccgctaaaacattcctccgcgccgggggcgggcgcaccaacaccgcccccgcacgccggctctgatggacaggagaggcgccgcccccatacgaatgatgagagacataatatcaaacacgaccaggcgggcgcggcgcatgccacaaaccacaaacaccgctggagaggaacaaaaccaaacaaggaggagtgacactctcagctggaacgacgaccaccacccactttgtgtggcgggacgccaaacacggcgacacaccacccccacaacaaaatacccagcggcgcggagaaacaacaaaccgcacggcgagctagaggatgcaacaacaccaacacgttatctgtgcggagcgacagaaaatagcgacaagaggagacgagagaaaaaaaataatcgacgggcggcttgatgaaataaaccacgcgcagcgacagccagagcaacgacacgagaacgcccacgaccacagcccacgcccacccaccccaacgccacggaacaccgaaacgagaagaagcagacagacaccgcagcaccaccagaaccgaacaccgccgacacgacagcagcagagtacacccgccacacgaacaagcacgccaacgcagaacgaccgacagacaccaccgagcacggaacgaccggcaccacaagcaggagacaacc

SEQ ID NO: 488709 - DNA, 2187 bp, Homo sapiens
gccgggcttccgcccggtctgccggcaacgctgcggccccgcccacgtcatggcgcccgaggagaacgcggggaccgaactcttgctgcagagtttcgagcgccgcttcctggcggccgctcactgcgctccttcccctggcagagcttagaagcaaagttaagagactcatcagattctgagctgctgcgggatattttgcagaagactgtgaagcatcctgtgtgtgtgaagcacccgccgtcagtcaagtatgcccggtgctttctctcagaactcatcaaaaaggaaaaagattagaacgaaagcaaacaagctctcactcagcctgcccccagcacgaggctgtccacacagagcctttggacgagctgtacgaggtgctggcggagactttgatggccaaggagtccacccagggccactggagctatttgctgccctcgggaggctcggtcacactctccaagagcacagccatcatctcccacggtaccacaggcctggtcacatgggacgccgccctctaccttgcagaatgggccatcgagaacccggcagccttcaaggccgggctgggatcagatgggaagtggaagctcgtcatgaccagaaactgtttccctacgaagagcacttggagatggcaatgctgaacctcacactgtaggactcacacacgactccaacgggattgtgagaatcaagtcactctcatgggaagaatttttatatgggaaagcggataaaactttcattggactggaatgtttggagaatgttaatttccaaatcaggaaccacaaactgccctctaataagacatcggctatctaagcgtgtgggtgccccctttctgccagcagttctggttcttaagaaaatcaccataaatcagacatgaaaattctggctccaaaaatagcattttctttgtgcaaataaaaacgtgtgtatcaagtatgatgttcccccaacgtggacacactcgttcctcacaaagccaagcccgctgcagctgccacatccctgggcttatggtgcagcaggtgcttttttcaagacaggaatcaaagtgttaggaacacggcagaaaggtgacacctggagaccaaatgcaggatgaggagtactgcagaggtcacagggaagtcacagaacagtaatacgctagcaggggcatggggcatgaagaacagaagacaggaagcgtttcagagactccaaagaagaaatcagggccaaccacagcttcccgggtcacagaacaattcattcaccaggtggcaccactgccgtcatttcagcttctggccactgggaggcgctgctcgaaagggtttgccctgagactccaagaagaagctgcgggaaggacagcaggggccctggggttttagcctctggcccaggagttatgtgtccataaccaaagggagcacagtctgcacccagctctcatcccatcagagctgctgcgactcccgcaggttcttccggaactggtttagcttgcctgcaggatcaggaaagtttgagaaaagcatctgcaaaatactaaagagcagagcttacctcattgcctgtccccaccccatcccaggtcaccacctggctgaccccaggtccccgacccaacaacaacccctcccaagtccctaactccctcacttggactcgagacccttcacaccccagcagcactccgcctccaacttgacatcacagtttctggaaacttccccgcatgtcccactttcccacacttggtgccctggagcacctcccggcctctacgtgctgcccattcccctgtgagcaccctcctctcggcctctggccaacacagtcccacccatctgtgggtaacaagggggtgtcggtgttcttttcagccttgctaaactgtctgaatcaaggatcacaaactacagcctgcaggccaaatccagcccacagcctgtgtttgtaaataaagctttattggaacaaagccacaccccttaatctacagatgatctgtggctactttcacaccacaacagagtaccatggttctgacagagactgggggaccctgtctaaatgacttctgacctggacctttactgaaaatcctcccaatcattctgttgacaagaatgatgtattactttttgcaataagaaacaagtaacctttgcaaaa

SEQ ID NO: 488710 - DNA, 2466 bp, Homo sapiens
  misc_feature (1650)..(1651): n is a, c, g, or t
ggcaggttcgcttacatcgaccgcctaagagtcgcgctgtaagaagcaacaacctctcctcttcgtctccgccatcagctcggcagtcgcgaagcagcaaccatgcgtgagtgcatctccatccacgttggccaggctggtgtccagattggcaatgcctgctgggagctctactgcctggaacacggcatccagcccgatggccagatgccaagtgacaagaccattgggggaggagatgattccttcaacaccttcttcagtgagacgggggctggcaagcatgtgccccgggcagtgtttgtagacttggaacccacagtcattgatgaagttcgcactggcacctaccgccagctcttccaccctgagcagctcatcacaggcaaggaagatgctgccaataactatgcccgagggcactacaccattggcaaggagatcattgaccttgtgttggaccgaattcgcaagctggctgaccagtgcaccggtcttcagggcttcttggttttccacagctttggtgggggaactggttctgggttcacctcccctgctcatggaacgtctctcagttgattatggcaagaagtccaagctggagttctccatttacccagcaccccaggtttccacagctgtagttgagccctacaactccatcctcaccacccacaccaccctggagcactctgattgtgccttcatggtagacaatgaggccatctatgacatctgtcgtagaaacctcgatatcgagcgcccaacctacactaaccttaaccgccttattagccagattgtgtcctccatcactgcttccctgagatttgatggagccctgaatgttgacctgacagaattccagaccaacctggtgccctactccccgcatccacttccctctggccacatatgcccctgtcatctctgctgagaaagcctaccatgaacagctttctgtagcagagatcaccaatgcttgctttgagccagccaaccagatggtgaaatgtgaccctcgccatggtaaatacatggcttgctgcctgttgtaccgtggtgacgtggttcccaaagatgtcaatgctgccattgccaccatcaaaaccaagcgcagcatccagtttgtggattggtgccccactggcttcaaggttggcatcaactaccagcctcccactgtggtgcctggtggagacctggccaaggtacagagagctgtgtgcatgctgagcaacaccacagccattgctgaggcctgggctcgcctggaccacaagtttgacctgatgtatgccaagcgtgcctttgttcactggtacgtgggtgaggggatggaggaaggcgagttttcagaggcccgtgaagatatggctgcccttgagaaggattatgaggaggttggtgtggattctgttgaaggagagggtgaggaagaaggagaggaatactaattatccattccttttggccctgcagcatgtcatgctcccagaatttcagcttcagcttaactgacagacgttaaagctttctggttagattgttttcacttggtgatcatgtcttttccatgtgtacctgtaatatttttccatcatatctcaaagtaaagtcattaacatccaaaaaaaaaaaaataannaaaaaaaaaaaaaaaaaaaaacaaacaaaaaaaaaaaaaaaaagaaacaaaaaaaaaaaacaaaaaaacaaaaaaaaaaacaaaaaaaaagaaaagcaaaaaacaacagaacaaaaaaaggagaagagaggggggggcggggcccgctaaaacattcctccgcgccgggggcgggcgcaccaacaccgcccccgcacgccggctctgatggacaggagaggcgccgcccccatacgaatgatgagagacataatatcaaacacgaccaggcgggcgcggcgcatgccacaaaccacaaacaccgctggagaggaacaaaaccaaacaaggaggagtgacactctcagctggaacgacgaccaccacccactttgtgtggcgggacgccaaacacggcgacacaccacccccacaacaaaatacccagcggcgcggagaaacaacaaaccgcacggcgagctagaggatgcaacaacaccaacacgttatctgtgcggagcgacagaaaatagcgacaagaggagacgagagaaaaaaaataatcgacgggcggcttgatgaaataaaccacgcgcagcgacagccagagcaacgacacgagaacgcccacgaccacagcccacgcccacccaccccaacgccacggaacaccgaaacgagaagaagcagacagacaccgcagcaccaccagaaccgaacaccgccgacacgacagcagcagagtacacccgccacacgaacaagcacgccaacgcagaacgaccgacagacaccaccgagcacggaacgaccggcaccacaagcaggagacaacc

SEQ ID NO: 488711 - DNA, 318 bp, Homo sapiens
  misc_feature (164)..(164): n is a, c, g, or t
  misc_feature (202)..(202): n is a, c, g, or t
aattttccctaaaggcagggatttttaacctggataaaagcccggggtaaccctgaacttgatggaaaaaaatgttccctctttattttcaccaaagaaactgaaatttagcccttctccccagttataaatggtggccccaaatccccgtagtaaaaacaggncctggggttttcccccccaaaccaacccgttccagccnctgtaatgtaacataaaaagggcctcttgaaggattgttcaaatttgtccccccttggaaagaaaaccgatcccgtaagttgatgttttaattaaaaagcccctatttttctgcca

SEQ ID NO: 488712 - DNA, 1794 bp, Homo sapiens
  misc_feature (151)..(151): n is a, c, g, or t
accatgactcagaagaggcattctaggtacctgggtgggactgggaaactgtgaaacaagtagactgacttggacactcccccaccacaccacgcctgtcctagcagccccacacaatacgctcatgtcctgtccccaaacaccgccatcntcaaacacatgtgctctgtttccaggccgggctgggatcagatgggaagtggaagctcgtcatgaccagaaactgtttccctacgaagagcacttggagatggcaatgctgaacctcacactgtaggactcacacacgactccaacgggattgtgagaatcaagtcactctcatgggaagaatttttatatgggaaagcggataaaactttcattggactggaatgtttggagaatgttaatttccaaatcaggaaccacaaactgccctctaataagacatcggctatctaagcgtgtgggtgccccctttctgccagcagttctggttcttaagaaaatcaccataaatcagacatgaaaattctggctccaaaaatagcattttctttgtgcaaataaaaacgtgtgtatcaagtatgatgttcccccaacgtggacacactcgttcctcacaaagccaagcccgctgcagctgccacatccctgggcttatggtgcagcaggtgcttttttcaagacaggaatcaaagtgttaggaacacggcagaaaggtgacacctggagaccaaatgcaggatgaggagtactgcagaggtcacagggaagtcacagaacagtaatacgctagcaggggcatggggcatgaagaacagaagacaggaagcgtttcagagactccaaagaagaaatcagggccaaccacagcttcccgggtcacagaacaattcattcaccaggtggcaccactgccgtcatttcagcttctggccactgggaggcgctgctcgaaagggtttgccctgagactccaagaagaagctgcgggaaggacagcaggggccctggggttttagcctctggcccaggagttatgtgtccataaccaaagggagcacagtctgcacccagctctcatcccatcagagctgctgcgactcccgcaggttcttccggaactggtttagcttgcctgcaggatcaggaaagtttgagaaaagcatctgcaaaatactaaagagcagagcttacctcattgcctgtccccaccccatcccaggtcaccacctggctgaccccaggtccccgacccaacaacaacccctcccaagtccctaactccctcacttggactcgagacccttcacaccccagcagcactccgcctccaacttgacatcacagtttctggaaacttccccgcatgtcccactttcccacacttggtgccctggagcacctcccggcctctacgtgctgcccattcccctgtgagcaccctcctctcggcctctggccaacacagtcccacccatctgtgggtaacaagggggtgtcggtgttcttttcagccttgctaaactgtctgaatcaaggatcacaaactacagcctgcaggccaaatccagcccacagcctgtgtttgtaaataaagctttattggaacaaagccacaccccttaatctacagatgatctgtggctactttcacaccacaacagagtaccatggttctgacagagactgggggaccctgtctaaatgacttctgacctggacctttactgaaaatcctcccaatcattctgttgacaagaatgatgtattactttttgcaataagaaacaagtaacctttgcaaaa

SEQ ID NO: 488713 - DNA, 2460 bp, Homo sapiens
  misc_feature (1644)..(1645): n is a, c, g, or t
ggtaccgcgaacggtgcgttacttacctcgactcttagcttgtcggggacggtaaccgggacccggtgtctgctcctgtcgccttcgcctcctaatccctagccactatgcgtgagtgcatctccatccacgttggccaggctggtgtccagattggcaatgcctgctgggagctctactgcctggaacacggcatccagcccgatggccagatgccaagtgacaagaccattgggggaggagatgaccttcttcagtgagacgggcgctggcaagcacgtgccccgggctgtgtttgtagacttggaacccacagtcattgatgaagttcgcactggcacctaccgccagctcttccaccctgagcagctcatcacaggcaaggaagatgctgccaataactatgcccgagggcactacaccattggcaaggagatcattgaccttgtgttggaccgaattcgcaagctggctgaccagtgcaccggtcttcagggcttcttggttttccacagctttggtgggggaactggttctgggttcacctcccctgctcatggaacgtctctcagttgattatggcaagaagtccaagctggagttctccatttacccagcaccccaggtttccacagctgtagttgagccctacaactccatcctcaccacccacaccaccctggagcactctgattgtgccttcatggtagacaatgaggccatctatgacatctgtcgtagaaacctcgatatcgagcgcccaacctacactaaccttaaccgccttattagccagattgtgtcctccatcactgcttccctgagatttgatggagccctgaatgttgacctgacagaattccagaccaacctggtgccctactccccgcatccacttccctctggccacatatgcccctgtcatctctgctgagaaagcctaccatgaacagctttctgtagcagagatcaccaatgcttgctttgagccagccaaccagatggtgaaatgtgaccctcgccatggtaaatacatggcttgctgcctgttgtaccgtggtgacgtggttcccaaagatgtcaatgctgccattgccaccatcaaaaccaagcgcagcatccagtttgtggattggtgccccactggcttcaaggttggcatcaactaccagcctcccactgtggtgcctggtggagacctggccaaggtacagagagctgtgtgcatgctgagcaacaccacagccattgctgaggcctgggctcgcctggaccacaagtttgacctgatgtatgccaagcgtgcctttgttcactggtacgtgggtgaggggatggaggaaggcgagttttcagaggcccgtgaagatatggctgcccttgagaaggattatgaggaggttggtgtggattctgttgaaggagagggtgaggaagaaggagaggaatactaattatccattccttttggccctgcagcatgtcatgctcccagaatttcagcttcagcttaactgacagacgttaaagctttctggttagattgttttcacttggtgatcatgtcttttccatgtgtacctgtaatatttttccatcatatctcaaagtaaagtcattaacatccaaaaaaaaaaaaataannaaaaaaaaaaaaaaaaaaaaacaaacaaaaaaaaaaaaaaaaagaaacaaaaaaaaaaaacaaaaaaacaaaaaaaaaaacaaaaaaaaagaaaagcaaaaaacaacagaacaaaaaaaggagaagagaggggggggcggggcccgctaaaacattcctccgcgccgggggcgggcgcaccaacaccgcccccgcacgccggctctgatggacaggagaggcgccgcccccatacgaatgatgagagacataatatcaaacacgaccaggcgggcgcggcgcatgccacaaaccacaaacaccgctggagaggaacaaaaccaaacaaggaggagtgacactctcagctggaacgacgaccaccacccactttgtgtggcgggacgccaaacacggcgacacaccacccccacaacaaaatacccagcggcgcggagaaacaacaaaccgcacggcgagctagaggatgcaacaacaccaacacgttatctgtgcggagcgacagaaaatagcgacaagaggagacgagagaaaaaaaataatcgacgggcggcttgatgaaataaaccacgcgcagcgacagccagagcaacgacacgagaacgcccacgaccacagcccacgcccacccaccccaacgccacggaacaccgaaacgagaagaagcagacagacaccgcagcaccaccagaaccgaacaccgccgacacgacagcagcagagtacacccgccacacgaacaagcacgccaacgcagaacgaccgacagacaccaccgagcacggaacgaccggcaccacaagcaggagacaacc

SEQ ID NO: 488714 - DNA, 421 bp, Homo sapiens
  misc_feature (21)..(21): n is a, c, g, or t
  misc_feature (83)..(83): n is a, c, g, or t
tttttccccaaagatttgttngggagtaggaggaatggcaaaatcttaagactttaaaattagatttttttctgagacgaagntcgctctatcacacagggctggagtgcaatggcatgatctcagctcactgcaacctctacctcctggattcaagtgcttctcccacctcagcctccccagtagctaggacaacaggcgcacgcacccacgcttggctaagtttttgtatttagtagagacggggtttcaccattttggccaggctggtctctaactcctgacctcaagtgatccactgcacccggcctaaaattagattttattaaaattattttctaggctgggcgcagtggctcacacctgtaatcccagcactttgggaggccaaggcaggcggatcacctgaggtcggggagtt

SEQ ID NO: 488715 - DNA, 1651 bp, Homo sapiens
  misc_feature (12)..(12): n is a, c, g, or t
  misc_feature (37)..(37): n is a, c, g, or t
  misc_feature (66)..(66): n is a, c, g, or t
gggattgggccngaagtagcatgttcccggccgccangggcggccggggggattggattaagcctngtcatgaccagaaactgtttccctacgaagagcacttggagatggcaatgctgaacctcacactgtaggactcacacacgactccaacgggattgtgagaatcaagtcactctcatgggaagaatttttatatgggaaagcggataaaactttcattggactggaatgtttggagaatgttaatttccaaatcaggaaccacaaactgccctctaataagacatcggctatctaagcgtgtgggtgccccctttctgccagcagttctggttcttaagaaaatcaccataaatcagacatgaaaattctggctccaaaaatagcattttctttgtgcaaataaaaacgtgtgtatcaagtatgatgttcccccaacgtggacacactcgttcctcacaaagccaagcccgctgcagctgccacatccctgggcttatggtgcagcaggtgcttttttcaagacaggaatcaaagtgttaggaacacggcagaaaggtgacacctggagaccaaatgcaggatgaggagtactgcagaggtcacagggaagtcacagaacagtaatacgctagcaggggcatggggcatgaagaacagaagacaggaagcgtttcagagactccaaagaagaaatcagggccaaccacagcttcccgggtcacagaacaattcattcaccaggtggcaccactgccgtcatttcagcttctggccactgggaggcgctgctcgaaagggtttgccctgagactccaagaagaagctgcgggaaggacagcaggggccctggggttttagcctctggcccaggagttatgtgtccataaccaaagggagcacagtctgcacccagctctcatcccatcagagctgctgcgactcccgcaggttcttccggaactggtttagcttgcctgcaggatcaggaaagtttgagaaaagcatctgcaaaatactaaagagcagagcttacctcattgcctgtccccaccccatcccaggtcaccacctggctgaccccaggtccccgacccaacaacaacccctcccaagtccctaactccctcacttggactcgagacccttcacaccccagcagcactccgcctccaacttgacatcacagtttctggaaacttccccgcatgtcccactttcccacacttggtgccctggagcacctcccggcctctacgtgctgcccattcccctgtgagcaccctcctctcggcctctggccaacacagtcccacccatctgtgggtaacaagggggtgtcggtgttcttttcagccttgctaaactgtctgaatcaaggatcacaaactacagcctgcaggccaaatccagcccacagcctgtgtttgtaaataaagctttattggaacaaagccacaccccttaatctacagatgatctgtggctactttcacaccacaacagagtaccatggttctgacagagactgggggaccctgtctaaatgacttctgacctggacctttactgaaaatcctcccaatcattctgttgacaagaatgatgtattactttttgcaataagaaacaagtaacctttgcaaaa

SEQ ID NO: 488716 - DNA, 1901 bp, Homo sapiens
  misc_feature (329)..(329): n is a, c, g, or t
  misc_feature (431)..(431): n is a, c, g, or t
  misc_feature (495)..(495): n is a, c, g, or t
  misc_feature (501)..(501): n is a, c, g, or t
  misc_feature (505)..(505): n is a, c, g, or t
  misc_feature (518)..(518): n is a, c, g, or t
  misc_feature (528)..(528): n is a, c, g, or t
  misc_feature (535)..(536): n is a, c, g, or t
  misc_feature (553)..(553): n is a, c, g, or t
  misc_feature (580)..(580): n is a, c, g, or t
  misc_feature (587)..(588): n is a, c, g, or t
gggagggaaacatttccccagaaccattatgccatgttccaaatcaggctgggaccgatgcaaagcctcttccttaaaatgccagcttcctccctggacacatggtttcttcaaaagcaagcccattcaagttgcaaatcctggacacattggttcctcaaaagccaagccgttcaagttgcacatcgttgacacatcgggtcctcaaaaagcaagccgttgcagttgcacatcggtgacacatcgatcctcacaagccaagccattgcagttccacatccctgacacatcggttcttcacaaagcaagcccgctgcagctgcacatcntggacacatcggttcttcacaaagccaagcccgctgcagctgccacatccctggacacactcggttcctcacaaagccaagcccgctgcagctgccacatcnctggacacactcggttcctcacaaagccaagcccgctgcagctgccacatcggtggacacactnggttcntcanaaagccaagcccnctgcagctgncacatcnntggacacactcggttcntcacaaagccaagcccgctgcagctgncacatcnntggacacactcggttcctcagaaagccaagcccgctgcagctgccacatccctggacacactcggttcctcacaaagccaagcccgctgcagctgccacatccctggacacactcggttcctcacaaagccaagcccgctgcagctgccacatccctgggcttatggtgcagcaggtgcttttttcaagacaggaatcaaagtgttaggaacacggcagaaaggtgacacctggagaccaaatgcaggatgaggagtactgcagaggtcacagggaagtcacagaacagtaatacgctagcaggggcatggggcatgaagaacagaagacaggaagcgtttcagagactccaaagaagaaatcagggccaaccacagcttcccgggtcacagaacaattcattcaccaggtggcaccactgccgtcatttcagcttctggccactgggaggcgctgctcgaaagggtttgccctgagactccaagaagaagctgcgggaaggacagcaggggccctggggttttagcctctggcccaggagttatgtgtccataaccaaagggagcacagtctgcacccagctctcatcccatcagagctgctgcgactcccgcaggttcttccggaactggtttagcttgcctgcaggatcaggaaagtttgagaaaagcatctgcaaaatactaaagagcagagcttacctcattgcctgtccccaccccatcccaggtcaccacctggctgaccccaggtccccgacccaacaacaacccctcccaagtccctaactccctcacttggactcgagacccttcacaccccagcagcactccgcctccaacttgacatcacagtttctggaaacttccccgcatgtcccactttcccacacttggtgccctggagcacctcccggcctctacgtgctgcccattcccctgtgagcaccctcctctcggcctctggccaacacagtcccacccatctgtgggtaacaagggggtgtcggtgttcttttcagccttgctaaactgtctgaatcaaggatcacaaactacagcctgcaggccaaatccagcccacagcctgtgtttgtaaataaagctttattggaacaaagccacaccccttaatctacagatgatctgtggctactttcacaccacaacagagtaccatggttctgacagagactgggggaccctgtctaaatgacttctgacctggacctttactgaaaatcctcccaatcattctgttgacaagaatgatgtattactttttgcaataagaaacaagtaacctttgcaaaa

SEQ ID NO: 488717 - DNA, 1682 bp, Homo sapiens
  misc_feature (1019)..(1019): n is a, c, g, or t
  misc_feature (1026)..(1026): n is a, c, g, or t
  misc_feature (1028)..(1028): n is a, c, g, or t
  misc_feature (1033)..(1034): n is a, c, g, or t
  misc_feature (1038)..(1038): n is a, c, g, or t
  misc_feature (1049)..(1050): n is a, c, g, or t
  misc_feature (1054)..(1054): n is a, c, g, or t
  misc_feature (1057)..(1059): n is a, c, g, or t
  misc_feature (1067)..(1068): n is a, c, g, or t
  misc_feature (1071)..(1071): n is a, c, g, or t
  misc_feature (1074)..(1074): n is a, c, g, or t
  misc_feature (1076)..(1076): n is a, c, g, or t
  misc_feature (1079)..(1079): n is a, c, g, or t
  misc_feature (1084)..(1084): n is a, c, g, or t
  misc_feature (1089)..(1089): n is a, c, g, or t
  misc_feature (1092)..(1092): n is a, c, g, or t
  misc_feature (1094)..(1094): n is a, c, g, or t
  misc_feature (1099)..(1099): n is a, c, g, or t
  misc_feature (1101)..(1102): n is a, c, g, or t
  misc_feature (1108)..(1108): n is a, c, g, or t
  misc_feature (1111)..(1111): n is a, c, g, or t
  misc_feature (1125)..(1125): n is a, c, g, or t
  misc_feature (1129)..(1130): n is a, c, g, or t
  misc_feature (1133)..(1134): n is a, c, g, or t
  misc_feature (1136)..(1136): n is a, c, g, or t
  misc_feature (1140)..(1143): n is a, c, g, or t
  misc_feature (1146)..(1148): n is a, c, g, or t
  misc_feature (1150)..(1153): n is a, c, g, or t
  misc_feature (1157)..(1159): n is a, c, g, or t
  misc_feature (1163)..(1163): n is a, c, g, or t
  misc_feature (1166)..(1167): n is a, c, g, or t
  misc_feature (1169)..(1171): n is a, c, g, or t
  misc_feature (1174)..(1174): n is a, c, g, or t
  misc_feature (1182)..(1182): n is a, c, g, or t
  misc_feature (1185)..(1186): n is a, c, g, or t
  misc_feature (1188)..(1189): n is a, c, g, or t
  misc_feature (1194)..(1194): n is a, c, g, or t
  misc_feature (1196)..(1207): n is a, c, g, or t
  misc_feature (1209)..(1209): n is a, c, g, or t
  misc_feature (1211)..(1212): n is a, c, g, or t
  misc_feature (1214)..(1214): n is a, c, g, or t
  misc_feature (1216)..(1217): n is a, c, g, or t
  misc_feature (1220)..(1222): n is a, c, g, or t
  misc_feature (1224)..(1224): n is a, c, g, or t
  misc_feature (1226)..(1226): n is a, c, g, or t
  misc_feature (1228)..(1228): n is a, c, g, or t
  misc_feature (1230)..(1231): n is a, c, g, or t
  misc_feature (1233)..(1233): n is a, c, g, or t
  misc_feature (1235)..(1236): n is a, c, g, or t
  misc_feature (1240)..(1241): n is a, c, g, or t
  misc_feature (1243)..(1244): n is a, c, g, or t
  misc_feature (1252)..(1252): n is a, c, g, or t
  misc_feature (1259)..(1259): n is a, c, g, or t
  misc_feature (1262)..(1264): n is a, c, g, or t
  misc_feature (1268)..(1268): n is a, c, g, or t
  misc_feature (1273)..(1274): n is a, c, g, or t
  misc_feature (1279)..(1279): n is a, c, g, or t
  misc_feature (1283)..(1283): n is a, c, g, or t
  misc_feature (1286)..(1286): n is a, c, g, or t
  misc_feature (1292)..(1292): n is a, c, g, or t
  misc_feature (1295)..(1295): n is a, c, g, or t
  misc_feature (1298)..(1300): n is a, c, g, or t
  misc_feature (1304)..(1304): n is a, c, g, or t
  misc_feature (1309)..(1310): n is a, c, g, or t
  misc_feature (1314)..(1315): n is a, c, g, or t
  misc_feature (1318)..(1320): n is a, c, g, or t
  misc_feature (1322)..(1324): n is a, c, g, or t
  misc_feature (1326)..(1326): n is a, c, g, or t
  misc_feature (1328)..(1328): n is a, c, g, or t
  misc_feature (1330)..(1331): n is a, c, g, or t
  misc_feature (1334)..(1335): n is a, c, g, or t
  misc_feature (1338)..(1341): n is a, c, g, or t
  misc_feature (1343)..(1346): n is a, c, g, or t
  misc_feature (1349)..(1350): n is a, c, g, or t
  misc_feature (1352)..(1353): n is a, c, g, or t
  misc_feature (1356)..(1356): n is a, c, g, or t
  misc_feature (1359)..(1359): n is a, c, g, or t
  misc_feature (1362)..(1362): n is a, c, g, or t
  misc_feature (1364)..(1364): n is a, c, g, or t
  misc_feature (1366)..(1366): n is a, c, g, or t
  misc_feature (1368)..(1368): n is a, c, g, or t
  misc_feature (1370)..(1373): n is a, c, g, or t
  misc_feature (1375)..(1376): n is a, c, g, or t
  misc_feature (1379)..(1380): n is a, c, g, or t
  misc_feature (1385)..(1385): n is a, c, g, or t
  misc_feature (1389)..(1390): n is a, c, g, or t
  misc_feature (1392)..(1393): n is a, c, g, or t
  misc_feature (1395)..(1395): n is a, c, g, or t
  misc_feature (1397)..(1397): n is a, c, g, or t
  misc_feature (1400)..(1401): n is a, c, g, or t
  misc_feature (1409)..(1410): n is a, c, g, or t
  misc_feature (1412)..(1414): n is a, c, g, or t
  misc_feature (1416)..(1417): n is a, c, g, or t
  misc_feature (1420)..(1422): n is a, c, g, or t
  misc_feature (1424)..(1424): n is a, c, g, or t
  misc_feature (1427)..(1427): n is a, c, g, or t
  misc_feature (1430)..(1430): n is a, c, g, or t
  misc_feature (1434)..(1435): n is a, c, g, or t
  misc_feature (1439)..(1442): n is a, c, g, or t
  misc_feature (1446)..(1446): n is a, c, g, or t
  misc_feature (1453)..(1453): n is a, c, g, or t
  misc_feature (1455)..(1455): n is a, c, g, or t
  misc_feature (1461)..(1461): n is a, c, g, or t
  misc_feature (1464)..(1464): n is a, c, g, or t
  misc_feature (1468)..(1468): n is a, c, g, or t
ggtaccgcgaacggtgcgttacttacctcgactcttagcttgtcggggacggtaaccgggacccggtgtctgctcctgtcgccttcgcctcctaatccctagccactatgcgtgagtgcatctccatccacgttggccaggctggtgtccagattggcaatgcctgctgggagctctactgcctggaacacggcatccagcccgatggccagatgccaagtgacaagaccattgggggaggagatgactccttcaacaccttcttcagtgagacgggcgctggcaagcacgtgccccggggctgtgtttgtagacttggaacccacagtcattgatgaagttcgcactggcacctaccgccagctcttccaccctgagcagctcatcacaggcaaggaagatgctgccaataactatgcccgagggcactacaccattggcaaggagatcattgaccttgtgttggaccgaattcgcaagctggctgaccagtgcaccggtcttcagggcttcttggttttccacagctttggtgggggaactggttctgggttcacctcccctgctcatggaacgtctctcagttgattatggcaagaagtccaagctggagttctccatttacccagcaccccaggtttccacagctgtagttgagccctacaactccatcctcaccacccacaccaccctggagcactctgattgtgccttcatggtagacaatgaggccatctatgacatctgtcgtagaaacctcgatattgagcgtccaacctatactaacctgaataggttaataggtcaaattgtgtcctccatcactgcttccctgagatttgatggagccctgaatgttgacctgacagaattccagaccaacctggtgccctactccccgcatccacttccctctggccacatatgcccctgtcatctctgctgagaaagcctaccatgaacagctttctgtagcagagatcaccaatgcttgctttgagccagccaaccagatggtnaaatgtnancctcnncatngtaaatacatnncttnctnnntgttgtanngtngtnangtngttanaaaanatntnaatgntnnaattgnaanaataaagaaaaagngtannatnnantttnnnnatnnntnnnnaaannnattnaanntnnnaanaaaataanacnntnnaaatntnnnnnnnnnnnnananntncnnaannnananananntntnncaannannacaaaaanaaaacanatnnntcancaatnncatanaatncanaaaaanttncannncatntatcnnaaanngcnnntnnntnantnntannttnnnnannnnatnnannaangtnagntntnanannnncnngannacatncctnncnntnanaannagtatgannannntnntgnnnantcnggngaannagannnngagnaagaagnanaggaanacnaaancagttaaaacgtcacaaaggtgctgcttttacagggaagcttattctgttttaaacattgaaaagttgtggtctgatcagttaatttgtatgtagcagtgtatgctctcatatacaattactgacctatgctctaaaacatgaatgctttgttacagacccaagctgtccatttctgtgatgggttttgaataaagtattccctgttttaaatg

SEQ ID NO: 488718 - DNA, 410 bp, Homo sapiens
  misc_feature (155)..(155): n is a, c, g, or t
tggtatgagtgcatgtcacgactattcatgctggatggaacacttacacgttctacacaatgaagcatcttctgagactcacaggagaatatggaattgtgatctaccccaatcacagtcagtgtgattatttgtattcccaaaatatctacagnatgacaggagaatagatctccgatgttcgcatggtgtggggtcaggaggctgcctcttaaacaatctccagatgtactgtgattgtgagtttgaaaacgagttcctgaagtaccacatctgggagaacatggcactaagctggaagcttccccaaaaagttctacccaaagaggctggagggaatttgtattcttcatccttagcacaaagcaccttaaaaaaagtaaaagggagctctatattccagataaaca

SEQ ID NO: 488719 - DNA, 1946 bp, Homo sapiens
  misc_feature (1836)..(1836): n is a, c, g, or t
  misc_feature (1920)..(1920): n is a, c, g, or t
gccgggcttccgcccggtctgccggcaacgctgcggccccgcccacgtcatggcgcccgaggagaacgcggggaccgaactcttgctgcagagtttcgagcgccgcttcctggcggccgctcactgcgctccttcccctggcagagcttagaagcaaagttaagagactcatcagattctgagctgctgcgggatattttgcagaagactgtgaagcatcctgtgtgtgtgaagcacccgccgtcagtcaagtatgcccggtgctttctctcagaactcatcaaaaagccctcgggaggctcggtcacactctccaagagcacagccatcatctcccacggtaccacaggcctggtcacatgggacgccgccctctaccttgcagaatgggccatcgagaacccggcagccttcactaacaggactgtcctagagcttggcagtggtgccggcctcacaggcctggccatctgcaagatgtgccgcccccgggcatacatcttcagcgactgtcacagccgggtcctcgagcagctccgagggaatgtccttctcaatggcctctcattagaggcagacatcactgccaacttagacagccccagggtgacagtggcccagctggactgggacgtcgcgacggtccatcagctctctgccttccagccagatgttgtcattgcagcagacgtgctgtattgcccagaagccatcgtgtcgctggtcggggtcctgcggaggctggctgcctgccgggagcaccagcgggctcctgaggtctacgtggcctttaccgtccgcaacccagagacgtgccagctgttcaccaccgagctaggccgggctgggatcagatgggaagtggaagctcgtcatgaccagaaactgtttccctacgaagagcacttggagatggcaatgctgaacctcacactgtaggactcacacacgactccaacgggattgtgagaatcaagtcactctcatgggaagaatttttatatgggaaagcggataaaactttcattggactggaatgtttggagaatgttaatttccaaatcaggaaccacaaactgccctctaataagacatcggctatctaagcgtgtgggtgccccctttctgccagcagttctggttcttaagaaaatcaccataaatcagacatgaaaattctggctccaaaaatagcattttctttgtgcaaataaaaacgtgtgtatcaagtatgatgttcccccaacgtggacacactcgttcctcacaaagccaagcccgctgcagctgccacatccctgggcttatggtgcagcaggtgcttttttcaagacaggaatcaaagtgttaggaacacggcagaaaggtgacacctggagaccaaatgcaggatgaggagtactgcagaggtcacagggaagtcacagaacagtaatacgctagcaggggcatggggcatgaagaacagaagacaggaagcgtttcagagactccaaagaagaaatcagggccaaccacagcttcccgggtcacagaacaattcattcaccaggtggcaccactgccgtcatttcagcttctggccactgggaggcgctgctcgaaagggtttgccctgagactccaagaagaagctgcgggaaggacagcaggggccctggggttttagcctctggcccaggagttatgtgtccataaccaaagggagcacagtctgcacccagctctcatcccatcagagctgctgcgactcccgcaggttcttccggaactggtttagcttgcctgcaggatcaggaaagtttgagaaaagcatctgcagctgagctgccagtncctctgagtcctcaaagaccaggccattttcttcatgtttcaccagctcatgtaaacacttgaagttcacagcacacacaggcnaacagcacccgaacatgtccaccacc

SEQ ID NO: 488720 - DNA, 1224 bp, Homo sapiens
ggtaccgcgaacggtgcgttacttacctcgactcttagcttgtcggggacggtaaccgggacccggtgtctgctcctgtcgccttcgcctcctaatccctagccactatgcgtgagtgcatctccatccacgttggccaggctggtgtccagattggcaatgcctgctgggagctctactgcctggaacacggcatccagcccgatggccagatgccaagtgacaagaccattgggggaggagatgactccttcaacaccttcttcagtgagacgggcgctggcaagcacgtgccccggggctgtgtttgtagacttggaacccacagtcattgatgaagttcgcactggcacctaccgccagctcttccaccctgagcagctcatcacaggcaaggaagatgctgccaataactatgcccgagggcactacaccattggcaaggagatcattgaccttgtgttggaccgaattcgcaagctggctgaccagtgcaccggtcttcagggcttcttggttttccacagctttggtgggggaactggttctgggttcacctcccctgctcatggaacgtctctcagttgattatggcaagaagtccaagctggagttctccatttacccagcaccccaggtttccacagctgtagttgagccctacaactccatcctcaccacccacaccaccctggagcactctgattgtgccttcatggtagacaatgaggccatctatgacatctgtcgtagaaacctcgatattgagcgtccaacctatactaacctgaataggttaataggtcaaattgtgtcctccatcactgcttccctgagatttgatggagccctgaatgttgacctgacagaattccagaccaacctggtgccctactccccgcatccacttccctctggccacatatgcccctgtcatctctgctgagaaagcctaccatgaacagctttctgtagcagagatcaccaatgcttgctttgagccagccaaccagatggggaatttgaccccgcatgggaattcaatggttgttgctgtggaccgagtgagtggtccaagtttaatgttgcatgcaccacaagacaggtccacagtgggttgggcccctggtcaggtggacatcgcccccttgggccggggggccgcaggcaagggttttatttggaaacagcatgttaggcggtcccggcaatggccatttcaaa

SEQ ID NO: 488721 - DNA, 481 bp, Homo sapiens
  misc_feature (189)..(189): n is a, c, g, or t
tccactctccttctgtctctccctccctccaccccgcactgcagcgcctaatagcaccggcggagtgggaagcggccgcgccgcacacagtcacaaatcttccatattactccctctcctttatttacaccgggcacacagtagcaattcaatctgaaaaagtaccgtgttttcggaggcgcgcagccnaagaaattgatgtttgtgttaatcggtcttgtaggagcctgcggggctcagagaggtgtgacgcagggatttcttctattgattaattgaattccgggcagggaggatgggaagaaaaatcaaaccctccaagtacctggaagctttggagctaggtcaggcgccctgccaacccttgcccagcctgaggtgtggggggtcccctggctctgagcccccataatgtcctcttagctcagcctcaaacctggtcgggggtcaggactccagctccaaggccggctgtggctgg

SEQ ID NO: 488722 - DNA, 366 bp, Homo sapiens
cacttagatgctagtaaacagaatctcggacgggaggctagatatcctcccttggaacagaaagagcaggcaggtgtattctcacgaaattctccagaagattccttagtacactaaagttagcacggccttggatctttttctgaaccttaaaggctataccagtgtatttccttccaggtgcagtgactcacaccagataatcccagacacttggggacggtgacacgagggacggaccagcctgacggccaggacgttcgacgaccaccctggggcgacacagataagacgacccaactctctaaaactactttaaaacattagactggggccgggcgcgagtgactcacggggggatcctct

SEQ ID NO: 488723 - DNA, 1655 bp, Homo sapiens
  misc_feature (354)..(354): n is a, c, g, or t
  misc_feature (360)..(360): n is a, c, g, or t
  misc_feature (364)..(364): n is a, c, g, or t
  misc_feature (377)..(377): n is a, c, g, or t
  misc_feature (387)..(387): n is a, c, g, or t
  misc_feature (394)..(395): n is a, c, g, or t
  misc_feature (412)..(412): n is a, c, g, or t
  misc_feature (439)..(439): n is a, c, g, or t
  misc_feature (446)..(447): n is a, c, g, or t
gaccacacatgtctgattcatacacgcttgcaacgggagttgtgagaataactgtcagtctcatagagagaaactccattactggcgaaacgcggttcaaacctttcccttgtactgcgtatagacctgtacgtagaagagtaacactccataatctacaataaccacaaagctgctcggctctatgtaagacgatcggctagtcgtaaagcgatgtgggtgcccccgttgctgcacagcgagtccgtgcattcgttagcgaaactcaccaaatctcaacatgaaaatctggtcttagttcagataaacaagtgtcctatcaagtatgacagttccccaaatgtggacacactnggttcntcanaaagccaagcccnctgcagctgncacatcnntggacacactcggttcntcacaaagccaagcccgctgcagctgncacatcnntggacacactcgttcctcacaaagccaagcccgctgcagctgccacatccctgggcttatggtgcagcaggtgcttttttcaagacaggaatcaaagtgttaggaacacggcagaaaggtgacacctggagaccaaatgcaggatgaggagtactgcagaggtcacagggaagtcacagaacagtaatacgctagcaggggcatggggcatgaagaacagaagacaggaagcgtttcagagactccaaagaagaaatcagggccaaccacagcttcccgggtcacagaacaattcattcaccaggtggcaccactgccgtcatttcagcttctggccactgggaggcgctgctcgaaagggtttgccctgagactccaagaagaagctgcgggaaggacagcaggggccctggggttttagcctctggcccaggagttatgtgtccataaccaaagggagcacagtctgcacccagctctcatcccatcagagctgctgcgactcccgcaggttcttccggaactggtttagcttgcctgcaggatcaggaaagtttgagaaaagcatctgcaaaatactaaagagcagagcttacctcattgcctgtccccaccccatcccaggtcaccacctggctgaccccaggtccccgacccaacaacaacccctcccaagtccctaactccctcacttggactcgagacccttcacaccccagcagcactccgcctccaacttgacatcacagtttctggaaacttccccgcatgtcccactttcccacacttggtgccctggagcacctcccggcctctacgtgctgcccattcccctgtgagcaccctcctctcggcctctggccaacacagtcccacccatctgtgggtaacaagggggtgtcggtgttcttttcagccttgctaaactgtctgaatcaaggatcacaaactacagcctgcaggccaaatccagcccacagcctgtgtttgtaaataaagctttattggaacaaagccacaccccttaatctacagatgatctgtggctactttcacaccacaacagagtaccatggttctgacagagactgggggaccctgtctaaatgacttctgacctggacctttactgaaaatcctcccaatcattctgttgacaagaatgatgtattactttttgcaataagaaacaagtaacctttgcaaaa

SEQ ID NO: 488724 - DNA, 322 bp, Homo sapiens
  misc_feature (307)..(307): n is a, c, g, or t
agtaaatccctgaccccatcctacagccatagatgaacccttgaagatatcaggcccaagtccgatcagcccagtctcaagaggacaaatattatgtgactcctcttatatgaggtaccctagaggatcaaatttatagagacagaaagtagaatggcagctacccaggggctgggggagaggggagagggaactgcgaagtcaatgggtccagggtttcatgggtacagagtttcaggtttgcaagatgaaaagtgttctggagatggatggagtttgaggttgcagtgagctgtgatggcaccantgcactgcagcctgg

SEQ ID NO: 488725 - DNA, 972 bp, Homo sapiens
ggcacgaggagtaatcgttctggtcactgggacacagctgcgctcgcccattctaaaaagtcagcgccctcaggcccgcgggtaaccacctcctcctgagcgcggtgaccagagcttagaagcaaagttaagagactcatcagattctgagctgctgcgggatattttgcagaagactgtgaagcatcctgtgtgtgtgaagcacccgccgtcagtcaagtatgcccggtgctttctctcagaactcatcaaaaagaacctgaagatttcaccgtagacgtgctgtattgcccagaagccatcgtgtcgctggtcggggtcctgcggaggctggctgcctgccgggagcaccagcgggctcctgaggtctacgtggcctttaccgtccgcaacccagagacgtgccagctgttcaccaccgagctagttgagtccccacgcccacccgggcctgcatggtccccgagctgtccctgcaggactccagtggaagtgaaagaactgggcgccggcgtaaagctagcatgccccacactcccacaacatgcggggaactcgggcagaggccggccaggccaaggccgggctgggatcagatgggaagtggaagctcgtcatgaccagaaactgtttccctacgaagagcacttggagatggcaatgctgaacctcacactgtaggactcacacacgactccaacgggattgtgagaatcaagtcactctcatgggaagaatttttatatgggaaagcggataaaactttcattggactggaatgtttggagaatgttaatttccaaatcaggaaccacaaactgccctctaataagacatcggctatctaagcgtgtgggtgccccctttctgccagcagttctggttcttaagaaaatcaccataaatcagacatgaaaattctggctccaaaaatagcattttctttgtgcaaataaaaacgtgtgtatcaag

SEQ ID NO: 488726 - DNA, 120 bp, Homo sapiens
cctaagtggaatgctcgctcaggtcttcagctgcgactcgcgcaccgcaccagctcctccaggtagcccttctgcgcgtagacgatgcggaacttctgctccatcttgtgccacttaggc

SEQ ID NO: 488727 - DNA, 1887 bp, Homo sapiens
  misc_feature (695)..(695): n is a, c, g, or t
  misc_feature (707)..(708): n is a, c, g, or t
  misc_feature (710)..(710): n is a, c, g, or t
  misc_feature (712)..(712): n is a, c, g, or t
  misc_feature (750)..(750): n is a, c, g, or t
  misc_feature (831)..(831): n is a, c, g, or t
  misc_feature (871)..(871): n is a, c, g, or t
  misc_feature (888)..(888): n is a, c, g, or t
  misc_feature (908)..(908): n is a, c, g, or t
  misc_feature (911)..(911): n is a, c, g, or t
  misc_feature (916)..(917): n is a, c, g, or t
  misc_feature (969)..(969): n is a, c, g, or t
  misc_feature (1006)..(1006): n is a, c, g, or t
  misc_feature (1011)..(1011): n is a, c, g, or t
  misc_feature (1108)..(1108): n is a, c, g, or t
  misc_feature (1124)..(1124): n is a, c, g, or t
  misc_feature (1133)..(1133): n is a, c, g, or t
  misc_feature (1143)..(1143): n is a, c, g, or t
  misc_feature (1147)..(1147): n is a, c, g, or t
  misc_feature (1152)..(1152): n is a, c, g, or t
  misc_feature (1178)..(1178): n is a, c, g, or t
  misc_feature (1183)..(1183): n is a, c, g, or t
  misc_feature (1186)..(1186): n is a, c, g, or t
  misc_feature (1189)..(1189): n is a, c, g, or t
  misc_feature (1209)..(1209): n is a, c, g, or t
  misc_feature (1212)..(1212): n is a, c, g, or t
  misc_feature (1215)..(1216): n is a, c, g, or t
  misc_feature (1226)..(1226): n is a, c, g, or t
  misc_feature (1229)..(1229): n is a, c, g, or t
  misc_feature (1234)..(1234): n is a, c, g, or t
  misc_feature (1254)..(1254): n is a, c, g, or t
gccgggcttccgcccggtctgccggcaacgctgcggccccgcccacgtcatggcgcccgaggagaacgcggggaccgaactcttgctgcagagtttcgagcgccgcttcctggcggccgctcactgcgctccttcccctggcagagcttagaagcaaagttaagagactcatcagattctgagctgctgcgggatattttgcagaagccctcgggaggctcggtcacactctccaagagcacagccatcatctcccacggtaccacaggcctggtcacatgggacgccgccctctaccttgcagaatgggccatcgagaacccggcagccttcactcacaggtgacctcggggcgcagggcagggcaccgaggcaggcttaccctggtgcagtcacagacacggtcccctttcctcccacctaacaggactgtcctagagcttggcagtggtgccggcctcacaggcctggccatctgcaagatgtgccgcccccgggcatacatcttcagcgactgtcacagccgggtcctcgagcagctccgagggaatgtccttctcaatggcctctcattagaggcagacatcactgccaacttagacagccccagggtgacagtggcccagctggactgggacgtcgcgacggtccatcagctctctgccttccagccagatgttgtcattgcagcaggnaatgccagcccnngnantctgtgcaggcggtgtccttgcagctctacccagtctnggtctgggaaaagggaacaatggatgctgtcaggcatggacatgatggggcttccagaagagttactctgggcctccaggntgacatcaaaggacaggggtgcctcttaaggtgaccttcnagccacagccctcttgntggagacaggcatactcccnttncagtnntcaccacatggctctgtcccagagccatgccctgtgtccttcagagaccacnggaggaaaacaaccacttctgggatgaggacagggcncttgngagaaggtggtgtttggctgggccaccaaaacccctcacccctgccagcacactcagtcccctctctggtggaacagagctctgcctgtggtcctgngtcccagccctgaaanccacaggtncagcggtggncagngacanaggcccacccctcaagccagcagacnaatcngcnganacctgaaacacgaagttcanggnagnntcaggctttntgncattnaaagccctctagataggccnacgtgctgtattgcccagaagccatcgtgtcgctggtcggggtcctgcggaggctggctgcctgccgggagcaccagcgggctcctgaggtctacgtggcctttaccgtccgcaacccagagacgtgccagctgttcaccaccgagctaggccgggctgggatcagatgggaagtggaagctcgtcatgaccagaaactgtttccctacgaagagcacttggagatggcaatgctgaacctcacactgtaggactcacacacgactccaacgggattgtgagaatcaagtcactctcatgggaagaatttttatatgggaaagcggataaaactttcattggactggaatgtttggagaatgttaatttccaaatcaggaaccacaaactgccctctaataagacatcggctatctaagcgtgtgggtgccccctttctgccagcagttctggttcttaagaaaatcaccataaatcagacatagctttatggctgactccggcccccttcagagcccatagtcacaggcctcagggctggttctgtaagtcagagctctagagaaacctggctcagtctttctcactaagtaagcagggctggagactggtgggatcttccgttcagtggct

SEQ ID NO: 488728 - DNA, 107 bp, Homo sapiens
aatggggccctgctcgaagaggcacagtatacagctgctgtgttcccagcaacactctttctcttaatcaagacccaaagtgcaagagcaggtgctgctggcatatg

SEQ ID NO: 488729 - DNA, 167 bp, Homo sapiens
ccacattaaatgggcatcgtaattaagcctcatagggatgtcatgaaactaattgatatattaaagcgagtttagaacagtgctggcacataggactaaatacatgttaactgctatgctactgctactactactagtactactattactactactacaactgctag

SEQ ID NO: 488730 - DNA, 975 bp, Homo sapiens
atttgaggtgtccccggcaagatgttatctgccacctgtcgcatcagcatggggaacatcttcgggcaacctgcttcaaggagcctttgaggcaagagaagaattgcgcatcctcatggtgtggctgccgtgatgcaggggagaccatgcatcctctactaagcggttaaggcttgggtgacgcagcgggtgcacctgacccatttccgcacctataaggcgtgcatcctgtggaaaaacctgtggaaggtataagaacatcaagacttcacatgtgttgggaacgtgggtggacaaggcatgagcatcctggccctcgtgtggcgccgactacgtctcccgagaaaccagacaaggcgcgtgatccttcgagctggactaggaatgaacagagagcgtgttgaggcgagggcccgtgagagaagtcttgagtgaccagatgctgcgcgcgatcgatccgaagctccgtggaagtgcctgtacacatcctgggtgttacggaccagatcgaagcaggggacctgccactcagatcgctcactgaatttgcggggcactgggggaatcactaggacagacgtcggtggagctgcagctctctacggaccacaaggaaactgtggtacccattcgcaggcacatcttgtcggccaaaacagccgggtcgcacggggctctcagtggaacaggaccttgacgacttggcctggtccatatctacgcctgcagtggaccagtacagctgacagggcgaacgcacagcttcccctacgtgaggccctctgttgccccttctgtatattaagctcctccatgtagggccgcacgttccggcgtcgctgcctggtgcacatatctctgcaaggcctgcttcccgttggactgtggggccctcgcagttgcccctcacaaccgcggccggagacacgtacgccgctattgggcccgtgcgccggcgcccttttttaacgtggc

SEQ ID NO: 488731 - DNA, 364 bp, Homo sapiens
cacagtagatcccctgtattttcagaactttgcgatgtttaggcaggccaagcacgattgtctgagagggagaccatcctgaccaacatggacgaaaccctctctctactaaaaattcaattagttgggtttggtggtgcacgcctgtaatcctagctacctgggaggctgaggcaggagaatgacttgaacccactaggcggagattgcagagagccaagagcgcgccagttcactacagcctgggcaacagagcaagactttgtctaacaagaggtgagcggaccatgaagtcaggcgttcaagaccagcctcggtaatgtggtggccccatctttactattcagacattagctaggcgggg

SEQ ID NO: 488732 - DNA, 330 bp, Homo sapiens
ggggtttatcccaaaattttggtgggattcatcttcatggagcaaaatagacccctggtcaaaaagtaaatgaaaaattcataaccggggaaaaatttagttggggcctaaaaagaataatggggagaaaaattccttgaagccttttgcaactggccttaagtttataaaaagggataaattttctttgatccgaaaacattctttggacatgggccggggccaacatactttttacctatggggcttccctatggccctatccctatgcctaccctatctatatgccctttaaaagggatcccccggtttaactcaaagaaaatgggt

SEQ ID NO: 488733 - DNA, 15731 bp, Homo sapiens
  misc_feature (12275)..(12275): n is a, c, g, or t
  misc_feature (12367)..(12367): n is a, c, g, or t
caacccacaccgcccctgccagccaccatggggctgccactagcccgcctggcggctgtgtgcctggccctgtctttggcagggggctcggagctccagacagagggcagaacccgataccacggccgcaacgtctgcagcacctggggcaacttccactacaagaccttcgacggggacgtcttccgcttccccggcctctgcgactacaacttcgcctccgactgccgaggctcctacaaggaatttgctgtgcacctgaagcggggtccgggccaggctgaggcccccgccggggtggagtccatcctgctgaccatcaaggatgacaccatctacctcacccgccacctggctgtgcttaacggggccgtggtcagcaccccgcactacagccccgggctgctcattgagaagagcgatgcctacaccaaagtctactcccgcgccggcctcaccctcatgtggaaccgggaggatgcactcatgctggagctggacactaagttccggaaccacacctgtggcctctgcggggactacaacggcctgcagagctattcagaattcctctctgacggcgtgctcttcagtcccctggagtttgggaacatgcagaagatcaaccagcccgatgtggtgtgtgaggatcccgaggaggaggtggcccccgcatcctgctccgagcaccgcgccgagtgtgagaggctgctgaccgccgaggccttcgcggactgtcaggacctggtgccgctggagccgtatctgcgcgcctgccagcaggaccgctgccggtgcccgggcggtgacacctgcgtctgcagcaccgtggccgagttctcccgccagtgctcccacgccggcggccggcccgggaactggaggaccgccacgctctgccccaagacctgccccgggaacctggtgtacctggagagcggctcgccctgcatggacacctgctcacacctggaggtgagcagcctgtgcgaggagcaccgcatggacggctgtttctgcccagaaggcaccgtatatgacgacatcggggacagtggctgcgttcctgtgagccagtgccactgcaggctgcacggacacctgtacacaccgggccaggagatcaccaatgactgcgagcagtgtgtctgtaacgctggccgctgggtgtgcaaagacctgccctgccccggcacctgtgccctggacggcggctcccacatcaccaccttcgatgggaagacgtacaccttccacggggactgctactatgtcctggccaagggtgaccacaacgattcctacgctctcctgggcgagctggccccctgtggctccacagacaagcagacctgcctgaagacggtggtgctgctggctgacaagaagaagaatgtggtggtcttcaagtccgatggcagtgtactgctcaacgagctgcaggtgaacctgccccacgtgaccgcgagcttctctgtcttccgcccgtcttcctaccacatcatggtgagcatggccattggcgtccggctgcaggtgcagctggccccagtcatgcaactctttgtgacactggaccaggcctcccaggggcaggtgcagggcctctgcgggaacttcaacggcctggaaggtgacgacttcaagacggccagcgggctggtggaggccacgggggccggcttttgccaacacctggaaggcacagtcaagctgccatgacaagctggactggttggacgatccctgctccctgaacatcgagagcgccaactacgccgagcactggtgctccctcctgaagaagacagagaccccctttggcaggtgccactcggctgtggaccctgctgagtattacaagaggtgcaaatatgacacgtgtaactgtcagaacaatgaggactgcctgtgcgccgccctgtcctcctacgcgcgcgcctgcaccgccaagggcgtcatgctgtggggctggcgggagcatgtctgcaacaaggatgtgggctcctgccccaactcgcaggtcttcctgtacaacctgaccacctgccagcagacctgccgctccctctccgaggccgacagccactgtctcgagggctttgcgcctgtggacggctgcggctgccctgaccacaccttcctggacgagaagggccgctgcgtacccctggccaagtgctcctgttaccaccgcggtctctacctggaggcgggggatgtggtcgtcaggcaggaagaacgatgtgtgtgccgggatgggcggctgcactgtaggcagatccggctgatcggccagagctgcacggccccaaagatccacatggactgcagcaacctgactgcactggccacctcgaagccccgagccctcagctgccagacgctggccgccggctattaccacacagagtgtgtcagtggctgtgtgtgccccgacgggctgatggatgacggccggggtggctgcgtggtggagaaggaatgcccttgcgtccataacaacgacctgtattcttccggcgccaagatcaaggtggactgcaatacctgcacctgcaagagaggacgctgggtgtgcacccaggctgtgtgccatggcacctgctccatttacgggagtggccactacatcacctttgatgggaagtactacgactttgacggacactgctcctacgtggctgttcaggactactgcggccagaactcctcactgggctcattcagcatcatcaccgagaacgtcccctgtggcactacgggcgtcacctgctccaaggccatcaagatcttcatggggaggacggagctgaagttggaagacaagcaccgtgtggtgatccagcgtgatgagggtcaccacgtggcctacaccacgcgggaggtgggccagtacctggtggtggagtccagcacgggcatcatcgtcatctgggacaagaggaccaccgtgttcatcaagctggctccctcctacaagggcaccgtgtgtggcctgtgtgggaactttgaccaccgctccaacaacgacttcaccacgcgggaccacatggtggtgagcagcgagctggacttcgggaacagctggaaggaggcccccacctgcccagatgtgagcaccaaccccgagccctgcagcctgaacccgcaccgccgctcctgggccgagaagcagtgcagcatcctcaaaagcagcgtgttcagcatctgccacagcaaggtggaccccaagcccttctacgaggcctgtgtgcacgactcgtgctcctgtgacacgggtggggactgtgagtgcttctgctctgccgtggcctcctacgcccaggagtgtaccaaagagggggcctgcgtgttctggaggacgccggacctgtgccccatattctgcgactactacaaccctccgcatgagtgtgagtggcactatgagccatgtgggaaccggagcttcgagacctgcaggaccatcaacggcatccactccaacatctccgtgtcctacctggagggctgctacccccggtgccccaaggacaggcccatctatgaggaggatctgaagaagtgtgtcactgcagacaagtgtggctgctatgtcgaggacacccactacccacctggagcatcggttcccaccgaggagacctgcaagtcctgcgtgtgtaccaactcctcccaagtcgtctgcaggccggaggaaggaaagattcttaaccagacccaggatggcgccttctgctactgggagatctgtggccccaacgggacggtggagaagcacttcaacatctgttccattacgacacgcccgtccaccctgaccaccttcaccaccatcaccctccccaccacccccacctccttcaccactaccaccaccaccaccaccccgacctccagcacagttttatcaacaactccgaagctgtgctgcctctggtctgactggatcaatgaggaccaccccagcagtggcagcgacgacggtgaccgagaaccatttgatggggtctgcggggcccctgaggacatcgagtgcaggtcggtcaaggatccccacctcagcttggagcagcatggccagaaggtgcagtgtgatgtctctgttgggttcatttgcaagaatgaagaccagtttggaaatggaccatttggactgtgttacgactacaagatacgtgtcaattgttgctggcccatggataagtgtatcaccactcccagccctccaactaccactcccagccctccaccaaccacgacgaccacccttccaccaaccaccacccccagccctccaaccaccaccacaaccacccctccaccaaccaccacccccagccctccaataaccaccacgaccacccctctaccaaccaccactcccagccctccaataagcaccacaaccacccctccaccaaccaccactcccagccctccaaccaccactcccagccctccaaccaccactcccagccctccaacaaccaccacaaccacccctccaccaaccaccactcccagccctccaatgactacgcccatcactccaccagccagcactaccacccttccaccaaccaccactcccagccctccaacaaccaccacaaccacccctccaccaaccaccactcccagtcctccaacgactacgcccatcactccaccaaccagcactactacccttccaccaaccaccactcccagccctccaccaaccaccacaaccacccctccaccaaccaccactcccagccctccaacaaccaccactcccagtcctccaacaatcaccacaaccacccctccaccaaccaccactcccagccctccaacaacgaccacaaccacccctccaccaaccaccactcccagccctccaacgactacacccatcactccaccaaccagcactaccacccttccaccaaccaccactcccagccctccaccaaccaccacaaccacccctccaccaaccaccactcccagccctccaacaaccaccactcccagccctccaataaccaccacaaccacccctccaccaaccaccactcccagctctccaataaccaccactcccagccctccaacaaccaccatgaccaccccttcaccaaccaccacccccagctctccaataaccaccacaaccaccccttcctcaactaccactcccagccctccaccaaccaccatgaccaccccttcaccaaccaccactcccagccctccaacaaccaccatgaccacccttccaccaaccaccacttccagccctctaacaactactcctctacctccatcaataactcctcctacattttcaccattctcaacgacaacccctactaccccatgcgtgcctctctgcaattggactggctggctggattctggaaaacccaactttcacaaaccaggtggagacacagaattgattggagacgtctgtggaccaggctgggcagctaacatctcttgcagagccaccatgtatcctgatgttcccattggacagcttggacaaacagtggtgtgtgatgtctctgtggggctgatatgcaaaaatgaagaccaaaagccaggtggggtcatccctatggccttctgcctcaactacgagatcaacgttcagtgctgtgagtgtgtcacccaacccaccaccatgacaaccaccaccacagagaacccaactccgccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccncgacacccatcaccaccaccactacggtgaccccaaccccaacacccaccggcacacagaccccaaccacgacacccatcaccaccaccacnacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccatgatacccatcagcaccaccactacggtgaccccaaccccaacacccaccactggaagcacggggccccccacccacacaagcacagcaccgattgctgagttgaccacatccaatcctccgcctgagtcctcaacccctcagacctctcggtccacctcttcccctctcacggagtcaaccacccttctgagtaccctaccacctgccattgagatgaccagcacggccccaccctccacacccacggcacccacgaccacgagcggaggccacacactgtctccaccgcccagcaccaccacgtcccctccaggcacccccactcgcggtaccacgaccgggtcatcttcagcccccacccccagcactgtgcagacgaccaccaccagtgcctggaccccaacgccgaccccactctccacacccagcatcatcaggaccacaggcctgaggccctacccttcctctgtgcttatctgctgtgtcctgaacgacacctactacgcaccaggtgaggaggtgtacaacggcacatacggagacacctgttatttcgtcaactgctcactgagctgtacgttggagttctataactggtcctgcccatccacgccctccccaacacccacgccctccaagtcgacgcccacgccttccaagccatcgtccacgccctccaagccgacgcccggcaccaagccccccgagtgcccagactttgatcctcccagacaggagaacgagacttggtggctgtgcgactgcttcatggccacgtgcaagtacaacaacacggtggagatcgtgaaggtggagtgtgagccgccgcccatgcccacctgctccaacggcctccaacccgtgcgcgtcgaggaccccgacggctgctgctggcactgggagtgcgactgctactgcacgggctggggcgacccgcactatgtcaccttcgacggactctactacagctaccagggcaactgcacctacgtgctggtggaggagatcagcccctccgtggacaacttcggagtttacatcgacaactaccactgcgatcccaacgacaaggtgtcctgcccccgcaccctcatcgtgcgccacgagacccaggaggtgctgatcaagaccgtgcatatgatgcccatgcaggtgcaggtgcaggtgaacaggcaggcggtggcactgccctacaagaagtacgggctggaggtgtaccagtctggcatcaactacgtggtggacatccccgagctgggtgtcctcgtctcctacaatggcctgtccttctccgtcaggctgccctaccaccggtttggcaacaacaccaagggccagtgtggcacctgcaccaacaccacctccgacgactgcattctgcccagcggggagatcgtctccaactgtgaggctgcggctgaccagtggctggtgaacgacccctccaagccacactgcccccacagcagctccacgaccaagcgcccggccgtcactgtgcccgggggcggtaaaacgaccccacacaaggactgcaccccatctcccctctgccagctcatcaaggacagcctgtttgcccagtgccacgcactggtgcccccgcagcactactacgatgcctgcgtgttcgacagctgcttcatgccgggctcgagcctggagtgcgccagtctgcaggcctacgcagccctctgtgcccagcagaacatctgcctcgactggcggaaccacacgcatggggcctgcttggtggagtgcccatctcacagggagtaccaggcctgtggccctgcagaagagcccacgtgcaaatccagctcctcccagcagaacaacacagtcctggtggaaggctgcttctgtcctgagggcaccatgaactacgctcctggctttgatgtctgcgtgaagacctgcggctgtgtgggacctgacaatgtgcccagagagtttggggagcacttcgagttcgactgcaagaactgtgtctgcctggagggtggaagtggcatcatctgccaacccaagaggtgcagccagaagcccgttacccactgcgtggaagacggcacctacctcgccacggaggtcaaccctgccgacacctgctgcaacattaccgtctgcaagtgcaacaccagcctgtgcaaagagaagccctccgtgtgcccgctgggattcgaagtgaagagcaagatggtgcctggaaggtgctgtcctttctactggtgtgagtccaagggggtgtgtgttcacgggaatgctgagtaccagcccggttctccagtttattcctccaagtgccaggactgcgtgtgcacggacaaggtggacaacaacaccctgctcaacgtcatcgcctgcacccacgtgccctgcaacacctcctgcagccctggcttcgaactcatggaggcccccggggagtgctgtaagaagtgtgaacagacgcactgtatcatcaaacggcccgacaaccagcacgtcatcctgaagcccggggacttcaagagcgacccgaagaacaactgcacattcttcagctgcgtgaagatccacaaccagctcatctcgtccgtctccaacatcacctgccccaactttgatgccagcatttgcatcccgggctccatcacattcatgcccaatggatgctgcaagacctgcacccctcgcaatgagaccagggtgccctgctccaccgtccccgtcaccacggaggtttcgtacgccggctgcaccaagaccgtcctcatgaatcattgctccgggtcctgcgggacatttgtcatgtactcggccaaggcccaggccctggaccacagctgctcctgctgcaaagaggagaaaaccagccagcgtgaggtggtcctgagctgccccaatggcggctcgctgacacacacctacacccacatcgagagctgccagtgccaggacaccgtctgcgggctccccaccggcacctcccgccgggcccggcgctcccctaggcatctggggagcgggtgagcggggtgggcacagcccccttcactgccctcgacagctttacctcccccggaccctctgagcctcctaagctcggcttcctctcttcagatatttattgtctgagtctttgttcagtccttgctttccaataataaactcagggggacatgcaaaaaaaaaa

SEQ ID NO: 488734 - DNA, 10043 bp, Homo sapiens
  misc_feature (6587)..(6587): n is a, c, g, or t
  misc_feature (6679)..(6679): n is a, c, g, or t
caacccacaccgcccctgccagccaccatggggctgccactagcccgcctggcggctgtgtgcctggccctgtctttggcagggggctcggagctccagacagagggcagaacccgataccacggccgcaacgtctgcagcacctggggcaacttccactacaagaccttcgacggggacgtcttccgcttccccggcctctgcgactacaacttcgcctccgactgccgaggctcctacaaggaatttgctgtgcacctgaagcggggtccgggccaggctgaggcccccgccggggtggagtccatcctgctgaccatcaaggatgacaccatctacctcacccgccacctggctgtgcttaacggggccgtggtcagcaccccgcactacagccccgggctgctcattgagaagagcgatgcctacaccaaagtctactcccgcgccggcctcaccctcatgtggaaccgggaggatgcactcatgctggagctggacactaagttccggaaccacacctgtggcctctgcggggactacaacggcctgcagagctattcagaattcctctctgacggcgtgctcttcagtcccctggagtttgggaacatgcagaagatcaaccagcccgatgtggtgtgtgaggatcccgaggaggaggtggcccccgcatcctgctccgagcaccgcgccgagtgtgagaggctgctgaccgccgaggccttcgcggactgtcaggacctggtgccgctggagccgtatctgcgcgcctgccagcaggaccgctgccggtgcccgggcggtgacacctgcgtctgcagcaccgtggccgagttctcccgccagtgctcccacgccggcggccggcccgggaactggaggaccgccacgctctgccccaagacctgccccgggaacctggtgtacctggagagcggctcgccctgcatggacacctgctcacacctggaggtgagcagcctgtgcgaggagcaccgcatggacggctgtttctgcccagaaggcaccgtatatgacgacatcggggacagtggctgcgttcctgtgagccagtgccactgcaggctgcacggacacctgtacacaccgggccaggagatcaccaatgactgcgagcagtgtgtctgtaacgctggccgctgggtgtgcaaagacctgccctgccccggcacctgtgccctggacggcggctcccacatcaccaccttcgatgggaagacgtacaccttccacggggactgctactatgtcctggccaagggtgaccacaacgattcctacgctctcctgggcgagctggccccctgtggctccacagacaagcagacctgcctgaagacggtggtgctgctggctgacaagaagaagaatgtggtggtcttcaagtccgatggcagtgtactgctcaacgagctgcaggtgaacctgccccacgtgaccgcgagcttctctgtcttccgcccgtcttcctaccacatcatggtgagcatggccattggcgtccggctgcaggtgcagctggccccagtcatgcaactctttgtgacactggaccaggcctcccaggggcaggtgcagggcctctgcgggaacttcaacggcctggaaggtgacgacttcaagacggccagcgggctggtggaggccacgggggccggcttttgccaacacctggaaggcacagtcaagctgccatgacaagctggactggttggacgatccctgctccctgaacatcgagagcgccaactacgccgagcactggtgctccctcctgaagaagacagagaccccctttggcaggtgccactcggctgtggaccctgctgagtattacaagaggtgcaaatatgacacgtgtaactgtcagaacaatgaggactgcctgtgcgccgccctgtcctcctacgcgcgcgcctgcaccgccaagggcgtcatgctgtggggctggcgggagcatgtctgcaacaaggatgtgggctcctgccccaactcgcaggtcttcctgtacaacctgaccacctgccagcagacctgccgctccctctccgaggccgacagccactgtctcgagggctttgcgcctgtggacggctgcggctgccctgaccacaccttcctggacgagaagggccgctgcgtacccctggccaagtgctcctgttaccaccgcggtctctacctggaggcgggggatgtggtcgtcaggcaggaagaacgatgtgtgtgccgggatgggcggctgcactgtaggcagatccggctgatcggccagagctgcacggccccaaagatccacatggactgcagcaacctgactgcactggccacctcgaagccccgagccctcagctgccagacgctggccgccggctattaccacacagagtgtgtcagtggctgtgtgtgccccgacgggctgatggatgacggccggggtggctgcgtggtggagaaggaatgcccttgcgtccataacaacgacctgtattcttccggcgccaagatcaaggtggactgcaatacctgcacctgcaagagaggacgctgggtgtgcacccaggctgtgtgccatggcacctgctccatttacgggagtggccactacatcacctttgatgggaagtactacgactttgacggacactgctcctacgtggctgttcaggactactgcggccagaactcctcactgggctcattcagcatcatcaccgagaacgtcccctgtggcactacgggcgtcacctgctccaaggccatcaagatcttcatggggaggacggagctgaagttggaagacaagcaccgtgtggtgatccagcgtgatgagggtcaccacgtggcctacaccacgcgggaggtgggccagtacctggtggtggagtccagcacgggcatcatcgtcatctgggacaagaggaccaccgtgttcatcaagctggctccctcctacaagggcaccgtgtgtggcctgtgtgggaactttgaccaccgctccaacaacgacttcaccacgcgggaccacatggtggtgagcagcgagctggacttcgggaacagctggaaggaggcccccacctgcccagatgtgagcaccaaccccgagccctgcagcctgaacccgcaccgccgctcctgggccgagaagcagtgcagcatcctcaaaagcagcgtgttcagcatctgccacagcaaggtggaccccaagcccttctacgaggcctgtgtgcacgactcgtgctcctgtgacacgggtggggactgtgagtgcttctgctctgccgtggcctcctacgcccaggagtgtaccaaagagggggcctgcgtgttctggaggacgccggacctgtgccccatattctgcgactactacaaccctccgcatgagtgtgagtggcactatgagccatgtgggaaccggagcttcgagacctgcaggaccatcaacggcatccactccaacatctccgtgtcctacctggagggctgctacccccggtgccccaaggacaggcccatctatgaggaggatctgaagaagtgtgtcactgcagacaagtgtggctgctatgtcgaggacacccactacccacctggagcatcggttcccaccgaggagacctgcaagtcctgcgtgtgtaccaactcctcccaagtcgtctgcaggccggaggaaggaaagattcttaaccagacccaggatggcgccttctgctactgggagatctgtggccccaacgggacggtggagaagcacttcaacatctgttccattacgacacgcccgtccaccctgaccaccttcaccaccatcaccctccccaccacccccacctccttcaccactaccaccaccaccaccaccccgacctccagcacagttttatcaacaactccgaagctgtgctgcctctggtctgactggatcaatgaggaccaccccagcagtggcagcgacgacggtgaccgagaaccatttgatggggtctgcggggcccctgaggacatcgagtgcaggtcggtcaaggatccccacctcagcttggagcagcatggccagaaggtgcagtgtgatgtctctgttgggttcatttgcaagaatgaagaccagtttggaaatggaccatttggactgtgttacgactacaagatacgtgtcaattgttgctggcccatggataagtgtatcaccactcccagccctccaactaccactcccagccctccaccaaccacgacgaccacccttccaccaaccaccacccccagccctccaaccaccaccacaaccacccctccaccaaccaccacccccagccctccaataaccaccacgaccacccctctaccaaccaccactcccagccctccaataagcaccacaaccacccctccaccaaccaccactcccagccctccaaccaccactcccagccctccaaccaccactcccagccctccaacaaccaccacaaccacccctccaccaaccaccactcccagccctccaatgactacgcccatcactccaccagccagcactaccacccttccaccaaccaccactcccagccctccaacaaccaccacaaccacccctccaccaaccaccactcccagtcctccaacgactacgcccatcactccaccaaccagcactactacccttccaccaaccaccactcccagccctccaccaaccaccacaaccacccctccaccaaccaccactcccagccctccaacaaccaccactcccagtcctccaacaatcaccacaaccacccctccaccaaccaccactcccagccctccaacaacgaccacaaccacccctccaccaaccaccactcccagccctccaacgactacacccatcactccaccaaccagcactaccacccttccaccaaccaccactcccagccctccaccaaccaccacaaccacccctccaccaaccaccactcccagccctccaacaaccaccactcccagccctccaataaccaccacaaccacccctccaccaaccaccactcccagctctccaataaccaccactcccagccctccaacaaccaccatgaccaccccttcaccaaccaccacccccagctctccaataaccaccacaaccaccccttcctcaactaccactcccagccctccaccaaccaccatgaccaccccttcaccaaccaccactcccagccctccaacaaccaccatgaccacccttccaccaaccaccacttccagccctctaacaactactcctctacctccatcaataactcctcctacattttcaccattctcaacgacaacccctactaccccatgcgtgcctctctgcaattggactggctggctggattctggaaaacccaactttcacaaaccaggtggagacacagaattgattggagacgtctgtggaccaggctgggcagctaacatctcttgcagagccaccatgtatcctgatgttcccattggacagcttggacaaacagtggtgtgtgatgtctctgtggggctgatatgcaaaaatgaagaccaaaagccaggtggggtcatccctatggccttctgcctcaactacgagatcaacgttcagtgctgtgagtgtgtcacccaacccaccaccatgacaaccaccaccacagagaacccaactccgccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccncgacacccatcaccaccaccactacggtgaccccaaccccaacacccaccggcacacagaccccaaccacgacacccatcaccaccaccacnacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccatgatacccatcagcaccaccactacggtgaccccaaccccaacacccaccactggaagcacggggccccccacccacacaagcacagcaccgattgctgagttgaccacatccaatcctccgcctgagtcctcaacccctcagacctctcggtccacctcttcccctctcacggagtcaaccacccttctgagtaccctaccacctgccattgagatgaccagcacggccccaccctccacacccacggcacccacgaccacgagcggaggccacacactgtctccaccgcccagcaccaccacgtcccctccaggcacccccactcgcggtaccacgaccgggtcatcttcagcccccacccccagcactgtgcagacgaccaccaccagtgcctggaccccaacgccgaccccactctccacacccagcatcatcaggaccacaggcctgaggccctacccttcctctgtgcttatctgctgtgtcctgaacgacacctactacgcaccaggtgaggaggtgtacaacggcacatacggagacacctgttatttcgtcaactgctcactgagctgtacgttggagttctataactggtcctgcccatccacgccctccccaacacccacgccctccaagtcgacgcccacgccttccaagccatcgtccacgccctccaagccgacgcccggcaccaagccccccgagtgcccagactttgatcctcccagacaggagaacgagacttggtggctgtgcgactgcttcatggccacgtgcaagtacaacaacacggtggagatcgtgaaggtggagtgtgagccgccgcccatgcccacctgctccaacggcctccaacccgtgcgcgtcgaggaccccgacggctgctgctggcactgggagtgcgactgctactgcacgggctggggcgacccgcactatgtcaccttcgacggactctactacagctaccagggcaactgcacctacgtgctggtggaggagatcagcccctccgtggacaacttcggagtttacatcgacaactaccactgcgatcccaacgacaaggtgtcctgcccccgcaccctcatcgtgcgccacgagacccaggaggtgctgatcaagaccgtgcatatgatgcccatgcaggtgcaggtgcaggtgaacaggcaggcggtggcactgccctacaagaagtacgggctggaggtgtaccagtctggcatcaactacgtggtggacatccccgagctgggtgtcctcgtctcctacaatggcctgtccttctccgtcaggctgccctaccaccggtttggcaacaacaccaagggccagtgtggcacctgcaccaacaccacctccgacgactgcattctgcccagcggggagatcgtctccaactgtgaggctgcggctgaccagtggctggtgaacgacccctccaagccacactgcccccacagcagctccacgaccaagcgcccggccgtcactgtgcccgggggcggtaaaacgaccccacacaaggactgcaccccatctcccctctgccagctcatcaaggacagcctgtttgcccagtgccacgcactggtgcccccgcagcactactacgatgcctgcgtgttcgacagctgcttcatgccgggctcgagcctggagtgcgccagtctgcaggcctacgcagccctctgtgcccagcagaacatctgcctcgactggcggaaccacacgcatggggcctgcttggtggagtgcccatctcacagggagtaccaggcctgtggccctgcagaagagcccacgtgcaaatccagctcctcccagcagaacaacacagtcctggtggaaggctgcttctgtcctgagggcaccatgaactacgctcctggctttgatgtctgcgtgaagacctgcggctgtgtgggacctgacaatgtgcccagagagtttggggagcacttcgagttcgactgcaagaactgtgtctgcctggagggtggaagtggcatcatctgccaacccaagaggtgcagccagaagcccgttacccactgcgtggaagacggcacctacctcgccacggaggtcaaccctgccgacacctgctgcaacattaccgtctgcaagtgcaacaccagcctgtgcaaagagaagccctccgtgtgcccgctgggattcgaagtgaagagcaagatggtgcctggaaggtgctgtcctttctactggtgtgagtccaagggggtgtgtgttcacgggaatgctgagtaccagcccggttctccagtttattcctccaagtgccaggactgcgtgtgcacggacaaggtggacaacaacaccctgctcaacgtcatcgcctgcacccacgtgccctgcaacacctcctgcagccctggcttcgaactcatggaggcccccggggagtgctgtaagaagtgtgaacagacgcactgtatcatcaaacggcccgacaaccagcacgtcatcctgaagcccggggacttcaagagcgacccgaagaacaactgcacattcttcagctgcgtgaagatccacaaccagctcatctcgtccgtctccaacatcacctgccccaactttgatgccagcatttgcatcccgggctccatcacattcatgcccaatggatgctgcaagacctgcacccctcgcaatgagaccagggtgccctgctccaccgtccccgtcaccacggaggtttcgtacgccggctgcaccaagaccgtcctcatgaatcattgctccgggtcctgcgggacatttgtcatgtactcggccaaggcccaggccctggaccacagctgctcctgctgcaaagaggagaaaaccagccagcgtgaggtggtcctgagctgccccaatggcggctcgctgacacacacctacacccacatcgagagctgccagtgccaggacaccgtctgcgggctccccaccggcacctcccgccgggcccggcgctcccctaggcatctggggagcgggtgagcggggtgggcacagcccccttcactgccctcgacagctttacctcccccggaccctctgagcctcctaagctcggcttcctctcttcagatatttattgtctgagtctttgttcagtccttgctttccaataataaactcagggggacatgcaaaaaaaaaa

SEQ ID NO: 488735 - DNA, 293 bp, Homo sapiens
acaaagaatgtactgataacaaacacaggcgaaatggtggttagtaagcgtcgagccttataaaatttacatccacgactgtttcacagacaagattgctctctccagaaacactagccagtcaacaagcagcaaacgaaaccctcatattcacatcccatttgcacataatttcagcctaaacatatattttgctcggaaatgcattaaatggtgcagtgtgtcgaaatcgcatcttttttcaaaattcttattttttaacacacaaggcatgattatgcatttcagaagtc

SEQ ID NO: 488736 - DNA, 923 bp, Homo sapiens
tcctacaatgccgccgtggacacagtggaggaagcaaaggagcctgttgaagtgacatcactgagctctgccgggacaatgtctccaaaatggcacttacctgactggggaacttgacggccaccagtgaagaactataagctcctggaaaatatgaataaactcaccagcttgaagtatcttgaaaactgacaagatatggctatacaacattagtaggaaccttaccggaccttaacacccagaaatatgctggactgcagccttatctggatcagactcaatgtcattgaagagcaggtagcagctcttgagcaggcagcttacaagtgggactgcttattcaaaaacacactggaacgccaagtacaagaacgctggagaagcgatgagaaacttattttctactgggacagagtcttttatttctttcaacatgtcgaacgcaactgctctaataacaaccggaaatccttgaggctgcactgcactggtgaacaatcctcaaacaacggaaattattgctggtcaatcacaggaacatcccaacgttcagagcaacactggcaggcacggggcttatccctgcaaacctccttggaagacagaaatcccgtcagaattctccaacgttaataactttccaacctttacttgagtgcttggcaattcttcagcgaccagacacccccacaacgttcagcacaccacgcctggcttaccagtaaaactaaaagtaaggcccatttcccctggagtgggcgggacgacacaatattactaagaggaggatacgccaccaaggcaccgccagcccggacacgaagccaagggttgaccacgatccctatttacagaaacacacaccttgttctgcgctaccactgagtcgacacttcccactggcaccacactagcacacg

SEQ ID NO: 488737 - DNA, 8960 bp, Homo sapiens
caacccacaccgcccctgccagccaccatggggctgccactagcccgcctggcggctgtgtgcctggccctgtctttggcagggggctcggagctccagacagagggcagaacccgataccacggccgcaacgtctgcagcacctggggcaacttccactacaagaccttcgacggggacgtcttccgcttccccggcctctgcgactacaacttcgcctccgactgccgaggctcctacaaggaatttgctgtgcacctgaagcggggtccgggccaggctgaggcccccgccggggtggagtccatcctgctgaccatcaaggatgacaccatctacctcacccgccacctggctgtgcttaacggggccgtggtcagcaccccgcactacagccccgggctgctcattgagaagagcgatgcctacaccaaagtctactcccgcgccggcctcaccctcatgtggaaccgggaggatgcactcatgctggagctggacactaagttccggaaccacacctgtggcctctgcggggactacaacggcctgcagagctattcagaattcctctctgacggcgtgctcttcagtcccctggagtttgggaacatgcagaagatcaaccagcccgatgtggtgtgtgaggatcccgaggaggaggtggcccccgcatcctgctccgagcaccgcgccgagtgtgagaggctgctgaccgccgaggccttcgcggactgtcaggacctggtgccgctggagccgtatctgcgcgcctgccagcaggaccgctgccggtgcccgggcggtgacacctgcgtctgcagcaccgtggccgagttctcccgccagtgctcccacgccggcggccggcccgggaactggaggaccgccacgctctgccccaagacctgccccgggaacctggtgtacctggagagcggctcgccctgcatggacacctgctcacacctggaggtgagcagcctgtgcgaggagcaccgcatggacggctgtttctgcccagaaggcaccgtatatgacgacatcggggacagtggctgcgttcctgtgagccagtgccactgcaggctgcacggacacctgtacacaccgggccaggagatcaccaatgactgcgagcagtgtgtctgtaacgctggccgctgggtgtgcaaagacctgccctgccccggcacctgtgccctggacggcggctcccacatcaccaccttcgatgggaagacgtacaccttccacggggactgctactatgtcctggccaagggtgaccacaacgattcctacgctctcctgggcgagctggccccctgtggctccacagacaagcagacctgcctgaagacggtggtgctgctggctgacaagaagaagaatgtggtggtcttcaagtccgatggcagtgtactgctcaacgagctgcaggtgaacctgccccacgtgaccgcgagcttctctgtcttccgcccgtcttcctaccacatcatggtgagcatggccattggcgtccggctgcaggtgcagctggccccagtcatgcaactctttgtgacactggaccaggcctcccaggggcaggtgcagggcctctgcgggaacttcaacggcctggaaggtgacgacttcaagacggccagcgggctggtggaggccacgggggccggcttttgccaacacctggaaggcacagtcaagctgccatgacaagctggactggttggacgatccctgctccctgaacatcgagagcgccaactacgccgagcactggtgctccctcctgaagaagacagagaccccctttggcaggtgccactcggctgtggaccctgctgagtattacaagaggtgcaaatatgacacgtgtaactgtcagaacaatgaggactgcctgtgcgccgccctgtcctcctacgcgcgcgcctgcaccgccaagggcgtcatgctgtggggctggcgggagcatgtctgcaacaaggatgtgggctcctgccccaactcgcaggtcttcctgtacaacctgaccacctgccagcagacctgccgctccctctccgaggccgacagccactgtctcgagggctttgcgcctgtggacggctgcggctgccctgaccacaccttcctggacgagaagggccgctgcgtacccctggccaagtgctcctgttaccaccgcggtctctacctggaggcgggggatgtggtcgtcaggcaggaagaacgatgtgtgtgccgggatgggcggctgcactgtaggcagatccggctgatcggccagagctgcacggccccaaagatccacatggactgcagcaacctgactgcactggccacctcgaagccccgagccctcagctgccagacgctggccgccggctattaccacacagagtgtgtcagtggctgtgtgtgccccgacgggctgatggatgacggccggggtggctgcgtggtggagaaggaatgcccttgcgtccataacaacgacctgtattcttccggcgccaagatcaaggtggactgcaatacctgcacctgcaagagaggacgctgggtgtgcacccaggctgtgtgccatggcacctgctccatttacgggagtggccactacatcacctttgatgggaagtactacgactttgacggacactgctcctacgtggctgttcaggactactgcggccagaactcctcactgggctcattcagcatcatcaccgagaacgtcccctgtggcactacgggcgtcacctgctccaaggccatcaagatcttcatggggaggacggagctgaagttggaagacaagcaccgtgtggtgatccagcgtgatgagggtcaccacgtggcctacaccacgcgggaggtgggccagtacctggtggtggagtccagcacgggcatcatcgtcatctgggacaagaggaccaccgtgttcatcaagctggctccctcctacaagggcaccgtgtgtggcctgtgtgggaactttgaccaccgctccaacaacgacttcaccacgcgggaccacatggtggtgagcagcgagctggacttcgggaacagctggaaggaggcccccacctgcccagatgtgagcaccaaccccgagccctgcagcctgaacccgcaccgccgctcctgggccgagaagcagtgcagcatcctcaaaagcagcgtgttcagcatctgccacagcaaggtggaccccaagcccttctacgaggcctgtgtgcacgactcgtgctcctgtgacacgggtggggactgtgagtgcttctgctctgccgtggcctcctacgcccaggagtgtaccaaagagggggcctgcgtgttctggaggacgccggacctgtgccccatattctgcgactactacaaccctccgcatgagtgtgagtggcactatgagccatgtgggaaccggagcttcgagacctgcaggaccatcaacggcatccactccaacatctccgtgtcctacctggagggctgctacccccggtgccccaaggacaggcccatctatgaggaggatctgaagaagtgtgtcactgcagacaagtgtggctgctatgtcgaggacacccactacccacctggagcatcggttcccaccgaggagacctgcaagtcctgcgtgtgtaccaactcctcccaagtcgtctgcaggccggaggaaggaaagattcttaaccagacccaggatggcgccttctgctactgggagatctgtggccccaacgggacggtggagaagcacttcaacatctgttccattacgacacgcccgtccaccctgaccaccttcaccaccatcaccctccccaccacccccacctccttcaccactaccaccaccaccaccaccccgacctccagcacagttttatcaacaactccgaagctgtgctgcctctggtctgactggatcaatgaggaccaccccagcagtggcagcgacgacggtgaccgagaaccatttgatggggtctgcggggcccctgaggacatcgagtgcaggtcggtcaaggatccccacctcagcttggagcagcatggccagaaggtgcagtgtgatgtctctgttgggttcatttgcaagaatgaagaccagtttggaaatggaccatttggactgtgttacgactacaagatacgtgtcaattgttgctggcccatggataagtgtatcaccactcccagccctccaactaccactcccagccctccaccaaccacgacgaccacccttccaccaaccaccacccccagccctccaaccaccaccacaaccacccctccaccaaccaccacccccagccctccaataaccaccacgaccacccctctaccaaccaccactcccagccctccaataagcaccacaaccacccctccaccaaccaccactcccagccctccaaccaccactcccagccctccaaccaccactcccagccctccaacaaccaccacaaccacccctccaccaaccaccactcccagccctccaatgactacgcccatcactccaccagccagcactaccacccttccaccaaccaccactcccagccctccaacaaccaccacaaccacccctccaccaaccaccactcccagtcctccaacgactacgcccatcactccaccaaccagcactactacccttccaccaaccaccactcccagccctccaccaaccaccacaaccacccctccaccaaccaccactcccagccctccaacaaccaccactcccagtcctccaacaatcaccacaaccacccctccaccaaccaccactcccagccctccaacaacgaccacaaccacccctccaccaaccaccactcccagccctccaacgactacacccatcactccaccaaccagcactaccacccttccaccaaccaccactcccagccctccaccaaccaccacaaccacccctccaccaaccaccactcccagccctccaacaaccaccactcccagccctccaataaccaccacaaccacccctccaccaaccaccactcccagctctccaataaccaccactcccagccctccaacaaccaccatgaccaccccttcaccaaccaccacccccagctctccaataaccaccacaaccaccccttcctcaactaccactcccagccctccaccaaccaccatgaccaccccttcaccaaccaccactcccagccctccaacaaccaccatgaccacccttccaccaaccaccacttccagccctctaacaactactcctctacctccatcaataactcctcctacattttcaccattctcaacgacaacccctactaccccatgcgtgcctctctgcaattggactggctggctggattctggaaaacccaactttcacaaaccaggtggagacacagaattgattggagacgtctgtggaccaggctgggcagctaacatctcttgcagagccaccatgtatcctgatgttcccattggacagcttggacaaacagtggtgtgtgatgtctctgtggggctgatatgcaaaaatgaagaccaaaagccaggtggggtcatccctatggccttctgcctcaactacgagatcaacgttcagtgctgtgagtgtgtcacccaacccaccaccatgacaaccaccaccacagagaacccaactccgacacccatcaccaccaccactacggtgaccccaaccccaacacccaccggcacacagaccccaaccatgatacccatcagcaccaccactacggtgaccccaaccccaacacccaccactggaagcacggggccccccacccacacaagcacagcaccgattgctgagttgaccacatccaatcctccgcctgagtcctcaacccctcagacctctcggtccacctcttcccctctcacggagtcaaccacccttctgagtaccctaccacctgccattgagatgaccagcacggccccaccctccacacccacggcacccacgaccacgagcggaggccacacactgtctccaccgcccagcaccaccacgtcccctccaggcacccccactcgcggtaccacgaccgggtcatcttcagcccccacccccagcactgtgcagacgaccaccaccagtgcctggaccccaacgccgaccccactctccacacccagcatcatcaggaccacaggcctgaggccctacccttcctctgtgcttatctgctgtgtcctgaacgacacctactacgcaccaggtgaggaggtgtacaacggcacatacggagacacctgttatttcgtcaactgctcactgagctgtacgttggagttctataactggtcctgcccatccacgccctccccaacacccacgccctccaagtcgacgcccacgccttccaagccatcgtccacgccctccaagccgacgcccggcaccaagccccccgagtgcccagactttgatcctcccagacaggagaacgagacttggtggctgtgcgactgcttcatggccacgtgcaagtacaacaacacggtggagatcgtgaaggtggagtgtgagccgccgcccatgcccacctgctccaacggcctccaacccgtgcgcgtcgaggaccccgacggctgctgctggcactgggagtgcgactgctactgcacgggctggggcgacccgcactatgtcaccttcgacggactctactacagctaccagggcaactgcacctacgtgctggtggaggagatcagcccctccgtggacaacttcggagtttacatcgacaactaccactgcgatcccaacgacaaggtgtcctgcccccgcaccctcatcgtgcgccacgagacccaggaggtgctgatcaagaccgtgcatatgatgcccatgcaggtgcaggtgcaggtgaacaggcaggcggtggcactgccctacaagaagtacgggctggaggtgtaccagtctggcatcaactacgtggtggacatccccgagctgggtgtcctcgtctcctacaatggcctgtccttctccgtcaggctgccctaccaccggtttggcaacaacaccaagggccagtgtggcacctgcaccaacaccacctccgacgactgcattctgcccagcggggagatcgtctccaactgtgaggctgcggctgaccagtggctggtgaacgacccctccaagccacactgcccccacagcagctccacgaccaagcgcccggccgtcactgtgcccgggggcggtaaaacgaccccacacaaggactgcaccccatctcccctctgccagctcatcaaggacagcctgtttgcccagtgccacgcactggtgcccccgcagcactactacgatgcctgcgtgttcgacagctgcttcatgccgggctcgagcctggagtgcgccagtctgcaggcctacgcagccctctgtgcccagcagaacatctgcctcgactggcggaaccacacgcatggggcctgcttggtggagtgcccatctcacagggagtaccaggcctgtggccctgcagaagagcccacgtgcaaatccagctcctcccagcagaacaacacagtcctggtggaaggctgcttctgtcctgagggcaccatgaactacgctcctggctttgatgtctgcgtgaagacctgcggctgtgtgggacctgacaatgtgcccagagagtttggggagcacttcgagttcgactgcaagaactgtgtctgcctggagggtggaagtggcatcatctgccaacccaagaggtgcagccagaagcccgttacccactgcgtggaagacggcacctacctcgccacggaggtcaaccctgccgacacctgctgcaacattaccgtctgcaagtgcaacaccagcctgtgcaaagagaagccctccgtgtgcccgctgggattcgaagtgaagagcaagatggtgcctggaaggtgctgtcctttctactggtgtgagtccaagggggtgtgtgttcacgggaatgctgagtaccagcccggttctccagtttattcctccaagtgccaggactgcgtgtgcacggacaaggtggacaacaacaccctgctcaacgtcatcgcctgcacccacgtgccctgcaacacctcctgcagccctggcttcgaactcatggaggcccccggggagtgctgtaagaagtgtgaacagacgcactgtatcatcaaacggcccgacaaccagcacgtcatcctgaagcccggggacttcaagagcgacccgaagaacaactgcacattcttcagctgcgtgaagatccacaaccagctcatctcgtccgtctccaacatcacctgccccaactttgatgccagcatttgcatcccgggctccatcacattcatgcccaatggatgctgcaagacctgcacccctcgcaatgagaccagggtgccctgctccaccgtccccgtcaccacggaggtttcgtacgccggctgcaccaagaccgtcctcatgaatcattgctccgggtcctgcgggacatttgtcatgtactcggccaaggcccaggccctggaccacagctgctcctgctgcaaagaggagaaaaccagccagcgtgaggtggtcctgagctgccccaatggcggctcgctgacacacacctacacccacatcgagagctgccagtgccaggacaccgtctgcgggctccccaccggcacctcccgccgggcccggcgctcccctaggcatctggggagcgggtgagcggggtgggcacagcccccttcactgccctcgacagctttacctcccccggaccctctgagcctcctaagctcggcttcctctcttcagatatttattgtctgagtctttgttcagtccttgctttccaataataaactcagggggacatgcaaaaaaaaaa

SEQ ID NO: 488738 - DNA, 675 bp, Homo sapiens
  misc_feature (103)..(104): n is a, c, g, or t
  misc_feature (460)..(460): n is a, c, g, or t
  misc_feature (609)..(609): n is a, c, g, or t
  misc_feature (620)..(620): n is a, c, g, or t
ataaaggaaacgaggatttaataccgaggtcaataacttaaaaatgtgtaactgtaaaagtgagataatctaaacttacattcttccagctatgccatttttnngtattcaaactgtgccttttatgtaaatagcctaattatgtttcaacagaactaacacttgaggtcaaattctttcatatgtgtaaaataaaaatgctattccaaagtagcaaaggctgggcatggtggctcatgcctgtaatcccagtactttgggaggccaaggcgggcggatcacctgaggtcaggagttcaagaccagcctgaccaacacggagaaaccccatctttactaaaaatacaaattagctgggtgtggtggtgcatgcgtgtaaccccagctatttgggagactgagacaggagaatcacttgaactgggaggtggagcctgcagtaagccaagatcgcaccatngcactccagcctggttaacaaaagcaaaactctgtctcaaaaaaagaaaaaaagagaaagggtggaaaagagggattccagagtgccaggcacacagattttctggaaggttacatgaggacgctgtggttgaatgtgtccccaaagtntgtgttggaantcaaccctaatgcacagtgtgtcagggaccttagagggatagtatgaggtctgct

SEQ ID NO: 488739 - DNA, 4892 bp, Homo sapiens
  misc_feature (1436)..(1436): n is a, c, g, or t
  misc_feature (1528)..(1528): n is a, c, g, or t
acgcatcacctaaatctattgctgttctatgatttcccccttatgtcactcatcaccacaatgacacccccttacaatcaccactcccagccctccaacaaccaccatgaccacccttccaccaaccaccacttccagccctctaacaactactcctctacctccatcaataactcctcctacattttcaccattctcaacgacaacccctactaccccatgcgtgcctctctgcaattggactggctggctggattctggaaaacccaactttcacaaaccaggtggagacacagaattgattggagacgtctgtggaccaggctgggcagctaacatctcttgcagagccaccatgtatcctgatgttcccattggacagcttggacaaacagtggtgtgtgatgtctctgtggggctgatatgcaaaaatgaagaccaaaagccaggtggggtcatccctatggccttctgcctcaactacgagatcaacgttcagtgctgtgagtgtgtcacccaacccaccaccatgacaaccaccaccacagagaacccaactccgccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccncgacacccatcaccaccaccactacggtgaccccaaccccaacacccaccggcacacagaccccaaccacgacacccatcaccaccaccacnacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccatgatacccatcagcaccaccactacggtgaccccaaccccaacacccaccactggaagcacggggccccccacccacacaagcacagcaccgattgctgagttgaccacatccaatcctccgcctgagtcctcaacccctcagacctctcggtccacctcttcccctctcacggagtcaaccacccttctgagtaccctaccacctgccattgagatgaccagcacggccccaccctccacacccacggcacccacgaccacgagcggaggccacacactgtctccaccgcccagcaccaccacgtcccctccaggcacccccactcgcggtaccacgaccgggtcatcttcagcccccacccccagcactgtgcagacgaccaccaccagtgcctggaccccaacgccgaccccactctccacacccagcatcatcaggaccacaggcctgaggccctacccttcctctgtgcttatctgctgtgtcctgaacgacacctactacgcaccaggtgaggaggtgtacaacggcacatacggagacacctgttatttcgtcaactgctcactgagctgtacgttggagttctataactggtcctgcccatccacgccctccccaacacccacgccctccaagtcgacgcccacgccttccaagccatcgtccacgccctccaagccgacgcccggcaccaagccccccgagtgcccagactttgatcctcccagacaggagaacgagacttggtggctgtgcgactgcttcatggccacgtgcaagtacaacaacacggtggagatcgtgaaggtggagtgtgagccgccgcccatgcccacctgctccaacggcctccaacccgtgcgcgtcgaggaccccgacggctgctgctggcactgggagtgcgactgctactgcacgggctggggcgacccgcactatgtcaccttcgacggactctactacagctaccagggcaactgcacctacgtgctggtggaggagatcagcccctccgtggacaacttcggagtttacatcgacaactaccactgcgatcccaacgacaaggtgtcctgcccccgcaccctcatcgtgcgccacgagacccaggaggtgctgatcaagaccgtgcatatgatgcccatgcaggtgcaggtgcaggtgaacaggcaggcggtggcactgccctacaagaagtacgggctggaggtgtaccagtctggcatcaactacgtggtggacatccccgagctgggtgtcctcgtctcctacaatggcctgtccttctccgtcaggctgccctaccaccggtttggcaacaacaccaagggccagtgtggcacctgcaccaacaccacctccgacgactgcattctgcccagcggggagatcgtctccaactgtgaggctgcggctgaccagtggctggtgaacgacccctccaagccacactgcccccacagcagctccacgaccaagcgcccggccgtcactgtgcccgggggcggtaaaacgaccccacacaaggactgcaccccatctcccctctgccagctcatcaaggacagcctgtttgcccagtgccacgcactggtgcccccgcagcactactacgatgcctgcgtgttcgacagctgcttcatgccgggctcgagcctggagtgcgccagtctgcaggcctacgcagccctctgtgcccagcagaacatctgcctcgactggcggaaccacacgcatggggcctgcttggtggagtgcccatctcacagggagtaccaggcctgtggccctgcagaagagcccacgtgcaaatccagctcctcccagcagaacaacacagtcctggtggaaggctgcttctgtcctgagggcaccatgaactacgctcctggctttgatgtctgcgtgaagacctgcggctgtgtgggacctgacaatgtgcccagagagtttggggagcacttcgagttcgactgcaagaactgtgtctgcctggagggtggaagtggcatcatctgccaacccaagaggtgcagccagaagcccgttacccactgcgtggaagacggcacctacctcgccacggaggtcaaccctgccgacacctgctgcaacattaccgtctgcaagtgcaacaccagcctgtgcaaagagaagccctccgtgtgcccgctgggattcgaagtgaagagcaagatggtgcctggaaggtgctgtcctttctactggtgtgagtccaagggggtgtgtgttcacgggaatgctgagtaccagcccggttctccagtttattcctccaagtgccaggactgcgtgtgcacggacaaggtggacaacaacaccctgctcaacgtcatcgcctgcacccacgtgccctgcaacacctcctgcagccctggcttcgaactcatggaggcccccggggagtgctgtaagaagtgtgaacagacgcactgtatcatcaaacggcccgacaaccagcacgtcatcctgaagcccggggacttcaagagcgacccgaagaacaactgcacattcttcagctgcgtgaagatccacaaccagctcatctcgtccgtctccaacatcacctgccccaactttgatgccagcatttgcatcccgggctccatcacattcatgcccaatggatgctgcaagacctgcacccctcgcaatgagaccagggtgccctgctccaccgtccccgtcaccacggaggtttcgtacgccggctgcaccaagaccgtcctcatgaatcattgctccgggtcctgcgggacatttgtcatgtactcggccaaggcccaggccctggaccacagctgctcctgctgcaaagaggagaaaaccagccagcgtgaggtggtcctgagctgccccaatggcggctcgctgacacacacctacacccacatcgagagctgccagtgccaggacaccgtctgcgggctccccaccggcacctcccgccgggcccggcgctcccctaggcatctggggagcgggtgagcggggtgggcacagcccccttcactgccctcgacagctttacctcccccggaccctctgagcctcctaagctcggcttcctctcttcagatatttattgtctgagtctttgttcagtccttgctttccaataataaactcagggggacatgcaaaaaaaaaa

SEQ ID NO: 488740 - DNA, 667 bp, Homo sapiens
  misc_feature (52)..(52): n is a, c, g, or t
  misc_feature (55)..(55): n is a, c, g, or t
  misc_feature (104)..(104): n is a, c, g, or t
  misc_feature (146)..(146): n is a, c, g, or t
  misc_feature (427)..(427): n is a, c, g, or t
ttacaacccacgatcaccaaaaaaaaaaagatcaactggtgagtacagattnaanctgtgtccctctattaaatcattaacagtaacattactttttaaagtcngcttggtttaaaagcaaacaatagcgtttttttcaatttttngtaatgcaaataaaatagcacagccactattccagattatatgaaaatgacttcctttcctataacttttaatagcttaaaggaagtttctatcacttgatagaaaatttttaatttcccgaaagtaagcttggcagactttacaaccccacgactttacacaagataacaccccaaatcagatctgtgaaatactgtatcaatgacaataatgcatgctcttctataatactaaaggcttggccaggcgttgtggctcatgcctgtaattccagcacttngggaggccaaggcaggcagatcatgaggttaggagatcaagaccatcctggccaatatggtgaaaccctgtctctactaaaaatacaaaattagctgggtgtggtggcgcacgcctatagtcctagctactcaggaggctgaggcaggagaattgcttgaacccaggaaatggaggttgcagtgaaccgagactgcgcagttgcactacagtctgggcgacaagagtgaaactccgtctc

SEQ ID NO: 488741 - DNA, 9812 bp, Homo sapiens
  misc_feature (6587)..(6587): n is a, c, g, or t
  misc_feature (6679)..(6679): n is a, c, g, or t
caacccacaccgcccctgccagccaccatggggctgccactagcccgcctggcggctgtgtgcctggccctgtctttggcagggggctcggagctccagacagagggcagaacccgataccacggccgcaacgtctgcagcacctggggcaacttccactacaagaccttcgacggggacgtcttccgcttccccggcctctgcgactacaacttcgcctccgactgccgaggctcctacaaggaatttgctgtgcacctgaagcggggtccgggccaggctgaggcccccgccggggtggagtccatcctgctgaccatcaaggatgacaccatctacctcacccgccacctggctgtgcttaacggggccgtggtcagcaccccgcactacagccccgggctgctcattgagaagagcgatgcctacaccaaagtctactcccgcgccggcctcaccctcatgtggaaccgggaggatgcactcatgctggagctggacactaagttccggaaccacacctgtggcctctgcggggactacaacggcctgcagagctattcagaattcctctctgacggcgtgctcttcagtcccctggagtttgggaacatgcagaagatcaaccagcccgatgtggtgtgtgaggatcccgaggaggaggtggcccccgcatcctgctccgagcaccgcgccgagtgtgagaggctgctgaccgccgaggccttcgcggactgtcaggacctggtgccgctggagccgtatctgcgcgcctgccagcaggaccgctgccggtgcccgggcggtgacacctgcgtctgcagcaccgtggccgagttctcccgccagtgctcccacgccggcggccggcccgggaactggaggaccgccacgctctgccccaagacctgccccgggaacctggtgtacctggagagcggctcgccctgcatggacacctgctcacacctggaggtgagcagcctgtgcgaggagcaccgcatggacggctgtttctgcccagaaggcaccgtatatgacgacatcggggacagtggctgcgttcctgtgagccagtgccactgcaggctgcacggacacctgtacacaccgggccaggagatcaccaatgactgcgagcagtgtgtctgtaacgctggccgctgggtgtgcaaagacctgccctgccccggcacctgtgccctggacggcggctcccacatcaccaccttcgatgggaagacgtacaccttccacggggactgctactatgtcctggccaagggtgaccacaacgattcctacgctctcctgggcgagctggccccctgtggctccacagacaagcagacctgcctgaagacggtggtgctgctggctgacaagaagaagaatgtggtggtcttcaagtccgatggcagtgtactgctcaacgagctgcaggtgaacctgccccacgtgaccgcgagcttctctgtcttccgcccgtcttcctaccacatcatggtgagcatggccattggcgtccggctgcaggtgcagctggccccagtcatgcaactctttgtgacactggaccaggcctcccaggggcaggtgcagggcctctgcgggaacttcaacggcctggaaggtgacgacttcaagacggccagcgggctggtggaggccacgggggccggcttttgccaacacctggaaggcacagtcaagctgccatgacaagctggactggttggacgatccctgctccctgaacatcgagagcgccaactacgccgagcactggtgctccctcctgaagaagacagagaccccctttggcaggtgccactcggctgtggaccctgctgagtattacaagaggtgcaaatatgacacgtgtaactgtcagaacaatgaggactgcctgtgcgccgccctgtcctcctacgcgcgcgcctgcaccgccaagggcgtcatgctgtggggctggcgggagcatgtctgcaacaaggatgtgggctcctgccccaactcgcaggtcttcctgtacaacctgaccacctgccagcagacctgccgctccctctccgaggccgacagccactgtctcgagggctttgcgcctgtggacggctgcggctgccctgaccacaccttcctggacgagaagggccgctgcgtacccctggccaagtgctcctgttaccaccgcggtctctacctggaggcgggggatgtggtcgtcaggcaggaagaacgatgtgtgtgccgggatgggcggctgcactgtaggcagatccggctgatcggccagagctgcacggccccaaagatccacatggactgcagcaacctgactgcactggccacctcgaagccccgagccctcagctgccagacgctggccgccggctattaccacacagagtgtgtcagtggctgtgtgtgccccgacgggctgatggatgacggccggggtggctgcgtggtggagaaggaatgcccttgcgtccataacaacgacctgtattcttccggcgccaagatcaaggtggactgcaatacctgcacctgcaagagaggacgctgggtgtgcacccaggctgtgtgccatggcacctgctccatttacgggagtggccactacatcacctttgatgggaagtactacgactttgacggacactgctcctacgtggctgttcaggactactgcggccagaactcctcactgggctcattcagcatcatcaccgagaacgtcccctgtggcactacgggcgtcacctgctccaaggccatcaagatcttcatggggaggacggagctgaagttggaagacaagcaccgtgtggtgatccagcgtgatgagggtcaccacgtggcctacaccacgcgggaggtgggccagtacctggtggtggagtccagcacgggcatcatcgtcatctgggacaagaggaccaccgtgttcatcaagctggctccctcctacaagggcaccgtgtgtggcctgtgtgggaactttgaccaccgctccaacaacgacttcaccacgcgggaccacatggtggtgagcagcgagctggacttcgggaacagctggaaggaggcccccacctgcccagatgtgagcaccaaccccgagccctgcagcctgaacccgcaccgccgctcctgggccgagaagcagtgcagcatcctcaaaagcagcgtgttcagcatctgccacagcaaggtggaccccaagcccttctacgaggcctgtgtgcacgactcgtgctcctgtgacacgggtggggactgtgagtgcttctgctctgccgtggcctcctacgcccaggagtgtaccaaagagggggcctgcgtgttctggaggacgccggacctgtgccccatattctgcgactactacaaccctccgcatgagtgtgagtggcactatgagccatgtgggaaccggagcttcgagacctgcaggaccatcaacggcatccactccaacatctccgtgtcctacctggagggctgctacccccggtgccccaaggacaggcccatctatgaggaggatctgaagaagtgtgtcactgcagacaagtgtggctgctatgtcgaggacacccactacccacctggagcatcggttcccaccgaggagacctgcaagtcctgcgtgtgtaccaactcctcccaagtcgtctgcaggccggaggaaggaaagattcttaaccagacccaggatggcgccttctgctactgggagatctgtggccccaacgggacggtggagaagcacttcaacatctgttccattacgacacgcccgtccaccctgaccaccttcaccaccatcaccctccccaccacccccacctccttcaccactaccaccaccaccaccaccccgacctccagcacagttttatcaacaactccgaagctgtgctgcctctggtctgactggatcaatgaggaccaccccagcagtggcagcgacgacggtgaccgagaaccatttgatggggtctgcggggcccctgaggacatcgagtgcaggtcggtcaaggatccccacctcagcttggagcagcatggccagaaggtgcagtgtgatgtctctgttgggttcatttgcaagaatgaagaccagtttggaaatggaccatttggactgtgttacgactacaagatacgtgtcaattgttgctggcccatggataagtgtatcaccactcccagccctccaactaccactcccagccctccaccaaccacgacgaccacccttccaccaaccaccacccccagccctccaaccaccaccacaaccacccctccaccaaccaccacccccagccctccaataaccaccacgaccacccctctaccaaccaccactcccagccctccaataagcaccacaaccacccctccaccaaccaccactcccagccctccaaccaccactcccagccctccaaccaccactcccagccctccaacaaccaccacaaccacccctccaccaaccaccactcccagccctccaatgactacgcccatcactccaccagccagcactaccacccttccaccaaccaccactcccagccctccaacaaccaccacaaccacccctccaccaaccaccactcccagtcctccaacgactacgcccatcactccaccaaccagcactactacccttccaccaaccaccactcccagccctccaccaaccaccacaaccacccctccaccaaccaccactcccagccctccaacaaccaccactcccagtcctccaacaatcaccacaaccacccctccaccaaccaccactcccagccctccaacaacgaccacaaccacccctccaccaaccaccactcccagccctccaacgactacacccatcactccaccaaccagcactaccacccttccaccaaccaccactcccagccctccaccaaccaccacaaccacccctccaccaaccaccactcccagccctccaacaaccaccactcccagccctccaataaccaccacaaccacccctccaccaaccaccactcccagctctccaataaccaccactcccagccctccaacaaccaccatgaccaccccttcaccaaccaccacccccagctctccaataaccaccacaaccaccccttcctcaactaccactcccagccctccaccaaccaccatgaccaccccttcaccaaccaccactcccagccctccaacaaccaccatgaccacccttccaccaaccaccacttccagccctctaacaactactcctctacctccatcaataactcctcctacattttcaccattctcaacgacaacccctactaccccatgcgtgcctctctgcaattggactggctggctggattctggaaaacccaactttcacaaaccaggtggagacacagaattgattggagacgtctgtggaccaggctgggcagctaacatctcttgcagagccaccatgtatcctgatgttcccattggacagcttggacaaacagtggtgtgtgatgtctctgtggggctgatatgcaaaaatgaagaccaaaagccaggtggggtcatccctatggccttctgcctcaactacgagatcaacgttcagtgctgtgagtgtgtcacccaacccaccaccatgacaaccaccaccacagagaacccaactccgccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccncgacacccatcaccaccaccactacggtgaccccaaccccaacacccaccggcacacagaccccaaccacgacacccatcaccaccaccacnacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccatgatacccatcagcaccaccactacggtgaccccaaccccaacacccaccactggaagcacggggccccccacccacacaagcacagcaccgattgctgagttgaccacatccaatcctccgcctgagtcctcaacccctcagacctctcggtccacctcttcccctctcacggagtcaaccacccttctgagtaccctaccacctgccattgagatgaccagcacggccccaccctccacacccacggcacccacgaccacgagcggaggccacacactgtctccaccgcccagcaccaccacgtcccctccaggcacccccactcgcggtaccacgaccgggtcatcttcagcccccacccccagcactgtgcagacgaccaccaccagtgcctggaccccaacgccgaccccactctccacacccagcatcatcaggaccacaggcctgaggccctacccttcctctgtgcttatctgctgtgtcctgaacgacacctactacgcaccaggtgaggaggtgtacaacggcacatacggagacacctgttatttcgtcaactgctcactgagctgtacgttggagttctataactggtcctgcccatccacgccctccccaacacccacgccctccaagtcgacgcccacgccttccaagccatcgtccacgccctccaagccgacgcccggcaccaagccccccgagtgcccagactttgatcctcccagacaggagaacgagacttggtggctgtgcgactgcttcatggccacgtgcaagtacaacaacacggtggagatcgtgaaggtggagtgtgagccgccgcccatgcccacctgctccaacggcctccaacccgtgcgcgtcgaggaccccgacggctgctgctggcactgggagtgcgactgctactgcacgggctggggcgacccgcactatgtcaccttcgacggactctactacagctaccagggcaactgcacctacgtgctggtggaggagatcagcccctccgtggacaacttcggagtttacatcgacaactaccactgcgatcccaacgacaaggtgtcctgcccccgcaccctcatcgtgcgccacgagacccaggaggtgctgatcaagaccgtgcatatgatgcccatgcaggtgcaggtgcaggtgaacaggcaggcggtggcactgccctacaagaagtacgggctggaggtgtaccagtctggcatcaactacgtggtggacatccccgagctgggtgtcctcgtctcctacaatggcctgtccttctccgtcaggctgccctaccaccggtttggcaacaacaccaagggccagtgtggcacctgcaccaacaccacctccgacgactgcattctgcccagcggggagatcgtctccaactgtgaggctgcggctgaccagtggctggtgaacgacccctccaagccacactgcccccacagcagctccacgaccaagcgcccggccgtcactgtgcccgggggcggtaaaacgaccccacacaaggactgcaccccatctcccctctgccagctcatcaaggacagcctgtttgcccagtgccacgcactggtgcccccgcagcactactacgatgcctgcgtgttcgacagctgcttcatgccgggctcgagcctggagtgcgccagtctgcaggcctacgcagccctctgtgcccagcagaacatctgcctcgactggcggaaccacacgcatggggcctgcttggtggagtgcccatctcacagggagtaccaggcctgtggccctgcagaagagcccacgtgcaaatccagctcctcccagcagaacaacacagtcctggtggaaggctgcttctgtcctgagggcaccatgaactacgctcctggctttgatgtctgcgtgaagacctgcggctgtgtgggacctgacaatgtgcccagagagtttggggagcacttcgagttcgactgcaagaactgtgtctgcctggagggtggaagtggcatcatctgccaacccaagaggtgcagccagaagcccgttacccactgcgtggaagacggcacctacctcgccacggaggtcaaccctgccgacacctgctgcaacattaccgtctgcaagtgcaacaccagcctgtgcaaagagaagccctccgtgtgcccgctgggattcgaagtgaagagcaagatggtgcctggaaggtgctgtcctttctactggtgtgagtccaagggggtgtgtgttcacgggaatgctgagtaccagcccggttctccagtttattcctccaagtgccaggactgcgtgtgcacggacaaggtggacaacaacaccctgctcaacgtcatcgcctgcacccacgtgccctgcaacacctcctgcagccctggcttcgaactcatggaggcccccggggagtgctgtaagaagtgtgaacagacgcactgtatcatcaaacggcccgacaaccagcacgtcatcctgaagcccggggacttcaagagcgacccgaagaacaactgcacattcttcagctgcgggacatttgtcatgtactcggccaaggcccaggccctggaccacagctgctcctgctgcaaagaggagaaaaccagccagcgtgaggtggtcctgagctgccccaatggcggctcgctgacacacacctacacccacatcgagagctgccagtgccaggacaccgtctgcgggctccccaccggcacctcccgccgggcccggcgctcccctaggcatctggggagcgggtgagcggggtgggcacagcccccttcactgccctcgacagctttacctcccccggaccctctgagcctcctaagctcggcttcctctcttcagatatttattgtctgagtctttgttcagtccttgctttccaataataaactcagggggacatgcaaaaaaaaaa

SEQ ID NO: 488742 - DNA, 9626 bp, Homo sapiens
  misc_feature (6587)..(6587): n is a, c, g, or t
  misc_feature (6679)..(6679): n is a, c, g, or t
caacccacaccgcccctgccagccaccatggggctgccactagcccgcctggcggctgtgtgcctggccctgtctttggcagggggctcggagctccagacagagggcagaacccgataccacggccgcaacgtctgcagcacctggggcaacttccactacaagaccttcgacggggacgtcttccgcttccccggcctctgcgactacaacttcgcctccgactgccgaggctcctacaaggaatttgctgtgcacctgaagcggggtccgggccaggctgaggcccccgccggggtggagtccatcctgctgaccatcaaggatgacaccatctacctcacccgccacctggctgtgcttaacggggccgtggtcagcaccccgcactacagccccgggctgctcattgagaagagcgatgcctacaccaaagtctactcccgcgccggcctcaccctcatgtggaaccgggaggatgcactcatgctggagctggacactaagttccggaaccacacctgtggcctctgcggggactacaacggcctgcagagctattcagaattcctctctgacggcgtgctcttcagtcccctggagtttgggaacatgcagaagatcaaccagcccgatgtggtgtgtgaggatcccgaggaggaggtggcccccgcatcctgctccgagcaccgcgccgagtgtgagaggctgctgaccgccgaggccttcgcggactgtcaggacctggtgccgctggagccgtatctgcgcgcctgccagcaggaccgctgccggtgcccgggcggtgacacctgcgtctgcagcaccgtggccgagttctcccgccagtgctcccacgccggcggccggcccgggaactggaggaccgccacgctctgccccaagacctgccccgggaacctggtgtacctggagagcggctcgccctgcatggacacctgctcacacctggaggtgagcagcctgtgcgaggagcaccgcatggacggctgtttctgcccagaaggcaccgtatatgacgacatcggggacagtggctgcgttcctgtgagccagtgccactgcaggctgcacggacacctgtacacaccgggccaggagatcaccaatgactgcgagcagtgtgtctgtaacgctggccgctgggtgtgcaaagacctgccctgccccggcacctgtgccctggacggcggctcccacatcaccaccttcgatgggaagacgtacaccttccacggggactgctactatgtcctggccaagggtgaccacaacgattcctacgctctcctgggcgagctggccccctgtggctccacagacaagcagacctgcctgaagacggtggtgctgctggctgacaagaagaagaatgtggtggtcttcaagtccgatggcagtgtactgctcaacgagctgcaggtgaacctgccccacgtgaccgcgagcttctctgtcttccgcccgtcttcctaccacatcatggtgagcatggccattggcgtccggctgcaggtgcagctggccccagtcatgcaactctttgtgacactggaccaggcctcccaggggcaggtgcagggcctctgcgggaacttcaacggcctggaaggtgacgacttcaagacggccagcgggctggtggaggccacgggggccggcttttgccaacacctggaaggcacagtcaagctgccatgacaagctggactggttggacgatccctgctccctgaacatcgagagcgccaactacgccgagcactggtgctccctcctgaagaagacagagaccccctttggcaggtgccactcggctgtggaccctgctgagtattacaagaggtgcaaatatgacacgtgtaactgtcagaacaatgaggactgcctgtgcgccgccctgtcctcctacgcgcgcgcctgcaccgccaagggcgtcatgctgtggggctggcgggagcatgtctgcaacaaggatgtgggctcctgccccaactcgcaggtcttcctgtacaacctgaccacctgccagcagacctgccgctccctctccgaggccgacagccactgtctcgagggctttgcgcctgtggacggctgcggctgccctgaccacaccttcctggacgagaagggccgctgcgtacccctggccaagtgctcctgttaccaccgcggtctctacctggaggcgggggatgtggtcgtcaggcaggaagaacgatgtgtgtgccgggatgggcggctgcactgtaggcagatccggctgatcggccagagctgcacggccccaaagatccacatggactgcagcaacctgactgcactggccacctcgaagccccgagccctcagctgccagacgctggccgccggctattaccacacagagtgtgtcagtggctgtgtgtgccccgacgggctgatggatgacggccggggtggctgcgtggtggagaaggaatgcccttgcgtccataacaacgacctgtattcttccggcgccaagatcaaggtggactgcaatacctgcacctgcaagagaggacgctgggtgtgcacccaggctgtgtgccatggcacctgctccatttacgggagtggccactacatcacctttgatgggaagtactacgactttgacggacactgctcctacgtggctgttcaggactactgcggccagaactcctcactgggctcattcagcatcatcaccgagaacgtcccctgtggcactacgggcgtcacctgctccaaggccatcaagatcttcatggggaggacggagctgaagttggaagacaagcaccgtgtggtgatccagcgtgatgagggtcaccacgtggcctacaccacgcgggaggtgggccagtacctggtggtggagtccagcacgggcatcatcgtcatctgggacaagaggaccaccgtgttcatcaagctggctccctcctacaagggcaccgtgtgtggcctgtgtgggaactttgaccaccgctccaacaacgacttcaccacgcgggaccacatggtggtgagcagcgagctggacttcgggaacagctggaaggaggcccccacctgcccagatgtgagcaccaaccccgagccctgcagcctgaacccgcaccgccgctcctgggccgagaagcagtgcagcatcctcaaaagcagcgtgttcagcatctgccacagcaaggtggaccccaagcccttctacgaggcctgtgtgcacgactcgtgctcctgtgacacgggtggggactgtgagtgcttctgctctgccgtggcctcctacgcccaggagtgtaccaaagagggggcctgcgtgttctggaggacgccggacctgtgccccatattctgcgactactacaaccctccgcatgagtgtgagtggcactatgagccatgtgggaaccggagcttcgagacctgcaggaccatcaacggcatccactccaacatctccgtgtcctacctggagggctgctacccccggtgccccaaggacaggcccatctatgaggaggatctgaagaagtgtgtcactgcagacaagtgtggctgctatgtcgaggacacccactacccacctggagcatcggttcccaccgaggagacctgcaagtcctgcgtgtgtaccaactcctcccaagtcgtctgcaggccggaggaaggaaagattcttaaccagacccaggatggcgccttctgctactgggagatctgtggccccaacgggacggtggagaagcacttcaacatctgttccattacgacacgcccgtccaccctgaccaccttcaccaccatcaccctccccaccacccccacctccttcaccactaccaccaccaccaccaccccgacctccagcacagttttatcaacaactccgaagctgtgctgcctctggtctgactggatcaatgaggaccaccccagcagtggcagcgacgacggtgaccgagaaccatttgatggggtctgcggggcccctgaggacatcgagtgcaggtcggtcaaggatccccacctcagcttggagcagcatggccagaaggtgcagtgtgatgtctctgttgggttcatttgcaagaatgaagaccagtttggaaatggaccatttggactgtgttacgactacaagatacgtgtcaattgttgctggcccatggataagtgtatcaccactcccagccctccaactaccactcccagccctccaccaaccacgacgaccacccttccaccaaccaccacccccagccctccaaccaccaccacaaccacccctccaccaaccaccacccccagccctccaataaccaccacgaccacccctctaccaaccaccactcccagccctccaataagcaccacaaccacccctccaccaaccaccactcccagccctccaaccaccactcccagccctccaaccaccactcccagccctccaacaaccaccacaaccacccctccaccaaccaccactcccagccctccaatgactacgcccatcactccaccagccagcactaccacccttccaccaaccaccactcccagccctccaacaaccaccacaaccacccctccaccaaccaccactcccagtcctccaacgactacgcccatcactccaccaaccagcactactacccttccaccaaccaccactcccagccctccaccaaccaccacaaccacccctccaccaaccaccactcccagccctccaacaaccaccactcccagtcctccaacaatcaccacaaccacccctccaccaaccaccactcccagccctccaacaacgaccacaaccacccctccaccaaccaccactcccagccctccaacgactacacccatcactccaccaaccagcactaccacccttccaccaaccaccactcccagccctccaccaaccaccacaaccacccctccaccaaccaccactcccagccctccaacaaccaccactcccagccctccaataaccaccacaaccacccctccaccaaccaccactcccagctctccaataaccaccactcccagccctccaacaaccaccatgaccaccccttcaccaaccaccacccccagctctccaataaccaccacaaccaccccttcctcaactaccactcccagccctccaccaaccaccatgaccaccccttcaccaaccaccactcccagccctccaacaaccaccatgaccacccttccaccaaccaccacttccagccctctaacaactactcctctacctccatcaataactcctcctacattttcaccattctcaacgacaacccctactaccccatgcgtgcctctctgcaattggactggctggctggattctggaaaacccaactttcacaaaccaggtggagacacagaattgattggagacgtctgtggaccaggctgggcagctaacatctcttgcagagccaccatgtatcctgatgttcccattggacagcttggacaaacagtggtgtgtgatgtctctgtggggctgatatgcaaaaatgaagaccaaaagccaggtggggtcatccctatggccttctgcctcaactacgagatcaacgttcagtgctgtgagtgtgtcacccaacccaccaccatgacaaccaccaccacagagaacccaactccgccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccncgacacccatcaccaccaccactacggtgaccccaaccccaacacccaccggcacacagaccccaaccacgacacccatcaccaccaccacnacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccatgatacccatcagcaccaccactacggtgaccccaaccccaacacccaccactggaagcacggggccccccacccacacaagcacagcaccgattgctgagttgaccacatccaatcctccgcctgagtcctcaacccctcagacctctcggtccacctcttcccctctcacggagtcaaccacccttctgagtaccctaccacctgccattgagatgaccagcacggccccaccctccacacccacggcacccacgaccacgagcggaggccacacactgtctccaccgcccagcaccaccacgtcccctccaggcacccccactcgcggtaccacgaccgggtcatcttcagcccccacccccagcactgtgcagacgaccaccaccagtgcctggaccccaacgccgaccccactctccacacccagcatcatcaggaccacaggcctgaggccctacccttcctctgtgcttatctgctgtgtcctgaacgacacctactacgcaccaggtgaggaggtgtacaacggcacatacggagacacctgttatttcgtcaactgctcactgagctgtacgttggagttctataactggtcctgcccatccacgccctccccaacacccacgccctccaagtcgacgcccacgccttccaagccatcgtccacgccctccaagccgacgcccggcaccaagccccccgagtgcccagactttgatcctcccagacaggagaacgagacttggtggctgtgcgactgcttcatggccacgtgcaagtacaacaacacggtggagatcgtgaaggtggagtgtgagccgccgcccatgcccacctgctccaacggcctccaacccgtgcgcgtcgaggaccccgacggctgctgctggcactgggagtgcgactgctactgcacgggctggggcgacccgcactatgtcaccttcgacggactctactacagctaccagggcaactgcacctacgtgctggtggaggagatcagcccctccgtggacaacttcggagtttacatcgacaactaccactgcgatcccaacgacaaggtgtcctgcccccgcaccctcatcgtgcgccacgagacccaggaggtgctgatcaagaccgtgcatatgatgcccatgcaggtgcaggtgcaggtgaacaggcaggcggtggcactgccctacaagaagtacgggctggaggtgtaccagtctggcatcaactacgtggtggacatccccgagctgggtgtcctcgtctcctacaatggcctgtccttctccgtcaggctgccctaccaccggtttggcaacaacaccaagggccagtgtggcacctgcaccaacaccacctccgacgactgcattctgcccagcggggagatcgtctccaactgtgaggctgcggctgaccagtggctggtgaacgacccctccaagccacactgcccccacagcagctccacgaccaagcgcccggccgtcactgtgcccgggggcggtaaaacgaccccacacaaggactgcaccccatctcccctctgccagctcatcaaggacagcctgtttgcccagtgccacgcactggtgcccccgcagcactactacgatgcctgcgtgttcgacagctgcttcatgccgggctcgagcctggagtgcgccagtctgcaggcctacgcagccctctgtgcccagcagaacatctgcctcgactggcggaaccacacgcatggggcctgcttggtggagtgcccatctcacagggagtaccaggcctgtggccctgcagaagagcccacgtgcaaatccagctcctcccagcagaacaacacagtcctggtggaaggctgcttctgtcctgagggcaccatgaactacgctcctggctttgatgtctgcgtgaagacctgcggctgtgtgggacctgacaatgtgcccagagagtttggggagcacttcgagttcgactgcaagaactgtgtctgcctggagggtggaagtggcatcatctgccaacccaagaggtgcagccagaagcccgttacccactgcgtggaagacggcacctacctcgccacggaggtcaaccctgccgacacctgctgcaacattaccgtctgcaagtgcaacaccagcctgtgcaaagagaagccctccgtgtgcccgctgggattcgaagtgaagagcaagatggtgcctggaaggtgctgtcctttctactggtgtgagtccaagggggtgtgtgttcacgggaatgctgagtaccagcccggttctccagtttattcctccaagtgccaggactgcgtgtgcacggacaaggtggacaacaacaccctgctcaacgtcatcgcctgcacccacgtgccctgcaacacctcctgcagccctggcttcgaactcatggaggcccccggggagtgctgtaagaagtgtgaacagacgcactgtatcatcaaacggcccgacaaccagcacgtcatcctgaagcccggggacttcaagagcgacccgaagaacaactgcacattcttcagctgcgtgaagatccacaaccagctcatctcgtccgtctccaacatcacctgccccaactttgatgccagcatttgcatcccgggctccatcacattcatgcccaatggatgctgcaagacctgcacccctcgcaatgagaccaggtgcctgctctacaagtccccgtcacccgagagtttgttcccgttgcaccacggccctgtaatgcgtatta

SEQ ID NO: 488743 - DNA, 662 bp, Homo sapiens
  misc_feature (424)..(424): n is a, c, g, or t
ggccgatgggaatggtctgtcacaatctgctccgttttgttgttgtccggccacacgtaactgagatggctcctttagaataaagcggtatgggtgttgtcaatgtcaaaaaaaagagaaaaaaaaaagaagaaaaaacagtatgtcgtgtggccgcgcctgggtcccgtagtgagaagttcttgtaatgaacacctattctgtgtggtgcggagccgagggggcgcacgatgctaggcatgaagcggcagcagtggcgccaaaatacacggtgttcccgctcacagggagaacgccggggcggccaagtgaacatggtgcgctgggggatttcctccacaccaatatatataaaaacacgcgccgggggggggggaacacccccgggacgcgtgtctccgtgtggacaaacactcccgcaaanatggggcgagttgccgagagagaggctcactataccgacgggggggtctctctatatcgacagacagggtgcgatctcccaacaggcgcgagagacgctctctgatatatacttcaaagtatttagcgcgccccgagtcgccgttgggggagaccctacgttgccccaaggatacttgtagggtcgcaaattaccttgtcgatagaatccattctcatcgcccaaaggatatgcgaat

SEQ ID NO: 488744 - DNA, 8679 bp, Homo sapiens
  misc_feature (6587)..(6587): n is a, c, g, or t
  misc_feature (6679)..(6679): n is a, c, g, or t
caacccacaccgcccctgccagccaccatggggctgccactagcccgcctggcggctgtgtgcctggccctgtctttggcagggggctcggagctccagacagagggcagaacccgataccacggccgcaacgtctgcagcacctggggcaacttccactacaagaccttcgacggggacgtcttccgcttccccggcctctgcgactacaacttcgcctccgactgccgaggctcctacaaggaatttgctgtgcacctgaagcggggtccgggccaggctgaggcccccgccggggtggagtccatcctgctgaccatcaaggatgacaccatctacctcacccgccacctggctgtgcttaacggggccgtggtcagcaccccgcactacagccccgggctgctcattgagaagagcgatgcctacaccaaagtctactcccgcgccggcctcaccctcatgtggaaccgggaggatgcactcatgctggagctggacactaagttccggaaccacacctgtggcctctgcggggactacaacggcctgcagagctattcagaattcctctctgacggcgtgctcttcagtcccctggagtttgggaacatgcagaagatcaaccagcccgatgtggtgtgtgaggatcccgaggaggaggtggcccccgcatcctgctccgagcaccgcgccgagtgtgagaggctgctgaccgccgaggccttcgcggactgtcaggacctggtgccgctggagccgtatctgcgcgcctgccagcaggaccgctgccggtgcccgggcggtgacacctgcgtctgcagcaccgtggccgagttctcccgccagtgctcccacgccggcggccggcccgggaactggaggaccgccacgctctgccccaagacctgccccgggaacctggtgtacctggagagcggctcgccctgcatggacacctgctcacacctggaggtgagcagcctgtgcgaggagcaccgcatggacggctgtttctgcccagaaggcaccgtatatgacgacatcggggacagtggctgcgttcctgtgagccagtgccactgcaggctgcacggacacctgtacacaccgggccaggagatcaccaatgactgcgagcagtgtgtctgtaacgctggccgctgggtgtgcaaagacctgccctgccccggcacctgtgccctggacggcggctcccacatcaccaccttcgatgggaagacgtacaccttccacggggactgctactatgtcctggccaagggtgaccacaacgattcctacgctctcctgggcgagctggccccctgtggctccacagacaagcagacctgcctgaagacggtggtgctgctggctgacaagaagaagaatgtggtggtcttcaagtccgatggcagtgtactgctcaacgagctgcaggtgaacctgccccacgtgaccgcgagcttctctgtcttccgcccgtcttcctaccacatcatggtgagcatggccattggcgtccggctgcaggtgcagctggccccagtcatgcaactctttgtgacactggaccaggcctcccaggggcaggtgcagggcctctgcgggaacttcaacggcctggaaggtgacgacttcaagacggccagcgggctggtggaggccacgggggccggcttttgccaacacctggaaggcacagtcaagctgccatgacaagctggactggttggacgatccctgctccctgaacatcgagagcgccaactacgccgagcactggtgctccctcctgaagaagacagagaccccctttggcaggtgccactcggctgtggaccctgctgagtattacaagaggtgcaaatatgacacgtgtaactgtcagaacaatgaggactgcctgtgcgccgccctgtcctcctacgcgcgcgcctgcaccgccaagggcgtcatgctgtggggctggcgggagcatgtctgcaacaaggatgtgggctcctgccccaactcgcaggtcttcctgtacaacctgaccacctgccagcagacctgccgctccctctccgaggccgacagccactgtctcgagggctttgcgcctgtggacggctgcggctgccctgaccacaccttcctggacgagaagggccgctgcgtacccctggccaagtgctcctgttaccaccgcggtctctacctggaggcgggggatgtggtcgtcaggcaggaagaacgatgtgtgtgccgggatgggcggctgcactgtaggcagatccggctgatcggccagagctgcacggccccaaagatccacatggactgcagcaacctgactgcactggccacctcgaagccccgagccctcagctgccagacgctggccgccggctattaccacacagagtgtgtcagtggctgtgtgtgccccgacgggctgatggatgacggccggggtggctgcgtggtggagaaggaatgcccttgcgtccataacaacgacctgtattcttccggcgccaagatcaaggtggactgcaatacctgcacctgcaagagaggacgctgggtgtgcacccaggctgtgtgccatggcacctgctccatttacgggagtggccactacatcacctttgatgggaagtactacgactttgacggacactgctcctacgtggctgttcaggactactgcggccagaactcctcactgggctcattcagcatcatcaccgagaacgtcccctgtggcactacgggcgtcacctgctccaaggccatcaagatcttcatggggaggacggagctgaagttggaagacaagcaccgtgtggtgatccagcgtgatgagggtcaccacgtggcctacaccacgcgggaggtgggccagtacctggtggtggagtccagcacgggcatcatcgtcatctgggacaagaggaccaccgtgttcatcaagctggctccctcctacaagggcaccgtgtgtggcctgtgtgggaactttgaccaccgctccaacaacgacttcaccacgcgggaccacatggtggtgagcagcgagctggacttcgggaacagctggaaggaggcccccacctgcccagatgtgagcaccaaccccgagccctgcagcctgaacccgcaccgccgctcctgggccgagaagcagtgcagcatcctcaaaagcagcgtgttcagcatctgccacagcaaggtggaccccaagcccttctacgaggcctgtgtgcacgactcgtgctcctgtgacacgggtggggactgtgagtgcttctgctctgccgtggcctcctacgcccaggagtgtaccaaagagggggcctgcgtgttctggaggacgccggacctgtgccccatattctgcgactactacaaccctccgcatgagtgtgagtggcactatgagccatgtgggaaccggagcttcgagacctgcaggaccatcaacggcatccactccaacatctccgtgtcctacctggagggctgctacccccggtgccccaaggacaggcccatctatgaggaggatctgaagaagtgtgtcactgcagacaagtgtggctgctatgtcgaggacacccactacccacctggagcatcggttcccaccgaggagacctgcaagtcctgcgtgtgtaccaactcctcccaagtcgtctgcaggccggaggaaggaaagattcttaaccagacccaggatggcgccttctgctactgggagatctgtggccccaacgggacggtggagaagcacttcaacatctgttccattacgacacgcccgtccaccctgaccaccttcaccaccatcaccctccccaccacccccacctccttcaccactaccaccaccaccaccaccccgacctccagcacagttttatcaacaactccgaagctgtgctgcctctggtctgactggatcaatgaggaccaccccagcagtggcagcgacgacggtgaccgagaaccatttgatggggtctgcggggcccctgaggacatcgagtgcaggtcggtcaaggatccccacctcagcttggagcagcatggccagaaggtgcagtgtgatgtctctgttgggttcatttgcaagaatgaagaccagtttggaaatggaccatttggactgtgttacgactacaagatacgtgtcaattgttgctggcccatggataagtgtatcaccactcccagccctccaactaccactcccagccctccaccaaccacgacgaccacccttccaccaaccaccacccccagccctccaaccaccaccacaaccacccctccaccaaccaccacccccagccctccaataaccaccacgaccacccctctaccaaccaccactcccagccctccaataagcaccacaaccacccctccaccaaccaccactcccagccctccaaccaccactcccagccctccaaccaccactcccagccctccaacaaccaccacaaccacccctccaccaaccaccactcccagccctccaatgactacgcccatcactccaccagccagcactaccacccttccaccaaccaccactcccagccctccaacaaccaccacaaccacccctccaccaaccaccactcccagtcctccaacgactacgcccatcactccaccaaccagcactactacccttccaccaaccaccactcccagccctccaccaaccaccacaaccacccctccaccaaccaccactcccagccctccaacaaccaccactcccagtcctccaacaatcaccacaaccacccctccaccaaccaccactcccagccctccaacaacgaccacaaccacccctccaccaaccaccactcccagccctccaacgactacacccatcactccaccaaccagcactaccacccttccaccaaccaccactcccagccctccaccaaccaccacaaccacccctccaccaaccaccactcccagccctccaacaaccaccactcccagccctccaataaccaccacaaccacccctccaccaaccaccactcccagctctccaataaccaccactcccagccctccaacaaccaccatgaccaccccttcaccaaccaccacccccagctctccaataaccaccacaaccaccccttcctcaactaccactcccagccctccaccaaccaccatgaccaccccttcaccaaccaccactcccagccctccaacaaccaccatgaccacccttccaccaaccaccacttccagccctctaacaactactcctctacctccatcaataactcctcctacattttcaccattctcaacgacaacccctactaccccatgcgtgcctctctgcaattggactggctggctggattctggaaaacccaactttcacaaaccaggtggagacacagaattgattggagacgtctgtggaccaggctgggcagctaacatctcttgcagagccaccatgtatcctgatgttcccattggacagcttggacaaacagtggtgtgtgatgtctctgtggggctgatatgcaaaaatgaagaccaaaagccaggtggggtcatccctatggccttctgcctcaactacgagatcaacgttcagtgctgtgagtgtgtcacccaacccaccaccatgacaaccaccaccacagagaacccaactccgccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccncgacacccatcaccaccaccactacggtgaccccaaccccaacacccaccggcacacagaccccaaccacgacacccatcaccaccaccacnacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccatgatacccatcagcaccaccactacggtgaccccaaccccaacacccaccactggaagcacggggccccccacccacacaagcacagcaccgattgctgagttgaccacatccaatcctccgcctgagtcctcaacccctcagacctctcggtccacctcttcccctctcacggagtcaaccacccttctgagtaccctaccacctgccattgagatgaccagcacggccccaccctccacacccacggcacccacgaccacgagcggaggccacacactgtctccaccgcccagcaccaccacgtcccctccaggcacccccactcgcggtaccacgaccgggtcatcttcagcccccacccccagcactgtgcagacgaccaccaccagtgcctggaccccaacgccgaccccactctccacacccagcatcatcaggaccacaggcctgaggccctacccttcctctgtgcttatctgctgtgtcctgaacgacacctactacgcaccaggtgaggaggtgtacaacggcacatacggagacacctgttatttcgtcaactgctcactgagctgtacgttggagttctataactggtcctgcccatccacgccctccccaacacccacgccctccaagtcgacgcccacgccttccaagccatcgtccacgccctccaagccgacgcccggcaccaagccccccgagtgcccagactttgatcctcccagacaggagaacgagacttggtggctgtgcgactgcttcatggccacgtgcaagtacaacaacacggtggagatcgtgaaggtggagtgtgagccgccgcccatgcccacctgctccaacggcctccaacccgtgcgcgtcgaggaccccgacggctgctgctggcactgggagtgcgactgctactgcacgggctggggcgacccgcactatgtcaccttcgacggactctactacagctaccagggcaactgcacctacgtgctggtggaggagatcagcccctccgtggacaacttcggagtttacatcgacaactaccactgcgatcccaacgacaaggtgtcctgcccccgcaccctcatcgtgcgccacgagacccaggaggtgctgatcaagaccgtgcatatgatgcccatgcaggtgcaggtgcaggtgaacaggcaggcggtggcactgccctacaagaagtacgggctggaggtgtaccagtctggcatcaactacgtggtggacatccccgagctgggtgtcctcgtctcctacaatggcctgtccttctccgtcaggctgccctaccaccggtttggcaacaacaccaagggccagtgtggcacctgcaccaacaccacctccgacgactgcattctgcccagcggggagatcgtctccaactgtgaggctgcggctgaccagtggctggtgaacgacccctccaagccacactgcccccacagcagctccacgaccaagcgcccggccgtcactgtgcccgggggcggtaaaacgaccccacacaaggactgcaccccatctcccctctgccagctcatcaaggacagcctgtttgcccagtgccacgcactggtgcccccgcagcactactacgatgcctgcgtgttcgacagctgcttcatgccgggctcgagcctggagtgcgccagtctgcaggcctacgcagccctctgtgcccagcagaacatctgcctcgactggcggaaccacacgaagacgaccgcgtcccggcctgcggcggccggggtgggagcccagccctctggagagcccgccgtcccaaagcacag

SEQ ID NO: 488745 - DNA, 129 bp, Homo sapiens
gaaacccagcccatgacccctaacaggggccctctcagccctcctaatgactcggctagcatgtgatttacattcactccataacgctcctcatactagggctactaaccaacacactaaccatataac

SEQ ID NO: 488746 - DNA, 8521 bp, Homo sapiens
caacccacaccgcccctgccagccaccatggggctgccactagcccgcctggcggctgtgtgcctggccctgtctttggcagggggctcggagctccagacagagggcagaacccgataccacggccgcaacgtctgcagcacctggggcaacttccactacaagaccttcgacggggacgtcttccgcttccccggcctctgcgactacaacttcgcctccgactgccgaggctcctacaaggaatttgctgtgcacctgaagcggggtccgggccaggctgaggcccccgccggggtggagtccatcctgctgaccatcaaggatgacaccatctacctcacccgccacctggctgtgcttaacggggccgtggtcagcaccccgcactacagccccgggctgctcattgagaagagcgatgcctacaccaaagtctactcccgcgccggcctcaccctcatgtggaaccgggaggatgcactcatgctggagctggacactaagttccggaaccacacctgtggcctctgcggggactacaacggcctgcagagctattcagaattcctctctgacggcgtgctcttcagtcccctggagtttgggaacatgcagaagatcaaccagcccgatgtggtgtgtgaggatcccgaggaggaggtggcccccgcatcctgctccgagcaccgcgccgagtgtgagaggctgctgaccgccgaggccttcgcggactgtcaggacctggtgccgctggagccgtatctgcgcgcctgccagcaggaccgctgccggtgcccgggcggtgacacctgcgtctgcagcaccgtggccgagttctcccgccagtgctcccacgccggcggccggcccgggaactggaggaccgccacgctctgccccaagacctgccccgggaacctggtgtacctggagagcggctcgccctgcatggacacctgctcacacctggaggtgagcagcctgtgcgaggagcaccgcatggacggctgtttctgcccagaaggcaccgtatatgacgacatcggggacagtggctgcgttcctgtgagccagtgccactgcaggctgcacggacacctgtacacaccgggccaggagatcaccaatgactgcgagcagtgtgtctgtaacgctggccgctgggtgtgcaaagacctgccctgccccggcacctgtgccctggacggcggctcccacatcaccaccttcgatgggaagacgtacaccttccacggggactgctactatgtcctggccaagggtgaccacaacgattcctacgctctcctgggcgagctggccccctgtggctccacagacaagcagacctgcctgaagacggtggtgctgctggctgacaagaagaagaatgtggtggtcttcaagtccgatggcagtgtactgctcaacgagctgcaggtgaacctgccccacgtgaccgcgagcttctctgtcttccgcccgtcttcctaccacatcatggtgagcatggccattggcgtccggctgcaggtgcagctggccccagtcatgcaactctttgtgacactggaccaggcctcccaggggcaggtgcagggcctctgcgggaacttcaacggcctggaaggtgacgacttcaagacggccagcgggctggtggaggccacgggggccggcttttgccaacacctggaaggcacagtcaagctgccatgacaagctggactggttggacgatccctgctccctgaacatcgagagcgccaactacgccgagcactggtgctccctcctgaagaagacagagaccccctttggcaggtgccactcggctgtggaccctgctgagtattacaagaggtgcaaatatgacacgtgtaactgtcagaacaatgaggactgcctgtgcgccgccctgtcctcctacgcgcgcgcctgcaccgccaagggcgtcatgctgtggggctggcgggagcatgtctgcaacaaggatgtgggctcctgccccaactcgcaggtcttcctgtacaacctgaccacctgccagcagacctgccgctccctctccgaggccgacagccactgtctcgagggctttgcgcctgtggacggctgcggctgccctgaccacaccttcctggacgagaagggccgctgcgtacccctggccaagtgctcctgttaccaccgcggtctctacctggaggcgggggatgtggtcgtcaggcaggaagaacgatgtgtgtgccgggatgggcggctgcactgtaggcagatccggctgatcggccagagctgcacggccccaaagatccacatggactgcagcaacctgactgcactggccacctcgaagccccgagccctcagctgccagacgctggccgccggctattaccacacagagtgtgtcagtggctgtgtgtgccccgacgggctgatggatgacggccggggtggctgcgtggtggagaaggaatgcccttgcgtccataacaacgacctgtattcttccggcgccaagatcaaggtggactgcaatacctgcacctgcaagagaggacgctgggtgtgcacccaggctgtgtgccatggcacctgctccatttacgggagtggccactacatcacctttgatgggaagtactacgactttgacggacactgctcctacgtggctgttcaggactactgcggccagaactcctcactgggctcattcagcatcatcaccgagaacgtcccctgtggcactacgggcgtcacctgctccaaggccatcaagatcttcatggggaggacggagctgaagttggaagacaagcaccgtgtggtgatccagcgtgatgagggtcaccacgtggcctacaccacgcgggaggtgggccagtacctggtggtggagtccagcacgggcatcatcgtcatctgggacaagaggaccaccgtgttcatcaagctggctccctcctacaagggcaccgtgtgtggcctgtgtgggaactttgaccaccgctccaacaacgacttcaccacgcgggaccacatggtggtgagcagcgagctggacttcgggaacagctggaaggaggcccccacctgcccagatgtgagcaccaaccccgagccctgcagcctgaacccgcaccgccgctcctgggccgagaagcagtgcagcatcctcaaaagcagcgtgttcagcatctgccacagcaaggtggaccccaagcccttctacgaggcctgtgtgcacgactcgtgctcctgtgacacgggtggggactgtgagtgcttctgctctgccgtggcctcctacgcccaggagtgtaccaaagagggggcctgcgtgttctggaggacgccggacctgtgccccatattctgcgactactacaaccctccgcatgagtgtgagtggcactatgagccatgtgggaaccggagcttcgagacctgcaggaccatcaacggcatccactccaacatctccgtgtcctacctggagggctgctacccccggtgccccaaggacaggcccatctatgaggaggatctgaagaagtgtgtcactgcagacaagtgtggctgctatgtcgaggacacccactacccacctggagcatcggttcccaccgaggagacctgcaagtcctgcgtgtgtaccaactcctcccaagtcgtctgcaggccggaggaaggaaagattcttaaccagacccaggatggcgccttctgctactgggagatctgtggccccaacgggacggtggagaagcacttcaacatctgttccattacgacacgcccgtccaccctgaccaccttcaccaccatcaccctccccaccacccccacctccttcaccactaccaccaccaccaccaccccgacctccagcacagttttatcaacaactccgaagctgtgctgcctctggtctgactggatcaatgaggaccaccccagcagtggcagcgacgacggtgaccgagaaccatttgatggggtctgcggggcccctgaggacatcgagtgcaggtcggtcaaggatccccacctcagcttggagcagcatggccagaaggtgcagtgtgatgtctctgttgggttcatttgcaagaatgaagaccagtttggaaatggaccatttggactgtgttacgactacaagatacgtgtcaattgttgctggcccatggataagtgtatcaccactcccagccctccaactaccactcccagccctccaccaaccacgacgaccacccttccaccaaccaccacccccagccctccaaccaccaccacaaccacccctccaccaaccaccacccccagccctccaataaccaccacgaccacccctctaccaaccaccactcccagccctccaataagcaccacaaccacccctccaccaaccaccactcccagccctccaaccaccactcccagccctccaaccaccactcccagccctccaacaaccaccacaaccacccctccaccaaccaccactcccagccctccaatgactacgcccatcactccaccagccagcactaccacccttccaccaaccaccactcccagccctccaacaaccaccacaaccacccctccaccaaccaccactcccagtcctccaacgactacgcccatcactccaccaaccagcactactacccttccaccaaccaccactcccagccctccaccaaccaccacaaccacccctccaccaaccaccactcccagccctccaacaaccaccactcccagtcctccaacaatcaccacaaccacccctccaccaaccaccactcccagccctccaacaacgaccacaaccacccctccaccaaccaccactcccagccctccaacgactacacccatcactccaccaaccagcactaccacccttccaccaaccaccactcccagccctccaccaaccaccacaaccacccctccaccaaccaccactcccagccctccaacaaccaccactcccagccctccaataaccaccacaaccacccctccaccaaccaccactcccagctctccaataaccaccactcccagccctccaacaaccaccatgaccaccccttcaccaaccaccacccccagctctccaataaccaccacaaccaccccttcctcaactaccactcccagccctccaccaaccaccatgaccaccccttcaccaaccaccactcccagccctccaacaaccaccatgaccacccttccaccaaccaccacttccagccctctaacaactactcctctacctccatcaataactcctcctacattttcaccattctcaacgacaacccctactaccccatgcgtgcctctctgcaattggactggctggctggattctggaaaacccaactttcacaaaccaggtggagacacagaattgattggagacgtctgtggaccaggctgggcagctaacatctcttgcagagccaccatgtatcctgatgttcccattggacagcttggacaaacagtggtgtgtgatgtctctgtggggctgatatgcaaaaatgaagaccaaaagccaggtggggtcatccctatggccttctgcctcaactacgagatcaacgttcagtgctgtgcacccccactcgcggtaccacgaccgggtcatcttcagcccccacccccagcactgtgcagacgaccaccaccagtgcctggaccccaacgccgaccccactctccacacccagcatcatcaggaccacaggcctgaggccctacccttcctctgtgcttatctgctgtgtcctgaacgacacctactacgcaccaggtgaggaggtgtacaacggcacatacggagacacctgttatttcgtcaactgctcactgagctgtacgttggagttctataactggtcctgcccatccacgccctccccaacacccacgccctccaagtcgacgcccacgccttccaagccatcgtccacgccctccaagccgacgcccggcaccaagccccccgagtgcccagactttgatcctcccagacaggagaacgagacttggtggctgtgcgactgcttcatggccacgtgcaagtacaacaacacggtggagatcgtgaaggtggagtgtgagccgccgcccatgcccacctgctccaacggcctccaacccgtgcgcgtcgaggaccccgacggctgctgctggcactgggagtgcgactgctactgcacgggctggggcgacccgcactatgtcaccttcgacggactctactacagctaccagggcaactgcacctacgtgctggtggaggagatcagcccctccgtggacaacttcggagtttacatcgacaactaccactgcgatcccaacgacaaggtgtcctgcccccgcaccctcatcgtgcgccacgagacccaggaggtgctgatcaagaccgtgcatatgatgcccatgcaggtgcaggtgcaggtgaacaggcaggcggtggcactgccctacaagaagtacgggctggaggtgtaccagtctggcatcaactacgtggtggacatccccgagctgggtgtcctcgtctcctacaatggcctgtccttctccgtcaggctgccctaccaccggtttggcaacaacaccaagggccagtgtggcacctgcaccaacaccacctccgacgactgcattctgcccagcggggagatcgtctccaactgtgaggctgcggctgaccagtggctggtgaacgacccctccaagccacactgcccccacagcagctccacgaccaagcgcccggccgtcactgtgcccgggggcggtaaaacgaccccacacaaggactgcaccccatctcccctctgccagctcatcaaggacagcctgtttgcccagtgccacgcactggtgcccccgcagcactactacgatgcctgcgtgttcgacagctgcttcatgccgggctcgagcctggagtgcgccagtctgcaggcctacgcagccctctgtgcccagcagaacatctgcctcgactggcggaaccacacgcatggggcctgcttggtggagtgcccatctcacagggagtaccaggcctgtggccctgcagaagagcccacgtgcaaatccagctcctcccagcagaacaacacagtcctggtggaaggctgcttctgtcctgagggcaccatgaactacgctcctggctttgatgtctgcgtgaagacctgcggctgtgtgggacctgacaatgtgcccagagagtttggggagcacttcgagttcgactgcaagaactgtgtctgcctggagggtggaagtggcatcatctgccaacccaagaggtgcagccagaagcccgttacccactgcgtggaagacggcacctacctcgccacggaggtcaaccctgccgacacctgctgcaacattaccgtctgcaagtgcaacaccagcctgtgcaaagagaagccctccgtgtgcccgctgggattcgaagtgaagagcaagatggtgcctggaaggtgctgtcctttctactggtgtgagtccaagggggtgtgtgttcacgggaatgctgagtaccagcccggttctccagtttattcctccaagtgccaggactgcgtgtgcacggacaaggtggacaacaacaccctgctcaacgtcatcgcctgcacccacgtgccctgcaacacctcctgcagccctggcttcgaactcatggaggcccccggggagtgctgtaagaagtgtgaacagacgcactgtatcatcaaacggcccgacaaccagcacgtcatcctgaagcccggggacttcaagagcgacccgaagaacaactgcacattcttcagctgcgtgaagatccacaaccagctcatctcgtccgtctccaacatcacctgccccaactttgatgccagcatttgcatcccgggctccatcacattcatgcccaatggatgctgcaagacctgcacccctcgcaatgagaccagggtgccctgctccaccgtccccgtcaccacggaggtttcgtacgccggctgcaccaagaccgtcctcatgaatcattgctccgggtcctgcgggacatttgtcatgtactcggccaaggcccaggccctggaccacagctgctcctgctgcaaagaggagaaaaccagccagcgtgaggtggtcctgagctgccccaatggcggctcgctgacacacacctacacccacatcgagagctgccagtgccaggacaccgtctgcgggctccccaccggcacctcccgccgggcccggcgctcccctaggcatctggggagcgggtgagcggggtgggcacagcccccttcactgccctcgacagctttacctcccccggaccctctgagcctcctaagctcggcttcctctcttcagatatttattgtctgagtctttgttcagtccttgctttccaataataaactcagggggacatgcaaaaaaaaaa

SEQ ID NO: 488747 - DNA, 202 bp, Homo sapiens
aagcctgctcgatacagagaggggcaggtagcctatttcatctgatgtttgtccctcgtgacttccacctagctggaaagggcaaagcgggcaaggaaagggtgtctagggcgccacacccttaagtaaatcggaccgcctacgcaggagcagtcgcacctgtcctaagtcgagtgaaggtggtccgtctccacccgagctc

SEQ ID NO: 488748 - DNA, 7588 bp, Homo sapiens
  misc_feature (6587)..(6587): n is a, c, g, or t
  misc_feature (6679)..(6679): n is a, c, g, or t
caacccacaccgcccctgccagccaccatggggctgccactagcccgcctggcggctgtgtgcctggccctgtctttggcagggggctcggagctccagacagagggcagaacccgataccacggccgcaacgtctgcagcacctggggcaacttccactacaagaccttcgacggggacgtcttccgcttccccggcctctgcgactacaacttcgcctccgactgccgaggctcctacaaggaatttgctgtgcacctgaagcggggtccgggccaggctgaggcccccgccggggtggagtccatcctgctgaccatcaaggatgacaccatctacctcacccgccacctggctgtgcttaacggggccgtggtcagcaccccgcactacagccccgggctgctcattgagaagagcgatgcctacaccaaagtctactcccgcgccggcctcaccctcatgtggaaccgggaggatgcactcatgctggagctggacactaagttccggaaccacacctgtggcctctgcggggactacaacggcctgcagagctattcagaattcctctctgacggcgtgctcttcagtcccctggagtttgggaacatgcagaagatcaaccagcccgatgtggtgtgtgaggatcccgaggaggaggtggcccccgcatcctgctccgagcaccgcgccgagtgtgagaggctgctgaccgccgaggccttcgcggactgtcaggacctggtgccgctggagccgtatctgcgcgcctgccagcaggaccgctgccggtgcccgggcggtgacacctgcgtctgcagcaccgtggccgagttctcccgccagtgctcccacgccggcggccggcccgggaactggaggaccgccacgctctgccccaagacctgccccgggaacctggtgtacctggagagcggctcgccctgcatggacacctgctcacacctggaggtgagcagcctgtgcgaggagcaccgcatggacggctgtttctgcccagaaggcaccgtatatgacgacatcggggacagtggctgcgttcctgtgagccagtgccactgcaggctgcacggacacctgtacacaccgggccaggagatcaccaatgactgcgagcagtgtgtctgtaacgctggccgctgggtgtgcaaagacctgccctgccccggcacctgtgccctggacggcggctcccacatcaccaccttcgatgggaagacgtacaccttccacggggactgctactatgtcctggccaagggtgaccacaacgattcctacgctctcctgggcgagctggccccctgtggctccacagacaagcagacctgcctgaagacggtggtgctgctggctgacaagaagaagaatgtggtggtcttcaagtccgatggcagtgtactgctcaacgagctgcaggtgaacctgccccacgtgaccgcgagcttctctgtcttccgcccgtcttcctaccacatcatggtgagcatggccattggcgtccggctgcaggtgcagctggccccagtcatgcaactctttgtgacactggaccaggcctcccaggggcaggtgcagggcctctgcgggaacttcaacggcctggaaggtgacgacttcaagacggccagcgggctggtggaggccacgggggccggcttttgccaacacctggaaggcacagtcaagctgccatgacaagctggactggttggacgatccctgctccctgaacatcgagagcgccaactacgccgagcactggtgctccctcctgaagaagacagagaccccctttggcaggtgccactcggctgtggaccctgctgagtattacaagaggtgcaaatatgacacgtgtaactgtcagaacaatgaggactgcctgtgcgccgccctgtcctcctacgcgcgcgcctgcaccgccaagggcgtcatgctgtggggctggcgggagcatgtctgcaacaaggatgtgggctcctgccccaactcgcaggtcttcctgtacaacctgaccacctgccagcagacctgccgctccctctccgaggccgacagccactgtctcgagggctttgcgcctgtggacggctgcggctgccctgaccacaccttcctggacgagaagggccgctgcgtacccctggccaagtgctcctgttaccaccgcggtctctacctggaggcgggggatgtggtcgtcaggcaggaagaacgatgtgtgtgccgggatgggcggctgcactgtaggcagatccggctgatcggccagagctgcacggccccaaagatccacatggactgcagcaacctgactgcactggccacctcgaagccccgagccctcagctgccagacgctggccgccggctattaccacacagagtgtgtcagtggctgtgtgtgccccgacgggctgatggatgacggccggggtggctgcgtggtggagaaggaatgcccttgcgtccataacaacgacctgtattcttccggcgccaagatcaaggtggactgcaatacctgcacctgcaagagaggacgctgggtgtgcacccaggctgtgtgccatggcacctgctccatttacgggagtggccactacatcacctttgatgggaagtactacgactttgacggacactgctcctacgtggctgttcaggactactgcggccagaactcctcactgggctcattcagcatcatcaccgagaacgtcccctgtggcactacgggcgtcacctgctccaaggccatcaagatcttcatggggaggacggagctgaagttggaagacaagcaccgtgtggtgatccagcgtgatgagggtcaccacgtggcctacaccacgcgggaggtgggccagtacctggtggtggagtccagcacgggcatcatcgtcatctgggacaagaggaccaccgtgttcatcaagctggctccctcctacaagggcaccgtgtgtggcctgtgtgggaactttgaccaccgctccaacaacgacttcaccacgcgggaccacatggtggtgagcagcgagctggacttcgggaacagctggaaggaggcccccacctgcccagatgtgagcaccaaccccgagccctgcagcctgaacccgcaccgccgctcctgggccgagaagcagtgcagcatcctcaaaagcagcgtgttcagcatctgccacagcaaggtggaccccaagcccttctacgaggcctgtgtgcacgactcgtgctcctgtgacacgggtggggactgtgagtgcttctgctctgccgtggcctcctacgcccaggagtgtaccaaagagggggcctgcgtgttctggaggacgccggacctgtgccccatattctgcgactactacaaccctccgcatgagtgtgagtggcactatgagccatgtgggaaccggagcttcgagacctgcaggaccatcaacggcatccactccaacatctccgtgtcctacctggagggctgctacccccggtgccccaaggacaggcccatctatgaggaggatctgaagaagtgtgtcactgcagacaagtgtggctgctatgtcgaggacacccactacccacctggagcatcggttcccaccgaggagacctgcaagtcctgcgtgtgtaccaactcctcccaagtcgtctgcaggccggaggaaggaaagattcttaaccagacccaggatggcgccttctgctactgggagatctgtggccccaacgggacggtggagaagcacttcaacatctgttccattacgacacgcccgtccaccctgaccaccttcaccaccatcaccctccccaccacccccacctccttcaccactaccaccaccaccaccaccccgacctccagcacagttttatcaacaactccgaagctgtgctgcctctggtctgactggatcaatgaggaccaccccagcagtggcagcgacgacggtgaccgagaaccatttgatggggtctgcggggcccctgaggacatcgagtgcaggtcggtcaaggatccccacctcagcttggagcagcatggccagaaggtgcagtgtgatgtctctgttgggttcatttgcaagaatgaagaccagtttggaaatggaccatttggactgtgttacgactacaagatacgtgtcaattgttgctggcccatggataagtgtatcaccactcccagccctccaactaccactcccagccctccaccaaccacgacgaccacccttccaccaaccaccacccccagccctccaaccaccaccacaaccacccctccaccaaccaccacccccagccctccaataaccaccacgaccacccctctaccaaccaccactcccagccctccaataagcaccacaaccacccctccaccaaccaccactcccagccctccaaccaccactcccagccctccaaccaccactcccagccctccaacaaccaccacaaccacccctccaccaaccaccactcccagccctccaatgactacgcccatcactccaccagccagcactaccacccttccaccaaccaccactcccagccctccaacaaccaccacaaccacccctccaccaaccaccactcccagtcctccaacgactacgcccatcactccaccaaccagcactactacccttccaccaaccaccactcccagccctccaccaaccaccacaaccacccctccaccaaccaccactcccagccctccaacaaccaccactcccagtcctccaacaatcaccacaaccacccctccaccaaccaccactcccagccctccaacaacgaccacaaccacccctccaccaaccaccactcccagccctccaacgactacacccatcactccaccaaccagcactaccacccttccaccaaccaccactcccagccctccaccaaccaccacaaccacccctccaccaaccaccactcccagccctccaacaaccaccactcccagccctccaataaccaccacaaccacccctccaccaaccaccactcccagctctccaataaccaccactcccagccctccaacaaccaccatgaccaccccttcaccaaccaccacccccagctctccaataaccaccacaaccaccccttcctcaactaccactcccagccctccaccaaccaccatgaccaccccttcaccaaccaccactcccagccctccaacaaccaccatgaccacccttccaccaaccaccacttccagccctctaacaactactcctctacctccatcaataactcctcctacattttcaccattctcaacgacaacccctactaccccatgcgtgcctctctgcaattggactggctggctggattctggaaaacccaactttcacaaaccaggtggagacacagaattgattggagacgtctgtggaccaggctgggcagctaacatctcttgcagagccaccatgtatcctgatgttcccattggacagcttggacaaacagtggtgtgtgatgtctctgtggggctgatatgcaaaaatgaagaccaaaagccaggtggggtcatccctatggccttctgcctcaactacgagatcaacgttcagtgctgtgagtgtgtcacccaacccaccaccatgacaaccaccaccacagagaacccaactccgccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccncgacacccatcaccaccaccactacggtgaccccaaccccaacacccaccggcacacagaccccaaccacgacacccatcaccaccaccacnacggtgaccccaaccccaacacccaccggcacacagaccccaaccacgacacccatcaccaccaccactacggtgaccccaaccccaacacccaccggcacacagaccccaaccacgacacccatcaccaccaccactacggtgaccccaaccccaacacccaccggcacacagaccccaaccatgatacccatcagcaccaccactacggtgaccccaaccccaacacccaccactggaagcacggggccccccacccacacaagcacagcaccgattgctgagttgaccacatccaatcctccgcctgagtcctcaacccctcagacctctcggtccacctcttcccctctcacggagtcaaccacccttctgagtaccctaccacctgccattgagatgaccagcacggccccaccctccacacccacggcacccacgaccacgagcggaggccacacactgtctccaccgcccagcaccaccacgtcccctccaggcacccccactcgcggtaccacgaccgggtcatcttcagcccccacccccagcactgtgcagacgaccaccaccagtgcctggaccccaacgccgaccccactctccacacccagcatcatcaggaccacaggcctgaggccctacccttcctctgtgcttatctgctgtgtcctgaacgacacctactacgcaccaggtgaggaggtgtacaacggcacatacggagacacctgttatttcgtcaactgctcactgagctgtacgttggagttctataactggtcctgcccatccacgccctccccaacacccacgccaacgttgggcctcacggtggcctctccaagctcagctcctgccctccaatggcatctgcaggccccaaatggtctccagtcgtggatatca

SEQ ID NO: 488749 - DNA, 879 bp, Homo sapiens
cggtgacctgggccgagcctcccggtcggctacgattgctgaggaggcggcgggtagctggtcaggcgccgacttccgagaggccgccgtccgggcgaggtgtcctcatgacttctcttgtggaccttgttcgtgatcttttttgcctgtgtggtacgggtaagggatggactgcccctctcagcctctactgagtttttaccacacccaagattttatggaatggaggagacggctcaggagtttagccttgctgactgtgcccagtatccaggtcgaggttctgcataaggctgtgactttatgtatactatttttcttctttcggcggagcgtggctctgcattggcatatcttgcatccgtgccaagatgtccacgcacgccatgagccttcatgctgtcctggatgacccgtgtgggtgggaattcacagacttccgtatgacactaccgtgcattggccgtagcctccaggccatacgcttttcttgagtttgacagcatcagttcagaagagtgacagtggccactctttaactatgtaagttcctctcagatggagtgcagctgtggaaaaaattcaggaggagctcaagttgcagcctccagcggttctcactctggaggacacagatgtggcaaatggggtgatgaatggtcacacaccgatgcacttggagcctggtcctaatttccgaatggaaccagtgacagccctgggtatcctctccctcattgctcaagcatcatgtgtgctgccctgaatctcattcgaggagttcatcttgctgaacattctttacaggttgcccatgaggaaattgggacacattctggcttttctttgtcctttcgtagcctgcattttccaggattc

SEQ ID NO: 488750 - DNA, 654 bp, Homo sapiens
agcggctggcatgacctacaatatgaccggggagctgggaccaaatggatcagatcgaggtggaatgctgagtggatgcacagaccgattccgctgtacagagtgacttgactgaaggactgagcgatgagtagaacaccacgaggactgagtgtctggtgtacactatgcgtacgtgcacctagcaagaaagaggaccacagagttttgctgaaaacttcgcaagctcactttccgctatttccctcgcatttcacgtagtcctcaatgcagtccaaagaggcacgctaaacggtcgtcattcgtcgcgactttgtatagctcgtcctaattaccccttgaaccgtcacagcggttttaggaattgaccaacgttgctcttgttgcacctatgaaggggcattacctccgcaattgtaccgctagttactagttccctcgtacgttgtgccaccgacagaccgcgcagttgtgcagctcccgcttgccgtacgtacccacaataacagcgatcacgcgataaccgccaccacatatcacgccatgggtagactaaaggcagcgcacaccgacacccctatccgcagccctgtaacaatcttcacgcacacgccacggtacaacgttatgaccacatcgatacctccgcgtacg

SEQ ID NO: 488751 - DNA, 2328 bp, Homo sapiens
  misc_feature (81)..(81): n is a, c, g, or t
  misc_feature (95)..(95): n is a, c, g, or t
  misc_feature (147)..(147): n is a, c, g, or t
gtagtagctctcgttcaggacacagcagataagcacagaggaaggttagggcctcaggcctgtggtcctgatgatgttggntgtgaagagtgggntcggcgtggggatccaggcaccggtggtggtcgtctgcacagtgctggggtngggggctgaagatgacccagtcgtgtacccgcgagtgggacatcgacaactaccactgcgatcccaacgacaaggtgtcctgcccccgcaccctcatcgtgcgccacgagacccaggaggtgctgatcaagaccgtgcatatgatgcccatgcaggtgcaggtgcaggtgaacaggcaggcggtggcactgccctacaagaagtacgggctggaggtgtaccagtctggcatcaactacgtggtggacatccccgagctgggtgtcctcgtctcctacaatggcctgtccttctccgtcaggctgccctaccaccggtttggcaacaacaccaagggccagtgtggcacctgcaccaacaccacctccgacgactgcattctgcccagcggggagatcgtctccaactgtgaggctgcggctgaccagtggctggtgaacgacccctccaagccacactgcccccacagcagctccacgaccaagcgcccggccgtcactgtgcccgggggcggtaaaacgaccccacacaaggactgcaccccatctcccctctgccagctcatcaaggacagcctgtttgcccagtgccacgcactggtgcccccgcagcactactacgatgcctgcgtgttcgacagctgcttcatgccgggctcgagcctggagtgcgccagtctgcaggcctacgcagccctctgtgcccagcagaacatctgcctcgactggcggaaccacacgcatggggcctgcttggtggagtgcccatctcacagggagtaccaggcctgtggccctgcagaagagcccacgtgcaaatccagctcctcccagcagaacaacacagtcctggtggaaggctgcttctgtcctgagggcaccatgaactacgctcctggctttgatgtctgcgtgaagacctgcggctgtgtgggacctgacaatgtgcccagagagtttggggagcacttcgagttcgactgcaagaactgtgtctgcctggagggtggaagtggcatcatctgccaacccaagaggtgcagccagaagcccgttacccactgcgtggaagacggcacctacctcgccacggaggtcaaccctgccgacacctgctgcaacattaccgtctgcaagtgcaacaccagcctgtgcaaagagaagccctccgtgtgcccgctgggattcgaagtgaagagcaagatggtgcctggaaggtgctgtcctttctactggtgtgagtccaagggggtgtgtgttcacgggaatgctgagtaccagcccggttctccagtttattcctccaagtgccaggactgcgtgtgcacggacaaggtggacaacaacaccctgctcaacgtcatcgcctgcacccacgtgccctgcaacacctcctgcagccctggcttcgaactcatggaggcccccggggagtgctgtaagaagtgtgaacagacgcactgtatcatcaaacggcccgacaaccagcacgtcatcctgaagcccggggacttcaagagcgacccgaagaacaactgcacattcttcagctgcgtgaagatccacaaccagctcatctcgtccgtctccaacatcacctgccccaactttgatgccagcatttgcatcccgggctccatcacattcatgcccaatggatgctgcaagacctgcacccctcgcaatgagaccagggtgccctgctccaccgtccccgtcaccacggaggtttcgtacgccggctgcaccaagaccgtcctcatgaatcattgctccgggtcctgcgggacatttgtcatgtactcggccaaggcccaggccctggaccacagctgctcctgctgcaaagaggagaaaaccagccagcgtgaggtggtcctgagctgccccaatggcggctcgctgacacacacctacacccacatcgagagctgccagtgccaggacaccgtctgcgggctccccaccggcacctcccgccgggcccggcgctcccctaggcatctggggagcgggtgagcggggtgggcacagcccccttcactgccctcgacagctttacctcccccggaccctctgagcctcctaagctcggcttcctctcttcagatatttattgtctgagtctttgttcagtccttgctttccaataataaactcagggggacatgcaaaaaaaaaa

SEQ ID NO: 488752 - DNA, 407 bp, Homo sapiens
ctctagcaggatccccgcgactcgcgtgtctatgtgatatatggtagtactaggtctttctgggaagagagtgcccagtcgatctctctgccccgaagtactaaccaggtcccttttacggtccctgatgcaacagcagcctgggagcaatcccagcctttcaaaggctgacaaggcaccgagtggatgaatggaacgaacgatacataaaaaaaacactttggctgataaaacctccaacctgtaggcagggacagtgtcgcacgctgacatgcagaaacataactgtagcagagatcatgatgatgagaaatgcttcgcatttcccacactgccgatatcccgtgccctgtgctaccaccctctccccgaacacacacacacacacacacacacagactacgcga

SEQ ID NO: 488753 - DNA, 461 bp, Homo sapiens
acacccattccggtctgggtaagtggaactgaattctgtattaatggcacaatgtttgtgaaaatggtgtagacacattactaatatatcattatttacttttaaatgtggtatagtgatggagagacattaacgtggccctagaaaccagcagtaagtgttgaccatgaaggcatgccagtgcaaaacgaggacaagaatagaactgcttttcacaaagaactttttttttaatactttttaatatttattgctaacaaagattttttctagacccagagcagtggctcacacctgtaatcccagcactttgggaggccgaggcaggcagatcacttgaggtcggcagttcgagaccagcccggctaatgtggtgaaaccccaactctactaaaagcacaaaaaattagccgggtgtgttggtgcatgcctgtaatcccagctacccaggatcccgggat

SEQ ID NO: 488754 - DNA, 620 bp, Homo sapiens
  misc_feature (368)..(368): n is a, c, g, or t
gacgcgtgtgcggacgcgtggagctgcgcatgagccgcagggccgtaggcagccatggggcccagccggagtggcatgggtactttgaacgcctcctactgttccacaaggcactgttgagtcggtgccgtggacatcgtggtttcatacctaagacggggccaggtaagattccgtgatgaacgtataggcccgcgacaaaagccaacgggcgactcccgttattgtggtccagtactcccgatgtctggtgtcctcgatcacaggccctcaatcggtgcagtctagtccgcactggtttctgtcttatcccatcaacgtaaaaggggttgccggcgtgcagtgttcccgttcgcggctctttcagncctgagtgagggcaagtccatcaaggcggggtatgcggtgcccggtgccccaattttacctaccttcaagccaataacgcgattggagccacctcgtggggaatcccaaatttcggccctcgaggtttatccgtgtgctgtgtaatgtcccggagcgaaaaggggtccgtgaaaggaccaaacgttttcccagaaccgccgtacggttttccctctttgccctaaggtggcctcgaaataggcgttttggcc

SEQ ID NO: 488755 - DNA, 199 bp, Homo sapiens
acttatcagcagtacatcttcgttgggcggctgctgcccagcatcccgccttcgagcaggaggcgcaccgcgccggctggtggtggagcgccgcatggcattcggccgcgactatgcggagacgctcaggcgctggcgccagtccttcgaggagcgcctggaggccgtgcgtgcccagggctttgacgaacgcttcgtg

SEQ ID NO: 488756 - DNA, 143 bp, Homo sapiens
gccttccgacgacgatacaaaaaaatagggacgggcatcgcccgtcccccgtcatcggccgcctggcgggttgagcctgacgcaggcacgaagcgcgcgctcagtcgaccttggtgcccgacgccttgaccaccggtgcccag

SEQ ID NO: 488757 - DNA, 1217 bp, Homo sapiens
  misc_feature (1035)..(1035): n is a, c, g, or t
  misc_feature (1048)..(1048): n is a, c, g, or t
  misc_feature (1084)..(1084): n is a, c, g, or t
  misc_feature (1104)..(1104): n is a, c, g, or t
  misc_feature (1108)..(1108): n is a, c, g, or t
  misc_feature (1114)..(1114): n is a, c, g, or t
  misc_feature (1145)..(1145): n is a, c, g, or t
  misc_feature (1154)..(1154): n is a, c, g, or t
ggtaccgcgaacggtgcgttacttacctcgactcttagcttgtcggggacggtaaccgggacccggtgtctgctcctgtcgccttcgcctcctaatccctagccactatgcgtgagtgcatctccatccacgttggccaggctggtgtccagattggcaatgcctgctgggagctctactgcctggaacacggcatccagcccgatggccagatgccaagtgacaagaccattgggggaggagatgactccttcaacaccttcttcagtgagacgggcgctggcaagcacgtgccccggggctgtgtttgtagacttggaacccacagtcattgatgaagttcgcactggcacctaccgccagctcttccaccctgagcagctcatcacaggcaaggaagatgctgccaataactatgcccgagggcactacaccattggcaaggagatcattgaccttgtgttggaccgaattcgcaagctggctgaccagtgcaccggtcttcagggcttcttggttttccacagctttggtgggggaactggttctgggttcacctcccctgctcatggaacgtctctcagttgattatggcaagaagtccaagctggagttctccatttacccagcaccccaggtttccacagctgtagttgagccctacaactccatcctcaccacccacaccaccctggagcactctgattgtgccttcatggtagacaatgaggccatctatgacatctgtcgtagaaacctcgatattgagcgtccaacctatactaacctgaataggttaataggtcaaattgtgtcctccatcactgcttccctgagatttgatggagccctgaatgttgacctgacagaattccagaccaacctggtgccctactccccgcatccacttccctctggccacatatgcccctgtcatctctgctgagaaagcctaccatgaacagctttctgtagcagagatcaccaatgcttgctttgagccagccaaccagatgggtgaaatgtggacccttngccatggtaaaanacatggggtttgcttgccctgtttgttaccgtggtngacgtgggtttcccaaaggntgtnaaatgntggccattggccaaccattcaaggaccaagnggtaccatncagtttttgtgggattgggtgccccaatgggttaaaagggttgggaattaacttaaccaggct

SEQ ID NO: 488758 - DNA, 782 bp, Homo sapiens
  misc_feature (72)..(72): n is a, c, g, or t
  misc_feature (81)..(81): n is a, c, g, or t
  misc_feature (107)..(107): n is a, c, g, or t
  misc_feature (147)..(147): n is a, c, g, or t
  misc_feature (152)..(152): n is a, c, g, or t
  misc_feature (167)..(167): n is a, c, g, or t
gagcggtgtgggcggacgcggcggacgtgggtgagggcgcggcgtaagagagcgggacgcggggtgcccggngcgtggtgngggtccccggcgcctgcccccacggnacccaagaaggcctggccagggtaccctccgcggagcccnggggngtggggggctgcggngccccatgtgagccgaagatgggcagccgggagccccaagacaggacggagctggcagcagacacacagcggaccgctgacccttggtggcgcgggtgacgcgtaaggccggtggaccaagagtggctcaaggggacgcgttgttgccgccggtccaatgatgggtacaccatagccctgcattggctcataacctagcgacactcgggatgcagcagccctaacagggtccccggcgagcgcagggggcatgcaagggacatagccatggcatgaggaggcaacaaagcggatgggaccccgaagcagaggagaccataggagacaaagcgaaccgcggacatgaacggttgggaggagcaataaacgtcatcaggggggacggggaccacaagactcaacacagtacgaagaacacattggcagtttgagtgtacagctagaggatatacaagagcaacccaggcgcgtctaaatgggggccgatttgggcgaatgcgcgcgttgggagagtcgtgaggccagccgaacgggtacagtgacagacgacccagtagggaattcggtacgcccatagcgccaacagtataacgacttcgcttaccagaggcccac

SEQ ID NO: 488759 - DNA, 2439 bp, Homo sapiens
  misc_feature (1623)..(1624): n is a, c, g, or t
ggtaccgcgaacggtgcgttacttacctcgactcttagcttgtcggggacggtaaccgggacccggtgtctgctcctgtcgccttcgcctcctaatccctagccactatgcgtgagtgcatctccatccacgttggccaggctggtgtccagattggcaatgcctgctgggagctctactgcctggaacacggcatccagcccgatggccagatgccaagtgacaagaccattgggggaggagatgactggcaagcacgtgccccgggctgtgtttgtagacttggaacccacagtcattgatgaagttcgcactggcacctaccgccagctcttccaccctgagcagctcatcacaggcaaggaagatgctgccaataactatgcccgagggcactacaccattggcaaggagatcattgaccttgtgttggaccgaattcgcaagctggctgaccagtgcaccggtcttcagggcttcttggttttccacagctttggtgggggaactggttctgggttcacctcccctgctcatggaacgtctctcagttgattatggcaagaagtccaagctggagttctccatttacccagcaccccaggtttccacagctgtagttgagccctacaactccatcctcaccacccacaccaccctggagcactctgattgtgccttcatggtagacaatgaggccatctatgacatctgtcgtagaaacctcgatatcgagcgcccaacctacactaaccttaaccgccttattagccagattgtgtcctccatcactgcttccctgagatttgatggagccctgaatgttgacctgacagaattccagaccaacctggtgccctactccccgcatccacttccctctggccacatatgcccctgtcatctctgctgagaaagcctaccatgaacagctttctgtagcagagatcaccaatgcttgctttgagccagccaaccagatggtgaaatgtgaccctcgccatggtaaatacatggcttgctgcctgttgtaccgtggtgacgtggttcccaaagatgtcaatgctgccattgccaccatcaaaaccaagcgcagcatccagtttgtggattggtgccccactggcttcaaggttggcatcaactaccagcctcccactgtggtgcctggtggagacctggccaaggtacagagagctgtgtgcatgctgagcaacaccacagccattgctgaggcctgggctcgcctggaccacaagtttgacctgatgtatgccaagcgtgcctttgttcactggtacgtgggtgaggggatggaggaaggcgagttttcagaggcccgtgaagatatggctgcccttgagaaggattatgaggaggttggtgtggattctgttgaaggagagggtgaggaagaaggagaggaatactaattatccattccttttggccctgcagcatgtcatgctcccagaatttcagcttcagcttaactgacagacgttaaagctttctggttagattgttttcacttggtgatcatgtcttttccatgtgtacctgtaatatttttccatcatatctcaaagtaaagtcattaacatccaaaaaaaaaaaaataannaaaaaaaaaaaaaaaaaaaaacaaacaaaaaaaaaaaaaaaaagaaacaaaaaaaaaaaacaaaaaaacaaaaaaaaaaacaaaaaaaaagaaaagcaaaaaacaacagaacaaaaaaaggagaagagaggggggggcggggcccgctaaaacattcctccgcgccgggggcgggcgcaccaacaccgcccccgcacgccggctctgatggacaggagaggcgccgcccccatacgaatgatgagagacataatatcaaacacgaccaggcgggcgcggcgcatgccacaaaccacaaacaccgctggagaggaacaaaaccaaacaaggaggagtgacactctcagctggaacgacgaccaccacccactttgtgtggcgggacgccaaacacggcgacacaccacccccacaacaaaatacccagcggcgcggagaaacaacaaaccgcacggcgagctagaggatgcaacaacaccaacacgttatctgtgcggagcgacagaaaatagcgacaagaggagacgagagaaaaaaaataatcgacgggcggcttgatgaaataaaccacgcgcagcgacagccagagcaacgacacgagaacgcccacgaccacagcccacgcccacccaccccaacgccacggaacaccgaaacgagaagaagcagacagacaccgcagcaccaccagaaccgaacaccgccgacacgacagcagcagagtacacccgccacacgaacaagcacgccaacgcagaacgaccgacagacaccaccgagcacggaacgaccggcaccacaagcaggagacaacc

SEQ ID NO: 488760 - DNA, 321 bp, Homo sapiens
  misc_feature (25)..(25): n is a, c, g, or t
  misc_feature (93)..(93): n is a, c, g, or t
  misc_feature (112)..(112): n is a, c, g, or t
  misc_feature (131)..(131): n is a, c, g, or t
  misc_feature (164)..(164): n is a, c, g, or t
  misc_feature (176)..(176): n is a, c, g, or t
  misc_feature (192)..(192): n is a, c, g, or t
  misc_feature (298)..(298): n is a, c, g, or t
  misc_feature (315)..(315): n is a, c, g, or t
cactgtgacaagctgacacgtggancctgagaacttcaggctcctgggcaacgtgctggtcctgtgtgctggcccatccactttgggcaaagnaatttcaccccaccagtgncaggactgccctattcagnaaagtggtggctggtgtggctaatggccctggncccacaagtatncactaagctcgctttncttgctgtcccaatttctattaaaggttcctttgttccctaagtaccaactactaaactgggggatattatgcaagggccttgagtcatctggattctgcctaatnaaaaacatttcattttncattgc

SEQ ID NO: 488761 - DNA, 2422 bp, Homo sapiens
  misc_feature (1606)..(1607): n is a, c, g, or t
ggtaccgcgaacggtgcgttacttacctcgactcttagcttgtcggggacggtaaccgggacccggtgtctgctcctgtcgccttcgcctcctaatccctagccactatgcgtgagtgcatctccatccacgttggccaggctggtgtccagattggcaatgcctgctgggagctctactgcctggaacacggcatccagcccgatggccagatgccaagtgacaagaccattgggggaggagatgactccttcaacaccttcttcagtgagacgggcgctggcaagcacgtgccccggggctgtgtttgtagacttggaacccacagtcattgatgaagttcgcactggcacctaccgccagctcttccaccctgagcagctcatcacaggcaaggatcattgaccttgtgttggaccgaattcgcaagctggctgaccagtgcaccggtcttcagggcttcttggttttccacagctttggtgggggaactggttctgggttcacctcccctgctcatggaacgtctctcagttgattatggcaagaagtccaagctggagttctccatttacccagcaccccaggtttccacagctgtagttgagccctacaactccatcctcaccacccacaccaccctggagcactctgattgtgccttcatggtagacaatgaggccatctatgacatctgtcgtagaaacctcgatatcgagcgcccaacctacactaaccttaaccgccttattagccagattgtgtcctccatcactgcttccctgagatttgatggagccctgaatgttgacctgacagaattccagaccaacctggtgccctactccccgcatccacttccctctggccacatatgcccctgtcatctctgctgagaaagcctaccatgaacagctttctgtagcagagatcaccaatgcttgctttgagccagccaaccagatggtgaaatgtgaccctcgccatggtaaatacatggcttgctgcctgttgtaccgtggtgacgtggttcccaaagatgtcaatgctgccattgccaccatcaaaaccaagcgcagcatccagtttgtggattggtgccccactggcttcaaggttggcatcaactaccagcctcccactgtggtgcctggtggagacctggccaaggtacagagagctgtgtgcatgctgagcaacaccacagccattgctgaggcctgggctcgcctggaccacaagtttgacctgatgtatgccaagcgtgcctttgttcactggtacgtgggtgaggggatggaggaaggcgagttttcagaggcccgtgaagatatggctgcccttgagaaggattatgaggaggttggtgtggattctgttgaaggagagggtgaggaagaaggagaggaatactaattatccattccttttggccctgcagcatgtcatgctcccagaatttcagcttcagcttaactgacagacgttaaagctttctggttagattgttttcacttggtgatcatgtcttttccatgtgtacctgtaatatttttccatcatatctcaaagtaaagtcattaacatccaaaaaaaaaaaaataannaaaaaaaaaaaaaaaaaaaaacaaacaaaaaaaaaaaaaaaaagaaacaaaaaaaaaaaacaaaaaaacaaaaaaaaaaacaaaaaaaaagaaaagcaaaaaacaacagaacaaaaaaaggagaagagaggggggggcggggcccgctaaaacattcctccgcgccgggggcgggcgcaccaacaccgcccccgcacgccggctctgatggacaggagaggcgccgcccccatacgaatgatgagagacataatatcaaacacgaccaggcgggcgcggcgcatgccacaaaccacaaacaccgctggagaggaacaaaaccaaacaaggaggagtgacactctcagctggaacgacgaccaccacccactttgtgtggcgggacgccaaacacggcgacacaccacccccacaacaaaatacccagcggcgcggagaaacaacaaaccgcacggcgagctagaggatgcaacaacaccaacacgttatctgtgcggagcgacagaaaatagcgacaagaggagacgagagaaaaaaaataatcgacgggcggcttgatgaaataaaccacgcgcagcgacagccagagcaacgacacgagaacgcccacgaccacagcccacgcccacccaccccaacgccacggaacaccgaaacgagaagaagcagacagacaccgcagcaccaccagaaccgaacaccgccgacacgacagcagcagagtacacccgccacacgaacaagcacgccaacgcagaacgaccgacagacaccaccgagcacggaacgaccggcaccacaagcaggagacaacc

SEQ ID NO: 488762 - DNA, 1673 bp, Homo sapiens
ggcaggttcgcttacatcgaccgcctaagagtcgcgctgtaagaagcaacaacctctcctcttcgtctccgccatcagctcggcagtcgcgaagcagcaaccatgcgtgagtgcatctccatccacgttggccaggctggtgtccagattggcaatgcctgctgggagctctactgcctggaacacggcatccagcccgatggccagatgccaagtgacaagaccattgggggaggagatgattccttcaacaccttcttcagtgagacgggggctggcaagcatgtgccccgggcagtgtttgtagacttggaacccacagtcattgatgaagttcgcactggcacctaccgccagctcttccaccctgagcagctcatcacaggcaaggaagatgctgccaataactatgcccgagggcactacaccattggcaaggagatcattgaccttgtgttggaccgaattcgcaagctggctgaccagtgcaccggtcttcagggcttcttggttttccacagctttggtgggggaactggttctgggttcacctcccctgctcatggaacgtctctcagttgattatggcaagaagtccaagctggagttctccatttacccagcaccccaggtttccacagctgtagttgagccctacaactccatcctcaccacccacaccaccctggagcactctgattgtgccttcatggtagacaatgaggccatctatgacatctgtcgtagaaacctcgatattgagcgtccaacctatactaacctgaataggttaataggtcaaattgtgtcctccatcactgcttccctgagatttgatggagccctgaatgttgacctgacagaattccagaccaacctggtgccctactccccgcatccacttccctctggccacatatgcccctgtcatctctgctgagaaagcctaccatgaacagctttctgtagcagagatcaccaatgcttgctttgagccagccaaccagatggtgaaatgtgaccctcgccatggtaaatacatggcttgctgcctgttgtaccgtggtgacgtggttcccaaagatgtcaatgctgccattgccaccatcaaaaccaagcgcagcatccagtttgtggattggtgccccactggcttcaaggttggcatcaactaccagcctcccactgtggtgcctggtggagacctggccaaggtacagagagctgtgtgcatgctgagcaacaccacagccattgctgaggcctgggctcgcctggaccacaagtttgacctgatgtatgccaaacgtgcctttgttcactggtacgttggggaggggatggaggaaggtgagttttcagaggcccgtgaggacatggctgcccttgagaaggattatgaggaggttggtgtggattctgttgaaggagagggtgaggaagaaggagaggaatactaaagttaaaacgtcacaaaggtgctgcttttacagggaagcttattctgttttaaacattgaaaagttgtggtctgatcagttaatttgtatgtagcagtgtatgctctcatatacaattactgacctatgctctaaaacatgaatgctttgttacagacccaagctgtccatttctgtgatgggttttgaataaagtattccctgttttaaatg

SEQ ID NO: 488763 - DNA, 561 bp, Homo sapiens
cgcagtggctcacgcctgtaatcccagcactttgggaggctgaggcaggtggatcacctgaggtcaggagttcgagaccagtctggtcaacataacaaaaccccatctctactaaaaatacaaaaatattagccaggcgtggtggcgggagcctataatcccagctactcgggaggctgaggcaggaaaatcatttgaacccgggaggcggaggttgcagtgagccgggatcgcgccattgcactccagcctgggtgacagggtgagactccatctcaaaaaaaaaaattatttgtatatggtttcccttatttctttgaacatatttggaattgatgttttgaagtctttgtgtaccaagtcctgtatttgatctccttcacagatagtttgtttctattgactatttttatttctgtacactttgcatgtgtcatagttgtttgttgtaaattggacattttgtgtaatatattgcagcagctttggattttgatttcttctcccccaggagatggttgttgtttcaggattatttgtttattgacttgcctcgactaa

SEQ ID NO: 488764 - DNA, 2483 bp, Homo sapiens
  misc_feature (397)..(399): n is a, c, g, or t
  misc_feature (402)..(411): n is a, c, g, or t
  misc_feature (420)..(422): n is a, c, g, or t
  misc_feature (1667)..(1668): n is a, c, g, or t
ggtaccgcgaacggtgcgttacttacctcgactcttagcttgtcggggacggtaaccgggacccggtgtctgctcctgtcgccttcgcctcctaatccctagccactatgcgtgagtgcatctccatccacgttggccaggctggtgtccagattggcaatgcctgctgggagctctactgcctggaacacggcatccagcccgatggccagatgccaagtgacaagaccattgggggaggagatgaccttcttcagtgagacgggcgctggcaagcacgtgccccgggctgtgtttgtagacttggaacccacagtcattgatgaagttcgcactggcacctaccgccagctcttccaccctgagcagctcatcacaggcaaggaagatggctggnnnccnnnnnnnnnnaaaaaaaannncactatgcccgagggcactacaccattggcaaggagatcattgaccttgtgttggaccgaattcgcaagctggctgaccagtgcaccggtcttcagggcttcttggttttccacagctttggtgggggaactggttctgggttcacctcccctgctcatggaacgtctctcagttgattatggcaagaagtccaagctggagttctccatttacccagcaccccaggtttccacagctgtagttgagccctacaactccatcctcaccacccacaccaccctggagcactctgattgtgccttcatggtagacaatgaggccatctatgacatctgtcgtagaaacctcgatatcgagcgcccaacctacactaaccttaaccgccttattagccagattgtgtcctccatcactgcttccctgagatttgatggagccctgaatgttgacctgacagaattccagaccaacctggtgccctactccccgcatccacttccctctggccacatatgcccctgtcatctctgctgagaaagcctaccatgaacagctttctgtagcagagatcaccaatgcttgctttgagccagccaaccagatggtgaaatgtgaccctcgccatggtaaatacatggcttgctgcctgttgtaccgtggtgacgtggttcccaaagatgtcaatgctgccattgccaccatcaaaaccaagcgcagcatccagtttgtggattggtgccccactggcttcaaggttggcatcaactaccagcctcccactgtggtgcctggtggagacctggccaaggtacagagagctgtgtgcatgctgagcaacaccacagccattgctgaggcctgggctcgcctggaccacaagtttgacctgatgtatgccaagcgtgcctttgttcactggtacgtgggtgaggggatggaggaaggcgagttttcagaggcccgtgaagatatggctgcccttgagaaggattatgaggaggttggtgtggattctgttgaaggagagggtgaggaagaaggagaggaatactaattatccattccttttggccctgcagcatgtcatgctcccagaatttcagcttcagcttaactgacagacgttaaagctttctggttagattgttttcacttggtgatcatgtcttttccatgtgtacctgtaatatttttccatcatatctcaaagtaaagtcattaacatccaaaaaaaaaaaaataannaaaaaaaaaaaaaaaaaaaaacaaacaaaaaaaaaaaaaaaaagaaacaaaaaaaaaaaacaaaaaaacaaaaaaaaaaacaaaaaaaaagaaaagcaaaaaacaacagaacaaaaaaaggagaagagaggggggggcggggcccgctaaaacattcctccgcgccgggggcgggcgcaccaacaccgcccccgcacgccggctctgatggacaggagaggcgccgcccccatacgaatgatgagagacataatatcaaacacgaccaggcgggcgcggcgcatgccacaaaccacaaacaccgctggagaggaacaaaaccaaacaaggaggagtgacactctcagctggaacgacgaccaccacccactttgtgtggcgggacgccaaacacggcgacacaccacccccacaacaaaatacccagcggcgcggagaaacaacaaaccgcacggcgagctagaggatgcaacaacaccaacacgttatctgtgcggagcgacagaaaatagcgacaagaggagacgagagaaaaaaaataatcgacgggcggcttgatgaaataaaccacgcgcagcgacagccagagcaacgacacgagaacgcccacgaccacagcccacgcccacccaccccaacgccacggaacaccgaaacgagaagaagcagacagacaccgcagcaccaccagaaccgaacaccgccgacacgacagcagcagagtacacccgccacacgaacaagcacgccaacgcagaacgaccgacagacaccaccgagcacggaacgaccggcaccacaagcaggagacaacc

SEQ ID NO: 488765 - DNA, 146 bp, Homo sapiens
tcgctgaggcgggaccgtgtggcgtcgagagattcgtcgattatcagtaagtcgaccgatgctgctcatccggaagctgtccttccagaggttggtgagggagatcgacgcaggatttcaaacaccgagcctgaaggtttcatgag

SEQ ID NO: 488766 - DNA, 2449 bp, Homo sapiens
  misc_feature (1633)..(1634): n is a, c, g, or t
ggtaccgcgaacggtgcgttacttacctcgactcttagcttgtcggggacggtaaccgggacccggtgtctgctcctgtcgccttcgcctcctaatccctagccactatgcgtgagtgcatctccatccacgttggccaggctggtgtccagattggcaatgcctgctgggagctctactgcctggaacacggcatccagcccgatggccagatgccaagtgacaagaccattgggggaggagatgactggcaagcacgtgccccgggctgtgtttgtagacttggaacccacagtcattgatgaagttcgcactggcacctaccgccagctcttccaccctgagcagctcatcacaggcaaggaagatgctgccaataactatgcccgactatgcccgagggcactacaccattggcaaggagatcattgaccttgtgttggaccgaattcgcaagctggctgaccagtgcaccggtcttcagggcttcttggttttccacagctttggtgggggaactggttctgggttcacctcccctgctcatggaacgtctctcagttgattatggcaagaagtccaagctggagttctccatttacccagcaccccaggtttccacagctgtagttgagccctacaactccatcctcaccacccacaccaccctggagcactctgattgtgccttcatggtagacaatgaggccatctatgacatctgtcgtagaaacctcgatatcgagcgcccaacctacactaaccttaaccgccttattagccagattgtgtcctccatcactgcttccctgagatttgatggagccctgaatgttgacctgacagaattccagaccaacctggtgccctactccccgcatccacttccctctggccacatatgcccctgtcatctctgctgagaaagcctaccatgaacagctttctgtagcagagatcaccaatgcttgctttgagccagccaaccagatggtgaaatgtgaccctcgccatggtaaatacatggcttgctgcctgttgtaccgtggtgacgtggttcccaaagatgtcaatgctgccattgccaccatcaaaaccaagcgcagcatccagtttgtggattggtgccccactggcttcaaggttggcatcaactaccagcctcccactgtggtgcctggtggagacctggccaaggtacagagagctgtgtgcatgctgagcaacaccacagccattgctgaggcctgggctcgcctggaccacaagtttgacctgatgtatgccaagcgtgcctttgttcactggtacgtgggtgaggggatggaggaaggcgagttttcagaggcccgtgaagatatggctgcccttgagaaggattatgaggaggttggtgtggattctgttgaaggagagggtgaggaagaaggagaggaatactaattatccattccttttggccctgcagcatgtcatgctcccagaatttcagcttcagcttaactgacagacgttaaagctttctggttagattgttttcacttggtgatcatgtcttttccatgtgtacctgtaatatttttccatcatatctcaaagtaaagtcattaacatccaaaaaaaaaaaaataannaaaaaaaaaaaaaaaaaaaaacaaacaaaaaaaaaaaaaaaaagaaacaaaaaaaaaaaacaaaaaaacaaaaaaaaaaacaaaaaaaaagaaaagcaaaaaacaacagaacaaaaaaaggagaagagaggggggggcggggcccgctaaaacattcctccgcgccgggggcgggcgcaccaacaccgcccccgcacgccggctctgatggacaggagaggcgccgcccccatacgaatgatgagagacataatatcaaacacgaccaggcgggcgcggcgcatgccacaaaccacaaacaccgctggagaggaacaaaaccaaacaaggaggagtgacactctcagctggaacgacgaccaccacccactttgtgtggcgggacgccaaacacggcgacacaccacccccacaacaaaatacccagcggcgcggagaaacaacaaaccgcacggcgagctagaggatgcaacaacaccaacacgttatctgtgcggagcgacagaaaatagcgacaagaggagacgagagaaaaaaaataatcgacgggcggcttgatgaaataaaccacgcgcagcgacagccagagcaacgacacgagaacgcccacgaccacagcccacgcccacccaccccaacgccacggaacaccgaaacgagaagaagcagacagacaccgcagcaccaccagaaccgaacaccgccgacacgacagcagcagagtacacccgccacacgaacaagcacgccaacgcagaacgaccgacagacaccaccgagcacggaacgaccggcaccacaagcaggagacaacc

SEQ ID NO: 488767 - DNA, 688 bp, Homo sapiens
catctcaaagacccttcgtcaaccacttgtccccccatgcccccttgtcctccccggcacgggaactcttccaatggtgccccccgaggttcatccccctcactataattgcctcctctctcaagctactccatcttgaacgtccgcttgccttcgcgactttctgatacccttctctgcaacagttatcacaagaacctagtaccccccataagtgattcttagggcttttttgaccaatcctcccagtaaccgtcttgcactatgcccccccccttcttaacctacccctggtagaaccttctctactgtattatagacaacccccccttctttgcctctgtccacataaatttacctcttcttcccgagtcttgacttcgagtagtctctcaacagcacatcgcgtagtgatttacacgccgctcgcccatttttacgaccacgctctgaatacacttattttaatttccctcccccgcaccctccctgtgggctgctcacactcctccactccacccacatggacacaacacttagacaccctctcatttaccaccacgagtaacgacccctccactgcgttgataacaccctcttccccgccatcttttcctctccctttcctctcctccaccgcccaatactacacatatcccggggttttcctcccacatcactataacca

SEQ ID NO: 488768 - DNA, 2544 bp, Homo sapiens
  misc_feature (267)..(267): n is a, c, g, or t
  misc_feature (1728)..(1729): n is a, c, g, or t
ggtaccgcgaacggtgcgttacttacctcgactcttagcttgtcggggacggtaaccgggacccggtgtctgctcctgtcgccttcgcctcctaatccctagccactatgcgtgagtgcatctccatccacgttggccaggctggtgtccagattggcaatgcctgctgggagctctactgcctggaacacggcatccagcccgatggccagatgccaagtgacaagaccattgggggaggagatgactgcactcccttcaacaccntctccttcagctgacgaccggtgcgcctggcgaacgcacgctgcccccgggcctgatgttctgctagcaccttgagcatagcccaccagtcacttcgattgcagacgctttctgacaccgtgtgcctagccgtcagcacggcccaggcttcgttccagccacatgaatgcagtctcattcgacaggcgtccagacggcaagatgctgccacactaacctatgccctgagggcactacaccattggcaaggagatcattgaccttgtgttggaccgaattcgcaagctggctgaccagtgcaccggtcttcagggcttcttggttttccacagctttggtgggggaactggttctgggttcacctcccctgctcatggaacgtctctcagttgattatggcaagaagtccaagctggagttctccatttacccagcaccccaggtttccacagctgtagttgagccctacaactccatcctcaccacccacaccaccctggagcactctgattgtgccttcatggtagacaatgaggccatctatgacatctgtcgtagaaacctcgatatcgagcgcccaacctacactaaccttaaccgccttattagccagattgtgtcctccatcactgcttccctgagatttgatggagccctgaatgttgacctgacagaattccagaccaacctggtgccctactccccgcatccacttccctctggccacatatgcccctgtcatctctgctgagaaagcctaccatgaacagctttctgtagcagagatcaccaatgcttgctttgagccagccaaccagatggtgaaatgtgaccctcgccatggtaaatacatggcttgctgcctgttgtaccgtggtgacgtggttcccaaagatgtcaatgctgccattgccaccatcaaaaccaagcgcagcatccagtttgtggattggtgccccactggcttcaaggttggcatcaactaccagcctcccactgtggtgcctggtggagacctggccaaggtacagagagctgtgtgcatgctgagcaacaccacagccattgctgaggcctgggctcgcctggaccacaagtttgacctgatgtatgccaagcgtgcctttgttcactggtacgtgggtgaggggatggaggaaggcgagttttcagaggcccgtgaagatatggctgcccttgagaaggattatgaggaggttggtgtggattctgttgaaggagagggtgaggaagaaggagaggaatactaattatccattccttttggccctgcagcatgtcatgctcccagaatttcagcttcagcttaactgacagacgttaaagctttctggttagattgttttcacttggtgatcatgtcttttccatgtgtacctgtaatatttttccatcatatctcaaagtaaagtcattaacatccaaaaaaaaaaaaataannaaaaaaaaaaaaaaaaaaaaacaaacaaaaaaaaaaaaaaaaagaaacaaaaaaaaaaaacaaaaaaacaaaaaaaaaaacaaaaaaaaagaaaagcaaaaaacaacagaacaaaaaaaggagaagagaggggggggcggggcccgctaaaacattcctccgcgccgggggcgggcgcaccaacaccgcccccgcacgccggctctgatggacaggagaggcgccgcccccatacgaatgatgagagacataatatcaaacacgaccaggcgggcgcggcgcatgccacaaaccacaaacaccgctggagaggaacaaaaccaaacaaggaggagtgacactctcagctggaacgacgaccaccacccactttgtgtggcgggacgccaaacacggcgacacaccacccccacaacaaaatacccagcggcgcggagaaacaacaaaccgcacggcgagctagaggatgcaacaacaccaacacgttatctgtgcggagcgacagaaaatagcgacaagaggagacgagagaaaaaaaataatcgacgggcggcttgatgaaataaaccacgcgcagcgacagccagagcaacgacacgagaacgcccacgaccacagcccacgcccacccaccccaacgccacggaacaccgaaacgagaagaagcagacagacaccgcagcaccaccagaaccgaacaccgccgacacgacagcagcagagtacacccgccacacgaacaagcacgccaacgcagaacgaccgacagacaccaccgagcacggaacgaccggcaccacaagcaggagacaacc

SEQ ID NO: 488769 - DNA, 158 bp, Homo sapiens
  misc_feature (5)..(5): n is a, c, g, or t
  misc_feature (60)..(60): n is a, c, g, or t
agaanacacagaggacggttgcgagaagacacgaaggttacgctgctgagacacgaaggntacgctgctagaagacacgagggtacgctgcgagaagacgacgagggtacgctgctagaagacgacagagggtacgctgcgagaagactacagaaggg

SEQ ID NO: 488770 - DNA, 2372 bp, Homo sapiens
  misc_feature (1556)..(1557): n is a, c, g, or t
ggtaccgcgaacggtgcgttacttacctcgactcttagcttgtcggggacggtaaccgggacccggtgtctgctcctgtcgccttcgcctcctaatccctagccactatgcgtgagtgcatctccatccacgttggccaggctggtgtccagattggcaatgcctgctgggagctctactgcctggaacacggcatccagcccgatggccagatgccaagtgacaagaccattgggggaggagatgactggcaagcacgtgccccgggctgtgtttgtagacttggaacccacagtcattgatgaagttcgcactggcacctaccgccagctcttccaccctgagcagctcatcacaggcaaggaagatgctgccaataactatgcccgagggcactacaccattggcaaggagtggttttccacagctttggtgggggaactggttctgggttcacctcccctgctcatggaacgtctctcagttgattatggcaagaagtccaagctggagttctccatttacccagcaccccaggtttccacagctgtagttgagccctacaactccatcctcaccacccacaccaccctggagcactctgattgtgccttcatggtagacaatgaggccatctatgacatctgtcgtagaaacctcgatatcgagcgcccaacctacactaaccttaaccgccttattagccagattgtgtcctccatcactgcttccctgagatttgatggagccctgaatgttgacctgacagaattccagaccaacctggtgccctactccccgcatccacttccctctggccacatatgcccctgtcatctctgctgagaaagcctaccatgaacagctttctgtagcagagatcaccaatgcttgctttgagccagccaaccagatggtgaaatgtgaccctcgccatggtaaatacatggcttgctgcctgttgtaccgtggtgacgtggttcccaaagatgtcaatgctgccattgccaccatcaaaaccaagcgcagcatccagtttgtggattggtgccccactggcttcaaggttggcatcaactaccagcctcccactgtggtgcctggtggagacctggccaaggtacagagagctgtgtgcatgctgagcaacaccacagccattgctgaggcctgggctcgcctggaccacaagtttgacctgatgtatgccaagcgtgcctttgttcactggtacgtgggtgaggggatggaggaaggcgagttttcagaggcccgtgaagatatggctgcccttgagaaggattatgaggaggttggtgtggattctgttgaaggagagggtgaggaagaaggagaggaatactaattatccattccttttggccctgcagcatgtcatgctcccagaatttcagcttcagcttaactgacagacgttaaagctttctggttagattgttttcacttggtgatcatgtcttttccatgtgtacctgtaatatttttccatcatatctcaaagtaaagtcattaacatccaaaaaaaaaaaaataannaaaaaaaaaaaaaaaaaaaaacaaacaaaaaaaaaaaaaaaaagaaacaaaaaaaaaaaacaaaaaaacaaaaaaaaaaacaaaaaaaaagaaaagcaaaaaacaacagaacaaaaaaaggagaagagaggggggggcggggcccgctaaaacattcctccgcgccgggggcgggcgcaccaacaccgcccccgcacgccggctctgatggacaggagaggcgccgcccccatacgaatgatgagagacataatatcaaacacgaccaggcgggcgcggcgcatgccacaaaccacaaacaccgctggagaggaacaaaaccaaacaaggaggagtgacactctcagctggaacgacgaccaccacccactttgtgtggcgggacgccaaacacggcgacacaccacccccacaacaaaatacccagcggcgcggagaaacaacaaaccgcacggcgagctagaggatgcaacaacaccaacacgttatctgtgcggagcgacagaaaatagcgacaagaggagacgagagaaaaaaaataatcgacgggcggcttgatgaaataaaccacgcgcagcgacagccagagcaacgacacgagaacgcccacgaccacagcccacgcccacccaccccaacgccacggaacaccgaaacgagaagaagcagacagacaccgcagcaccaccagaaccgaacaccgccgacacgacagcagcagagtacacccgccacacgaacaagcacgccaacgcagaacgaccgacagacaccaccgagcacggaacgaccggcaccacaagcaggagacaacc

SEQ ID NO: 488771 - DNA, 1743 bp, Homo sapiens
ggtaccgcgaacggtgcgttacttacctcgactcttagcttgtcggggacggtaaccgggacccggtgtctgctcctgtcgccttcgcctcctaatccctagccactatgcgtgagtgcatctccatccacgttggccaggctggtgtccagattggcaatgcctgctgggagctctactgcctggaacacggcatccagcccgatggccagatgccaagtgacaagaccattgggggaggagatgactccttcaacaccttcttcagtgagacgggcgctggcaagcacgtgccccggggctcatgtggttgtgtatgacgtatgcgagagcccgatcgaggtcattgtgactgaaggttgcgtccagcatggagacatcgcgtagctctggcaggctcgtatccccaggcgctgtagacaggctcgatcacgaagggcagaaggtagaggacttgctaggctagagtaagcgtagtgtccctgaagggcactacaccattggcaaggagatcattgaccttgtgttggaccgaattcgcaagctggctgaccagtgcaccggtcttcagggcttcttggttttccacagctttggtgggggaactggttctgggttcacctcccctgctcatggaacgtctctcagttgattatggcaagaagtccaagctggagttctccatttacccagcaccccaggtttccacagctgtagttgagccctacaactccatcctcaccacccacaccaccctggagcactctgattgtgccttcatggtagacaatgaggccatctatgacatctgtcgtagaaacctcgatattgagcgtccaacctatactaacctgaataggttaataggtcaaattgtgtcctccatcactgcttccctgagatttgatggagccctgaatgttgacctgacagaattccagaccaacctggtgccctactccccgcatccacttccctctggccacatatgcccctgtcatctctgctgagaaagcctaccatgaacagctttctgtagcagagatcaccaatgcttgctttgagccagccaaccagatggtgaaatgtgaccctcgccatggtaaatacatggcttgctgcctgttgtaccgtggtgacgtggttcccaaagatgtcaatgctgccattgccaccatcaaaaccaagcgcagcatccagtttgtggattggtgccccactggcttcaaggttggcatcaactaccagcctcccactgtggtgcctggtggagacctggccaaggtacagagagctgtgtgcatgctgagcaacaccacagccattgctgaggcctgggctcgcctggaccacaagtttgacctgatgtatgccaaacgtgcctttgttcactggtacgttggggaggggatggaggaaggtgagttttcagaggcccgtgaggacatggctgcccttgagaaggattatgaggaggttggtgtggattctgttgaaggagagggtgaggaagaaggagaggaatactaaagttaaaacgtcacaaaggtgctgcttttacagggaagcttattctgttttaaacattgaaaagttgtggtctgatcagttaatttgtatgtagcagtgtatgctctcatatacaattactgacctatgctctaaaacatgaatgctttgttacagacccaagctgtccatttctgtgatgggttttgaataaagtattccctgttttaaatg

SEQ ID NO: 488772 - DNA, 1673 bp, Homo sapiens
  misc_feature (404)..(404): n is a, c, g, or t
  misc_feature (406)..(406): n is a, c, g, or t
  misc_feature (408)..(408): n is a, c, g, or t
  misc_feature (412)..(412): n is a, c, g, or t
  misc_feature (419)..(419): n is a, c, g, or t
  misc_feature (428)..(430): n is a, c, g, or t
  misc_feature (437)..(438): n is a, c, g, or t
  misc_feature (517)..(517): n is a, c, g, or t
  misc_feature (529)..(529): n is a, c, g, or t
ggtaccgcgaacggtgcgttacttacctcgactcttagcttgtcggggacggtaaccgggacccggtgtctgctcctgtcgccttcgcctcctaatccctagccactatgcgtgagtgcatctccatccacgttggccaggctggtgtccagattggcaatgcctgctgggagctctactgcctggaacacggcatccagcccgatggccagatgccaagtgacaagaccattgggggaggagatgattccttcaacaccttcttcagtgagacgggggctggcaagcatgtgccccgggcagtgtttgtagacttggaacccacagtcattgatgaagttcgcactggcacctaccgccagctcttccaccctgagcagctcatcacaggcaagggagggggngngnaggncgggggncgggggggnnngggcggnnggcgggggggggggggggggggtgggggggggggggcgcagggggggggggggggggggggggggaggggggggggggnggggggaggggnggggggggggggggggggggggggggggggggggggggggggggctcagttgattatggcaagaagtccaagctggagttctccatttacccagcaccccaggtttccacagctgtagttgagccctacaactccatcctcaccacccacaccaccctggagcactctgattgtgccttcatggtagacaatgaggccatctatgacatctgtcgtagaaacctcgatattgagcgtccaacctatactaacctgaataggttaataggtcaaattgtgtcctccatcactgcttccctgagatttgatggagccctgaatgttgacctgacagaattccagaccaacctggtgccctactccccgcatccacttccctctggccacatatgcccctgtcatctctgctgagaaagcctaccatgaacagctttctgtagcagagatcaccaatgcttgctttgagccagccaaccagatggtgaaatgtgaccctcgccatggtaaatacatggcttgctgcctgttgtaccgtggtgacgtggttcccaaagatgtcaatgctgccattgccaccatcaaaaccaagcgcagcatccagtttgtggattggtgccccactggcttcaaggttggcatcaactaccagcctcccactgtggtgcctggtggagacctggccaaggtacagagagctgtgtgcatgctgagcaacaccacagccattgctgaggcctgggctcgcctggaccacaagtttgacctgatgtatgccaaacgtgcctttgttcactggtacgttggggaggggatggaggaaggtgagttttcagaggcccgtgaggacatggctgcccttgagaaggattatgaggaggttggtgtggattctgttgaaggagagggtgaggaagaaggagaggaatactaaagttaaaacgtcacaaaggtgctgcttttacagggaagcttattctgttttaaacattgaaaagttgtggtctgatcagttaatttgtatgtagcagtgtatgctctcatatacaattactgacctatgctctaaaacatgaatgctttgttacagacccaagctgtccatttctgtgatgggttttgaataaagtattccctgttttaaatg

SEQ ID NO: 488773 - DNA, 1212 bp, Homo sapiens
agcggtgctgggtgactcatgcctgtagtcccaacactttggtaggttcaggtccgccgatcggatgactgcccggagtcgacaacctgactgtgctagactgtggtctacgtcacgtctctacttacagatgatccaatatacatagagagttcatgctgcggctgtggctgtgtacactccgggtacatccactgtctagcattatgagattgcgcgtgttgatgattcaccttggatgcctagagatgatactatcgctgcttcagtagtgcgataccatcactgcggacattgagcctcttagctcatcttctcgcatgatcatgttagagacgcggtgctcatccctggagaggcatcttaatatttacccgagactccctccaaatcattgcgctgtgcagcgcagtgaaaatgtctcccctccagggatcgaagaaccgagtagaaccattgggtcaagaccaatcgattcttttgctgtagatgcgcttgtgtgccaattctaacccggcaattcgagtccattgggcaagattgtaccactttatgccaaccattgggccttgaagccctattcaggttgtcctatctatggaacccccgcataggccgcaatccgggccccattctgtgaacctaagcccattgctatgtggcccttacttcccacttgttttggcggcgcttggccttcagcccgttagggccctgttcgtaagcccttctttcttgtggcgacgtcttggcgttggggcaatcgtcggggcaagtagagagggctgcccccttggccccgatggctcaagaagccgccaaggcccgtccgttttgctacacaagaatttcttcattcgctgcgacgaatccttttgtggcccgtcgcccatttggggccctcgttttgagcggggttccaatccgtccgccacagtttgcgtctcacaggaacccgttccccaaggtaggctttcgacacgcacattggggggtggagcgctatgcactttgcacctacttggttggtcgggcggcttggggggccccgttggtcccttccacaccgtgtgtggacttttgtcacttggcgcgggtgtgttttttccccttggtggtaccaccgggccttggccggctctgtggggttcccccgttatcaccctttttccgggcgggcttggaggcgcgtccggtggggccccctctccg

SEQ ID NO: 488774 - DNA, 358 bp, Homo sapiens
  misc_feature (130)..(131): n is a, c, g, or t
  misc_feature (152)..(153): n is a, c, g, or t
  misc_feature (191)..(191): n is a, c, g, or t
  misc_feature (206)..(206): n is a, c, g, or t
  misc_feature (217)..(217): n is a, c, g, or t
  misc_feature (278)..(278): n is a, c, g, or t
  misc_feature (317)..(317): n is a, c, g, or t
  misc_feature (334)..(334): n is a, c, g, or t
gttgtcttgtatgctcagcgaggcccggagagaccgggagagagctaggccgagtccaccgcccgagtctgctgcccgagcccgcgttacgcacaaagccgccgatccccggcctggggtgagcagacgnncaccgcccgggagcagcgcgnngagaccacggtgcgccctatgcccccgcgcccccaccncccccgccgcggcancgaaagcgcantgtagaacgcgccaccgggggcccgggtgcagctagcgaccctctcgccacctgcgcgcancccgaaggtgaagcagtgaagcggcaaacgagagggcanccaaggcgtttcgcggngccccctccttgcttgccccgggg

SEQ ID NO: 488775 - DNA, 100 bp, Homo sapiens
tcgagctcgcccattctgctggggttgtggggtatgtgctattgaaacttctaaaactaagcattgctgcctggggttctaacactaagtgctattgaaa

SEQ ID NO: 488776 - DNA, 468 bp, Homo sapiens
tcttcataaaagcccaaaagtggaaccaatttaaatgtccatcatctggtaaaaacatacatgtggtctatccatacagtagcatattactagacaattggaaggaatgaagtactgacacaggctacaacatggatgaatattgcaaacatcacgctaaatgaaagaagccagtcacaaaagactccatgattccgtttctgtaacatgcccagaacaggaaagtgtatagaggcagaaagtagattagtggctgtttagggctgggggttgaggtgaaatggggactgactgctaaggggtacagtgtttctttctggggtgatggaaatgtgctaaaattgattgtgatgatggctgcacaattctgtgaatatactaaaaagcactgaatcaggttcaacactttaaaagggttaattatatggtatgtgaattacacctcaataaagctgccataaaaaatgg

SEQ ID NO: 488777 - DNA, 291 bp, Homo sapiens
caaaatacatcgtgttacattcttttgtaaatctttatgttagcttttcttttttgagatggagttttactcctgttgcccaagctggagtgcaatggcgcaatctcggctcactacaacctccacctcctgggttcaagtgcattctcctgcttcagcctcctaagtagctgggattacaggggcctgccaccacacccagctaatttttgtatttttagtagagatggggtttcatcatgttggccaggctggtctcaaactcctgacctcaggtgatccacccgcctt

SEQ ID NO: 488778 - DNA, 391 bp, Homo sapiens
  misc_feature (145)..(145): n is a, c, g, or t
ttatattgttacttgctatgcagaagtataagtctgaattactacaggatgtttgtggtttgaaaaatacaaatgctatatctcatcagtatataattatatatgtacacagtctatataaacacaatttatgtatttgtctatnatatgcaaaccaaagtctttagttgagctcaagctaaatagtctttgtttttaaaaaatttccaattgttgccgggtgcggcggctcacgcctgtaatcctagcactttgggaggctgaagtgggtggatcaactgacgtcgggagttcgagaccaacctaatcaacatgcagaaaccccgcctctactaaaaatacaaaattagccgggcgtagcggcccatgcctgtaatcccagctacttggg

SEQ ID NO: 488779 - DNA, 684 bp, Homo sapiens
ggacgccgccttcgccgctggctccgtctgttggggggcgaacacgccgcggtcctcgtcgtggtgagcgcagccactcaggctggtcctgggggtggggctgtaggggaaagtgctaaagccgctgaggctctgagagattcctctgcgaatctgtttttagctatcaagtggcatccacgcttaaacaggtgaaacatgatcagcaagttgctcggatggaaaaactagctggtttggtagaagagctggaggctgacgagtggcggtttaagcccatcgagcagctgctgggattcaccccctcttcaggttgatactgcctggatggtcacctctggtgcgcagcaagtgcaaagccagtgggggactttctcacagcttacatagccatccagagatccacagctacgtcactgaattgttaatgcacatttgtacttggtttctctgtatctattcacaggcaacaaatacttatatgtgtgatctttcaaataaaacaacccccctacccctcacccacactcacaacaaggaaacaacacctcctccctcacaaaccatgccggccgcctggcctcggctttagactcggcaggcttatgcatgcggcccgaattcggctcactggcccaattccccctatagggagccgtatacaatcaactggcggggtttccc

SEQ ID NO: 488780 - DNA, 522 bp, Homo sapiens
  misc_feature (437)..(437): n is a, c, g, or t
  misc_feature (456)..(456): n is a, c, g, or t
cggacgcgtgggtcgacccacgcgtccgggcgaacacgccgcggtcctcgtcgtggtgagcgcagccactcaggctggtcctgggggtggggctgtaggggaaagtgctaaagccgctgaggtaagaggccgaggggtcgagggccctcgggagcttggtgaaaagggagttaacccccaggatcctacctgcagggactagaaaaatggagaaggtaggaggagaaacaggagactgctgcagcagacgtgcgataggaaatttccccaggccgggtttgaccgagtgcgcatgcgggccgagggctggcgcctgcgcagtgggacagcgccgatggcgtagtttcctggggacccagctgggtgggctggccactttttctccacgctaacctctcttccctttttcttcctcccttccccccttccccctcctncttctattctcttcccttnctcttcccctttttcttctttccaccctctccctcctctctcctctctctctttcttcttctctcc

SEQ ID NO: 488781 - DNA, 1032 bp, Homo sapiens
gcggcgcgagcccctcgtgctggtggaagtgccccatgcgtgcagtgctgctaggagggctgctggctgcctgtgcggaatgaatgccctgtcccctgcagcttgcgacctggagatccactgaatgtcccaatgtcccatgtgaccctgtgcgctgtccctgtggacgactggcgctgtgcggcgctccatgcacgatgttttcctgccaatggacatcgagtgtggcacatggttaacccttgtgaccaatgtagcctggtggcttcggtgtgcatcgtcaaccaacgtggccttcccatgttgaggcaagaccgagagtaaactacactcatgctcgtcgacctgcacgcccgatacgctgagtgtggtttgctggatcctggccttcccgtgtaaccagttcgggaagcagtgagccagtgcagtaaccgaagatgatcaaagagttcgccgcgggctacaacgtcaaattcgatatgttcagcaagatctgcgtgaacggggacgacgcccacccgctgtggcaagttggatgaagatccaacccaagggcaaggggcattcctgggaaatgccatcaagtggaacttcaccaaagttcctcatcgacaagaacggttgcgtgctgaagcgctacggacccattggaggagccccttggtgatagagaaggacctgcccactatttctagcttccacaagttgttttggcccgcctgagcccttgccaggccctcggaggcttccacctggattcttgacgggctgccttgaactgctggtgggcaggaccgaaatcatgtgcacccgcggaggaagtccatggcctgctgagtttgacttgagccccacccccgtggtacttggtgggattaactggcacttatgccatacacaacaaaaaaaaaactggcaacacatcagggtggaacacattatgacagggacagtacaatgtgtcagaccacatcataaagtagaaatatgggccaaatagggtataaccgcacaaataagacaaataacagt

SEQ ID NO: 488782 - DNA, 447 bp, Homo sapiens
gaggggaaaaattgttcttcaaaaaaaaaaagaaagaaaaataaaataaaattaaaaattcagagccacaagaaagtaccagtccaccaactcacattttctatattaataattcttaactaaaagaagttccatattcgacagcattttagttttttaatagtacttattagcatcaaccatcttgataatcaccaagggaaaaattaaaaatacctagactgcaataaacctttaaattggattttcagtgagaatttagaagcaatcactacctttctcgtttcatttgtgtaaccatgcagcataggcactgtgttacatcatctttacgctttggtatttgaacttattacagaattttttctctaaattggatgtttctttatatgaccttggaaactgaagtgatcttagcattaaacaaaaatgctttttaaagcaaaa

SEQ ID NO: 488783 - DNA, 158 bp, Homo sapiens
tgaggcaggatctattctgttaccaggcaggagtcagtggcacaatcagggctcactgcagcagccttgacctcccgggctctagtgatcctcctgactcttttttttttggcagagacaaggtctccctatgtggcctatgcgggtctcaaactccg

SEQ ID NO: 488784 - DNA, 886 bp, Homo sapiens
  misc_feature (80)..(80): n is a, c, g, or t
  misc_feature (83)..(83): n is a, c, g, or t
  misc_feature (86)..(86): n is a, c, g, or t
  misc_feature (90)..(92): n is a, c, g, or t
  misc_feature (103)..(103): n is a, c, g, or t
  misc_feature (111)..(111): n is a, c, g, or t
  misc_feature (157)..(157): n is a, c, g, or t
  misc_feature (183)..(183): n is a, c, g, or t
gacggtcctgacattcatccatggctcaggtgacctatccgtactcagctcccaaagtgctgaaattacaggcgtgagcnacnggntggnnnaaaggtatttntaatgagnaagcaatatgtatttcctaactagttccccttccctgggaacagancacagtgttattctggaatgttattnggaaaatattataatttattgttgtggcttgatcaggatgtatccaagaaaaactgtcctatgaagtgtgatgcttttatcctcgtataacttatttcctctgtcaaatttctgccttggcactgccatatcaccccttcataactcataaatcacccacagtcaatcttagttgacataaacagttcgctaatggtaggaattcatgttttaagtagatatactattcttaagcatattttcagttcaaaacctgactgatattttggcctgagacatcaataaaatattgtgaaagtagagagcatagaaaaaaggggagctaactctttacaaaactgtatgctggcccttacagcagctagaatgaaatgttgtcactctcacttccataaacttgccaattgctgtttttctttctctgtagtgaagtaagaactctgctagagaggaaatggctgcttcatcatcatcctcctcagctggtggggtcagtggaagttctgtcactggatctggtttcagtgtctcagaccttgccccaccacggaaagcccttttcacctaccccaaaggagctggagagatgttagaagatgatctcatgctgctttctgaataattggattcagatctgcaatgcatattaattgtaaagaagctattaagtggattaaagatgagtttgccctgaaaaaaaaaa

SEQ ID NO: 488785 - DNA, 170 bp, Homo sapiens
tctgagatcccagctccaacaagattaacatgagatatcccatcagcaaatggatgcaatatattgatcattgctgaagtcaagggagggatatctggggtctcattgtgttattccttctacttttctgtaagattaaaagttgttcagagtaaaaagatttttttgtg

SEQ ID NO: 488786 - DNA, 545 bp, Homo sapiens
cccctatgagctgtccaaacgtaccaattacattaggaaaggtaggcatatagtcaaaactcagctgagtatatatgggtgaatctatttctatattgtatactcctccactaataccacactgtgggtgactctagtagctgtacagtaactcttaacatcatatacgggcaattctttccactttattgatttatattttcagaatggctttagcttttcttgtcccttgcctttccataaaaattcagaataagctatgtaagtgtctacaaacaaacctgccataattttgataagaattaaagcagaggtgtccaatctttgggcttccctgggccacagtggaagaagaagtgtcgtgggccacacataaaatacacacacacaaaaacacacacactaatgggcggtgtatagtcatcattttatatctaccaccacagatcagcaaagatcgtcgcttgcataatactcctaattatgcactgccccattcagagggtctttcaaaatcattgaacaggtccagaagtagatgctta

SEQ ID NO: 488787 - DNA, 683 bp, Homo sapiens
  misc_feature (34)..(34): n is a, c, g, or t
  misc_feature (40)..(40): n is a, c, g, or t
  misc_feature (61)..(61): n is a, c, g, or t
  misc_feature (84)..(84): n is a, c, g, or t
  misc_feature (91)..(91): n is a, c, g, or t
  misc_feature (101)..(101): n is a, c, g, or t
  misc_feature (120)..(120): n is a, c, g, or t
  misc_feature (141)..(141): n is a, c, g, or t
  misc_feature (149)..(149): n is a, c, g, or t
  misc_feature (160)..(160): n is a, c, g, or t
  misc_feature (162)..(162): n is a, c, g, or t
  misc_feature (164)..(164): n is a, c, g, or t
  misc_feature (179)..(179): n is a, c, g, or t
  misc_feature (212)..(212): n is a, c, g, or t
  misc_feature (217)..(217): n is a, c, g, or t
  misc_feature (264)..(264): n is a, c, g, or t
  misc_feature (266)..(266): n is a, c, g, or t
  misc_feature (279)..(279): n is a, c, g, or t
  misc_feature (281)..(281): n is a, c, g, or t
  misc_feature (325)..(325): n is a, c, g, or t
  misc_feature (335)..(335): n is a, c, g, or t
  misc_feature (351)..(351): n is a, c, g, or t
  misc_feature (367)..(368): n is a, c, g, or t
  misc_feature (371)..(371): n is a, c, g, or t
  misc_feature (373)..(373): n is a, c, g, or t
  misc_feature (379)..(379): n is a, c, g, or t
  misc_feature (441)..(441): n is a, c, g, or t
  misc_feature (445)..(445): n is a, c, g, or t
  misc_feature (447)..(447): n is a, c, g, or t
  misc_feature (516)..(516): n is a, c, g, or t
  misc_feature (520)..(520): n is a, c, g, or t
  misc_feature (527)..(527): n is a, c, g, or t
  misc_feature (554)..(554): n is a, c, g, or t
  misc_feature (591)..(591): n is a, c, g, or t
  misc_feature (682)..(682): n is a, c, g, or t
tggggtcgcccagtttattggtaaaacgggcacngagcgnggcgagcgccgggcgcggaancctggggcgggggcgcctttccncttgaanaacttccacnggaccttgaaggcgagcanccagtcgctgaccgagggccnctggcaancggaggtgcananangcgcctggcgggggngcggggcgccggagcggcgcgcggggcgggggnggggngggggccgggccggggttcggagcgcggcgccgccgcgggagggtcncnccgcgggcgcccncncttcacttgcccgccttctgcgccttctgcgccgacttggtgancttgccggcnccgccgctcttcttcnccacgttcttaaaaannccnanggccancgtctgcctcaagtcgcgcacggcgaacggccgaaaagcgggtactgggaaaaactctccanaaanangggctttcccggcaccatctccacgatggccgcgtctccagacttcagggacttggggttgtcctccancttnttgccanagcgccggtcaatcttctccttcagcnccgcaaacttgcaggcgatgtgggctgtgtggcagtngatgaccggggagtagccggcgctaatctgccccgggtggttcaggatgatgactggggaggtgaactgagcacctcctgcggcgggtcana

SEQ ID NO: 488788 - DNA, 890 bp, Homo sapiens
  misc_feature (25)..(25): n is a, c, g, or t
  misc_feature (29)..(29): n is a, c, g, or t
  misc_feature (34)..(34): n is a, c, g, or t
  misc_feature (43)..(43): n is a, c, g, or t
  misc_feature (49)..(49): n is a, c, g, or t
  misc_feature (63)..(63): n is a, c, g, or t
  misc_feature (874)..(875): n is a, c, g, or t
taggggtttaccccagacatatcantaangaatncctcttacnctgctntagcatctcacatntctgctggatctcttcctcactcaaaagcacccaacatcccaatagttagatgaagctttttaggattctggaaaatgctgctgtcaaccccatgatccatggagcacttcgccagtacttcctcctggaatctcaggaatccttcctgaacctcaacttcattgaggaaaaaggcaaggaagtgagtgaagggctgctttcttcgaaaagtgtccaaaagaacatcaatccgtgttcgggctgaaattacaccatttcgatgctggccagtgattacaatttccccgtcttgtccaggtttaggaatgctaatagaagttttggtctccatttctattttcttcctagtgtcccctctctttccaactatatgcttatagagcaagctgggggccctcaaagtagaccggaatccttgtggggtctgctccacctcgtaggcatcacagggctcatcagcacactccatggagccttgatagaagtcctcttcatcttcttcatgttgataggtctgttcttggactggattcttcctgtaattccggccatcaattcttataagctgtggacgcagaacttccatgacactttctccaaatgatattccaattatgcccctgcttcgaggtggtttggagaggaagaggaaagctgtgtctttctgcaatatcgtgagggaagccgaggccctgaatcatcaaagagaaggagaagaggactaggcggctgcaggtaaaccaaggtagggcgaggaggaggacccggaattcctctacgcgagcgcgttctctgctcccctcctcgcgnntccgccccggccacc

SEQ ID NO: 488789 - DNA, 835 bp, Homo sapiens
  misc_feature (25)..(25): n is a, c, g, or t
  misc_feature (29)..(29): n is a, c, g, or t
  misc_feature (34)..(34): n is a, c, g, or t
  misc_feature (43)..(43): n is a, c, g, or t
  misc_feature (49)..(49): n is a, c, g, or t
  misc_feature (63)..(63): n is a, c, g, or t
  misc_feature (819)..(820): n is a, c, g, or t
taggggtttaccccagacatatcantaangaatncctcttacnctgctntagcatctcacatntctgctggatctcttcctcactcaaaagcacccaacatcccaatagttagatgaagctttttaggattctggaaaatgctgctgtcaaccccatgatccatggagcacttcgccagtacttcctcctggaatctcaggaatccttcctgaacctcaacttcattgaggaaaaaggcaaggaagtgagtgaagggctgctttcttcgaaaagtgtccaaaagaacatcaatccgtgttcgggctgaaattacaccatttcgatgctggccagtgattacaatttccccgtcttgtccaggtttaggaatgctaatagaagttttggtctccatttctattttcttcctagtgtcccctctctttccaactatatgcttatagagcaagctgggggccctcaaagtagaccggaatccttgtggggtctgctccacctcgtaggcatcacagggctcatcagcacactccatggagccttgatagaagtcctcttcatcttcttcatgttgataggtctgttcttggactggattcttcctgtaattccggccatcaattcttataagctgtggacgcagaacttccatgacactttctccaaatgatattccaattatgccgtgagggaagccgaggccctgaatcatcaaagagaaggagaagaggactaggcggctgcaggtaaaccaaggtagggcgaggaggaggacccggaattcctctacgcgagcgcgttctctgctcccctcctcgcgnntccgccccggccacc

SEQ ID NO: 488790 - DNA, 705 bp, Homo sapiens
tagtccccgcagatgtaatcatgtctgaaccaatcatactgcttgtgactggagctggtgctcaaattgcatattcactgctgtacagaattggaaatggatctgactttgctaaagatcagactatagtccttagtactgtctggatatcacccctatgatgcatgtgctggacagtgtcctaatgcaactgcaagactgtgcccttccacttctgaaagatgtcatcgctacagataaagaagacgctgccttcaaagagctggatgtggacattctagtgggctccatgccaagaagggtaggcatgtagaggatttactgaaagcagatgtgaaggttattgtcgtggcttatccacacaataccaactgtctgactgcttgcaagtcagctccatccatccgcaaggagaactccagatgcttgactcgttaggatcacaaccgagctaaatctcaaatagctctcatactctggcgtgactgctaatgatgtaaagaatgtcattatctgaagaaaccattgctcgactcagcatccatatgtcaaccatgccaaggtgaaattgcaacgggaagccggtgcttatgaagctctgatagatgacagctggctcaatggagaatctgtacgactgtgcagccacggggcgctgctgtcataacgctcataccaattcagtgccatgtctgctgcatccat

SEQ ID NO: 488791 - DNA, 505 bp, Homo sapiens
  misc_feature (25)..(25): n is a, c, g, or t
  misc_feature (29)..(29): n is a, c, g, or t
  misc_feature (34)..(34): n is a, c, g, or t
  misc_feature (43)..(43): n is a, c, g, or t
  misc_feature (49)..(49): n is a, c, g, or t
  misc_feature (63)..(63): n is a, c, g, or t
taggggtttaccccagacatatcantaangaatncctcttacnctgctntagcatctcacatntctgctggatctcttcctcactcaaaagcacccaacatcccaatagttagatgaagctttttaggattctggaaaatgctgctgtcaaccccatgatccatggagcacttcgccagtacttcctcctggaatctcaggaatccttcctgaacctcaacttcattgaggaaaaaggcaaggaagtgagtgaagggctgctttcttcgaaaagtgtccaaaagaacatcaatccgtgttcgggctgaaattacaccatttcgatgctggccagtgattactgtaaacaaagaagaaagggtaaactgctcaaggacccccaaatacttataaaacaggacctcttgatactgtcacctctgaggagctaaagcagttctgaatgcgtatatgaatctaaacaggggacaataacaaatataagaaaactgctaattaattcaat

SEQ ID NO: 488792 - DNA, 356 bp, Homo sapiens
aggcacactgtcctttagcatgccttcgtgaatcctgtacacatgaatgctgacagtcacagctagcttggacttcactgcttccaatttatcttctctcactactgcacccttgtggcaggaatgtccattctcttttcgtttcctttcaccatactcatacagcatctgtttggcctggttaccatgaacccctagtgtatagctcagccatttgtatgtcacgctcttgttttggtccgtgacgacctcgtctatattttccagataaagctggtccgccatggtgcgacagcgctgggacccgcctctaacccctctctctatcacagccacagctcccggcggcggaaacc

SEQ ID NO: 488793 - DNA, 760 bp, Homo sapiens
  misc_feature (25)..(25): n is a, c, g, or t
  misc_feature (29)..(29): n is a, c, g, or t
  misc_feature (34)..(34): n is a, c, g, or t
  misc_feature (43)..(43): n is a, c, g, or t
  misc_feature (49)..(49): n is a, c, g, or t
  misc_feature (63)..(63): n is a, c, g, or t
taggggtttaccccagacatatcantaangaatncctcttacnctgctntagcatctcacatntctgctggatctcttcctcactcaaaagcacccaacatcccaatagttagatgaagctttttaggattctggaaaatgctgctgtcaaccccatgatccatggagcacttcgccagtacttcctcctggaatctcaggaatccttcctgaacctcaacttcattgaggaaaaaggcaaggaagtgagtgaagggctgctttcttcgaaaagtgtccaaaagaacatcaatccgtgttcgggctgaaattacaccatttcgatgctggccagtgattactgtaatcccagcactctggggcaaaggccaaggcaggaggattgcctgaggccaggagttccagacagcctaggcaatttactgaaactctgtctctacagtggttggaggtggagaagcttctgatgttccattgcctgagatttcaaaacagacaagaccagatccttgtctagaggattaaaagctaccagatcatttccttctctgatttctcaatttccccgtcttgtccaggtttaggaatgctaatagaagttttggtctccatttctattttcttcctagtgtcccctctctttccaactatatgcctggacttccaagtataaatattctgacaatccaaagttatcttctggaacccacagtcgtttgatgtgttcaagtgaatgagactgagaatcaccccatccgct

SEQ ID NO: 488794 - DNA, 198 bp, Homo sapiens
tagatcccctggtaatgattcttctactttatgtctctataaatgtgactattctagggatctcatgtaagtggaataatacaatatttgtccttttgggcctagcttaattaacttggcataatgtccacaaggttcatctatgttgtaacgtgtcagaatttccttctggctgaattaaatttaatgttagagata

SEQ ID NO: 488795 - DNA, 1202 bp, Homo sapiens
ggacgccgccttcgccgctggctccgtctgttggggggcgaacacgccgcggtcctcgtcgtggtgagcgcagccactcaggctggtcctgggggtggggctgtaggggaaagtgctaaagccgctgagtgaagtaagaactctgctagagaggaaatggctgcttcatcatcatcctcctcagctggtggggtcagtggaagttctgtcactggatctggtttcagtgtctcagaccttgccccaccacggaaagcccttttcacctaccccaaaggagctggagagatgttagaagatggctctgagagattcctctgcgaatctgtttttagctatcaagtggcatccacgcttaaacaggtgaaacatgatcagcaagttgctcggatggaaaaactagctggtttggtagaagagctggaggctgacgagtggcggtttaagcccatcgagcagctgctgggattcaccccctcttcaggttgatactgcctggatggtcacctctggtgcgcagcaagtgcaaagccagtgggggactttctcacagcttacatagccatccagagatccacagctacgtcactgaattgttaatgcacatttgtacttggtttctctgtatctattcacaggcaacaaatacttatatgtgtgatctttcagggaatgttttgtttatttgtttttaaaagtattgggaatcagattaagacaatcagtttcagagaaccaggaggtttggggttaagagatactcaaaaattttcacaagccaagtagggcatatatcagatttggccaactgaatggcgtctgtcctgtcatccatatggtgcctggaaatatttaccagtcaaggtcaaggtcagcatctgtggttaaaaatatagcattctgacctaaaaaagttattttgcagatgaatgtgttttcaactcaggacctatccaaatgaggaatttttaaatattcttttttttttcctatttttagacatcaattctatagattctgactttttctaacctcttatagacatgccaaatgctggcaaaaagaagtgctttttggatatggcagcacttgtaaaaataaagcagtaagcaaaatccttttaaacacagaaatcctgagttcttctcattggtggactcaagcaattctgtagcaaataaatcctttgaaagagctccaaa

SEQ ID NO: 488796 - DNA, 1136 bp, Homo sapiens
ggacgccgccttcgccgctggctccgtctgttggggggcgaacacgccgcggtcctcgtcgtgtgaagtaagaactctgctagagaggaaatggctgcttcatcatcatcctcctcagctggtggggtcagtggaagttctgtcactggatctggtttcagtgtctcagaccttgccccaccacggaaagcccttttcacctaccccaaaggagctggagagatgttagaagatggctctgagagattcctctgcgaatctgtttttagctatcaagtggcatccacgcttaaacaggtgaaacatgatcagcaagttgctcggatggaaaaactagctggtttggtagaagagctggaggctgacgagtggcggtttaagcccatcgagcagctgctgggattcaccccctcttcaggttgatactgcctggatggtcacctctggtgcgcagcaagtgcaaagccagtgggggactttctcacagcttacatagccatccagagatccacagctacgtcactgaattgttaatgcacatttgtacttggtttctctgtatctattcacaggcaacaaatacttatatgtgtgatctttcagggaatgttttgtttatttgtttttaaaagtattgggaatcagattaagacaatcagtttcagagaaccaggaggtttggggttaagagatactcaaaaattttcacaagccaagtagggcatatatcagatttggccaactgaatggcgtctgtcctgtcatccatatggtgcctggaaatatttaccagtcaaggtcaaggtcagcatctgtggttaaaaatatagcattctgacctaaaaaagttattttgcagatgaatgtgttttcaactcaggacctatccaaatgaggaatttttaaatattcttttttttttcctatttttagacatcaattctatagattctgactttttctaacctcttatagacatgccaaatgctggcaaaaagaagtgctttttggatatggcagcacttgtaaaaataaagcagtaagcaaaatccttttaaacacagaaatcctgagttcttctcattggtggactcaagcaattctgtagcaaataaatcctttgaaagagctccaaa

SEQ ID NO: 488797 - DNA, 176 bp, Homo sapiens
tacttttcccagggatccagagacatacttttctccaaagaagatcttttcctttcttttttcttcttttgggttgggtacccaaagtttaaaacagaagtaaggaactaggaacggtattaagacctcctttggaaggacatgtaagattggtactttggaagtatgggtaatgg

SEQ ID NO: 488798 - DNA, 269 bp, Homo sapiens
ttctactcactgccctcacaaattacagggacatcagtgcactgtcctgacagaggaggagaagcggacctgattgtgagggtacccattcccacaaaaattcccctcacaaagccgaggagaaggcttgaagagaagtcggaggaaaatcaagaacaagatctcagcccaaggagagcccgtcgtaagaagaaggagtatgtggagtgtctagaaaagaaggtggagacatttacactctgagaacaatgaactgtggaagaaggcgt

SEQ ID NO: 488799 - DNA, 344 bp, Homo sapiens
  misc_feature (2)..(2): n is a, c, g, or t
  misc_feature (29)..(29): n is a, c, g, or t
  misc_feature (63)..(63): n is a, c, g, or t
  misc_feature (303)..(303): n is a, c, g, or t
tncccctgggatgcaactccgttacgagntgctgatcaaaggtcattcaataaagtgatcgtnactatttaatggcgaaggtaaagggataagctcgttatcttcaaaataaaaatcaaatgcggtcagtaaagcatcttttgccgcttccatcgcttcagcgacagtttcgccctgggtcaacgcttcagggatatccacaaaagaaaccatataaccgccttccggcgcgggtgtaagagtgacgggataacgcataatttcgactgtctctcgcatgtcattaacctttttaattggcgnttaactcaaaccgagttgtttcaggattgctttacgcaatt

SEQ ID NO: 488800 - DNA, 1071 bp, Homo sapiens
cccacgcgtccgggcatgttcattcttcactttctttctgcttttacaaaagaacttggatgtatgttccaaagggtcctcattctgttcctctttgaacttttcctttgtccttgtattaaagtggttttaaaggggtctaaaaagatttggcaaaacatatttgcagatgtagattagctggtgaagaaaattactgctagagatcaactgattaactggtaaagaacgtttattttataacccttgaagaatagaaggacatagttggattattgtgtgtgcattgtatttttacttctattttttttttgcttccattttccagttagcagagataaaatgagagcgttttaacttcaatgtaccattttactgagtgctaaggaagcatatcaattccaatattttataaccaaagctctatcagaacatatttataaaacttgtggaatttttacggctttggtgtagtcatgtaggtaaatcatttaaaatataaaacaatctcaatttagatcaagggttatttcttagatcaaatttatgccaattatatgaaaagattttaactccgagacaggagtctttcagtgctgaatttttagactgtaaatgagttcttcttaacttagctgtttccctacttctgtgacttctgtgttagccatcttatttctttaaaatctgagtcctgattggcttaatgattttgcagcagacatgtctccacatattctcaaatgctgtcatgcggaaacgtatgaaacagatgaagaatgactgacccagattttagatgtataatgttgttaaagtacatactactgtaaaaatatgggatgaattttatatattaagaaatgccaaaaacatagtttctgcaccaagttaattatccctgtcctttcacatttatagggggaaaataaatactttatagcctaacagttatttgatgttattcttgcagagggaatggaaaggaatggaaagatttgttggcgtaatttttgaatatttgttatgatcatatgaataagtaaaaaaattcatcctgaaaaaaaaaaa

SEQ ID NO: 488801 - DNA, 530 bp, Homo sapiens
  misc_feature (26)..(26): n is a, c, g, or t
  misc_feature (36)..(36): n is a, c, g, or t
  misc_feature (89)..(89): n is a, c, g, or t
  misc_feature (103)..(103): n is a, c, g, or t
  misc_feature (109)..(109): n is a, c, g, or t
  misc_feature (164)..(164): n is a, c, g, or t
  misc_feature (282)..(282): n is a, c, g, or t
  misc_feature (521)..(521): n is a, c, g, or t
gaaacccccagaataaaattaaaccnacccccaacntcaaattggggtcaaaaaaaggtgggtttgtacccccgggttccatatactgncccaacagtatggncctcanaaaaactgaccccccttaaccctttgtttgtgttacctgccctacactcattganagttgggacctatttcacacatacagtccccgggcatgtagaagggaccttaatgttgaaagaaggggaggcattttaaaatcccacatcaaaaaaatgttgttctgtttgggagtgngtgtcacgcctgcaatcccagcactttgggaggccgaggcgggtggatcacctgaggtcaggagttcgagatcaacctgagcaacatggtgaaaccccgtctctactaaagatacaaacattggctgagcatgggggtgggatcctgtaatcccagctacttgggaggcttaggcacttgaatgagaatcacttggacccaggaggtggaggttgcagtgagcaatgattgtgccactncctgggcaa

SEQ ID NO: 488802 - DNA, 770 bp, Homo sapiens
  misc_feature (749)..(749): n is a, c, g, or t
ggtaccgcgaacggtgcgttacttacctcgactcttagcttgtcggggacggtaaccgggacccggtgtctgctcctgtcgccttcgcctcctaatccctagccactatgcgtgagtgcatctccatccacgttggccaggctggtgtccagattggcaatgcctgctgggagctctactgcctggaacacggcatccagcccgatggccagatgccaagtgacaagaccattgggggaggagatgactccttcaacaccttcttcagtgagacgggcgctggcaagcacgtgccccggggctgtgtttgtagacttggaacccacagtcattgatgaagttcgcactggcacctaccgccagctcttccaccctgagcagctcatcacaggcaaggaagatgctgccaataactatgcccgagggcactacaccattggcaaggagatcattgaccttgtgttggaccgaattcgcaagctggctgaccagtgcaccggtcttcagggcttcttggttttccacagctttggtgggggaactggttctgggttcacctcccctgctcatggaacgtctctcagttgattatggcaagaagtccaagctggagttctccatttacccagcaccccaggtttccacagctgtagttgagccctacaactccatcctcaccacccacaccaccctggagcactctgattgtgcccccactggtactcagctgctaggagtggtaatgaagnaaaactaatggctttactgac

SEQ ID NO: 488803 - DNA, 897 bp, Homo sapiens
  misc_feature (775)..(775): n is a, c, g, or t
  misc_feature (791)..(791): n is a, c, g, or t
  misc_feature (838)..(838): n is a, c, g, or t
ggtaccgcgaacggtgcgttacttacctcgactcttagcttgtcggggacggtaaccgggacccggtgtctgctcctgtcgccttcgcctcctaatccctagccactatgcgtgagtgcatctccatccacgttggccaggctggtgtccagattggcaatgcctgctgggagctctactgcctggaacacggcatccagcccgatggccagatgccaagtgacaagaccattgggggaggagatgaccttcttcagtgagacgggcgctggcaagcacgtgccccgggctgtgtttgtagacttggaacccacagtcattgatgaagttcgcactggcacctaccgccagctcttccaccctgagcagctcatcacaggcaaggaagatgctgccaataactatgcccgagggcactacaccattggcaaggagatcattgaccttgtgttggaccgaattcgcaagctggctgaccagtgcaccggtcttcagggcttcttggttttccacagctttggtgggggaactggttctgggttcacctcccctgctcatggaacgtctctcagttgattatggcaagaagtccaagctggagttctccatttacccagcaccccaggtttccacagctgtagttgagccctacaactccatcctcaccacccacaccaccctggagcactctgattgtgccttcatggtagacaatgaggccatctatgacatctgtcgtagaaacctcgatatcgagcgccaactatatacttancgcgttattggcagantgtgtctccatcactgttcctgagattgatgggcctgatgtgcctgngattccgaccactgtgcctacccggtcattctcttggcatgcccgtttttgtggaagcc

SEQ ID NO: 488804 - DNA, 608 bp, Homo sapiens
  misc_feature (427)..(427): n is a, c, g, or t
ggtaccgcgaacggtgcgttacttacctcgactcttagcttgtcggggacggtaaccgggacccggtgtctgctcctgtcgccttcgcctcctaatccctagccactatgcgtgagtgcatctccatccacgttggccaggctggtgtccagattggcaatgcctgctgggagctctactgcctggaacacggcatccagcccgatggccagatgccaagtgacaagaccattgggggaggagatgactggcaagcacgtgccccgggctgtgtttgtagacttggaacccacagtcattgatgaagttcgcactggcacctaccgccagctcttccaccctgagcagctcatcacaggcaaggcacgacgtagccactcactatgccccgtggtcttcaccataggctttgcaacaacgccttttntttctccaaatttgctgctacttttcaataattctttctaaatggtttctccccttttactattcggcacccctctccaatttttttaatttctcatttttgatctacgtctctttttccggtttgccccccgcctctcctcttcccttccatccactccgtcttttctatcaaatgataa

SEQ ID NO: 488805 - DNA, 238 bp, Homo sapiens
ttgagacccatacaaatagcttaccttgcagttaaatctgtgggttcagaattaaagaagagggccaggcacagttggctcacaccatgtaatcccagctactcaggaggctgaagcatgagaatcgcttgaacctgggaggcagaggttgcagtgagtggagatcatgccactgcactcctgtctgggtgacagagcgaaactgtgcctcaaaaaaaccaaaacacctattgtatgt

SEQ ID NO: 488806 - DNA, 481 bp, Homo sapiens
aatcggctatcgaagtctggtaggaggccagtacaagtggtgcaaagtgagaaagatcttggaggggcacaaaagggaatccctcatctggtgactcatgatgcccggcaccatctgctaccccgatcccctcatcaaggtgaatgataccattcagatggatttacgagactggcacgattactgatttcatcaagttcgacactggtaacctgtgtatggtgactggaggtgctaacctaggaagaattggtgtgatcaccaacagagagaggcaccctggatcttttgacgtggttcacgtgaaagatgccaatggcaacagctttgccactcgactttccaacatttttgttattggcaagggcaacaaaccatggatttctcttccccgaggaaagggtatccgcctcaccattgctgaagagagagacaaaagactggcggccaaacagagcagtgggtgacatgggtccctggg

SEQ ID NO: 488807 - DNA, 361 bp, Homo sapiens
  misc_feature (102)..(102): n is a, c, g, or t
  misc_feature (119)..(119): n is a, c, g, or t
  misc_feature (268)..(268): n is a, c, g, or t
gtcctgtgtgcgcgctcgtcctctgctgtttcccgccagagctcgttgggcctccccggcccgcccggcccatggacctgcctcacagacggtttttcctgngagctccgaggcgagancatctttttcctgcggcccaaagaggtggagctgctgctgaaaacctggctacccggggagggtgctgtgcaaaaccatgtcctgacactgctacgatggagagcctacctgctgctcaccacctgcctcccgctgagggtggactgcncgttcagctacctggaggtccaggccatggcgctgcgggagactccccctccagtcacctttgagctggagtcccttcgtgagctggtcctgg

SEQ ID NO: 488808 - DNA, 342 bp, Homo sapiens
agggaataacgcggggtatatgaaatgaaggcaggaattcagaatgtaagaagatactaacgtatctcatcactggaaggtccggtggtgatggttatcccggggagaatcttcaccggctttatgtgcagtaataaatttctctcgtcatagctgttgactgtcatcttgtaatcgggatgtaatcttttttgcttagctctgcctgaggtaaagtaaacttcagcctcttataaacaagagtgatagagagctgcaggctgctacaacaaataccatagacaggttggtttataaataacatgaatttatttctcacagttctggacgctggttattccg

SEQ ID NO: 488809 - DNA, 98 bp, Homo sapiens
gggaaaagggttttagtaaaagggtgattggttttttccccaggggttttttttatataaatgttttggtttttccaattaaaatgccccaaacccca

SEQ ID NO: 488810 - DNA, 131 bp, Homo sapiens
atctattgtgtctcctccactcccactgtattacttgagtctgcttaaaatgattcagatcggcttggacataggttggctcacgccctgtaatacccagcactttgtggaggccaatgcagtaggggatc

SEQ ID NO: 488811 - DNA, 110 bp, Homo sapiens
agtgaggcctcaggtgtcctcaccacagcgtctggtgccctccgaccgcggacctgagcggggcgtgtcctcgccctgtcgggcgacagacacgtttgtcggtaacacgc

SEQ ID NO: 488812 - DNA, 586 bp, Homo sapiens
ccagctggcagtcgagtgggtggcgacctttaaaggaatgggacccacccggagttcttctttctcctgtctctctctctctctctctctctctctctctctctctctctctctctctctctctctgtgtctctagctgtcgtctgtgtgtgtgtctctgtctctctgtctctctctctctctctctctctctctctcttctctctctctctctctcatcatcaacatacacaaaacaacagagaatagaacaccacaccacggaaaaacaaagacacaaaaaacaacagaagggagaacaaaccaaatgcaggcacgaggcagagcacaaacagcaacacacaaacaaacaagagaagacacagccacacaacaaccacgacaaccacaaagacgaaagcaaagccaacacaacaagagcacaaaaccaccaagaacaaacacacgaccaacaaaaaaccacaaccaaacaaaataaaccaagaaaacagaacaaaagaaccagacatcgaccacaccaaacaaagcaaaaacaaagaaaaaccaaaagacaagaaaacaaacaaccaaaacaacaaaacaggag

SEQ ID NO: 488813 - DNA, 876 bp, Homo sapiens
ggctaggtaggaggctgggtgtgaatcggccgaggatagcttgctgcagccttgatctcccaggatcttgcctcagcctcccgagtagctgggactgcatgcttgtgccaccacactcggttaatatttgtagagatggggtcttgctatgttgcccaggctggcttcaaactcctgaacttaaaagcctcctgtttagtttggttttttatcactttttttttttttttggaaatggagcctgtggtccccatcggtgcgggttgggagtggcggggggctcagtctcggctcactggcaggcttctggcctctcgggttcaacgcgattctcctttctcagcctcttgagtacgctgggaattaccagtggtgcgccaccaccaccacgccgggctagttttctctggtgttttagtagagacggggtttggctattgtgggccagggctgggtcttgaactactggacctctggtggatctaccctggtctgggccttccaagggtggctagggattacagagcggtaagccacagcgcctgggcctggctacattttttttcttttgttgtttgttgtttttgaccaagacacgtggggcgccgccttttttgttgcccccaaattgtgttctgcccgtggcgccacaaagcagcttatgtgtgcggcgagacctcaccacaaaggcggcgggggatgtatgcggggggtggagggcctccgtgtggtggccccttgatttaagaatagaggggcggcatgtgttgtagaaccacggtgtaccaagacggccgcggagagtgcctcaaaaggggggggggaacgagggggggacatcgcgtggcgccagtgggggagctttttcaaaaagac

SEQ ID NO: 488814 - DNA, 278 bp, Homo sapiens
  misc_feature (13)..(13): n is a, c, g, or t
gtatggcatactnatagatggtgtggatgtaaatcgcagagtaaaatcacaagcaaagctgataggaaagaataaatagtgggtgtctgagggggaaggtcgcagcttcgggcagctttgagaagcggtacaagagtactgtgcctgtgtgtcgcagccctgtgcagccaggcagtggatttattttgaagctcttataagcaactcctggatcaggaatgcgtgacccctgagatgggtctacgcatctctctacacttccgttctctccgtgggat

SEQ ID NO: 488815 - DNA, 251 bp, Homo sapiens
aatttagtgatgggattttttaataacatgcaggatataaatgggcagattttatgcgtgttggcaaaatcctttttcagcctgccaaatggggctgcaatattacctttttcccttaagcagttttttacatttacggtggtgctttttaaaatgaatgtgaaagccctcttttatggctgcaacctgccttttcccttacagaaatttttgtttgatggaatccataaactttggtatgatatgattta

SEQ ID NO: 488816 - DNA, 647 bp, Homo sapiens
ggtacggcccggaagtacgggatgcggcggcggacgcgcggctcccaccgctcccctctcacgggctctcacctccccagtgggggtcgcagaccactaccctctggaaggtgataggccaggccccagagcgcaggctagacgagcctagggtgcccggacatgggctgtatcggctctcggagcccgcggggtcaggcatttctggggaccaacagcattggccgaggctcagggatagagacggctgcatccagctaaaggtgaatgttggagacacagtcgcgatgctgccaagtcccggcgagccctaactatccaggagatcgctgcgctggacaggtcctccctgcatggtatttcccaggtggtgaaggaccacagtgaacaagcctaccagacatggcccagggccgagtggctcacctcattgagtggaagggctggagcaaagccgagtgactcacctgcatgcccatggaactcagccatatgacactcctattcagaccatcagcgagggcgaacaagaggctcgctatggcagacaggagtggctgagcaagtgggcactcgcggaagccaaggctccgagcatggtctatacggtgggatggccgagggaatccactgatgaactcctatga

SEQ ID NO: 488817 - DNA, 311 bp, Homo sapiens
ggggaaaaggggggtttttgctgggttttaagggccggaaggaaaattaaaaggctcctttttaaattggaaggttttggtaaaaaccctttatttgggaaaaaagtaatttggaagtttgtccaccggaaaaggattgaaaaaaaaaaaaaacatggtttttggaaaaacccccaaaaattggaaaaggtcaattttaggggtttgaaaaggaaaaaaaataaaatgggggacaagggtgggggttttaaaaatggttggaaaaacctcctttccttttacaatgaaaataaaacctttttcccggggga

SEQ ID NO: 488818 - DNA, 678 bp, Homo sapiens
ccagatgaaaaatgaaaaataatacacagttatagatgtagaacactaaaatttctgttgatgggaatgtaaagtggtataatactttgaaaactgcagttctaaggctcaatgtgccctaggacctggcactttcactctgaggtatagaccaccggaaatgcatatatgtgtgtgtgtgtgtgtgtttatgtatgtatatattcaccaaaagatgtttactcatgtaaaagtctttaccggtgctaaataaccaaaagtaagaaactactcaaatgcacactagaattatttttgtcaattcagttgtgtcacattcacgtaattggatactatataataatgagaataaatgctttataactagcaacaaaatggatgaaagtaataaacaatataccaaagaagccagacgcagtagtacatcctatgtaattctattaatatgaaatacaaaaacacaactatgctgctacaagtcaggatagtgcttacccttgggaaaggaagaattgactggaagaaaggacaaaaaggattctggaatgttggtaatgttttgtgttctgttatgtttttctgaatttgagtattgaccacatgatgaattcagttgtacaaacttaggtgcacttttttgtatgtgtagtatactccaataaagtttttaaaaataca

SEQ ID NO: 488819 - DNA, 470 bp, Homo sapiens
aggatacgatgtccgtctcaaaaaaaaaatcattagtagcgttctcggtcagtttatggtgggaaagggaatcaagtaaacaaattctcaaaaagattggcttcaaataagagaacacggtttaggtggaagatctcctttttcagcagggtcttcccaaggtaacaagggggtggggatggactggggggtgtctgacataatggagacacagacacatttacgtcggcgggttaaaagtgacgctgaaatccaggacgtacggttttcctcaagggcttataaaaaactggaagagtgacccaggtttcctcattttaaacaggggctaatttctacatggctaatacgggttatgcagagtattaaactttcggataacggttttacgtaaaaactaattctctccatgtcggggcatatataatttactaatatatggcccggacatcgggatcctcgggtaccga

SEQ ID NO: 488820 - DNA, 140 bp, Homo sapiens
aatcagaagaactgtctgtcagtgtctgaggaggtaggatctgggtgccggtagaaggatctgggactgccagtatctgaggaggtaggatctggcccttgcatgaggatctgtgtctgtcagacctgagcaagccaggt

SEQ ID NO: 488821 - DNA, 934 bp, Homo sapiens
gcagcgcgctctgtggaggcccggacacgtcgcgagtgtggtgtgtgttagatgagaagtcgtgcagactgtcccctgtgctcgcggtggaccggggaagtgcaggttgtgttggccggtgcgaggccctcgcgagagggggttgccctgtcgtgggggggtgcgccacgccccgccccctccggtggcggtgtcggtgtgtttggcgggcccccgtctgcgcggtgtttgggtttggaggctctcgccaagcgttcccgtctgcgcgttgccgtacattggccggagctccggcggggacagcatagtgggttcacaaatgcctctctggcacgagaaggtaatcgcttcgggcgcccaacgcagagtgggtagaagtgtgctggccccgctgttgcgatgggagggggcgttaagcccgcaccttcgcttgtctcttatcgttgttggtccacccgggcctccgctgggttttggtgcaatcgacggcgccggtgctgatggtgtgttctgggttcgcgccgctgcccggtattgtctgtgtgcgcaggaaccctcctagtcgcgctggcttcgtcactcgttgtctcgcagtccggtggacaagggctcgcgcacgtactagtatagtcatgcaccagccccttgtgtagacgacgcacgcagcccccagcgccgtttgccacaaatgtagaatcatgagaaaaggcacatcatgagcaatggggatcattgaaatggcgcccggtgggattattgagagtatcgggaggtgttacagcatcggaaatctcgttaaagatgtgaagtttctatgttggagtgatcccctaaagaaactgtttgaatgggaagaggtgcgtatatacaaatcttgtcaaacatgctttctttataaaagaaaacctaaaccagtggggggcacaacaagaca

SEQ ID NO: 488822 - DNA, 413 bp, Homo sapiens
tgtcatctggctcggatgcgtcacctacgccatcgacacgcatcggccaactgatgcgacctgggatttatccgccgctacagcgccgcccattcggcgcgatgcgccagcagaaaatccacaaacgcccgcacccgatggggcacatagcggccgtggggatacagcaaggtaaacggccgtgagcgcccgccgtaaggctgcaacacctccaccaggctgccgttggccaactcctcctctacgatgaacttgtaggtctggaataaccccgcgccgtgcttggccagggttacgccacccagcacgtcgtcagagcagctgtagcctgcttccccagcaaactcccgctgctggcggtattcctggcgctgtccccgcatgtcacggtcgatgtccgcatcagcagaggt

SEQ ID NO: 488823 - DNA, 807 bp, Homo sapiens
ctcctccccaactcattctatgaggccacatcatcttgataccaaaatctggcagatacacacacacacacacacacacacacacacacacacaatctacaggccaataccctcgcatgaacatcagtgcaaaaatcctcaacaaaatagtggcaaaccaaatccagcagcacatcgaaagaagttaatccatcatgatcgaagtatgcttcatccccaggtatgcagagggttgcctcaacatacacatatcaattactctgattcatcacatgaacaaaactagagtataaaacaccatgtggttatctcaatataagcagaaaaggctttcatataaatattcatagtgcctctccatattaaaaactctaaaaattatctgggtattgaagacaacatagctcaaaatgatgagctgtttgtgtatcagtatcatgctgttgtggtcactgtagccctgtatgtatggtgagaagttggggtaacatgatgcctccagcttcgttctttgagctgaggactcgcttggactataagggctcttttaaggggttccatatgaatttgtgaaatagtgtgctctagttctgtgagagaatgccgatggtaatttaatagggataacttgcatctgtaaatcactggggcagtatggccatataatgacataaattcttcctatccagtagagcatgacatgtgtaaccatgagtgcgtgtcttctctggattctgatgagcagtgttgtgaaattcttctagagatctcctagagatcttcactccctggataaggtgaatacca

SEQ ID NO: 488824 - DNA, 1313 bp, Homo sapiens
tcaaaaattgaaaaagatgttttaaaatattcacaaaaatacaactggaagatcaaaacaataataatggacgcttgatgggttttcccctaagctggattattattcccattggaaaacactcagagtatatgtttggaatattctcaatctcttaatgtaatggccttatggatgtggctccctataacagagatattacgcgcgctatatattttacaagacgagaccctgtgtgttggccagggacagaaaactatgggacaaggggcaaagatcctggccctttaaggccaaccttaagttcggttatattctggcgaaccgaggaaaggcaggtcgctagaggcaccaggggaacagagggagagcacaaaagggctgacagggcggtgggctggagcagggctgtggagaaaaaggtccgtgcccgtaaaaggcctcactctcacggggtgacgcagctatcctttacagggaaaaaccgtggtccgtggccagaagacacacagttcgtggccacgcgtgcccctggccagtggggaggaacggctgagggagaaaacacgggcggagggactcaatcgtgccagaaagtgcacagagggacacgtagacaagaaggttagcacggagagtcaagcggtgagagaaagagaaggccacaaaaaaagtcgagcgcgtgggggaaagggagagcgtggaaaaagagggacgcgaacacaggggccccccacagggtggtacacttcacacattgaagtgggaccccccccaagagaggcacaccaagaggtcacaaacgaaaagaccaaatgggggatcccacgcaggagcccacgcaaagaaaaagaacagctggaaggcggaccaatgggcagccaccaggagaaaccacacggcaagagattgtgccactcgacagtcaaacgcgaggcaaacgggtgtgaaaaacacgcggtgacacaatcacaaaggtgcccgtaatctctgggaaaacaccacatgtaaaggaacaaatgaacacgagcagtcaataacaaggtttagcccgcgggaccacaagacaaaccaccagctaccgcaacgagggatcacaggcgcgaccagagacccagagagtacactagaaagaggttcacaaaccgacaacaccaccaccaaaaagaaagaagccaaaagcaaaatagtaaaaaagacacacacaatgaacaaacagacaacaagaccaagaactcacaccagagcaacataggagacaagagagagagagctcacacaagaaagcacagatagactaccagcggagaaca

SEQ ID NO: 488825 - DNA, 156 bp, Homo sapiens
gaagagctgagcaaggcctatgaggatgatggtgacgctacagcagcatcatggtcaagggcgctggggggaccggcttggcagaggccttttgcagaaggagctccatgaaagagttcgccgagaacctgtgggccctactgtggcagtaggcca

SEQ ID NO: 488826 - DNA, 837 bp, Homo sapiens
tcgccgtgtgtccagggtagaatctcggagaagtccactcacgtacctagggcatgcatattctactgaactgcagagtgatcttgagagatagctcatcaggaagttccgactactggactgtgttgaagactagggagtagagagacctcggtatcgaagctagtgctgcaaggaatcattgggataaaaggcttggtgaggacatgacgtcgctaggaaaccgctgactagtcgaagcgaactatggataatgcttcgcgttgatggcaaggtctcgaagagcgagactctaacataatggtgaagtatcatttgacaggagcagcacagcaggatgactccgatccacagaacacatgataccatgctcacctgtcaggctagacgtgtgctgtcacctgattagaagcggctggtgtagtcgaattggaagcagatgctctcctcaagaggacctgagtcagaagccgtaccgaatgcatggcgcgtatctaggacttagacacctggagtgagatggagcttatggtcaggtgtagaacaagatatggatgccactataggccacggccatacagacagaaggagaatatagaggcaataggttcacggcagtcagtacctatagcacttaatgaagaattgcgattggaaacggcagataatagttgcaggctctgagtcgcccaaagaaacaggatctggggcgtgtgacgacttgccagtgcctaggaggtgcacccgttggtaaaaattgtcgattggccaagaagtggctccggggaaggtccgcgcggtaatggattctgcagaattgcaaaattgcgaagacag

SEQ ID NO: 488827 - DNA, 472 bp, Homo sapiens
taaccctgtcatccagctacagtagacagacaccgcgatgacgaccaccatggcacgatgaccagcggcaagatgaggctgagcggcacgtcgctcacccgtgtgtcgtactccacgcggaccagcacccactcgcgagagccgaacttcacaatgaactcgggcaggttgtgtgtggtgtctcgtttctgccgccgcttgtgcgggaccgctgcaagaaggaattcacagacctgatgatcgagatggaggaccagaccaacgatgtgcaacgaggccggcatccccgtgcttggactacaagacctacaccgaccgcgtctactacctgccctccaaaggacggcgacaaaggacgttgatgatcacccggcaagctgtacatccccgatgccggcggctggccaggatgctggagcaggccctctaccagttctccaacctgctgaacagaaattcttacctcatcaat

SEQ ID NO: 488828 - DNA, 334 bp, Homo sapiens
atcttagctccactgggttggcataaaaataatataaaagtacaggactagaattaggcctcagatcctaaaaatttcactatctctgggcagctcagaacatcacagccagccgggcgtggtggctcacaccttgtaatcccagcacttggggaggctgaggcgggtgatcacctgaggtcgggagtacgagacctgcctgaccaacatggggaaaccccatctctactaaaaatacaaaaattagtcagacatcgtggtgcacgcctgtaatcctagccactccagaggctgaggtgggaggatcgcttgagcctgggaggcagaggtggca

SEQ ID NO: 488829 - DNA, 128 bp, Homo sapiens
cttagcacgcaagacatccagtctccaacctgtttctagtatgtatgtttgcgttcagccgcactctcccagtgacaacatcgctatagtttgtcacttctcttaggtggctctgggactgggagagg

SEQ ID NO: 488830 - DNA, 110 bp, Homo sapiens
  misc_feature (2)..(2): n is a, c, g, or t
  misc_feature (5)..(5): n is a, c, g, or t
  misc_feature (11)..(11): n is a, c, g, or t
  misc_feature (15)..(16): n is a, c, g, or t
  misc_feature (39)..(39): n is a, c, g, or t
  misc_feature (46)..(46): n is a, c, g, or t
  misc_feature (53)..(53): n is a, c, g, or t
  misc_feature (56)..(56): n is a, c, g, or t
  misc_feature (73)..(73): n is a, c, g, or t
  misc_feature (79)..(79): n is a, c, g, or t
  misc_feature (83)..(83): n is a, c, g, or t
  misc_feature (87)..(87): n is a, c, g, or t
  misc_feature (98)..(99): n is a, c, g, or t
tnttntcactntttnncttttgtttatataactcaacgnaatgttnttttatntcntttcctgatctcttaantaaatntttngatnatattaataanntaaataaattg

SEQ ID NO: 488831 - DNA, 224 bp, Homo sapiens
gctcgacacagggtcttgttatgatgcccaagctggtctcaaactcctggactcaaacgatcctcccacttgagctcccaaaatggtgaaattacagacatatcctttttttttcttttgagacagtctcgctctgtcgcccaggctagagtgcagtggcacaatcttggctcactgcaagctccacctcccgggttcacaccattctcctgcctcgtcgacgc

SEQ ID NO: 488832 - DNA, 106 bp, Homo sapiens
ctcgtgcatacacttaagctatctgatttggaccattacttcgaatgaagaaatttggtgcccaatagttacctatgatcgctcgtgcctttcggggcgtattctg

SEQ ID NO: 488833 - DNA, 229 bp, Homo sapiens
atattacccttactgtgtgtagcagaaatacgatatcatcaggtatgactggaagtatggagagcaaacatccaaacaccagtgattagggtctgaactgatgatagcattagagctactggggactaaaacgaactgtgcttggtttgaatgtatggggtaagattaagcccagatttctgtctttggtccctgagctaaggacagtgccactctcttgagttgggac

SEQ ID NO: 488834 - DNA, 151 bp, Homo sapiens
tcgcgtacccgtgatacattgcgtgtccccttgttaaaatttaactcgttagctccacagaggatggaacagctctttggacactacgagaataataatccttgtagagagagtaaaaaattgtgaacacccatcagtagagcgcctaaaa

SEQ ID NO: 488835 - DNA, 393 bp, Homo sapiens
gcatcccgaatagctgggattacaggcgcgcaccaccacgcccagcttatttttgaattttaatagagacgcaatttcaccatgttgggcacggtgaaactcctgacctcaggtaatccgtgtgcctcggcctcccaaagtgctgggattacaggcatgagccaccgcacccgaccttttttttggttttgtaaagcctctgatcaacactaccttgtactttggcttttaaaaatttcaatttagctctgcttcttcatctttaaatgaagttaagaacttgtgggaacttcgtttcaactatgagcccctctgcttacttgctgtgtgatctcgggcaagtgccttcactcctctgtgcctgcaattcctccttgtcaaaagggtgagcgt

SEQ ID NO: 488836 - DNA, 1359 bp, Homo sapiens
tgaccattgcccatatgctcaacacgatcctgaactcagaccgggatgctgtgtgctacaatgctggggagagtggtagatgctggactcccctgtgacaccctgctgcaaacagccccactccctgttccagcagcttgctgcagagcagccagcagggacgtccctgcctcactcgtgagtgtccctgagcccaatcccacaccctgcagagttctcccactctactctgataccagtgcctgtggcctatacagaggtgcttggcttgctatgataaacatatctacctacttgcggtgactctaagctacttccagcacattaccaccagaaatgcgagaacagtggcaacccttggataactactattgtgaaatacaaatacctatgcgatgggccagcgatacctagagtgctaaccaccagaacccaaggcctacatgctactaggacccctacttgcatacttgtgaactgccagtgatggacatcacgaactaggcataagcgagccccacgttagcataaagcataagctcacagaatcaaggcatacgacgagttccagtcctttaacattttcatggaggatatcaaccaagaagcaactcaactactgccacgtgggacgaacaagacaagacacaagtaaaaagacaacgagaacacccgacacctcgaatagtagcaaagatacttgtgagcagtacgcacccaacaaacgcacaagatggcagagtcaccagacaaaaaagatgatgcaaaaaggaagaaacggctgcaggagatactgtgtgacgccagacagcgaatgaaagcaacatagctaaccccagaaactttaaatagtgtacgaaaaaaacattcagggacgaacaaacgaacgaagggaagagtaaccacccacacacaaagagagctaagacacagaacaaaaaaaaagaacgcagacaaaacaaaaccggcggaggcacaagccaccgaggcgacacgaaaactaggacaccagaacaaaacgagacgagcaaaaacgagacgaagcaccgccgcgcagcggacgaacgacgacaagaagcaaggcagcagaaaacaaggcaccacgcaaagaagaagcgccgagcgcggaggagagacggaaaaaaagcgagcagaacgcacgccggagccgaaacaggaaagcagaggaggacaagaccgcggtacacaacaggccgagaaacgagaccagaaaagacgaacaacgagacgccaacagcggaggcagggcgagatgagggcgcaagaaagacgacagagagagagagacagcggacagaaggaaagagaacaagaaagggaaagcccgaggaggagcaa

SEQ ID NO: 488837 - DNA, 517 bp, Homo sapiens
aacgcgctgatagcctcctgacgatgggtggccgggcagagacgctgctcactttctagacgggatggcggccgggaagaggcgctcctcagttcccagactgggcagccgggcagaggggctcctcacatcccagacgatgggcggccaggcagagatgctcctcacttcccagacggggtggcggccgggcagaggctgcaatctcggcactttgggaggccaaggcaggcggctgggaggtggaggttgtagcgagcggaggtcacgccactgcactccagcctggcaacattgagcactgagtgaacgagactccatctgcaatcccggcacctcaggaggccgaggctggcagatcactcccggttaggagctggagaccagcccggccaacacagcgaaaccccgtctccaccaaaaaatacgaaaaccagtcaggcgtggcagcgcatgcctgcaatcgcaggcactcggcaggctgaggcaggaggctatcagcgcgttgggtaccgag

SEQ ID NO: 488838 - DNA, 110 bp, Homo sapiens
ggactacaggcgcatcacccatgccggcttaatattgttttttaccccgtcttctaatgtaaaatacacaaaaaaccccaaaacccaaaaaaaatgctttttggaggaca

SEQ ID NO: 488839 - DNA, 500 bp, Homo sapiens
tggtcgagctggataaaaccatccggtatatgttacttactcatcagtagtgtacgaaaggctgaaatgaacacaggctgttgtacaacaccttgaaggagctcttcaccttcagatacattaaaaaacatattcaggactctcatgctgaaaatgaaataagagaaaatcgtgccaccctcccccagatccccatctccgtccagcatgtattcacagctaagctcgacaccctggaccgcatttgtttactccacacctggggtaccactcattcctcagctcaccactgcctcacttctgctagcctcagcagcaaaacaccttactgcaaaattcatcagtgccctccactgtggcagatcaaaagcatggtagtccatcctctgctagcctgaagtctactacgtagtggatgccgctcgccattcttttctacttaacggtctcctccctgatttctgtgtgggccccgatcctgagttccttctatttcttcg

SEQ ID NO: 488840 - DNA, 366 bp, Homo sapiens
cacaggctcgtacagaacggcacgaggttcttaaatgttgtagtattactttctaaactgatgcttcagctacaaaataatttgaagtaaatgtttgatatgatttatttatgaaccctaatgaagcagaattaaatcctgtattaaaataagttcgctgtctttaaacaaatggagatggctactaagtcacattgcctttaacataaggtatccctataccttatttgttaaaatatagccggtatacattttatatattttagcacttaatcctatgaaaacaaataattgtaaaggattcttgtcagattacagtaagaatgcacatatttgtggcatcgagataaagtttatatttcccct

SEQ ID NO: 488841 - DNA, 140 bp, Homo sapiens
tccagaggatcccccactgtgttcatacctggctctctgtatcgggggggggtatgaacaacagtgcaagtatgaacaacagtgcaggtatgaacaacagtgcaagtatgaacaacagtgcaagtatgaacaacagtgca

SEQ ID NO: 488842 - DNA, 138 bp, Homo sapiens
gaaggtgcgacacaagccctgcagtcactgagattcatcaagtctgaacggggcacatggagacgcagttagtcatggggtccgggcaggctttgaatggcaggaacaagatgctggatctgcatgtgtgaatcggca

SEQ ID NO: 488843 - DNA, 873 bp, Homo sapiens
cgcgggtaatgcgggggtgcgcaagcgaggggaaagcccggcccccgtaggagggacgacgagggggccgcccaaactgaggcgcgcaccaaggaagacccccgttgggcgaaccacacggcgcgaccacacgcgtgtttcacagcgtcgtcggaaactgctcgcgtgaaacacaaaacggggtcgccacccagagagagggattaaaaagcgctgggagagacaaacgtctagccgcgttcgccacggcgcagagatatatatacgcgcgcgcacccttctttggagagggaaggggggagaggcccacattccacagcgacaccccaccccgcgatcgctgtttggttgaggccgcgttgttggtgaaacagcccacagacgcccccgggcgcgccaccaaacgaggccgccccgcttggagaagcgctgtttttatatggagacgagttttttcgcgcccgcgctcttgtgtgtatagagaggagatggatgcggcttgcacaaagagcgcttgccgagatatataggaggaccgcttcgctttatcgcccgagaggagagggggttaaaacaacactcttgtttgcttgcgacacatcacacgacctgcctctagaggctttatataacactcccccctattttaaaagacctatctccgccctctccatctgaggaaaaaaagagaaaagaaaattagaaagaataccacaacgtttatattcatactcgttgtttccttttttttccgttgtgtgaaaaccaccaaccccgcttcttaaaaacataaaatatttctctttaataccatttgccctcctttttctttttggttccatttaaaaaaaaagggaaaaaaccccaaaaaaa

SEQ ID NO: 488844 - DNA, 707 bp, Homo sapiens
ctgtccctagctagctagctagctctctcgcgttgtcggcacggcacctagaggttgagacttgcattgcatctgatttaatgaacttaagtctgtggatccgcccttgtgttaacgactggtattcggtcaccagcatatttagagaaaagacttggagcttaatataaaacttaggcccaatagacgcttagctgctgatctaccagagaacttcttgtaactttaaagatttccagtcatagccaaactggtgttttaaactattgccagtagctgggactttttagtgtgaacccagccatttattggagaagtgaatccaccagggaaataaagatgagttaaagccaagatgatgctcctccacgaactggagagccccagtttatcttacgtctgcctccccgaatatgcctctactgtgagaagggccagtaccagtctggtcatgtcaacctcaaggaccagactgaccattgagttacatcctgatgggcgtcatggaatcgtccagagtggacccgtgttcccttggcctccaaaattagtagacctgcccctgtgttatggaagcttgaaacccttgataaaaaactttttacccagacagctgatatctgtcagatgcttgtatccaccgttgatggtgatctctatcctcctgtggaggagcccgttgctagcactgatccttaagccagcca

SEQ ID NO: 488845 - DNA, 120 bp, Homo sapiens
cggatccccttcgatgtgtctcagagcactggctcccagagaaagccaggaagtccccgtggtgtaccctgtgcctccccccaccctctgctgcaggaggtgtggcaccaccagatgctc

SEQ ID NO: 488846 - DNA, 235 bp, Homo sapiens
aacacttggtatctcaatatctcacatgtgacatgggaattagaaaatcaaccaagacaggaggatacaaaaattcaaggaggtaatgcacaaaggaaatgcctagaagagtacccaactcatgaaaaaccctcgagatgcagaattctgttttaagctagttcatggattgaaagaaaactggccttagctcccagtgcctgttgggttcccgctccaccagccaaacctggtt

SEQ ID NO: 488847 - DNA, 183 bp, Homo sapiens
agatgagccggtaccgaatctcgaagttgtgcatggggcaggtgcattgtgatgcctgtaatcccagtgctttgggaagctgaggcaggaggatcccttgaggccaggagtttgagaccagcctggggaacatagcaagatcccctctctacaaaaaattgaaaaatttgccgagtatggtgg

SEQ ID NO: 488848 - DNA, 765 bp, Homo sapiens
  misc_feature (15)..(15): n is a, c, g, or t
agcgggtctctggcngccccgtggcgcccgagtgcactgaagatggcggctgctgtaggacggttgctccgagcgtcggttgcccgacatgtgagtgccattccttggggcatttctgccactgcagccctcaggcctgctgcatgtggaagaacgagcttgacaaatttattgtgttctggttccagtcaagcaaaattattcagcaccagttcctcatgccatgcacctgctgtcacccagcatgcaccctattttaaggggtacagccgttgtcaatggagagttcaaagacctaagccttgatgactttaaggggaaatatttggtgcttttcttctatccttgggatttcaccttgtgtgtgtcctacagaaatgtgtgcttttagtgacaaagctaacgaatttcacgatgtgaacctgtgaagttgtcgcagtctcagtggattcccactttagccatctttgcctggataaatacaccaagaaagaatggtggttggggccacatgaacatcgcactcttgtcagacttaactaagcagatttcccgagactacggtgtgctgttagaaggttctggtcttgcactaagaggttctcttcataattgaccccaatggagtcatcaagcatttgagcgtcaacgatctcccagtgggccgaagcggtggaagaaaccctccggttggggaagggtccagtttgttgaacacctgggaattctgccggagtggacgggtttcaaatagcagtactttta

SEQ ID NO: 488849 - DNA, 690 bp, Homo sapiens
  misc_feature (15)..(15): n is a, c, g, or t
agcgggtctctggcngccccgtggcgcccgagtgcactgaagatggcggctgctgtaggacggttgctccgagcgtcggttgcccgacatgtgagtgccattccttggggcatttctgccactgcagccctcaggcctgctgcatgtggaagaacgagcttgacaaatttattgtgttctggttccagtcaagcaaaattattcagcaccagttcctcatgccatgcacctgctgtcacccagcatgcaccctattttaaggggtacagccgttgtcaatggagagttcaaagacctaagccttgatgactttaaggggaaatatttggtgcttttcttctaatcctttggatttacaccttttgtggtggtcctacaagaaaattgttgcttttagtgacaaagctaacgaatttcacgatgtgaacctgtgaagttgtcgcagtctcagtggattcccactttagccatctttgcctggataaatacaccaagaaagaatggtggttggggccacatgaacatcgcactcttgtcagacttaactaagcagatttcccgagactacggtgtgctgttagaaggttctggtcttgcactaagaggttctcttcttgacccgggcagatatagggcttctggaggtaactaattcctaagcggcccgactcccggagccctccctgttct

SEQ ID NO: 488850 - DNA, 594 bp, Homo sapiens
  misc_feature (15)..(15): n is a, c, g, or t
agcgggtctctggcngccccgtggcgcccgagtgcactgaagatggcggctgctgtaggacggttgctccgagcgtcggttgcccgacatgtgagtgccattccttggggcatttctgccactgcagccctcaggcctgctgcatgtggaagaacgagcttgacaaatttattgtgttctggttccagtcaagcaaaattattcagcaccatgcttttagtgacaaagctaacgaatttcacgatgtgaacctgtgaagttgtcgcagtctcagtggattcccactttagccatctttgcctggataaatacaccaagaaagaatggtggttggggccacatgaacatcgcactcttgtcagacttaactaagcagatttcccgagactacggtgtgctgttagaaggttctggtcttgcactaagaggttctcttcataattgaccccaatggagtcatcaagcatttgagcgtcaacgatctcccagtgggccgaagcggtggaagaaaccctccggttggggaagggtccagtttgttgaacacctgggaattctgccggagtggacgggtttcaaatagcagtactttta

SEQ ID NO: 488851 - DNA, 503 bp, Homo sapiens
  misc_feature (226)..(226): n is a, c, g, or t
  misc_feature (363)..(363): n is a, c, g, or t
catctctgctcccagatcacgcgattctcttgcctcagcctcccaagcaactgagattacaggcctgtgtcactatgcccagctaatttttgtatttttagtagagatggggttttcaccatgttggtcaggctggtctcaaactcctgacctcaagtgatccaccagcctcgtcctcccaaagtgctggattacaattgtgagccactgtgtctggccacacacngactttcactgtaatatctggatgttttatgtaacatatctgggcaatagggcttatggcagaattggccctcgtggtgtaggccttccaagttccaagtctcatttttagtattcctccgttccaacccctggatncaccagttccaacagcctggatccaccttgatattgacagccaggcagatgcttctgctgatcaccgcagctctagcaatggaaatggatatttttagaaaatacttgtctattcttttattttggtggtttaaactatt

SEQ ID NO: 488852 - DNA, 387 bp, Homo sapiens
  misc_feature (110)..(110): n is a, c, g, or t
  misc_feature (247)..(247): n is a, c, g, or t
agatcactctctctcagctcccagcactgaatacaggctatatcaggctgtctcaacaactcccaaagtgctggattacaattgtgagccactgtgtctggccacacacngactttcactgtaatatctggatgttttatgtaacatatctgggcaatagggcttatggcagaattggccctcgtggtgtaggccttccaagttccaagtctcatttttagtattcctccgttccaacccctggatncaccagttccaacagcctggatccaccttgatattgacagccaggcagatgcttctgctgatcaccgcagctctagcaatggaaatggatatttttagaaaatacttgtctattcttttattttggtggtttaaactatt

SEQ ID NO: 488853 - DNA, 332 bp, Homo sapiens
cttatacaatggttagagaaaatatgaatggacttgtgtggtgtgtggtttacagaatgaaccagttgtaacccggtaactgatatacaaagggaaaaaagtgaaaaaagtacatatttggtggcagatgacagaacagaacaaaataactaaagtgtcatgacattgacagtggccatgcatgtagagtgtcacatgtaactacgaacttattataatttcacaaggttggctaaacatgctaaccatctacatgtgcatggacgagcttatgttaaaaactctaaagaatactctcccctttgaaattttgtactcgaaaaaaagctttg

SEQ ID NO: 488854 - DNA, 232 bp, Homo sapiens
cacacagccctggcagccgccggtctctgacttggaaaaacctccggatgaatggatggaatggaatagggtgaataatgaatggagtgagtgagtgaatgatgaatgtaatgaacaatgaatgatggagtgagtgagtgacgatggcaagactgggaaggaatggaattgaatggacggggtgaatggagtgaagtggaatgcatggaatggagtggagtgagtggaatgc

SEQ ID NO: 488855 - DNA, 360 bp, Homo sapiens
tgggctgtgcaaacttttagaaaaagtgatcagttgccttcaacacaaaaaaagcaagatgaaaagagaacctacagactgaaaaagatctcaaggaatacatctcaagcaatcactaacttacagaccttatttgagtcccaatccaaacacatgaggaaaacacaataaaaaaattgagaaaacatgaatatttgataatattaaggaataagttcattttctataggtaggataatgctattatagtaatttatgtgatctttcagagatatacaaaaataacttgacaggttaaatgatatgactgggatttgctctaaaataactgggcagagggtatatatataaaacaagatt

SEQ ID NO: 488856 - DNA, 747 bp, Homo sapiens
  misc_feature (643)..(643): n is a, c, g, or t
cggaccgcgtgggccacaggccacttgttttggcaaataaagttttattggagcacaaccatgcacatttgcttacaaattgtctatggttgctttcacactacaatgacagagtagttgtgatagaaaccatttggcccacaggtcaaaatatttatcatctaatcatttacagagaaagtttgccaacccctgctctattgtatagctatatcaaattgtatttaactcactctcattgataggtcttcactattttatatctaactataaccttgggcatccttagggacactaatcttactacttcttcgagagggtacttagaagtggaattgttgggcaaaacaggtacacattttaaattgagaaatattgtcagcttaccattaaacaatagtttgtatcaatttgggactctcacaaaaagaagtatgtataagttccttttagccatgtacagcagctcatgcctataatcctaatgctttgggaggctggggcaggaggatcgcttgaggccaggagttgagaccagcttgggcaccatagtgaaaccccatctctacaaaaaatacaaaattagcttggcatggtggtgtgcacctgtagtcacaactagttgggaggctgaggcgagaangatcacttgagacaggaggtcagatctgtagtgagccatgattggggccactgtattccggcctgggtgacagagcaagaacttgtctccaaaaaaaaacaaag

SEQ ID NO: 488857 - DNA, 254 bp, Homo sapiens
atcccctgataggacgagccatagctcagcttcacgcttacgctgcgcaatggctgatggccggcatatgaagtgtgcgtcatcatctgtggaagaagggcgagattgttaagagaatcctggagcagaggtagtgcccggatcagcatctccgcgggctcctgctgtgaacgcatcatcaccatcatcgtggtttacatcagctgtcttccatgcctatctgccatatacttaggtttaaagagtggagtgat

SEQ ID NO: 488858 - DNA, 329 bp, Homo sapiens
actacaattcgagctcgtaccctgttacagcctgctgagatagctcacagtcaaggagccaggatgtgttacactctctcttgaccaaccagagattctgtgtggatctcctaacagaaggtactttagacccacacaacgagctgtatgtattctgataacaggctctgccattttcttccctataaagacagtctccaaaatatatctccaaggctcttttggactctgagctatcatgtctcttgagtgaatccaagtgatgaaatcttcatatttcactataaaactcaatttcttagagatcagaacataatgtttctcttttt

SEQ ID NO: 488859 - DNA, 249 bp, Homo sapiens
ccacgcgtttaggattactcaagcatgacctttcattccaattaataaaatgcacactctgctagattctagaataactaaaaggaaaatggcaccaactaaaacaaacaaacttcatttcgacctgaacatgcactttacgtttttggctactaatcaacccacataatccattttacctcgcaacctgaccaccaactttgccctttacactaaacaactctgctggttaacatatgacaacgatgc

SEQ ID NO: 488860 - DNA, 301 bp, Homo sapiens
  misc_feature (24)..(24): n is a, c, g, or t
gaggcgggggctcgctctgttgcncaggctggagtgcagtggcacaatcttggcttactgcagcctcctcctcccgggttcaagtgattctcctgcctcagcctcctgggtagctgggactataggtgtgagccaccacgcccagccagatttaatttcatttattgctcctttttgccgggtgcagtggctcacacctgtaatcccagcactttgggaggccaaagtgggcggatcacctgaggtcaggagttccagaccagcctggctaacatagcaaaaccccttctgtcgtcttctc

SEQ ID NO: 488861 - DNA, 238 bp, Homo sapiens
gcagctactcaggaggctgaggcaggagaatcacttgaacccaggcggcagaggttgcagtgagccgagatcgtgccactgcactccagcctgagcaacagagtaagacgccgtctcaaaaaaggaaggaaaaaggaaaaaaaaaggaagggaaggaaaagaagggaaggaagggaggaagggaggaaggaagaaccaaagaaggaaggaaccttagggttggcaacctgggcttatt

SEQ ID NO: 488862 - DNA, 969 bp, Homo sapiens
gcagcatgcctgaccctgacatctgtctcttggatatgtattgttcggagggcatacagatgcgctcactctattctcctcttcctagcgtgctcgaatccatcttagctccgcagacttccggtacccatcttctggctcgttccatctcatgaatgctgagaccctgtccacgctagcacgttgtctagtggtgttcatgcgtgctcttccattcgcactacaccgaaaaactctagttgaagtcgcacctatgaacttgcagatcaatagagtataatgtacgaactcggacgatgagatggcagccatttccgaccattgctgttttcaatcaaggacctggctccgtgttctacctactttgtacccttctctgatggtgccacctcctactcctgaccccagaggattgattattggcctctgtgcgagaggtcgagatcgcaagctggatggattctttggctcgacgaaagcctcgagacgaagaagggattaaagtgcggaatcgtgcgtacaaatgctagatcctcccgctagtcaagagtgacggtatcgaagggagtggcgggacttgtgcgattttcggattcgaagtaccaataaaatgcatgccttgctttgctattggaagattgagtggaataatgccttatacagcttatagcacctgtctattgcatcggaacactgtgagggaggttaatgcctaatcgttgagccccctggaccgagtgtactcttatcttccactgaggttctatcgtccgaagtggagctcctccatctgtttggaatgtactcctgaagcacggctttgttccatagaagtgaagcatcctagagaggtgatgccaacatatgagggtggcgaacgtgaacaaatctccataagcatggggtcgagcctgcatggtcagattggcgactcttcatctctcatgggctcaaacgcttgctacgatt

SEQ ID NO: 488863 - DNA, 1078 bp, Homo sapiens
  misc_feature (24)..(24): n is a, c, g, or t
tacagttgtagtccgtatgcaatncagtactaactgtgtatatcataatctttgttgacgacgaacaattgtatgagaagagagagttgacctgtaggaccattggaagacatgagtaagccgtagaatttcggttttgaatactctgtaggaattcctctaagctctgctttatttggggtattaagaaggccataaaaataggaggggaaatctcttgaaatctctttcgttagcactcgctaatagtaagatatagcatagagtggtcaaataatattataaaatgaaggtagcgtgaaattgttgctcgggctcttgatgagcttcctaggcctagagttgatgaacgctttcatgtaaatgctatggctccaccatgctgttgacctgcatgtttatgagaaaggccatgttatgtagagaccctggcaaattctcaactcctgtattggcaaattatatctcactatcatcgcaatgaggactacgtggggagaacaattatttacacccacggtatattgtatgattcgctctttatttatatctgtcactgacgaaacctatgaaccaacgcgcgttttaaggcgctcaacttacacacgatgagggaagcaagatttcccagaaaaggaccagaagggcatttttattccacaaggaaaattgggttccctggccccagatgaacagaaaaaatgggagctctggctaagttggccttaagtctgactgacttcagtggctcataaccgtgagccaagtattttggtgggtcataactgttgttttgtgaactatgtcttacatgtctagagttctggctggatctaaggaaaggaggagctatcgaagtcaacggatcaaaaaaaaacaaggctttttgtcactgccttcttggcaggtagtggcctagaagagagagtaaactgtaagagtctgagtcttttgacttcaccttttcaaggtgtacttctagttgtcagcttctcgagacaataaacttgacaagctgggttgcttcggcacagaagaaaggggactattggtgccccacgaaagctgggactacaag

SEQ ID NO: 488864 - DNA, 406 bp, Homo sapiens
tatttatctccctatcccaccccctaccccacctaacacatttgcactgccaggaatggacactggaagtgccaggaggaaggaaggctggtttggtggggtagtggggaggtcagggaggcggggccaagggtgtcccacatttccaacaccgccctttgatcaccatgggaatctttggactcaggacagggccaggtgcagggctttccctcctttcccctttgctgtcccctccccctggagggcatggtgtcggggggtggcattaactatagatacccgggaaggttaagaaaccccacaaacaaagccacctagggatgagtatagatgctggtgactgtgtttcatagccccagtccagggctgtttaagaaataaagatcaacagcccccccctgga

SEQ ID NO: 488865 - DNA, 303 bp, Homo sapiens
ctgctccctcttcagaatatgccttccgcatgtctcgttcagtgccggtatttggtgaaagtcaccagggctactaattcccaggtctacttaaaagtggtgagaacactgttaagtgaactgccttagccaagaaaaagggagattatgattgggattcaaaatcaacaacactttacgctggaactcattgcagacccctcccgatttcttgggactctaacaaaattaaccatcaggaatttatgggattaagcaaaaacgactaaagaagcttcgtggaaaggagaaaccaaagaaagg

SEQ ID NO: 488866 - DNA, 113 bp, Homo sapiens
cttcctccattcttgtgtagttgtcccctgcagccaggttgcaatctaaactccagtccaggcaaaggaagaacaatggaagtgccagcagtcctggggccagccagagagaa

SEQ ID NO: 488867 - DNA, 559 bp, Homo sapiens
tcgtctggtgttccggaggatccccagactcggtaccgattcaggagataggctgggcgaggactccatgactaaaacacccgaagcaatggcaagcaaaagccaaaatagacaaattgggatctactgaaactaaagagcttctgcaaatgcaaaagaaagctaccatcagagtgaccaggcgacctacagaaggggaggaaattttcacaacctactcgtctggacaaagggcctaatatctcagaatctacaatgaactctcaacaaagttacaagaaagaaaacgaacaaccccattcaacaaatgggcgacggagtatgaagagacatctctcgaaagaagagcatttatgcagccagaacacacatgatcaaaatgctcagtcgtcacatggccatcagtagaacatgcaatattcaaaaccacaatgagataccatctcatgccagttagaatggcaatcattaacaagtcaggaaacaacaggtgctggggaggatgtggagaaataggaacacttttacactgttggtgggactgtaaactagttcaacc

SEQ ID NO: 488868 - DNA, 120 bp, Homo sapiens
tggcctccgggggttaagttgctgctggagatgtaaggcttgggagtctccaagtataaggtgaaggtgaatgtcggaactgtcttctctagctctcatcacctcgctttatatgacgtt

SEQ ID NO: 488869 - DNA, 280 bp, Homo sapiens
acccccccctttttttttttccccttttgggggatttttaaaaaaagggcccccggccccccttttttaaaattttgggagggggggagggggttttttccagttttttttttttttcccccccaaaaaagggaaaaaatttttttaaaaaaaaccccccttttttggggggttggggttttgggggttttttaaaaaaaattcccccccctttttaagggggggaaaggtttttttttttttttggggccccccttaaaaatttttttaggggggggga

SEQ ID NO: 488870 - DNA, 191 bp, Homo sapiens
ttaaaaaaaaggggggggaatttcccaaccaatttttggaaaatttttaaaaaattttaaaaatttcccaagcaattcccccaaatttggggggggtggggaacccccccgttcataatggaaagggggggtaaaaactttaaaataaaaggtgttttaaagggggccaaaaaaaaaaagggtttcgccca

SEQ ID NO: 488871 - DNA, 1004 bp, Homo sapiens
gtccagactggctagagttagaaggcagacctaggctttggaagcaggtggcctccaggagccttgccattaaaaggctgaaggcagccgggcgcagtggtctcacgcctgtaatcccagcactttgggaggctgaggcgggcggatcctgacgtcagcgagatcgatgaccatcctggctaacgtggtgaaaccccatctctactaaaaatatcataagatacattacatccacggcatggtgacgggcgcctgtaactcccatgtctactctgtgaggctaagtgcaagagaagtcccttgaacccgggagggtgaacgtttgcagtgagccgaggatcgcaccactgcgactccagcctggatgacaggagcaagtctccctctcaagaatacatcataaaagatacacaatatacacaaaagagaaaaaagatagacacatacaatagacacacaaataacagagagaaaacccataaaacacatgacataccacaaacaccacagtaacataccaagatacaagcagattgaagcccaataacacagagtaccaatctcaagagacatccaatctgatcacagtagactcattgctccgagggagccaccactgtgatcgagggatgcctcacacagtgagtccacaggcgcgcagcgtcgacaacacgtggagagccttaccgtgatggtgcatagaattgaatgatcatcacactctagggaaaacaaccagcatccgactagggccaacaatacaacacgacagccaagactaagacactgactgaacggccagcaaaaccacctcacaataccgacagaggctaaaaacacgagtggcacacacgacatcaccccaacgctaccgccaagagacaaacaacagtcgactgaacaaaattcaacatcttacctaggatcacaagtactccgccaacaaacatacagcacatcacaaatatacataccgatacagttcgaacgcaacacgcacacag

SEQ ID NO: 488872 - DNA, 324 bp, Homo sapiens
gctgctaccgttatctggcacgcataacatctgccggtcttctgtcccacgaaggatggtgaactgctgacttactgtagccctaatgcctccacactgagctgatagcttgtattcagtcttattgaagacaagcgacacttcatcctctgccatgaaattatctagtcgtattgctgtcagttactgacccctggattcctgggctctctggtctctcaatggcttataactcattaccatgcttaattatgttggtgtgaaacaatcccagacaaggttggtggaggttgcttgacaattgataggtgctcacatcatttc

SEQ ID NO: 488873 - DNA, 461 bp, Homo sapiens
tatcccggcctccttgtgttgctggtgccatgcttgtactgtctgtagacgtcatgagccaatgaaacctctttatctttttaatttttttttttaaagaaaaaattttcacttttgttgcccaggtggaagtgcatgggccaattctcggctcattgaaacctcggcctcccaggttaaattaattctctgtgcttcagcctcccaaggtacatggatatttaagattgcctgccaccacacctggcaaatttttggtttatttagtagagacgggttttcgccagtgtgggccaggcgtgtctcaacctcggggacctcagttaactcggccgtgcctcgaacctccaaaaggtgcgggaactacaggcataatgtgccgcgttcagccctgagtccctttattttttaatggggggggaattccaactgtgttccccgggcggtatggaaggcgcaaa

SEQ ID NO: 488874 - DNA, 1190 bp, Homo sapiens
  misc_feature (137)..(137): n is a, c, g, or t
  misc_feature (257)..(257): n is a, c, g, or t
ggtttcggccaaatgtgtggcaccaaccctgtttcacgggaggtcgccccgtcgggtgtaagaagagtttaatgctcccccctgctaaagatttagggtgatgaatatgtgatatgtgaaccccccatagtgggtgntggataataccccgccttttgtgggtggaggaccccctcctcttgtggattggtcccccacgaatatggtctctcgcggggatagtccccctcacgtagaataagcccctacgacgaagnttgtgtggtgttaataataaagatagaataggctgcccctcctaatttatattatggaggggacgtacctttttaaaaaataaagataacagtatgggtgtatattacgtgccccacaataagcatcccaacgtgtcgtcatcgtacacctcattgcttttctacgcgacgagaatagacaacaccacatattacgcctgcaactactctatcacctcaatggggggctcacgtctccgacgtgagtaatgagataacgacccccctcttgtggtttgagtaagagtaggcgcccacaactgttggcaacgcgagagtgcgtctgtctcgcacacagcggcaccctcttgagaggtgtgtggagacaccggggtgtgtggctcccccgcgcctgtgtttgtgtagcctcgtgtttagaccccgcccacagtgtgttgtgggcccaccgctacagggcgccacatagatatgtgttcctccccccacatttgcgcgctctcacagtgtctctctcagtgtgctcccctccaacaccagagcgcccccggtgtggcgccacatgtaagaacgcccaccccttggtgtggtaacacaccggacacagtctgcgccacaatagtgtttatatctcctactctccacggtgtaagacatttgtctcaccagatctcatatgggaataatatatagttgagatttttttggcgacccacaacccgttttgtcttttagaaagtatggttccattgttttgtgattgccatagatttcccttcccttctcaacactgggttcttccccggccattccagaagaagaggagaggagaaggagagaaaaagaaggggagggaaacttcccccaacataacccccacccgtgcttttggcccttattttgagaataaatttctgtttccaaccgtttaaaaaa

SEQ ID NO: 488875 - DNA, 297 bp, Homo sapiens
aagggacccttggtgtctggaaacacaacatgaacgcagagccacggatgatgaagacagtgccctaccacaatgaccacgaggcccacagacaaccccagggctgcagaccacagtctctgtgagctctgacataggggctggactctcgggctcccagtgtttcatgaagaggcttgtccagtccccagtgctccaccttgccaggcatcactctcctcagcagaagggcggagggtgaggtcactgctcttgacaacggagtgatcactcttggggcggcagctggtctcagaa

SEQ ID NO: 488876 - DNA, 812 bp, Homo sapiens
aatcatcctgatgttgcaagcaaattggctacttgtcccttcaatgctcgccaccaggttcctagagctgaaattagccatcatatctcatgctgtgatgacaaaagttgtattgagcaagatgttgtcaaccaaaccaggagccttagacaagagactctggctgagagcactggtcatagccctacttgatattaacactgggataaagattcgggggatcataccagcaatcccatttgggtggggcacaactcactacagcagacaacaacagccctgtgagctacatagttacaaaacataaaaatctcctgacttctagcatgccagttcacaactctctggcgaatttccccgcatggaaaaacaatgtaaaggcaccgaccctaataccctctcttatcgaatgccagcccgtaaaatactggcagcctttcatactacaagcgggttggcattttcctcctatgctagccctagacggggaacccccgttggtatttttccaaaatggcaatatcaactttttttctgcaattattcgtgtgtgcattcggttcaggacatagcaatagttaagagactctcaaagaactccataagcgtgccggtaccgatgcgggagctcacaataatagtgtaatttaatagaaggctatttatccagcatccgcgcagctgactgtaccacgatagaccgctaaatgcgatctttgctcgaagtgactgcgtcgcctgataatccagcattttgattttggagacatgcatgcggtgactctatgatctctatctcttctgtatggcgt

SEQ ID NO: 488877 - DNA, 139 bp, Homo sapiens
ggaccgaactcgacatgtgtgcacactaaaatatcaaatcaggtgcttggttttaaagtaaatgtttttctaaagaaagctgtgttcttctgttgacccagacgaatagggcacagcctgggtaccggctcgatctaca

SEQ ID NO: 488878 - DNA, 1039 bp, Homo sapiens
ggcaatggccctcatgatgtatagagctagcacattctggaactacaccatcagaagcttccaagacaaggcaggaacgagcaggtctgtaccgactggtgaatgcaagtgagtcgtaattgtggcatgaaaacgatggtacacctcttttactagttatctccactgcacgttacatgaatgagatacagcagattcacgtgaattgaatgttcatgaatggaggtggtgtgaaaagtcgcgtctcacctcttagtatgatcatgacattatatcggtggaaaactgggaaagaggactacgattgtatgcacgtgaaaaaactgtgtaactctgacatgatgctattacatgggattaggacgagtcgttgtagcagcagacagagaggactatgtgcatgtggtgtacacaaagtagtcatgtgcaacttgggagggtaaaatgggagttacgagtgagtgagagaatggcgcctgagatgcgagtgagcttagaaacatgaaagtatggggccgaaatgtgtgtcaagagaggaatctctctcacttggtaatgtggcaaggcagggatgggggaggccacttaggaggggccttgaaggagtttgcatagttgggcacccatgtaagaactgtatgccaaattatttgtctcactagggtcatgtaatacactccaagctcggtaataagtcacgagatggtatattcgggaaaaagtgtataagtcgcgactcgaacattgggtttaggaaggaacggctactcaatagtcaggagttaacccaaggaaattgtacaaagcgactgagtaagaaacaccctataagttcggttaggggaagcttgaagtaatgagtctttataacttagactccggtgcagaaccgggagagtagattgcgagaaggattagttgccaaagctttcaaagatgtggctgggagatttgggggaggtaaaacgtttgagaacgttggaaagtcaggggagaaactgggtctagaggggagagacgctagaattccagtagacgg

SEQ ID NO: 488879 - DNA, 1068 bp, Homo sapiens
  misc_feature (518)..(518): n is a, c, g, or t
ctatagcgtccagtcgcccttcacccgcagcgcccagagcagcccagagtgcgcggcagcacggcggccgctggagagcgaccagggtgaccccttcacgctcttcaacgtcttcaacgcctgggtgcaggtgaaatctgaacggagcagaaactctcgcaagtggtgccgccgccggggcatagaggagcatcgactgtacgaaatggccaaccttcggcgccagttcaaggagctgttggaggaccacgggctgctggctggggcccaggccgcgcaggtaggggacagctacagtcggttgcagcagcgccgggagcgccgggccctgcaccagctgaaacgccagcacgaggagggcgcgggggcgcagggcgcaagggtgtgtggcgggtgtgcggagagagacgcagagacggggggtctccagatgacgaggacaggggctggcaccagaccccaccaggggaccagtgatggcgtggacatccagggatgtgacgttcaacgcttcggcnatgacactggcgcagctggcaggcccgctgcccagctcagccccaggacctggagccgcgaagcagctaggctctggctgaagctgtgtgctggggccggggcctgtacccacagttggccggtccccgacgccttcaacagcagccgaaagggactcagagcagattttccacacgcaggccaaagcagggcgccgtgctgcaccccactgcgtctacgctgggcagcccgaggtgctgcacgcacaggaggctggaggccaggcaactgggacggaagccgaggcatggtgcgtgctgagacgtcacattcagaattgggtgacctccgggacggagccaggcacaaaggcaggccagaaacaggtcaacgagtaggagcaaaaacagcccatacagctcgggcctgctggacaacacaaagggacctgggcaagggtcggcatactgacccaagaccacgagttagccggcttggcacacgggatgtaccacggggccacgagggcagggcagaaagagaaggccagcaggggacagagagcacgga

SEQ ID NO: 488880 - DNA, 188 bp, Homo sapiens
acacacagaaacacacacagacatatgatagtgacttagctagtggcagcaatatgtttatatgtgtgcccaatcattggtgcaaagcagtatgtggttacagtggtaagaaaaaaggtttacatcaactatatatatcaagcggaacttcacaagtattcccaacaactcactatagtgacgtgaga

SEQ ID NO: 488881 - DNA, 754 bp, Homo sapiens
  misc_feature (109)..(109): n is a, c, g, or t
  misc_feature (433)..(433): n is a, c, g, or t
  misc_feature (440)..(440): n is a, c, g, or t
  misc_feature (456)..(456): n is a, c, g, or t
  misc_feature (460)..(460): n is a, c, g, or t
  misc_feature (463)..(463): n is a, c, g, or t
  misc_feature (468)..(468): n is a, c, g, or t
  misc_feature (475)..(475): n is a, c, g, or t
  misc_feature (719)..(719): n is a, c, g, or t
  misc_feature (721)..(721): n is a, c, g, or t
tagcatttagaataattaatattcctgagattgtcttgaaaagacttccatgtatcgctaataggattcctaatgcatgtaagtcttttggaaagttagttacatcttnaagaatcttgagcaaattctggtttattcactagatggatatatgtgagaaactaatttttgataaatctgaggataagaactgtgtatttaaaaaatttttaaaaacagaaaaaattgtgtattaaatgtaattacaattatttctttttaagaaactgcaatggaaaaaaagactggaaagaaatgttagcagtatttgtagttgggtaatgagactatggctattttcttttctctgtatgctaaattttacttagtatgcactagttttacaatgaaacaattaaagaaaaaagaggaaggaaggaagaaaagaaggaanaaagganggaagggagaaaatangaangancactncttaaangtaagaaaatggcctaattagaccagttagtaaccacttagttaaatgctataattaagcttttaccctatcaaggaactttctaagtgatcacaaatgataactaagtcatataatatctgcactgaagggacatcttacctaattctgtcatttgacatgtgtagcatataaattataattattcaatgctttacagtttacagagtgtgttcattttaagatcgagaaatttaggttacananatagtaatgtgctctaataataatgctattatt

SEQ ID NO: 488882 - DNA, 495 bp, Homo sapiens
gtaagggctgaggatttgtggtccgcagctcctgctctgactcaccgctgtcgctctcgccgaggaacaagtcggtcaggaagcccgcgcgcaaagcatggtttaaaggataccggaaaacacacccgtgagccggaggtgcaattcaccgaatacgaatcaccctaacaaggcgcaaggtaaaatccttggacacagggtgtgtgcctgacttgataagaggcgcacaaagaaaaagactctcaaagtgaacaggaccagttcgaattgcctaccaagattggagaatcataaagaaaaactccttgtggtgaagggttctaagacgtgggatcgttcccaggaatgagaattcacaaggcgatcattgatatgcaacagtccttctgagatggttaagcagataacttccatcagttatgagccaggaagtagaggtggaagtcaccatgggagatgttaagtcaaactatcttataacatgtgatgaccagt

SEQ ID NO: 488883 - DNA, 1471 bp, Homo sapiens
  misc_feature (546)..(546): n is a, c, g, or t
gacccacgcgtccgtcgacccacgcgtccgtttttttttttggttcgcaacgggtttgccgccaaaacacaggtgtcgtgaaaactacccctaaaagccaaaatgggagaaaggaaaaagactgctattatcaccattgtgtcgtctattggagaccacggtaagattgcgggcgcaatgtccaccactaactgggcgcatctggatctataatatggcggtgggctatcggacaaaaagaaccaattggaacaatatttgagaagaagggagggctgcgctgagaaatgggagaacaggggctcccttacaagtgttatgcgcctgggtgttcttggagtataaactctgagacaacgctgagagctgtgagaactgtggggttatcaccccattgagatatatcttcccttgtgtgtgcgaacacaatttgtgcagaacacacagcaagagttcacctgagtgtgtgacactatactccagtgtgagagtgacccccccgagggacacccacgagagagacacttatataactcacacaaacanagtggtatttccacccggggcccactatcttcgagggctgtggaactgtgggcggctgtgcatcacgatggatatgtggatgtgcagtcgctgatggagtgtatgtggagtgaaatctttgtgacacagccgatggaaaaatctctccagagaaaatgtgggggacgaagcacccccggaagaacgcctagttgccccatttcaaggggatataaacaaacactgtggggagtggtgtagaaacacaaaaccaataaatctgcgactccgaggtgtatatacaccaacacacaggggggaatatctccccagcggtgggaagcacaacccctcgataagcacggccccagaaagagaaagagattagttgcaggaacaatctgggtcacaacggcgacaagtcctcacggccccttctccagttttagagagaaacaaacttgggcataacaaaaccccccagaacaccgcaggcgaaagcaaatggggacggccaaaatatcccgagaatggcgacaagcggcgacccaaccagtgcccgcggacgccaaaggggtcaaaccaacagccctagggtgtacacaaggggaacggcgcaaacagcccccccgataaaaggatgcgccaccgccagagaggggaaaccaactcggtcgcagtgaaaggcacagcaaaataggcatccctacaccaaccaaacgacgcgccacgcgtggaaagccccctggtgcccatgcgcttcccagagaggctaacaaagggagcgcaaagaagcacacacgcggaggccaacaagaacacgaggcccaacaccagataggacaactgaacaaaaagaacaccaggcagaaaactgaaagcacaaaacgcaagcagcaacgacgaacacgggagacacatacaaagatcagacaaaacgaaacag

SEQ ID NO: 488884 - DNA, 283 bp, Homo sapiens
attaggcgcgtactggtgctggtgacaaggacgacatcacggagcctgccgtctgcgctctgtgccactcactagcctgcacctgaggccgagcatggcccagaactctgtgcgtctacaactattgcatcccagccatcgtgaagctgctcaaccagcccaaccagtggccactggtcaaggcaaccatcggcttgatcaggaatctggacctgtgcccagccaaccatgccccggtgcaggaggcaagcggtcatcccaccgaggcagaacgcgcctaatc

SEQ ID NO: 488885 - DNA, 202 bp, Homo sapiens
aagggagaaagcgagagaggaaggaacagggagtgagaaaggaaggattggaggaaggagagagaaaaaaaggaaggcaggagagagaggagaaggcaagtgggggaggaagggagaagggggaatgaagcggggagagaggggagggagggagagagagctagagagcggaacggagggagaaactgaggcagaccacagg

SEQ ID NO: 488886 - DNA, 837 bp, Homo sapiens
taaaagtttcatctttaatgaaatgactttggaaattatccgtacatttcccatgtgacaccaatactacagttttcggagtcacagtaagatacacagaattacatccgtaattaatatgaatgccaacttgtcaagcagtaattggttacagtggcaaacaaaatcaagaaagcaaccatcaaacaaaagagacccatagcttcagacaaggcaaattcccaggatagcttttgagaacagcgtgcgtgcttcagcaaagggttccggggcatacccaagtgataaggctgccaaagacgtgttccaattaccagcaccagaaccagccactccatacgtgtgtgcagcacctgtgcaccaattaaattgggcagcagtatcaagtgtctcgtgcgtgatgtgcccgtggtctgaaactcccttgggattagctgagacacaccattcgtgggccccattaaataccgtaaagccctctccagtcctattagcctctggtcgagataaccactgatgcagaaatgggtcttgtatgcacactctggatccagctcggatcaaaaaggggtgtgcaggcaagcttggcgcaggcgaacattcttacactcttcggagactgcgcggctgagaaatatggggtagacaggcaacgtgggctcctctcccgattcctcttttcccaggaggcggaggggcaccggcattgcacccaaaggtctactgcgaaatgacgactattctcagaatcagactgtccaaatttccagaaattgtcgcacattacactctgaagggaccccacaggttatcgggaagggccccagaggaacccct

SEQ ID NO: 488887 - DNA, 269 bp, Homo sapiens
atgtggatactcctgatcgcagccaattataatgatatcaatgatgtcaaacgactgacccctgactacttagaagctactgtggactgatatacaaggtatcaggttcctgatggacaaccagaaactgcgtctgcgtttaatgcagactttacagatcaggcactttgccctcgatattattaaaagcactcatgaccattggcacgcatcagtgactaagaaaacgaatggaccaggactcagaagcatgaaaacaactttgtctg

SEQ ID NO: 488888 - DNA, 824 bp, Homo sapiens
gactgggtttcggccaggcacagtggcttacacttgtaatcccagcactttgggaggccaaggcagtggatcacctgaggtcaggagttcgaggctagcctgaccaaaatggtgaatcctagtctctactaaaagtaaaaggccgggcgtggtggctcacgcctgtagtcccagcattttggaagactgaggtgggtggatcacaaggtcaagagatcgagatgagcctcgccaacatggtgaaaccccgtctctactaaaaatacaaaaattaggcctggcacagtggctcacgctgtaatcccagcactttgggaggctgaggtgggcgaatcacctgaggtcgggagttcaaaaccagcctgaccaacatggtgaaaccctgtctctactaaaaatacaaaattagcctggcatggtggcacatgcctgtaatcccagctacttgggcaggctgaggcaggagaatcacttgaacccgcgaggcagaggttacggtgagccgagatcgcgccatggtaatccagcctgggcaacaagagcaaaactccgtctcaaaaacaaaaattagctggacatggtggcatgtgcctgtagtaccagctactcgggaggctgaggcaggagaaatctcttgaaaccggggaggcagaggttgcaattgaagccaaagaatcgcgcttatgcacttcagacttggtgacggagcaaagacttcatctcaaaaacaaagaataaagagaaaaaacagaattaggcgggtgaagcatgcgtgttatcccaggaattgagaagtgaggaggagataggtgaaccgggagttg

SEQ ID NO: 488889 - DNA, 878 bp, Homo sapiens
cttagagggactaggctgggtgtgtgagctgcatcgtatccacaggccccaggatgcgaggccctggtgctactcactctgcagttggagccctcctcgggcacagtcagctgccagaacccgtgtcagtccgctccgagtaggtagggcctccccagatcccgacagcacaagtgggctgcgtggatggatggaggaggatccttgtcattcaaagctccccgtgaacaagctggcatgcggcttgtgcctccaacttcggctatgacctgtaccgggtgccgaatccagcatgagccgcactgaccaatcgtgcatccgtgtcatccgtctccacgatgtggccgacggaccctctcggccctcatcgcatgggatgctggagcatcgaacgagaattccatcattcaccgggctctctagtatgagttgatcagcagaccagacatccatggtacctataaggatggctccttgacatcggtcacttggccccgcagatagaacctctaatgagtgcgtcccggatcgtctttgagaagaagctgcgcatagaatccagcttggtggcacctctggataagtcatatgggaccaggcccatgagtcctgacgggtgcaacctcgtcgctttggactcttgcaatgcaggatcaagctaactgggtgtcaaggcggcagcatgataatggggaatggctcgcctaggttccacaaaggaaatttccctgatgagtatcagcctagtgctccttctcgggtggtggcggcagtttcagggggggcaagtggggtaatcaaagtttggctccggaaaagaactttccctccgaggagtttccgaacttggatggaagggaagaccaggggaagggtac

SEQ ID NO: 488890 - DNA, 444 bp, Homo sapiens
cccctactccagctttcctgtattcttcagggtctgttagcctccagcccacctccttcacgaagtcttccctgatcaccaggcttgagggttctcctgagatgttgggtcttggggtgaaccctgacatttgtgatatgcatgaagagaaagaagttctgacatctcagacctctggctgcccctttggagcctggggcagggttcaaaagacccgagatccaatcccgagccagccatttgtaatcatgagatctgatcctgcaggattttcagcagctcccctctgccttctgggaaattggaactctggcgcttgtttacccacttacccatgccacttagcactcaagtcctttcagctcccagtcactcacagcctgggggctttgcacctgctgttccctctctgggatgtgcccctcccacacctcttccctaagc

SEQ ID NO: 488891 - DNA, 151 bp, Homo sapiens
gggcccaagaataaactgtagggggatatacaaaaatagtccccatgtatgtaaaaggttaccaaataaaacccagtgttctatatttgtttataaactgtagggggaaaaataatttaaaagcttgttttaataaacttttcccccccta

SEQ ID NO: 488892 - DNA, 920 bp, Homo sapiens
ctcgttttggtaaacttttgcccccaacaatgtctcggttttcccggggtcggggtagccccgtgtagatcccatggcttggaccaccccgccgtgggaacttattacatgtgcccgctgccaccagaggtgtttaagacgtggggtccgactttcaccatgggggatcccacgagtgaataaccgcaccatgggtgtccacagagtgggcccccttttacatattcgcggtatgaagctcccccggttctttctaatagttgtccttggtacagcccgccgctaacatagtaaccttggtgcgaaaatacataaagagggcaaaatattgtctcgagcaataaaaaaaaatgaggggacaaacaagtgaaggagggaaacccactcttagtaagacaaatagaaagaggccaacacataaacacccgcggaagggatgctcaaaaatttggtaatccacactaaccacaaagggttgggaataacaaccaggactcacccgccgacgggccaacgcgcggtgggtgataaacacctccccccgcaccctactccagtcaaagagaaatactgtatgtgtttacggcacgacgaaagggagaaggataggctactaagcaaacttctctgtctcttttacccgtcgggccactttccttctggcggaagaattttgtccagactaacacactgtggtgcgaccccgctcacaagtggcttaaaaatcctttctaagtaggtccagacccgccgcaaaaatatttaaataatatagtggttacactaccatgatgcgtgttgtgcattcgttaataatactgtatgcagcacacaggggggcgggacaatgattaacgctcgtgattatttaatgtaacacacacaaggaaaaaattttatgccctccgcaccacaaaaca

SEQ ID NO: 488893 - DNA, 521 bp, Homo sapiens
atcgagacatgtaagcagcatcatggaggtttgacagatgccgcatttggattggatgaattccaaattctgcgtagctagcttttaactatcgatatgcttatacgcgtgtacactttatgcaccacaatgtaggggttatacatgatgttaaaatggacatgatcatactttataatcctactaagagtgctgactccatgtatgatgtaatctgagcaggttgctaccacaggtagctctaggagggctaggcgacttagaggtggggagcagagaattctcttatccaacatcaacatcttggtcagatttgaactcttcaatctcttgcactcaaagcttgttaagatagttcagcgtgcataagttaacttccaatttacatactctgcttagaatttgggggcaaaatttagaaatataattgacaggattattggaaatttgttataatgaatgaaacattttgtcatataagattcatatttacttcttatacatttgataaagtaaggcat

SEQ ID NO: 488894 - DNA, 125 bp, Homo sapiens
tgatgacatgtggtctgcgaggatgcagggctaaactgggacatgagacactcaatgtcctgctagcgctgagatatatacggtgtgtcttgtcgcagtgtgcaacagttgccagtcacctgtca

SEQ ID NO: 488895 - DNA, 118 bp, Homo sapiens
atattcaaccacccccacccccaccctgaggcttcccggttggggcgggcagccttggaggcgggcggtggcggcatgcctgggagaagatgaatatatcatgagtgatgtgcggccg

SEQ ID NO: 488896 - DNA, 560 bp, Homo sapiens
cccgtcatctactcaaccatcttcgcaggcagactcatcagagcggctaagctcgcactgatttttcacctgagtaggcctagaaataaacatgctagcttttattccagttctaaccaaaacgaataaaccctcggttgccacagaagcgtggcagtcaagtattgtcctcacgcaagcaaccgcatccataatccttctaatagctatccctcttcaagcaagtagtacgtcgtccggaccaagtgacaccagtaaccaagtacgtagccaagtcgaagtagcgtcagtcagtgtaactaagtcagtaagtggccctatagccaagtaaacagcgtaaggacataggccccccatttttcacctttcttgaacgtctccagcaggttaccccaagggcgaccccgtcgtgagcattccggcccttgctgttctatcgtcaccagtgaccacacacaacctaagcgcgcccgagtcctccaaactcagttatacccaagaagtctcctcgaccttcacgctacaaccggtaccagcccgtttcgtccgtcaacgtctct

SEQ ID NO: 488897 - DNA, 245 bp, Homo sapiens
  misc_feature (9)..(9): n is a, c, g, or t
  misc_feature (18)..(19): n is a, c, g, or t
  misc_feature (39)..(39): n is a, c, g, or t
  misc_feature (46)..(46): n is a, c, g, or t
  misc_feature (62)..(66): n is a, c, g, or t
  misc_feature (91)..(91): n is a, c, g, or t
  misc_feature (105)..(105): n is a, c, g, or t
  misc_feature (110)..(110): n is a, c, g, or t
  misc_feature (125)..(125): n is a, c, g, or t
  misc_feature (192)..(192): n is a, c, g, or t
  misc_feature (195)..(195): n is a, c, g, or t
  misc_feature (223)..(223): n is a, c, g, or t
  misc_feature (235)..(235): n is a, c, g, or t
  misc_feature (244)..(244): n is a, c, g, or t
cccccttcnaatgactgnnaatatattttcactgtttcncaatgtntttaattcataaagtnnnnnttttatgaaaagaaacttgcaaggnaaatcctagttttnagtcnactcgccccactttntagtagcttcactgaatttcctgctttcctggttgaattttctactgtttcacgtggtgtaaccctnggntggcgcccttggcgtgcccctttgtgtntgaataaacttntctcccccng

SEQ ID NO: 488898 - DNA, 118 bp, Homo sapiens
atccccccaggtaaataggcggtcctgatgtttgtgctgaggttggtgcacatttgtttgttatatgcccctgacttacagcagaaagagctcacctccttttgttcacacgatagta

SEQ ID NO: 488899 - DNA, 140 bp, Homo sapiens
  misc_feature (7)..(7): n is a, c, g, or t
cggaggnttgcagcagtgagctgagaatcatgccactgcatgccagcctgggcaacaagagcaaaactccatctcaaaaaaataaaaaaataaaaaataaataaaaactaaaaagggactcaccattctagatggccatt

SEQ ID NO: 488900 - DNA, 323 bp, Homo sapiens
  misc_feature (209)..(209): n is a, c, g, or t
  misc_feature (226)..(226): n is a, c, g, or t
  misc_feature (242)..(242): n is a, c, g, or t
  misc_feature (268)..(268): n is a, c, g, or t
  misc_feature (281)..(281): n is a, c, g, or t
  misc_feature (317)..(317): n is a, c, g, or t
caggtatatcacagccttcttatgcttaggaatgctcagcagcacttcagcactacagttggggaccattataaacagcaaaatcactaacaaaaagcacccaaaaaatgcaaaatatgtgacactaaatagtcctcagaaaggatacttatttccagtgatgagagctgaaataagaaggtggaggcttgacctcagctgggaatgtncctgcagagtgactttncagctctgtgcatgtncgtgtccagaaatgaccgtgaaagtncctcaagtattgnttttggagtaacaaataaattttagtgaaaaggtanattcac

SEQ ID NO: 488901 - DNA, 1582 bp, Homo sapiens
  misc_feature (365)..(365): n is a, c, g, or t
  misc_feature (942)..(942): n is a, c, g, or t
  misc_feature (1071)..(1071): n is a, c, g, or t
  misc_feature (1220)..(1220): n is a, c, g, or t
ctagtgtgcggcctcttctttcacgtcttgtgctgtggcctcagaagagcttttgtgtgggatcctctgtctgcagcaactcgccacgcatttcgcagaaggtcctgtttctcctcctgtgggggacactttttttgtggcgtctcggcctctcctggagaagtttttttggcagacaccagaagggcttctgcatgattctgtgtgtgaggtgtgggcacaaaggtgtttccgttgccccttatggccccctgttgtgcgcccacttttgttgtcgcgtccagagaacgttgcacaccaccccccctattctatcggccctcccggcggtgtttcctaccccggagttggaactctcccctcgnggggattggggccctgttgatgagtcccccccgacagcttctgttctgtgtttgtcccgggtggggcttctccggaggcgccccccccgtgtgtgctagttttttatagggaagcgcttcttcgttggacctggggggggcacaacaccctgcccccagggggaagcttgggcgcccagcgcccagccccgtggtgatgttgtgggatggccttttcccccctttggttgtgagctgtgtggcctgtttccccgcctttctctgagtgcgccccgctggactatttcttggtgtgggggacaaaagtcctcaatcgtcgtaattgccgccccgagcactcatgttggtgggccgccccccccatcccccaatttttgtcgcgcggtggcacccgtgttctcgttgccccccaagaccacccacggggaatcttttttacgcccagcccccctacgagtagtcgcccccccggtttacttgccgcccctgttctccccctcgcgcatatataggcttgttctctgaataggggtgggtttcactatctgggagtccccctgtttcgcctgctgtgggngcgctctcaatacgcgcccaacactcggtgtattgtctttctcccctctgtttagctcggtgtgtagatatattatatgttctcaccccccccccgtgtaaatatgtgtttttgggggagcccacgcgncgcccaatacccctcttctccccactcttagctcatatacatatgtgtgttggagaatataaaccgtctcacaccacaaagatgtggcgtcttctccctccttggctctgagagaagatatggagaaggcgctctggtgtgggatattntgctctctctctgggtgttcacctataggggcccctcttgtggagagggccacagagaagagggtaacaccactccctctctctcccctcttctctataccccgctgcgagggcccacacagagttctcctctcctcgagagaggcaccgcgagagttgctcgcccctctctctccccatcggtggcccgctcgccctcttgttgcctgtgttatgtgaacaccacacccaagtggaggggataaaacacctggccacataggtctttgttggtttgttctttcgcccttctcactggacattgccccagaataatctttccctttttgaggccagcctatataaatgatcatttttgccca

SEQ ID NO: 488902 - DNA, 101 bp, Homo sapiens
attttttaagggtaatattcccttgtatgcatgggccccctttcgctttcagtagtcctttttaagctctataaaataaaatgaaaaaagggcagttccca

SEQ ID NO: 488903 - DNA, 204 bp, Homo sapiens
aaaggcacatatatccacacatgcacacacagcacacacacaaacgcacagcacacacaaacgcacagcacacacgcacacacagcacacacacgagcacacagcacacaaacgcacagcacacgcacacacatgcacacacagcacacacactagcacacagcacacacacaaagacacagtacacatggaatggcacacaca

SEQ ID NO: 488904 - DNA, 123 bp, Homo sapiens
tctaagcatcctctatgatttgtgttgatcccatctgccatctaattcttcccgatcaggttcttatctgattttggtccggtcaatgagagggagagtactatcatcatatgaatgactgct

SEQ ID NO: 488905 - DNA, 176 bp, Homo sapiens
tagcttttttggaatcttggggtgggggtcatctttggggattatggctaccccccggaatttgagtgtagggagtgtgggagcacccttggcaaatggggcacccgtgccctgcaggtgtttacaagatccgccctttgtaatgtccttggcccaataaaaccaaatgtcagtta

SEQ ID NO: 488906 - DNA, 241 bp, Homo sapiens
tctgtgaggtactccttccatggctgaaggaattatggaagggtccagctcatcctggctgtaaaaaaacacaaccccagtggccttgtcagaagtggctggatgctgaggctgaagacaacaatggcagagggctcaccagggccatcatgtggtgtaatctaaacagtggaagtatcctttgtggcgtccatcagagtcaggcctgtttcaacagggaatacgaacagtgctttcagca

SEQ ID NO: 488907 - DNA, 313 bp, Homo sapiens
atgtaatctccacatacatcacacgcccccacacacgcagacgtagccctcacaccccacacgtatatcacacacagacatatactacacacatcacacatccatatgctcccctaacactacacacacacacacacgtgcacactccacatgcccctacatcctcccctgcgtacacacacctgcagattgtctcggcaggcccagtttgctgcacataaagcccttaccactcttgggcatctgagctggatcaagcagcccagctcctaggcctgtggtagatgtgggtatgcttctgttcctgtgggga

SEQ ID NO: 488908 - DNA, 520 bp, Homo sapiens
agagaatagaatacctaggatccaacttacaacggacgtgaaggacttcttcaaggagaactacaaaccactgctcaatgaaataaaagaggatacaaacaaaaggaagaacattccatgctcatggataggaagaatcaatatcatgaaaatggccatactgcccgaggtaatttatagattcaatgccatccccatcaagctaccaatgactttcttcacagagttggaaaaaactactttaaagttcatgtggaaccaaaaaagagcccacattgccaagtcaatcctaagccaaaagaacaaagctggaggcatcacactacctgacttcaaactatactacaaggctacagtaaccaaaacaccatggtactgttaccaaaacagagatatagaccaatggaacagagcagagccctcagaaataatgccgcatatctacaactatctgacctttccatcctagaaaaaatggggaaaacagaagaaaaaaagacaaaatcgaccataaaagacc

SEQ ID NO: 488909 - DNA, 953 bp, Homo sapiens
tggcagctcgtatttatttaaatacaaaaatactttaacatagcaaattaggcaattggtaaggataaaataacaaatactttaaaaatcatacaaaagatggccgggcagggtgtggcctcacagctgataactcccagcccttataggaggctgagggtgggcggatccacgaaggttcaggagtttgaaaacagccgtgccaatagtgggtgaacacctcatctctactaaaaatacaaaaataagccgagggtgtgggtgctacacgccgtgtagtcgcagctacatggggaaggctaaggcaggagaaactcgcctgaaccgtgggaggcggaagtttgcaggtgagcaagaatcagtgaacaagcaacaatacctcaagggcactttataattaatacaccaccaaacacagtgtggtgcctttcgtggaccacagcgagaagatcacatgtcgtggtgggtatctacagagctatgtgaagtgcgggtgcacaagaactgtgtcgcttcccttaggctaagagtgccacgatttccaaagctcttagagtaccaacaaaccaggcaagatcttttctggcaaaaaacaggtgttcgaacttttaaaaaagagggtatagaggggtctggagcgtagggggggactatgtgtttgcgtgtaactctccaggttttaatagtgggaagggcttaggagttaagcaagcgcaaaggaataggcgccagtgtgcatctatacaggcctgggcagaacgaagcgagaactcttcaaaggggggctaataatatacaccttcaaatttatgggccccaagttttccaagatgtggtaaaccctcccggttgaaaaaaacacacggtatccaacctccctttattattagcccttaatatgtattgccaagagcaagcgtaatcttcttcccaagagttggaacgttaaacga

SEQ ID NO: 488910 - DNA, 118 bp, Homo sapiens
gacagcattcaagattatgaaagtgttacaatgaccgcttcaagtactgcgaaaacctcaaaacgtagccgacttgacaaatatttgagttttacggcagatttaaaatccatctggc

SEQ ID NO: 488911 - DNA, 309 bp, Homo sapiens
ctgacacttgttgacccaaatagtactgtctcccagcatactccatgtaatcagatttgtgaagttctatttcatgctgtccaaccaagacatcaacattctacattacgagtagatttctcggatccagaggctttgagcacctatataggaggaagggcatctttgatgagattttcttggagactttgtttcttctagttcctttattgtagccctctggtatattttcagcattgtagcaggcaccccactcttccatcctattctgatttgaactcttgtaatcagtatgggcatcctcgcttc

SEQ ID NO: 488912 - DNA, 200 bp, Homo sapiens
actcttgagaaataagtaaaatactcctattttcagtatctgtagcacctgaaataggtctttgtatagccagaacaatgttattttgaagttagctttctttgtcaacagttttggcaataaaaatcttaagtattacacttgatattctactggggcccttcaaacttggttgggagaattcacccagatatctacat

SEQ ID NO: 488913 - DNA, 136 bp, Homo sapiens
ccttttcttcaccgattcaggtctcatgcagcccgtcaggaggaatgacagcagctcctgtagagtcatgctgctggtagcccagcaaatgggatgcaaaatggccaaccttgttctggaacacatgtggcaaaat

SEQ ID NO: 488914 - DNA, 363 bp, Homo sapiens
taaagatgtcatttcttccaaagattagatgcaattcctatcaaagagtcacagcatagatctgttctagatacagaaaagtgtatactaacaatttatctggaataggacacaaggaactagtaataaccagtatacaattttgtataagcgaaaataaaaggggctaatcagtcagtgtacctgacttccgagaagctctattatatagctaatagtgatcaggacaatatatgatcagctgggggacatacgcagtatcaatgacatacagtagaaaatgcaaaaagtgatgaacagatatgtccatgtgatttgtgagagaggtgcataatatcttcagtggtgaaccaataggctttt

SEQ ID NO: 488915 - DNA, 476 bp, Homo sapiens
ttctcctactgtatctagggagtggtggggactgtggcggacagaggaagcccatggcccagctaaagtggcggccactgctcagctctggttccttgtggccccttgttgtggggagggtgggcagcccaatgtttctctttatagagcagctggagagctgggttttatatcaaatctcccaatttccaaattcaatttataaaaaacatacgtggcgtgaaaaacaatcaaagactaaaaaactgccatgaaccagagaccagggggatacagcaacgagacgcagtggggtttgcttgattggatctcgggacggaaagaggacagaaatggaaaaactggtgaaatgtaaatgacctctggagtttagttgatagaaacataccagtgctggtttgttagtttgcaccatgcatcctggtgatggaagatgttaacaatggggaaatcagttgtaggatacagtagggaga

SEQ ID NO: 488916 - DNA, 298 bp, Homo sapiens
cagcacatctgcacttgtcagccacagacgcaagaggcttcagacgccagagagggacctgctggtactgggacaagtgcgagaactggatgaaataaaccatttctccctcctctgtctggaaacaagcctgtgatgggaatctgaagggctggatttattcctgggtttggctgctttaaacctgtggtccctctcaagcctcagtttccccacttgtcagaggagagtgttctctgccctgcagcactccctggatgataagatggtggctgttcggagtccccaaagaaaagtc

SEQ ID NO: 488917 - DNA, 141 bp, Homo sapiens
cgtagacgagttaagtcctcgtctgacgtgagaggtacgacgactaccatcgacagactaacggaccctatcttgggatacttcagaccccaaaaagccccccccttcccggaagtttacttagcccgaaccatcattaag

SEQ ID NO: 488918 - DNA, 398 bp, Homo sapiens
ctgatacccggtaagagcggtccatgtattgtccatttaattctcaaagtaaccctgtgagatggtctccatcccaaacttacagatgtgaaaataaatacaaacaagtcagataattttctcaaggccataaagacagtaagggttcaaatgagatttaaacataggtctcattgctcagtgggtaggtcttagttaaagtaaaacctcatggagtggagttcccgtcatggtgcagcgcaaatgaatccgactaggaaccatgaggttgcaggttccatccctggccttgctgagtgggttaaggatccggcgttgccatgagctgtggtgtaggtagcagacgcggctcagatctggctctgattagacccctaggctggcaacctccatatgcc

SEQ ID NO: 488919 - DNA, 258 bp, Homo sapiens
agggtgattatcatattcttctcaggagtacccagcaagagtttagcaaagaggttgtattcagtgagtaggggattcatgtagctctctaacaggcatctggattttgggtgctacagcggggggggggagaccaaaagagaaggatgttccacagtccttgggtgttatctcacggttggtggcctgaagaatccatcaactttttcagggtattcaaaaggtgatgaacaattgtgttaatattggcaagatcta

SEQ ID NO: 488920 - DNA, 1527 bp, Homo sapiens
gtctgtgggttgtgtgtgtgtgtggtgttgttctgtttgttttgtctgtcgtttgtacttttatatactcggatcggctggttgtgcttgtcggggcggggcctggctgttttgtgtgatctacttgtgtggacgactttggttggtgattgtcctgttcggggactcgatttcgcgggtggggttccgctgtctcccagggtggttttctctgtccgccggtgggggcccgtcccccctcgcgccaggagcttctcgcccttatggacgtttggcttttttgatgccggggggctccctcgggggttccccggtggtggtgatgttgtgtgcagacggtgctggttcttcgtgtgccttggtctgtgtgaccgccgcctcagggcttttctttgggggatctcctagagctcctcctaagagtcgttgtgtggcgcccctgtaaggttgagtgtcctggtgtcgtttggacctggggacaccttgggttttctgtttgatttccattgggcccgcgaggtatcccacccagtgccctgatgtgatggtggccccagttgggatatttgtggggtaaggaaccacccgtgggggaccctctttaaggaaccccccgctcttgggaattttaggggtcgtggaaaaatgttggtatttgggaatatagtgttgttttcccccgggaatttatgtgatatacctccgccgtggggagcctacccctcttgttcccgagggctttaactcttggattctcgtgtgtttgggcacaataaggccatgggcaccatattataggcttttggtgttgggcaccctctggggctgtgtctggcttctttttgttttcacagggaaaagcttgcgcccccacaaggataagtggtgcggacaccttgcggatataagatagtagatatatttatgtttggaaataggtttttgtgtgagaaatacccgcgagagttcgcacagatgctttggggatagatctcccagagaaccctagaataagactttttatttagagagagagtacattgggagacaccctttggaaaagacaccatatgtggttctgctgcccccatacaccagatgtgtactgtaggaagatatagtgtgaacttatagaatctctgaagagccagctcaagtgaatttagtgtggctgttttgaagagaatacaccaataatatatatagctggggccaagaaataggtgggcttgttgtgtgttgttggtgatccagtgccatgtttgtctgttcttttatatctcactgttaccattctcgttaaatgcgttcactggtacggtagagttatagagtctggtagcgtatatactgtccaaatgttgtgtttaaagagcaccaacgtggttaaaaatggtggggtagttgttgttaaaagccaattaatttgtaagagcttggttcccatagcccacataacttgcagactccccttttatgggtcatccatagggtcctatgccaatgtaaattatttgccagggtcct

SEQ ID NO: 488921 - DNA, 189 bp, Homo sapiens
  misc_feature (70)..(70): n is a, c, g, or t
  misc_feature (129)..(129): n is a, c, g, or t
tctcactctgttacccatgctggagtgcagtggcacaatcttggctcagagcaacctctgcctcccaggntcaagcaatcctcccacttcagtctaagtagctgggactacaggcacgtgccaccaggnccagctaatttttgtgttttgttagagatgaggttttgcccatgtttgcccagggtcgtt

SEQ ID NO: 488922 - DNA, 387 bp, Homo sapiens
  misc_feature (158)..(158): n is a, c, g, or t
  misc_feature (171)..(171): n is a, c, g, or t
  misc_feature (180)..(180): n is a, c, g, or t
  misc_feature (194)..(194): n is a, c, g, or t
  misc_feature (201)..(201): n is a, c, g, or t
  misc_feature (208)..(208): n is a, c, g, or t
  misc_feature (213)..(213): n is a, c, g, or t
  misc_feature (223)..(223): n is a, c, g, or t
  misc_feature (240)..(240): n is a, c, g, or t
accaaagtcaactgcacgtgttttatatttttaagagatcgtaggcaattagagatcgaagcctcctatctccacatctctgaagaagttgaggggtgggggagagaatgacttctgccttcatctgcagtaacggggggacctatatgaccttttcncccagcctttganaaacagttntaaggtgggttggnaaatttnccaaaancctgnacttcttttnccacttcaccaaccagnactgaaaaccacgcgtgaatttgggggatttttcagtggaacccttgcccccaaatgtcgaccagcccccaaatgtcgaagaattttcttcttgccaattttgttgtttaaaaaaaaaattcagggaaaattaaaaaactggaactc

SEQ ID NO: 488923 - DNA, 1116 bp, Homo sapiens
  misc_feature (119)..(119): n is a, c, g, or t
  misc_feature (131)..(132): n is a, c, g, or t
  misc_feature (152)..(152): n is a, c, g, or t
  misc_feature (155)..(155): n is a, c, g, or t
  misc_feature (162)..(162): n is a, c, g, or t
  misc_feature (169)..(170): n is a, c, g, or t
  misc_feature (172)..(172): n is a, c, g, or t
  misc_feature (182)..(182): n is a, c, g, or t
  misc_feature (203)..(203): n is a, c, g, or t
  misc_feature (348)..(348): n is a, c, g, or t
  misc_feature (354)..(354): n is a, c, g, or t
  misc_feature (364)..(364): n is a, c, g, or t
  misc_feature (366)..(366): n is a, c, g, or t
  misc_feature (381)..(381): n is a, c, g, or t
  misc_feature (383)..(383): n is a, c, g, or t
  misc_feature (389)..(389): n is a, c, g, or t
  misc_feature (404)..(405): n is a, c, g, or t
  misc_feature (410)..(411): n is a, c, g, or t
  misc_feature (413)..(413): n is a, c, g, or t
  misc_feature (415)..(415): n is a, c, g, or t
  misc_feature (420)..(420): n is a, c, g, or t
  misc_feature (430)..(431): n is a, c, g, or t
  misc_feature (439)..(440): n is a, c, g, or t
  misc_feature (444)..(444): n is a, c, g, or t
  misc_feature (446)..(446): n is a, c, g, or t
  misc_feature (451)..(451): n is a, c, g, or t
  misc_feature (454)..(454): n is a, c, g, or t
  misc_feature (481)..(482): n is a, c, g, or t
  misc_feature (492)..(492): n is a, c, g, or t
tagacaggactagtgcataaaattaatcttgcgctcgagaatatatatcgggactatcgctgagatttgttaaatctcttacatcggtgtgttctacagattctgcctcttagctgcanaagggaatgganngtcttattaaaagcctccanatnttttcanactcttnnanaatgtatgtnaatgcatactaatcatatctnatgtgaaagagttttaaagcagttgccattattcaaatacagagaaatagccacagggctagtgtttttcaaatgcattttaaagaacatggggatttttttttgtagttgtcagttcactgaccaaaaaaaaaaaaaaattcanaattanttggatcggngnaaccccaaattctcnantactcnaaaaagcggggaggnnaaccnncnanggccnggggcctacnnagctggcnntctncngctancgnaggggccaggggcggccatcagccatnncccaaaacanaagggcctgccctgtccggccagtggatggtcctgggttttacacctatctggaaaatgtcttttcccccagggtggtggaggctttggcagcgcatgtggtcgttgtcgtgtggtgtcaagagccagttaaagtccttcattttggtcagaccagaatgtggggacgctcacacagctggcattgaggaggggcacgcgcgtgcatttaagccatgtcggccactgggagggggctctggttggcccctcgggcgtcaaataccctggtgagtacacggcctaagcacagcagaaggtcttttgggcgtatcaagagaaacgtggaaacccctttggcgcggggggaggggtgaacttctacaaaataggacaaatttccctctctgcaaacttgaacagggggttgaacaactaccagcgaattgccggctacaatattaaagctagtgtctgaaaaaaaaaacgcggtgattaactaatcttttgcaaaagaaagtttcttgtgcgcctcagaacacaaaacgctggcagacagttttctcaatataaatgtaggagaaagcctggtgggggggggtacccaagttccccacgctgttgccttggtgttccacatatcagc

SEQ ID NO: 488924 - DNA, 1244 bp, Homo sapiens
  misc_feature (119)..(119): n is a, c, g, or t
  misc_feature (131)..(132): n is a, c, g, or t
  misc_feature (152)..(152): n is a, c, g, or t
  misc_feature (155)..(155): n is a, c, g, or t
  misc_feature (162)..(162): n is a, c, g, or t
  misc_feature (169)..(170): n is a, c, g, or t
  misc_feature (172)..(172): n is a, c, g, or t
  misc_feature (182)..(182): n is a, c, g, or t
  misc_feature (203)..(203): n is a, c, g, or t
  misc_feature (476)..(476): n is a, c, g, or t
  misc_feature (482)..(482): n is a, c, g, or t
  misc_feature (492)..(492): n is a, c, g, or t
  misc_feature (494)..(494): n is a, c, g, or t
  misc_feature (509)..(509): n is a, c, g, or t
  misc_feature (511)..(511): n is a, c, g, or t
  misc_feature (517)..(517): n is a, c, g, or t
  misc_feature (532)..(533): n is a, c, g, or t
  misc_feature (538)..(539): n is a, c, g, or t
  misc_feature (541)..(541): n is a, c, g, or t
  misc_feature (543)..(543): n is a, c, g, or t
  misc_feature (548)..(548): n is a, c, g, or t
  misc_feature (558)..(559): n is a, c, g, or t
  misc_feature (567)..(568): n is a, c, g, or t
  misc_feature (572)..(572): n is a, c, g, or t
  misc_feature (574)..(574): n is a, c, g, or t
  misc_feature (579)..(579): n is a, c, g, or t
  misc_feature (582)..(582): n is a, c, g, or t
  misc_feature (609)..(610): n is a, c, g, or t
  misc_feature (620)..(620): n is a, c, g, or t
tagacaggactagtgcataaaattaatcttgcgctcgagaatatatatcgggactatcgctgagatttgttaaatctcttacatcggtgtgttctacagattctgcctcttagctgcanaagggaatgganngtcttattaaaagcctccanatnttttcanactcttnnanaatgtatgtnaatgcatactaatcatatctnatgtgaaagagtttgaaagtatatagagagcaaaaactggcaggatcgtaagtgaaggtgactagtaatctaattaaaatcacctgcagctaagcatgattgaccctgccagaggaaaacatgcctatttgaccattccctttaaagcagttgccattattcaaatacagagaaatagccacagggctagtgtttttcaaatgcattttaaagaacatggggatttttttttgtagttgtcagttcactgaccaaaaaaaaaaaaaaattcanaattanttggatcggngnaaccccaaattctcnantactcnaaaaagcggggaggnnaaccnncnanggccnggggcctacnnagctggcnntctncngctancgnaggggccaggggcggccatcagccatnncccaaaacanaagggcctgccctgtccggccagtggatggtcctgggttttacacctatctggaaaatgtcttttcccccagggtggtggaggctttggcagcgcatgtggtcgttgtcgtgtggtgtcaagagccagttaaagtccttcattttggtcagaccagaatgtggggacgctcacacagctggcattgaggaggggcacgcgcgtgcatttaagccatgtcggccactgggagggggctctggttggcccctcgggcgtcaaataccctggtgagtacacggcctaagcacagcagaaggtcttttgggcgtatcaagagaaacgtggaaacccctttggcgcggggggaggggtgaacttctacaaaataggacaaatttccctctctgcaaacttgaacagggggttgaacaactaccagcgaattgccggctacaatattaaagctagtgtctgaaaaaaaaaacgcggtgattaactaatcttttgcaaaagaaagtttcttgtgcgcctcagaacacaaaacgctggcagacagttttctcaatataaatgtaggagaaagcctggtgggggggggtacccaagttccccacgctgttgccttggtgttccacatatcagc

SEQ ID NO: 488925 - DNA, 250 bp, Homo sapiens
cgtcagggagtagccgctacgaccagccgttagtgacagccgtacttatttcgcgatgattctaaagaaatattgcggcgaatacttctgtaatgatccgctcttcgctaaacatgagcagtccagccaacagataattccttctattactgctgtttcttagctttccccatgctaccgattttgtattacacatattctttcgtttcaacgcccattccacggatgattcggtgtctaaatgccatca

SEQ ID NO: 488926 - DNA, 246 bp, Homo sapiens
tgatacttacatcctgatgacttgtaacctgaaatcttgacatttcagcaacattaagtaggattatattcaattttcatatgcttacatttttcattgggcagtaaagctgagaacacatcatcctttcacactgtacgggctaatgatttccattgtgaaatagccccaagtatattattaaccttttgggtagctgaagtttctgatgcctgaaatgtgtatctactgaatggcgttagttat

SEQ ID NO: 488927 - DNA, 449 bp, Homo sapiens
tctagaggatcgcccgctgtacagttgcggggggagacgcccccgcgttctcgtgtgcacccgctcggcccttgcactttgctttaactgcctgggcgccctctggctccgttacttcgggagcggtgccgcctccgtgagctcctggtgtccgcccactggggaccggggacgctgctggggcgcacgggttggagaacgcgactcagcctgagcccctctcacggttggggctagggggtgagcgggggcgtttggcaagcagctttccggcgaggactgtgccacccgtcaggctgacgctggtatgcgtggggccaggggtgtggccggggctttctgaataggtgggaggtgggcaggatttcagtccagtgaggacaccggccacctcccctttcgggcgcaattggtagggggggggggtacggagctcgaatccggatcat

SEQ ID NO: 488928 - DNA, 329 bp, Homo sapiens
tgccactcactgggcactgcgaaggccatgactgaagaattaacagctttccctcaggcgcaggaccaggtgcagggtcgagtctttctggatggtgtagtcagaaagagcgcggccatcttccagctgcttgcctgcaaagatgagcctctgctggacaggagggatgccttccttatcttgaatctggaactagacatattggatgttgctactgggctccactttcagagtgccggtcttgccgagtgagggtcttcacgaagatctgcataccacctctcagacgcaggaccagatgcaggttctacttcttctggatgttgtag

SEQ ID NO: 488929 - DNA, 112 bp, Homo sapiens
gttatcccactatacagtcattgacagttgtgaaagtctattttatgacctgtaaatctatttctacagaatataagaaacatcactgacctgatctgtacttcctcctcct

SEQ ID NO: 488930 - DNA, 240 bp, Homo sapiens
acccaacatcatgtaagcgctgtaacggtgagtactcgagcaggagatctactttaactggtctctgcgcatgctcctgcggcagccactcgggcttctggttatgtctcctgggggaccacctgcatgagcttctgacacaggacggccgtggagaagatgccctggaggagccacttgctcttgtttgtccaccagaccctgaagaagtagacttgcagcccgctgaagatgttggga

SEQ ID NO: 488931 - DNA, 524 bp, Homo sapiens
  misc_feature (49)..(49): n is a, c, g, or t
  misc_feature (105)..(105): n is a, c, g, or t
  misc_feature (118)..(118): n is a, c, g, or t
  misc_feature (131)..(131): n is a, c, g, or t
  misc_feature (137)..(137): n is a, c, g, or t
  misc_feature (139)..(139): n is a, c, g, or t
  misc_feature (141)..(141): n is a, c, g, or t
  misc_feature (145)..(146): n is a, c, g, or t
  misc_feature (299)..(300): n is a, c, g, or t
  misc_feature (308)..(308): n is a, c, g, or t
  misc_feature (312)..(312): n is a, c, g, or t
  misc_feature (314)..(316): n is a, c, g, or t
  misc_feature (321)..(321): n is a, c, g, or t
  misc_feature (335)..(335): n is a, c, g, or t
  misc_feature (338)..(338): n is a, c, g, or t
  misc_feature (352)..(352): n is a, c, g, or t
  misc_feature (355)..(355): n is a, c, g, or t
  misc_feature (358)..(358): n is a, c, g, or t
  misc_feature (369)..(369): n is a, c, g, or t
  misc_feature (375)..(375): n is a, c, g, or t
  misc_feature (378)..(380): n is a, c, g, or t
  misc_feature (404)..(404): n is a, c, g, or t
  misc_feature (407)..(407): n is a, c, g, or t
  misc_feature (429)..(429): n is a, c, g, or t
  misc_feature (457)..(457): n is a, c, g, or t
ggggggggggggggttggggggggcttgggggggggggtgggggggggngggggggtgtgtggcctcctgtagcagggcgctcttaacagactcaggtgtaaggnttgggtcccttgntacatcacaaatnagtttnangngggnnttcagtaagaccacaagtctgcaggaaactctgggccaagtatgttgcatgagaagttttagggtttccaatatcttcagtctagcttcctcctcaggtccatcataaacctccagataaccaatgatgactctctccagcctctttaagtgnnggggagtnaggntnnncaacntgttcacgaaagcnggnaggtttcttgcgtnggnggngggtaaaagangggggnggnnngggtccatgtgggtgggggtgagnggnagacctcatcaaaatgggtggngggtggggctccatctcctttccagtgnggggttttctccaggatggggaataaatccagcagacacaggagcacagcctgaatgaggtggtgct

SEQ ID NO: 488932 - DNA, 1062 bp, Homo sapiens
  misc_feature (392)..(392): n is a, c, g, or t
gatccttcgtcgcgcgatagtagtccacacaccggaggaaaggtcaagggctgctgtatggtagtctactatagctgaagctagtcttgatttgtcttactccgcgaagcctggcataggaaatggcatagtctcgaatagcatgctgcaagcttggaccaaagctgaggcacagagagatccattgaatccttagcactaaccaagtataacgaccgagaagtggtacttttggtaggagacacgcgagtgccgtgccgggacttcctgcgtaagacctagactcgccatgctcatgtataccagcaacagaggctttaggtacattctcccaaggagtgtgctggatgtttagcagactatagattgcctcgacagagagaggtgcgtgncagctcacctgagcgctctcgtgctgactgttcccgtttgctgccagcgtgcaggagttcactgctgcctgatataccacgaatgcctccctgtaaccggaaacgcgcgatcaatggactcttcgtttcgcaaaaggcaaagcgtaggctatcctccagcttggtccgactgggaccgggctctacctagtcccatattggagaagggactgctagtgcgttggctccaaatgagggagacgttggggcaaacgcgggtgctgagtgcgctcgcttctgtgtggtaggccattctccccaggaggaggcctcgatccagggcgctttgttccctcccgttggaacagggttgtcgcccgaagattttgcacacttgcactcttcagttgtctcgacctgaggtgcgacgttgtaaaagcccaaccaatgtttgttgaatacccccaattctgtaatctcgcctggtgttaggccacctgtaggtggatagcatggcacagtcctataccttggacagtgtctccgacgtcgaaagcacccattgtgggggttcccgagaccggtttgttcggtccttttctcaagacaccgtgtgttagcaagagggcgaccctacgaaatgttggcagaggccccatatgcgcccaagtggcgtgaggctgtaagggga

SEQ ID NO: 488933 - DNA, 252 bp, Homo sapiens
tccgacggtatcactgttacaggtcaccggtggcatggctctgcgctagcagctggcacgagggcgtgctcggaagagcgctccggccaccggcggttcaagaagccccatcgcgggtcggcctggtacagtggctctccgcgagattctgccgctaccagaagtccaccgagctgctgatcagaacgctgccttttcagccgtcgggatgcgtgacgactcgcgcaggaccttcaacgacccgaccttgcg

SEQ ID NO: 488934 - DNA, 578 bp, Homo sapiens
  misc_feature (540)..(540): n is a, c, g, or t
tgcactctcttctctgagcttcccggaccccaacatccctctccagggacagcctgttgagaaatcttcgtggagtggtggaccagaggcgaggagtttaaaagttggggcttgaaagacaggaagatacgatggcttcctcgtctggcaacgacgatgatctcactatccccagagctgctataaataagatgatcaaaagagactcttcctaatgtccgggtggccaacgattgcccgagagctggtagtgaactgctgcacggaattcattcaccttatatcttctgaagccaacgagatttgtaacaagtcagaaaagaagacaatttcaccagagcatgttatacaagcactggaaagtttgggctttggctcttacatcagtgaagtaaaagaagtcttacaagaatgcaagacagtagcattaaaaagaagaaaggccagttctcgtttggaaaacctcggcattcctgaagagggattattgagacagcacagggattatttgccaaagctagcagccaccagcagattggncccacaggaatggcttccaatgcagcagcagctccaac

SEQ ID NO: 488935 - DNA, 416 bp, Homo sapiens
gttcccagatgtgtagaggaacgtcatatgatagtcgggatggggatgatatacgaatctataaattgacctaggacagtctggccatgcatgatatgattcttcctacccgtgaggatggaatgtccctccatttgtttgtatcctcttttatttcattgagtagtggtttgtagttctccttgaagaggtccttcacgtcccatgtaagctggattcctaggtattttattctcttagaagcaatagtgaacgggagttcactcatgatttggctctctgtttgcctgttattggtgtatacagaatgcttgtgatttttgcacattgattttgtatactgagactttgctgaagttgcttatcagcttaaggagattatgggctgagacaatggggttttctagatatactat

SEQ ID NO: 488936 - DNA, 424 bp, Homo sapiens
ttcacgtgcaccacgtcatagatcctagggtgcatctctcatgtgcgtgatcatcacgcaaatctgcactaggttatcaccgctcagtcactcatacacaggttgctagtgtcgaacttgataataatcgataatcttgccattctctaaatcaatctgaatggtatcattcaccttgactgacgggatcggggatagcggattggttgcgggcatcatgagtcaccagatgatcggattccttgtgtgcccatcaaagatctttctcactttgcacaacttgtacttgacctcctcaggttgtatacgatgtacagcaaaatgcgaccctgtgtgtcttacattttactgtttttatctcccgtcttggtcatgctgatgacatccaatgaatccagcaggggtaggttatttcagttcggac

SEQ ID NO: 488937 - DNA, 183 bp, Homo sapiens
  misc_feature (11)..(11): n is a, c, g, or t
  misc_feature (30)..(30): n is a, c, g, or t
  misc_feature (83)..(83): n is a, c, g, or t
  misc_feature (116)..(116): n is a, c, g, or t
  misc_feature (124)..(124): n is a, c, g, or t
  misc_feature (132)..(132): n is a, c, g, or t
  misc_feature (170)..(170): n is a, c, g, or t
tctaatagttntgtaacagtatcgctcatngtggtcttattttgatgtgaaacatcttttcatgtgcttttcgtcatcctttntagtaaaatatctcttcctatctttcgtctatnctctaatngaatattnttgttgttttactgtatgagttatttagagttcattanatactctagatat

SEQ ID NO: 488938 - DNA, 1222 bp, Homo sapiens
cgtggtgcagccatcaatgaacaaaggagagctgagctgccatcgcagggctgaactctgcctccatccatccaacccgccctgaccgaagtggaccctgacaccatcctgaaaggcactcttcaagtcctcaggggccatctggtgaccacgaccagcccaccagacattcgagaaatcgacagctatgtgagccagtggtgcagctcgcaggcatgccagcacagttgtggggccagcagtgcagggttggctctagtttcccccaaggccaaagcttcatgcacctaatggcgcccatcggcactggcagcaccccgtgatctgctggcgcaagggtatgccacagaggcatcacaagcagctatcactcgactgggcatagggcaccaccaggccgttcacgatggttgctactgatggctatcctttgccccacactgattggcagtccatatacatacgattcgataacagggattttaaacacaggtaagaacacataggagttaaaggatacttggctaacaccaatattccaactacattacaacattccgggacggcacaacagggggctaaaggcgcccatatagcagatggttacagtatatccaggggatagcataggattggcccataccccccactgcaccggccactctaaggacagcacccacaacaggaccttgaacgtcatagtcgattttacttccacagggggagacaccacgtggggatcaacccaaactactgggaaaaacactcactccttccataggagaagagatgtaggacaatatcatccatgtggagttggacgacaccccccaaatatggcggaagaccattgagcaacacacacggatagaggacgtggccaatggcatcccattcgacaaggtgggaaaccacacccgatgggagacaattacacaaacatccacaaaccgagggggtagaacccacgtaaacaggggtaggggaccaatgggaccaacttatataatctccccatttattaacgggcatgaagatatagaataacttcttcaccaggggccttaacatcacgacgcacaaaaacaaccaaaaaccgtcagggggaaacgacgggcgcgcaaacatcgtcgagacgacacaggacacaccgacgacagggaaggcgattgacgcatccccccatttcggacaacacgtgccgtggagacaagtcacccca

SEQ ID NO: 488939 - DNA, 308 bp, Homo sapiens
tgatcgagctcggtccttctttgatcaccaccacagagaccaccttcacacagatcctccatagcttgagttctgccatcatcaccactgagaccaggtcacacagtcctcccatctttacttcttcgatcaccaccacagagaccacctcacacagtcctcctagcttcacttctttgatcaccaccaccgagaccacctcacggagtctcgctgtgtttcccagagtgcttcgggagtccttctctagatctagctgtgcgcgtgtgcactctgttcacatgtgcgctctctgttttcacagtctc

SEQ ID NO: 488940 - DNA, 1102 bp, Homo sapiens
tgctgctccagcgcggtcttatcggagttgcgcacaaaaattgaccccactattgtgccgggctgacagaatggtggcggcaagtacttggtgcagtcggagctttacctgagatattcaccgaatcggaaatttcctactatcctgcttagacggcttctagcgtgtacgcactgaaggagacaagacacagcagcaaaggttcacaagctgtctaagaatgatcgtgctcatggctgaaccataggatccctgatcaacacggcgggacgagttagctgctgtcaaggccgacttcggctacaaacttgttcttgaccaactccagctgtgcacacgacgcgtacgtgagacccaaattgccctctagccgacagagctctcgacacaccactggcgcttctacttgcgcttgggcgtcacgataacaacgcggcagtgacaatcacagcctaacagttcccgatgcatgcactgacaagcaacttacgcagtctcaagacttaattcaccatttctgcgcacttgcgcactcttcgcgacaaccgcttcgcgaatttccctccgtctaaacgcacacccaaatggcggcttccgtctctctccaccactgcacagtcatcttgcggtgcaactacgcactttccatcaagctcttccgttatacccatttacgcttccgtgttccacacggcttaacgcgcttcactctacctcttctactgtagtctgtccctcgcctattccctatgcgagtatactaaacacatcctttcggctcacaatccctctctctcatctatctcacccccgtctctgtacacctcttagtagtctcaggcactaaatctaattctacactcacataactggtctcacaatcctactatcaccttcattaatcctcacccaaacatcttagtaaccattaaatacttcattctacccactctctagtataatcacaccactctgtcctcatacatctatatatcatatcacaaaaatcactataataacttctagactcaatcaaaagacactcatatacaccatcgattacatcctcacaattatttttattaaatctacatacagaacg

SEQ ID NO: 488941 - DNA, 735 bp, Homo sapiens
  misc_feature (323)..(323): n is a, c, g, or t
attggaagatgtgctgaggttcaggacgtagtaggagtgcctcggtctgcagtatctgtccccagtctgcgatggaagaggctgtccccgagtagacagccagcccccactgtcctggcccaccctggtctcccagcttgaacatctctcattaaactgaaaaggcagagtttgtcaccttgaatcattttgccagttcccctggcttttagggccactagcatgttctgagtcctcgatgccgccctgtgagagcaggtcgctgcgtcgcagcagtgcagacagggccacccttctctcgctcaccaatctcccctgcgggntcttacggagggtgattgaagccagcaaacccacggccagtgccggatggagcctcagggctttgcgggtattgggcttgtggcccttgttccgggacagattgagatggtgctgttatagaagcaactgtctcgaatttccccaagagcaagggcttgggtgcagatcgcctgtttaggagatgatcacaggcctaagggaatcgggagagtgatgctgagaggagtaagccccatgattctgggctgctgtacactcagggctccgtcccacctctgaggagcctgcccgaggcctccaggagtgtgcctgggaagggccaaaggcggggctctgctcgcaggggttgagggctccccagggtgttaactccctgtgctttgcttggcagagcttgtgccgcacaatgtg

SEQ ID NO: 488942 - DNA, 367 bp, Homo sapiens
  misc_feature (1)..(1): n is a, c, g, or t
ncttgaggatccccttacgaaaaggctgggcacggtggctcatgcctataatcccctatttttggctcatgcctataaacattttgggaggctgaggtgtgaagatcatttgaggtcaggcgcttgagagcagcctgggcaaaatagtgagaccctgtttctataaacaaacaaacaaacaaacaaacaacatgctgggtgtggtggctcatgcctgttatcccagcactttgggaggccaaggcaggcagatcacctgaagtcaggagttcaagaccagcctaacatggagaaaccccatctctactaaaaatacaaaattagctgggcgtgatggtgcatgcctgtaatcccagctactcaggag

SEQ ID NO: 488943 - DNA, 271 bp, Homo sapiens
cagagacaaaatctttttatctgaggaatttaaaagggagcaaagaccacctggtgactatcaggccatgcagaggcaaaatgccttatttggggaaaattaaaagtaattagactttcctattatctaaagcaggcatctggttccagatttcttttccccgaaaaaaaccttagaagtaactaaaatttctgtacatctccggaatgccatgctgaaactcactgcaaccccacggtcccgctttaaggtccataaatatccctaagga

SEQ ID NO: 488944 - DNA, 128 bp, Homo sapiens
  misc_feature (62)..(62): n is a, c, g, or t
cgaagtgcaatggctggggtaattgtcacagtagcaacaggaaatcagtacaagccctgganctggccattcttcatgtcccttcccaagctccaagcccacatgggcacttgccaagatcagagctc

SEQ ID NO: 488945 - DNA, 891 bp, Homo sapiens
aaacagtatgcaaaaccctgttgaaaaagaacaatatgaccagcactttgcgaggctgaggtgggtggatcacttgatgacaggaattcaagaccagacctggccaacatggcgaaaccccgtctctactaaacaataaaaaaaattagccaggtgtggtggtgggcacctgtaatcacagctacttgggagtctgagacaggagaatcactcgaactcaggagtcagaagttgcagtgagccaagatcgcgccactgcactccagcctgggccgacacagagagacttgtggcgccgggaggagggaacgatatgggaagattgctctaccaacgtataaacactttttcataaagccacagtcaattcaggatagggtctctatctgagacaagacggagcaacaaagcaagactggccacatcacttgaattcataaacagtcccattcgtatatctatatatatatatatcatagtgaggtgactccgagacgttgtgcagatcacgtagtacatatgcaccataattggaaaaaaggtaaagcacgaaacagatggtttggatggagaaaagctgctgcctcctaataattcggaggaccttaacgggactaataaagtattcaaatactctgttgtttctgcaacaggatgatagcaagccatagtcctcagaatagataaaacgaacatcatggccttccccgcagtggcactaactcttgatcaggccaagacttccttttggaagatatatagacaagtatcatctaactctacgagagtttcatgtggcaactgtacacacaatatcataaacacacaaactgtatcgcaacagcatcaaatagtttaacagatctggtgcgcgacgcagatataatcaag

SEQ ID NO: 488946 - DNA, 290 bp, Homo sapiens
gggtgatctacaggatctccagtcttgctcccatcagatcagtgctcttgttgcttcctacatacacacacttttagaaaacaggtgccacttttaggcagggcacggtggctgatgcctgcaatcccagcaccttgggaggctgaagcaggaggatcacttgagtccaggagttcaccagcctgggcaacagtgggaccttgtctctacaaaaaataaacaaaattagctgggcatggtggcgggcacctgtaattccagctactcaggaggctgatgggagaagatgg

SEQ ID NO: 488947 - DNA, 519 bp, Homo sapiens
  misc_feature (2)..(2): n is a, c, g, or t
  misc_feature (72)..(73): n is a, c, g, or t
  misc_feature (100)..(100): n is a, c, g, or t
  misc_feature (127)..(127): n is a, c, g, or t
  misc_feature (135)..(135): n is a, c, g, or t
  misc_feature (141)..(141): n is a, c, g, or t
  misc_feature (147)..(148): n is a, c, g, or t
  misc_feature (154)..(154): n is a, c, g, or t
  misc_feature (157)..(158): n is a, c, g, or t
  misc_feature (160)..(160): n is a, c, g, or t
  misc_feature (163)..(163): n is a, c, g, or t
  misc_feature (167)..(168): n is a, c, g, or t
  misc_feature (170)..(170): n is a, c, g, or t
  misc_feature (175)..(175): n is a, c, g, or t
  misc_feature (185)..(186): n is a, c, g, or t
  misc_feature (190)..(190): n is a, c, g, or t
  misc_feature (193)..(193): n is a, c, g, or t
  misc_feature (198)..(199): n is a, c, g, or t
  misc_feature (201)..(201): n is a, c, g, or t
  misc_feature (214)..(214): n is a, c, g, or t
  misc_feature (216)..(216): n is a, c, g, or t
  misc_feature (218)..(218): n is a, c, g, or t
  misc_feature (226)..(226): n is a, c, g, or t
  misc_feature (228)..(228): n is a, c, g, or t
  misc_feature (231)..(231): n is a, c, g, or t
  misc_feature (242)..(242): n is a, c, g, or t
  misc_feature (245)..(245): n is a, c, g, or t
  misc_feature (250)..(250): n is a, c, g, or t
  misc_feature (258)..(258): n is a, c, g, or t
  misc_feature (264)..(264): n is a, c, g, or t
  misc_feature (267)..(267): n is a, c, g, or t
  misc_feature (270)..(270): n is a, c, g, or t
  misc_feature (276)..(276): n is a, c, g, or t
  misc_feature (280)..(280): n is a, c, g, or t
  misc_feature (282)..(282): n is a, c, g, or t
  misc_feature (288)..(288): n is a, c, g, or t
  misc_feature (294)..(294): n is a, c, g, or t
  misc_feature (301)..(301): n is a, c, g, or t
  misc_feature (304)..(304): n is a, c, g, or t
  misc_feature (307)..(307): n is a, c, g, or t
  misc_feature (321)..(321): n is a, c, g, or t
  misc_feature (330)..(330): n is a, c, g, or t
  misc_feature (342)..(343): n is a, c, g, or t
  misc_feature (349)..(349): n is a, c, g, or t
  misc_feature (406)..(406): n is a, c, g, or t
  misc_feature (413)..(413): n is a, c, g, or t
  misc_feature (447)..(447): n is a, c, g, or t
  misc_feature (518)..(518): n is a, c, g, or t
tntcttccctgggcggccccggccccggcctcgccccccatcccgggctgcccctctgggcccccgcctggnntgggctccctgggtcttttcctttttnttggggaacttctggtcacaaaggcgncccctgcntcgttncttttnnctccgnttnngnttncgcnntngtgtnttggctagcnntttnttnttggnntnggggtactggtcntntntgggcgcntngcnctccgcttggntgnttttntcgttgtnttcttnttnttntttttntttntntttttncttttnctggttngtngtnttttttgggtttcntgtggcttntttttttttctnncgtttngttctttcttttgctctcctggttcttctttctttgggttttgttgttctttttgcnctgttcnttctgggcctgttgggttgcctctgcgccttctnccgcagcttcttctccttggcttcccggctggcctgccgctcctcctccgtcttgctccccaaactgtggna

SEQ ID NO: 488948 - DNA, 115 bp, Homo sapiens
ggcctaggatgttgaaaaaaactatgggtttttcccccttttggccctttccctttttaggaaggtttttttttaagggccagggcccccccaataaaggaatgttttttcttta

SEQ ID NO: 488949 - DNA, 113 bp, Homo sapiens
tgagctggatacgcgttgtgcacagattgcctcatgatctcgtaaggattaagtgactcattcaattacggtctcgaaagatctgtattgtatttttcgcactactcccgggt

SEQ ID NO: 488950 - DNA, 569 bp, Homo sapiens
  misc_feature (531)..(531): n is a, c, g, or t
  misc_feature (543)..(543): n is a, c, g, or t
ggtggagagggggtctcaccaggtggccaggctggtctcgaactccttgacctcaggtggtccaccggtctgggcctcgtagagggtggggattacaggcatgagccaccacgctcggcccagtccagactttttaactaccgggccccactgcagacacagttccctctagtccttcccagagttacaagaagagaactccagtagccttattcggtcagggacgagtggtttaccccaggataaggtaggatatcataaattcttcttcaaaggttttagccggtaattggttaagtacatggagttcggagatcctctccaaagaaccaaggtatcagtatgttcagctcaccggtgcttggttcttcattttaacttttaatttcctcattctttatgtctcctggcccctagtttcagtaaacaatcccctcctagcctcggtcaccggctcggaccggagtcacctttagtcaccgggtccgtaaccatcttgccggtctaaatttctcaccccaccagtctggnttatacccctgntctctttaaaatacgcagtcagaatt

SEQ ID NO: 488951 - DNA, 194 bp, Homo sapiens
catgaccaggcaaacacgtcaatgctacttattcataaggcccagacacatagagttcctctccaaagcctttcctgaaaccctgacaactgactgctcactgacctcttctatagcgtgcatgtgtgctgggccttatgaattagtaggcatttacgtggttcggctgagtcagtggcggacccggcgctgat

SEQ ID NO: 488952 - DNA, 353 bp, Homo sapiens
ccttaagacagagggatagccgagagtgtcgagcagacagaggacaaaagagcagcgagtcaggctgatcggggcgatctacccaaagaggggacagcgatcaaagtgaagcgaagggcgggcagtcctggtggggctccagggtgcatcccagttgtgccacccatgccttcatcctgtgctaggcaggcggggagaggaaagcgcagactgcacggtcccgggcacgtcctcggcaggcagtggccttgcaattggccggccctactcaatgcactccatgacatgtatctgcagggtgtccatatcaggggcctgatactggcacttgggacagcagaagtcaggtggct

SEQ ID NO: 488953 - DNA, 105 bp, Homo sapiens
gctgactagaggatcccgggctagggcatttttaatcttagagcgaaagctataatcactgcgccgtcatacagggatggcatggtaggttatagatagttgggt

SEQ ID NO: 488954 - DNA, 588 bp, Homo sapiens
tcaatgtgaagacaacaaagatgaggaacttcatgactgtccactttcacttaatgaatagtaaatatatcttctctttcttacaatgttcttaatagcattttttctctagcttactttattgtaagaataaagtatataataatataacatacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaagaaaaaaaaaaaaaaaaaaggagaaaaaaaaaaaagggggggaaaaagaaaaacgaaggaaaaaaaagggaggaaaagggaaaaacaacggggaagagaccccccccaccgcccaggccacacagagaggcccaaccccccgccccgggcccccccaaaagccgcgaaaaccgagcaaagaccgcggcaacaaccccgccccacgccccacccgcacccaaacggcacgacacccccaaaaaccccccgaacacccacaaaacgccccgcaacagcggcacccccccgcccacccacggccacaacgggcccttacaacgccccccccc

SEQ ID NO: 488955 - DNA, 330 bp, Homo sapiens
  misc_feature (21)..(21): n is a, c, g, or t
  misc_feature (64)..(64): n is a, c, g, or t
  misc_feature (112)..(112): n is a, c, g, or t
tgtgggtatcatcagatacangaagggtcccagcgttggggagagccccaagttgagaacagtnagtgaacaattgttgtactgaaccacttgttacgatactgctgatcanaaacaacctgtgtgtaatatgttttcctcctacacacgtagcacccttcagcaggaccctataaaactttcctccagcccttgcctctttgcaggtagccccttctctgctgagctgcccactgcaacatattttcacaatttctctaataaatctgcccttctttacctacaactatcttggtaaatggctttaccacctgcaaaactgaccctagg

SEQ ID NO: 488956 - DNA, 578 bp, Homo sapiens
cgtaagccagtataatacgataaaacaaaaggtacttgtaataatagtcatataaaatcgctatggcttgcatttagaaaccaagacacaaataaagatataccagcagattgtgtcttttgagcagctgaaaccttcagcagcttccaaagattagtctcttcactgtagctgctttgggtggtagagttgccatcctttcagtattttattttacaatgtaaatagtatttcatgtatggaacagaagcctgctatgtttctttgctaaaaaaaatttaaatctaaactaatgatatagtgttacaggcaaattagtgatgtttcatactactacattactggattattttagaaacaaagataaaaaaaccttactgagcccacttcatgaacgtaaattatttaaagtacacgacttcatagagtgctttcgggcctgggagatgtaatgtggagtcaacgaataactttttaaacatttattttcagagacttatttgtgaggtccagctttggttataagtctgaattttagctctgcctggcagatcgtatgtaggttaatgaacccaatg

SEQ ID NO: 488957 - DNA, 116 bp, Homo sapiens
acggtaaacaggcaatgaatcatctgaggaaggatcagcacattgtatcttgcaggaagattggccacaggcaaaatataagaacacatctctaagccccttctgtcgtcttctcg

SEQ ID NO: 488958 - DNA, 355 bp, Homo sapiens
cgtgaatccattcagcttcctccagtccagcaacataaacacctctccacccatacatactgtacttgttgagggcaagaactgctgttttatttactaagtctattcacacgtgctttgtagtccattaatgctttacagaatgaattaatcaataaataaatgaatggatgaatactgagtaactgggccaggtacagtggctcacacctgtaatcccagcactttgagaggccgaggtgggcggataccttgaggtcaggatttcgagacaagcctggccaacatggtggaaccccatctccactaaaaatacaaaaattagccaggcatggtggcaggtgcctgcaatccc

SEQ ID NO: 488959 - DNA, 252 bp, Homo sapiens
ctgcagagggggtccatacggcgttgttctgggattcccgtcgtaacttaaaggggaatttcacaatgtccggagcccttgatgtcctgccaaatgaagggaggaggatgtccttaaggttccttgcaagcaaggaacccaactaaggtggcaccattcttgactcccagatggaccagtcacatctataaaagggaaaagtgatggcatctatatcatatatctcaagaggccctcggagacgcttctgct

SEQ ID NO: 488960 - DNA, 666 bp, Homo sapiens
  misc_feature (46)..(46): n is a, c, g, or t
  misc_feature (49)..(49): n is a, c, g, or t
  misc_feature (117)..(117): n is a, c, g, or t
  misc_feature (161)..(163): n is a, c, g, or t
  misc_feature (166)..(166): n is a, c, g, or t
  misc_feature (188)..(188): n is a, c, g, or t
  misc_feature (195)..(195): n is a, c, g, or t
  misc_feature (209)..(209): n is a, c, g, or t
  misc_feature (590)..(590): n is a, c, g, or t
  misc_feature (654)..(654): n is a, c, g, or t
  misc_feature (662)..(662): n is a, c, g, or t
cttcttctactgtcacatggtgcgcgctgttttctaatcacgtggntgncacccaggcctctctgctcctgtcttttgtttggatgccggcgctgctgcctgtggcctcccgccttnttgttgctaccccgagtcttgctgaccatggcctctggaagccnnnccngacccagccctacgccggcctncggattnccggctctggctangttccgggctcggtctctgcagcctttgttacgttgccccaacgagaaggtcgccaaggagatcgccaggccgtggtggagaagcgcctagcagcctgcgtcaacctcatccctcagattacatccatctatgagtggaaagggaagatcgaggaagacagtgaggtgctgatgatgattaaaacccaaagttccttggtcccagctttgacagattttgttcgttctgtgcacccttacgaagtggccgaggtaattgcattgcctgtggaacaggggaactttccgtacctgcagtgggtgcgccaggtcacagagtcagtttctgactctatcacagtcctgccatgatgagccctgttcctgctcatcatgaagatncccgcgatacttcaacgcctttgacttccaggtgatgactgggcccccaataaatcccgtcttnggggaatncata

SEQ ID NO: 488961 - DNA, 629 bp, Homo sapiens
aggaggagagcaggaggggagcaggagagagaggcggagccgaggacggatgggagcagacgggcagaagcgaaagggacggagagagagggagacggaaggaagggcggggagggcaggcggggatgggcggaggggaggggagacggggacggaagagagctgagagggagagagagcgaaggagagagacagagagagagagagagagacggagacagagagagagagagagagagagagagagagagagagagagagagagagagagagagagagagagagagagctcgtgccgaattcggcacgagggggagccgagattgggccactgcactccagcctgggcgacagaataagactctgttttggccaggtacgttggctcatgctttgggaggtcaacggaggaggattactcgaggccaggagtttgagaccagcctgggcaacatagtgagatcctgtctctacaaaaaaatttaaaaattagccaagcgtgcctgtggtcccaacttcttgggaggctgaggtggaggattgcttgagcctgggaggctaaggctgcagtgaaccgtgactgcgctactgtactccagcctgggtgacagagtgagatcttgtctcag

SEQ ID NO: 488962 - DNA, 102 bp, Homo sapiens
gccaggttttaggggttcggggggttgaataaaactggtttggggtttgacttttggttttgtttttccccttttaaaaatttgggcccttgggccccttta

SEQ ID NO: 488963 - DNA, 842 bp, Homo sapiens
  misc_feature (293)..(293): n is a, c, g, or t
  misc_feature (337)..(339): n is a, c, g, or t
  misc_feature (342)..(342): n is a, c, g, or t
  misc_feature (364)..(364): n is a, c, g, or t
  misc_feature (371)..(371): n is a, c, g, or t
  misc_feature (385)..(385): n is a, c, g, or t
  misc_feature (766)..(766): n is a, c, g, or t
  misc_feature (830)..(830): n is a, c, g, or t
  misc_feature (838)..(838): n is a, c, g, or t
ggccgctcttcctgggggtttgtttctcccgtgtgacgtgattggctctattgagaatcaactctcgctgtaccagcgtaggccgcatgagtggggaggacgggctcccgcggtcgctgactcggcggagtggatgagttgacacggcggccgccccgcccctgtccgggtccttcgaagcctcgaccgctactcgcacgcggtaaatcccagaggttggcctcagtgaggtgcctctctgctcctgtcttttgtttggatgccggcgctgctgcctgtggcctcccgccttnttgttgctaccccgagtcttgctgaccatggcctctggaagccnnnccngacccagccctacgccggcctncggattnccggctctggctangttccgggctcggtctctgcagcctttgttacgttgccccaacgagaaggtcgccaaggagatcgccaggccgtggtggagaagcgcctagcagcctgcgtcaacctcatccctcagattacatccatctatgagtggaaagggaagatcgaggaagacagtgaggtgctgatgatgattaaaacccaaagttccttggtcccagctttgacagattttgttcgttctgtgcacccttacgaagtggccgaggtaattgcattgcctgtggaacaggggaactttccgtacctgcagtgggtgcgccaggtcacagagtcagtttctgactctatcacagtcctgccatgatgagccctgttcctgctcatcatgaagatncccgcgatacttcaacgcctttgacttccaggtgatgactgggcccccaataaatcccgtcttnggggaatncata

SEQ ID NO: 488964 - DNA, 336 bp, Homo sapiens
tgagctcgtaccctttaggaggctgcagtgcattccagcctgggtacaagtgatgaccctgtctcaaaaggaaaaaaaaaaaaaagaaaaaaagagatttcctgaaagggagtttccttgggaccccttggtgattcaacactgttggaaaaggggaaggaagccgggatgattggagggagaagctggattggaatttaagcacaaaagggcttcattctgatttgtaaaaggagatctgaagctgagatagccctttaagattttttctcatattgggaaggaggggcacagcttgtcttacctcctgcacttgccagcctcccagggggactg

SEQ ID NO: 488965 - DNA, 103 bp, Homo sapiens
gtgcccccctgtgattggctgttccctgtcccctggcaaattccctctgtgcaaatgcaagcttgtgagatgatttattatctaacaggtacggggggtcaaa

SEQ ID NO: 488966 - DNA, 452 bp, Homo sapiens
  misc_feature (424)..(424): n is a, c, g, or t
gcgcttaaagcagtgaagaactctgtcaaggatggatattcagatatcaactatttagagtccagagggagccatggcactagaaatagttgataatgaaatgagattttatgaagtataccgctccacctaatgagcgtctgtctctgatgggcttggagatgttaacagagagccaaaagagagggaaagtgtgacaaaataacagtagatctgcagaaagttctgaggccaatcagagcttcgttaattcaaggagacaaaccaaagacgttgctgtcacactgtgcatgtgctctatctttaaggcacaatgagacccgcaattcctgagcaggtctacaaggaagtctcgttaatgctaactgaagcaatttaagaggtctttttacaggaagatgagagggcttgccaagatagaatngatgtacccatgaagattgcttgtgtgg

SEQ ID NO: 488967 - DNA, 172 bp, Homo sapiens
  misc_feature (5)..(5): n is a, c, g, or t
aggtnttgcggacagagtattgctcttgtctcacaaaaaaaaaaaaaaaaaaaagaaaatgcaaaaacaaaacccaagttcctaaggcttttgtgaaccagggaggctcacagggggcccaggaattttgccgggaaccaggctttccccgggtggggcccggggacaaagg

SEQ ID NO: 488968 - DNA, 94 bp, Homo sapiens
  misc_feature (75)..(75): n is a, c, g, or t
cccccccccccttttttttaaaaaaggggggggcaaggggatttcaacccccatgggggggaattaaattaattncccccctttttttttttta

SEQ ID NO: 488969 - DNA, 1116 bp, Homo sapiens
  misc_feature (47)..(47): n is a, c, g, or t
  misc_feature (56)..(56): n is a, c, g, or t
  misc_feature (131)..(131): n is a, c, g, or t
  misc_feature (193)..(193): n is a, c, g, or t
  misc_feature (264)..(264): n is a, c, g, or t
  misc_feature (298)..(298): n is a, c, g, or t
  misc_feature (516)..(516): n is a, c, g, or t
  misc_feature (541)..(541): n is a, c, g, or t
  misc_feature (553)..(553): n is a, c, g, or t
  misc_feature (608)..(608): n is a, c, g, or t
  misc_feature (644)..(644): n is a, c, g, or t
  misc_feature (649)..(649): n is a, c, g, or t
  misc_feature (666)..(666): n is a, c, g, or t
  misc_feature (690)..(690): n is a, c, g, or t
  misc_feature (698)..(698): n is a, c, g, or t
ggaccttcagcagggctgtggctaccatgttctctcgcgcgggtgtncgctgggcntgtcggcctggaccttgcagccgcaatgggattcaagttcgcaaatattggcaactttggaaagatatcaccagngagactaacagttccatcaaaaacatccaggaaaattaaccaagtctatgaacaatggtagncggcaggaaaaatatgccgcgagctgagagagagctgaaaaccagctcggaatattatggattggggatcntttaggctctgtatgaaaaagcgtgatatcaagngggcctggaagacaaagaagaaacacctccttatgtggtgtgtcctcagatcgaggacctgtgtggtgctattcattcctccatgtgctaaacagatgaaaagcgaggtttgctacactaacagcagctgggaaagaagttatgctgtgtgggaatgggtgacaaaatcagaggcatactttataggactcattctgaccagtttctggtggcattcnaagaagtgggaagaaagcccccccnttttggagatgngtcagtcattgcccttgaattactaaattctggatatgaatttgatgaaggctcntcatctttaataaattcaggtctgtcatctcctatnagacngaagaaagccatttttnccttatacgttgcagtgtgacagntgagtatntatgacgatattgatgctgacgtgctgccaaaattacccagaataccaatctggcccaacatcatctactactctctgaaggagtcccaccactagtgagcccgagtgcccggatgacagccctggaccatgcccagccagaatgcttctgagatgattgaccaattgacattgacattcaaccgtacccgcccagctgtcatcaccaaagagttgattgaaattatctctggtgctgcagctctggattaatgaaaatccagttccatcctcagaccagaggtaaagaaggaaaattcagcccgttgattttgtttttagcttactgctgcctttgtccgaagaaactgttcctcccttatttgaattactgaagacagcccagatatttgtaaattatcttaaaataaaccactta

SEQ ID NO: 488970 - DNA, 268 bp, Homo sapiens
tatttccctaggctgcaggcgtcatcacctacatctgcttagactgatgaggaaaaagatgtggaggaagtggacaacaaaagcagccttcgaactgcacactgggatgtcctgtgttattttgggttttttttttttttttttgggggggttttatttttccccatgaaagaatctgataaaccctaaccccacctcctctaaacacaagagagaaagttccatttgtgatgctcggggacacctcctttaggcgggtttagggtta

SEQ ID NO: 488971 - DNA, 246 bp, Homo sapiens
agctggcaggtaagataggcatcaggaagtatccgtggatgatagcgtcttcagtttaatgaggagcggtcggttttcatactccaggcaggcgcaggtgatggtgcagccatcgagggaggatccggcaccttggagaggggtcactctccgcaccccccgtcaagcgttgtagtacaccacgcgtgttctcgccgacaggatgaaccactcgctgccttccagattgtgagacatggcgcgtga

SEQ ID NO: 488972 - DNA, 824 bp, Homo sapiens
  misc_feature (553)..(553): n is a, c, g, or t
agcggagtggttggaggttgtaggaccggcgaggaataggaatcttggctggcgtgagctgtgcgttggctgttggcgattcgcgctgctgtggcgacccacgcgagcctccggggcttgcgctggctacatgtttttgcacttacgcgtgacaatgaccttgagactcgcaagactacgtccgtcatcatgactccatatggaagtgatcatgctgtccgacatgcagagatctacatggggcacacggcatggcctgataggaggagtggccgctgtggtgctgtaaggagggacgcagctggtctcgggactccagaaaatacccgtggagattgcataggctcggcactcacgaacggaagccgatttgcggggtaggagattaactactctgaccgttcttttccttccgccggagtccccgataggagatcacgtgcgctaacatattctcaagtttccccacgggacacttcccgaaataggttgaaggagcctagatgaataggtgtcaggtcgaagagatccaatcatcttcagagcagacggngcggaggaaccgggtccccatttgcacatggaggtccttggccagaggtttcaacgcatgggttccccggttgtcccaatccttgggtttcaccttggcaccttcgaagggggccctgggggtaaccaaattgaaattcaaaccttgggagctttaccttgtaccgtggtacccagaatgagctccgcttgcgattggttaaccccgggacattcgcggaaagaagggccagagaggattcttcgttgtcagcctcgcagcgattttcccc

SEQ ID NO: 488973 - DNA, 180 bp, Homo sapiens
cactcacacatgaaatacagattgtagtttattaaaaagttacgacacaaatttaccatcagaaaccagcacaattctactcctaggaacctacctcaagagaaatacaaacatatacacacagaaaaacgtatgtgactgtgcacagccagcatgattcctaaatggccaacaaattag

SEQ ID NO: 488974 - DNA, 323 bp, Homo sapiens
atatactttaagtggtggagacactgatttcatttgttctatttctcaaaagttatttcttaaactctgagtcagtgtttaattttgcgtttacttcttgcttgaagaaacaaactcaggatgcttcttgacgtcaagaagcatcctgagtttgtcctttcttttaaataatgtactgattacatgccatgtggttggtttttctaaaaaattatatttaaatgtcattttataaataggctggatgccgtggctcacacctgtactgccaccactttgggaggccacgaaggccgattgcttcaactcaggatgcttcttga

SEQ ID NO: 488975 - DNA, 370 bp, Homo sapiens
tatttatttgactcaggtaccagtggtacatatatacagtgtaattatgaccaggctggtaaaattggctgctcgcaaacaatccccttttttcctggcagtatttggaatttatcatttattaataactatacatttttaaaggcagaagaagaaaatctatctatcatctatctatctatctatctatctatctatctatctatctatctatctatctatctatctaaatgacctgacagaagaaaactgttaaaaatggatattattggaggggatttaaaacagtgggtgtgaattatcattctgatggaaagaaaatagcaaaacaatgtgttacaagtatttgctaataaacagtatactgcca

SEQ ID NO: 488976 - DNA, 120 bp, Homo sapiens
gcagaggttgcggtgagcgagatcgctccattgcacttgaacctgggcaacaagagcaagactccgtctcaaaaaagtaaataaaaataggaccaggcgcgggggctgaggcagtcgaat

SEQ ID NO: 488977 - DNA, 204 bp, Homo sapiens
cgtatatgctgtctcaaaaaaacattgttggtagctgttttaaaaagattacagttttcacttaacaactggcaaaaaaaaaaaaaaaaaaaaaaaaaattcctggtttggccccattggcattatggtgaaaacccggcattttttggtcccgccaaagttccggaaccctaggggttttttgtggtccccccagacccccac

SEQ ID NO: 488978 - DNA, 850 bp, Homo sapiens
gctgcgcggcgatgctgcagttcgtcctgggccggtggcgcgggcctggcttcggcctaccgtgcagccagtggcctgatgttctcctgtgctgtgaacgatgtgcatgctgctgtgctgacctgagaaccctggatgcagtgtgtgcgatgctgatgggtctccctgtgagccctgtgcttgctgcaaatgtctgatgctccctggtacccactcatctgacgcccagtgcaggcctgtggtcagagtccttgctggggcttcgagcaggagctgctgtgggcctggcctgacctgcaccccgatgttttcgccacctgcgcccaggctggacatacttgcaccagtgttgctatcgtgtgcacgcaagaacttcaagacgaattagctattgccaatgaccaagactgatgatgcctgaggtgcgtgggcgtgtggcctggaagccttggccgcagaaatgtgcacttgggctgtggcccggcatggcagcatcctgctctccgctctggcgaggacggaggtgttgcccatggcccccggtggccccacaaagttactactacatgctgcccatgaaggtgcgggcgctgggtctcaaagtggcactgacctgtcaagcttggcccaggacgagctgcacatcatggactccctagagctgccaccggagaccacagtacctgacagagctggtgcacttaccgccgctggggggactccgtactcctcgtggacttaacacacgagggagatgccaaagaagcatcgtggaggccactctagcgcttaagaccttcaagttgatccgggtggtggcctaatggtgcacggcattgtcaggcgcaga

SEQ ID NO: 488979 - DNA, 314 bp, Homo sapiens
agcacaggtaaccaggaggagcaggtcccccaaagccaggctggagatgaagagattgggcacgttgcgcatggacttcaccgtacagaagatcttgatcagagatgatgttgccaacgaggcctatcagaatgatgaccccataaatggcagggatgacatagaagaccccggggtggaaccagtcgtcgttcgtggggagatccacactgagattagagatgtggcagtgcacgaaacggtccgcttccaagtccagaggcaaacagtcattcagagccatcctccagattcggtctcacctaaaacgtgtc

SEQ ID NO: 488980 - DNA, 881 bp, Homo sapiens
gtctctcctgctctctgctctgccagcgcgatgccgcgaccggcccctcgcagctttccggagcatggcctgtctggatcgcaccttcatcgtgatgaagcttcggaggtgctggctgcagcggggtctggtgcgggagatcatcaattcgctccgatgagaatggattccgcctcgtgggtctgggagtttgcctcgcgtggccccgtcttgaaacgtagacaacctgaagacgaacagctactattgggaactggaaatgaaccgagccagttactttccccctgtgggctgagttgcagaggtcacatgacatctcatggcgcggatagtaggtccgagtggtctaggcggacgtgcgagctcgtaaactgtggctcggatacgtacagggccgcagatgtatcgctttggacgacgaatcaacttccagggatgaactagcaaaaagccgagggcaatcactattccccgggggcggtactttatttgcaatatctacgtgctctagtgcaagagtaccctagttccaatatcaactgagccaggctgaattccaaggtatataattgtggcctcgtataggaatagagaatctatgcctatcgagttgagcgccctgaatgaacgggttggctagaagtcttgttgctccaatgacttggggtctatgacataagcatggtcggcacaccaacatgctggctccctgcaggcattggcgctggattgttggtgcccgggggacgacacggcactgtcccattgcctatttgactgtggatgcaaccagtggattggatcatgctaaccataagaggccatagctgtgcactgaaagctctctgggcacgtccggcacaaaaatgccccattgggtg

SEQ ID NO: 488981 - DNA, 430 bp, Homo sapiens
ttccgtcaactcagcctaactttccccaagttataaaacttgagatcatgtaatccacaaagcaaagaagcaggctctaggattaacacaggtggcataagtggaataaaagaggggagggagattttacagacaatctgccagagaaaacatgacaacatgattatggctttgtagcatccttctggacttgagcagattaggagacctgagaggctgaggcagacaggggcaagcaagacctacaagatgacaaagcagggggagctcactctgggccaggtcactttcaagtagctggggctgcaacacagaacatcaccactggccctgagagcacatttagctgttttttgcaggaaccacgggattgagacagtggcagaaccctcactggagaaaaaggaagatgacagaaagccacactgac

SEQ ID NO: 488982 - DNA, 157 bp, Homo sapiens
gagatgtgcaataaatgagagtgacctgactgataaaagggacagaaaaaatgacttagacactctgagcctcggtgcctcaactagtagggttgtggctttcgtacaggagcccattggctgaaaagcagttagagggtggagaccgttgggctaa

SEQ ID NO: 488983 - DNA, 642 bp, Homo sapiens
cgccccgtgcagccacccctgtttgtcgccggggccttattttggggtgattcttccgttgtggccgcccacggttactgtgttgggacgggccgcgtggtccccggagtagtctcttatgttgtagccccccgggtgtagtcgccgcgtgggttccgctcggtggtgcctccggcagtggttctgcggccccgcctatgttctgttttggcgcccgggtggcctccgcccggatcggctatggtgctccctctgtctcacacataacagatatagagaaaataaatgggttccccccaaatgtctcggttttcctctcaaagaggggtgtcgccccctgggcgcggcgcccctactggggtttgatgcgtctccccccacggaatatttcaaaaagtgagaggaatttctcacaataagcgcgcatatctcgccgcggatacgtggctgagaagggggagtaattctaccaccccacttcccccggaaaatccaccagtttctttagacactttttttactcttttattgccccccctcttttgtaaccttgttgcgagaaaagggataaaattttttttgaaaacacacatccacagttccccggtgcggttcgaccccgaacatccattagtacgaaaa

SEQ ID NO: 488984 - DNA, 176 bp, Homo sapiens
ggcttcgtgaactcactgatgtatctttttgtagatgttagatgtggaatttctgggtcaaagataaacacatacataaacttttctagagcttgcccaattccctttcagagggattgtaccattttgtattctattaacacattagaatgcctctttcccagtctcacggagag

SEQ ID NO: 488985 - DNA, 375 bp, Homo sapiens
cacgagggccaaggtcatgggccgatcagcagcagggcagccgagggtggtgatcctgggcggcgggttcgccggcctggccgcagcccgcgcgctcaagggcgcgccctgccgggtgaccctggtggaccgccagaaccatcactgtttccagcccttgctctatcaggcggccacggcggcgctgaccgccaacgacgtggcctggcccatccgcgaaatcctgggacgccaggccaatctcgacatcctcatggacgaggtggagggcctcgatcccgaggcgcggcaggtgaggctgtcgggcgggacgctggactatgatcggctgatcgtcgccaccggcgccagccacgactatttcggccatgacga

SEQ ID NO: 488986 - DNA, 675 bp, Homo sapiens
  misc_feature (520)..(520): n is a, c, g, or t
  misc_feature (534)..(534): n is a, c, g, or t
  misc_feature (582)..(582): n is a, c, g, or t
  misc_feature (602)..(602): n is a, c, g, or t
agagtccaaacattagacctttgtcaaatgcataacctgcaaatattttttcccattctataggttgtctgtttactctggtgttagcttcctttgctgttcagaagctccttggtttaattagttcctgcttttcaatttttggttttgttgcaattgctttttggagtctttatcataaaatctttgccagggctgatgttcagcgtggtatttcctcttttcttctgtgtttttaacacttttacatcttacattcaagcctttcatccatcttgggttgaattttgtatatggtcaaaggaaggggtctagtttcaaaattttgcatattgctagccagttatccaagcactatctattgaatagggagtctttccccattgcttgcttttgtcagctttgtcaaagatcaggcagttgtagatatgtggctttatttctgggttatctaatgactgtgttgcattggtctatgtatctgctcttatgccagtatcatgctgttttcattactgtngccttgttgtgtantttgaaatcaggtagtgtgatgcctctcactctgttccttttgtttangattgaattggctatttganctccactggtgacatttaccccatgttaacaaaccctacatgttgtacccccaaacctaaaaatgaaaagttg

SEQ ID NO: 488987 - DNA, 377 bp, Homo sapiens
  misc_feature (22)..(22): n is a, c, g, or t
  misc_feature (26)..(26): n is a, c, g, or t
  misc_feature (30)..(31): n is a, c, g, or t
  misc_feature (33)..(35): n is a, c, g, or t
  misc_feature (38)..(38): n is a, c, g, or t
  misc_feature (55)..(55): n is a, c, g, or t
  misc_feature (78)..(78): n is a, c, g, or t
  misc_feature (82)..(82): n is a, c, g, or t
  misc_feature (88)..(89): n is a, c, g, or t
  misc_feature (92)..(93): n is a, c, g, or t
  misc_feature (102)..(102): n is a, c, g, or t
  misc_feature (238)..(238): n is a, c, g, or t
  misc_feature (257)..(257): n is a, c, g, or t
  misc_feature (264)..(264): n is a, c, g, or t
  misc_feature (286)..(286): n is a, c, g, or t
  misc_feature (358)..(358): n is a, c, g, or t
tccactcgcccacggtgattcnggtnatcnnannntangctgcaagtggccgagngcccccccgagtggatcttctantggnttgccnnatnntatgcctgntgcggctctgccaccagtcaaaacagcatcttgtggagattcattgggaggccagcatgttgaaggcggcacacacatgaggtggtgtaggacatcattgaaacacttgtcccttttaagcaccctacaggggcgnctctgaagtttgcaggacncaaaganctggcagaatggatagccaggngtcttagggtattgaggtctcagacagccgcgtataaagatggtgtcaccacacggtcccagtcccagctcncagagcacttgtctattct

SEQ ID NO: 488988 - DNA, 135 bp, Homo sapiens
ggcggtacctacagcttctgagccagcgacttctgaatgggccctgtcaaacgtatagggctcctgcctaagcctctccctccagccaataggcagctttcttaactatcctaacgagactttccgtatggatgc

SEQ ID NO: 488989 - DNA, 378 bp, Homo sapiens
  misc_feature (22)..(22): n is a, c, g, or t
  misc_feature (26)..(26): n is a, c, g, or t
  misc_feature (30)..(31): n is a, c, g, or t
  misc_feature (33)..(35): n is a, c, g, or t
  misc_feature (38)..(38): n is a, c, g, or t
  misc_feature (55)..(55): n is a, c, g, or t
  misc_feature (78)..(78): n is a, c, g, or t
  misc_feature (82)..(82): n is a, c, g, or t
  misc_feature (88)..(89): n is a, c, g, or t
  misc_feature (92)..(93): n is a, c, g, or t
  misc_feature (102)..(102): n is a, c, g, or t
  misc_feature (239)..(239): n is a, c, g, or t
  misc_feature (258)..(258): n is a, c, g, or t
  misc_feature (265)..(265): n is a, c, g, or t
  misc_feature (287)..(287): n is a, c, g, or t
  misc_feature (359)..(359): n is a, c, g, or t
tccactcgcccacggtgattcnggtnatcnnannntangctgcaagtggccgagngcccccccgagtggatcttctantggnttgccnnatnntatgcctgntgcggctcattgaccattaagttccgggatagggtttcgcctggagtgcacaaagcctcaaagtacttatgccaaaacagcttcttgtagagattcattgggaggacagcatgtctgaacagcccctacaggggcgnctctgaagtttgcaggacncaaaganctggcagaatggatagccaggngtcttagggtattgaggtctcagacagccgcgtataaagatggtgtcaccacacggtcccagtcccagctcncagagcacttgtctattct

SEQ ID NO: 488990 - DNA, 293 bp, Homo sapiens
gaactctgagctcggtacccattcgtgtcggagagtatattgtgaagaggagtagctattagaaggattatggatgcggttgctggtgtgaggtaacatacttgatgatcagcttctgtggcacaggtagggttaatgttattggttaaaactggaataaaagctagcatgtttatttctaggcctactcaggtaaaaaatcagtgcgagcttagcgctgtgatgagtgtgcctgcaaagatggtagagtagatgacgggttgggccaggggattaatggacacgaatgttca

SEQ ID NO: 488991 - DNA, 990 bp, Homo sapiens
  misc_feature (18)..(18): n is a, c, g, or t
  misc_feature (78)..(78): n is a, c, g, or t
  misc_feature (85)..(85): n is a, c, g, or t
  misc_feature (92)..(92): n is a, c, g, or t
  misc_feature (103)..(103): n is a, c, g, or t
  misc_feature (106)..(106): n is a, c, g, or t
  misc_feature (112)..(112): n is a, c, g, or t
  misc_feature (116)..(116): n is a, c, g, or t
  misc_feature (132)..(133): n is a, c, g, or t
  misc_feature (135)..(136): n is a, c, g, or t
  misc_feature (141)..(142): n is a, c, g, or t
  misc_feature (144)..(144): n is a, c, g, or t
  misc_feature (182)..(183): n is a, c, g, or t
  misc_feature (213)..(213): n is a, c, g, or t
  misc_feature (215)..(216): n is a, c, g, or t
  misc_feature (219)..(220): n is a, c, g, or t
  misc_feature (226)..(226): n is a, c, g, or t
  misc_feature (237)..(237): n is a, c, g, or t
  misc_feature (256)..(257): n is a, c, g, or t
  misc_feature (282)..(282): n is a, c, g, or t
  misc_feature (284)..(284): n is a, c, g, or t
  misc_feature (296)..(299): n is a, c, g, or t
  misc_feature (301)..(301): n is a, c, g, or t
  misc_feature (324)..(328): n is a, c, g, or t
  misc_feature (330)..(330): n is a, c, g, or t
  misc_feature (333)..(333): n is a, c, g, or t
  misc_feature (374)..(374): n is a, c, g, or t
  misc_feature (384)..(384): n is a, c, g, or t
  misc_feature (463)..(463): n is a, c, g, or t
  misc_feature (474)..(474): n is a, c, g, or t
  misc_feature (889)..(889): n is a, c, g, or t
  misc_feature (987)..(987): n is a, c, g, or t
ccccctcatgtctcctcnagtatcaaacaccatttcatatctctaacacgagagcagagtcggcattcagtataaganccaagtnaaaagcnttaaatttcangcntctgancccntcacatggcgaccagnnanngcctnnangtcattctcccacattatccaactctgcatctcacacnnatcctcatctcactcaagcccaacccctcncnntcnnattgtnaagtgcaggcngttgagagagataaaaatnnagtgaaaacacatcaatctcaattnanctcagttaaaannnngntaagttaatttttttttgttttnnnnngnggngggggggaaaggggtccatggggttaagagtcaaaactggncagggctggnaactatagatggcatgttgtagctctggaaagtatctgtcacatgatattttaaaataaagtggcttttgtggattttntcttttttggnattgtaaacatgtactgtttaatattacccgaatttaatttaaaacatgtttgcaaacaaaacaaaattaaaagcctttaaggcaaacctccccctaaggaaaaaagtcatttgttataaaattgtgaggacacccaagcaagaccccacttaagattcgtcagcatgaacttgagagcttttgtccactgctcctcagagttaaactgggttttgatggaataggagccgccactgcctcctgtgtcttcaatcttgcctttctccacatccatcctgtagggaagacaaaaacgtgtctcgcctttctcaacctcttctttgaactgctgcacacagtccaggaaagccacccattgcatggtcaaacttgttgtcccagaaaaaccgcaaccccccagaacagtataacggnagctcctaattagccgggcgtggtggtgcatgcctgtaatcccagatactcaggaggctgaggcaggggaattgcttgaacccgggaggcggaggttnagt

SEQ ID NO: 488992 - DNA, 405 bp, Homo sapiens
taacttttctaattaaagatgtaatcactgatatagactaacaacaacttctgtttaatccagtatgaaggaaaaatagaagaagtcttatttcctgaatgaatactttctatggagatttgttctattttgttgaagtaatgaagtgtcaataactggccagaatttgggttctacttttcttctttaggttttctgttcttcatgatcccatcaaagcaaataatctttgtactgtgcatttttctcttgtcgtttacgctttgatgttgtttgctgatatgtgcagagtaaagtgctgggacttggttgctctttataattatgtttaagaatactacacagatgttctgatataaagtgttattttattttgggttactatacattcttgtagaattttca

SEQ ID NO: 488993 - DNA, 690 bp, Homo sapiens
acaggcttggcaggtactaagccagatggaggcatgaccctgggagggggtggagtgcaaagaggtgcagagcaccccataaaataaggggttgggcatcaccatgccccctgcaggctttgccacccatcagcaccagcaagtcgccccacccagagctctgcaaagaacaccgccagctctttccttccgggtgctcttgctggggggtcaggctggtcccctctgactggcactgcccacgctgggacatgggaggagggccatctgggcactgcaggagcagatcctgggtgcacatggggagacaggtgtgctggcaggaacagcaggcggggctgagctcaggaggcgcctcacagcgggtgcctccagcctggtctgagcacgggatgaagaaccaggcaccgctcatcgtgcatctccacaaggcactgtgtgacttcatgcaagccgctcaacctctctggccccacgtccttgtccacaggggcagagtggactgaatggaggctgaggtccctctcagcttgggtggtgtggcagagggtgaggaggagcccatgggccctggatcaccagcctccctccacccagaatgccccgtccactccactgcccacatcctctgtgcaattgacaaacgtcctgggtgttaacgcctaagcataaagagtcggtttgcttgtt

SEQ ID NO: 488994 - DNA, 409 bp, Homo sapiens
  misc_feature (34)..(34): n is a, c, g, or t
  misc_feature (45)..(45): n is a, c, g, or t
  misc_feature (90)..(90): n is a, c, g, or t
  misc_feature (102)..(102): n is a, c, g, or t
cccccccccagaaaagaaaggaatgggcccaatnaaaaaattggnaaaaatttaaggggaaaaccaggatgccctaaggcaagccttggngtaggccaaagnccttaaaaccagagggcaaaatggaggacctgtttgaccctgaaggttcatgcctctttcccattatacacaacagctttcccttatttgacttagatctttttaatagaggcatttttgggctgattgctgtaacgttagagcaaatatactccagtttctaacttttctgttcaattttccaggttacattactgtgaaatgaagtgactggatattttgcttacacagctttgctcagcaatcagttgctttctgccatggccataaaatggaaaattctttccacaaatagaatctctggcaa

SEQ ID NO: 488995 - DNA, 235 bp, Homo sapiens
gaataaaattaatgactctattattggtgtgtatttatatttttaaaataatttgttttattattaaaatcaattgggataaatttcattaaaatttacctttaattaataatttgcctatgcacaaaatgtccattatattgctcattattttcataaactttatctgctgtcattttaatgtacatacgacatcaggcatggttttgtttttttcttttcctgcatatattgg

SEQ ID NO: 488996 - DNA, 664 bp, Homo sapiens
cttttgttgtagccatcaactgtcttttaatgctacatatactattctcaaggcacatctgatgatattttttataccacagtaggtgtcaaagcatgtttaacatatgatttcttcaggatccctgccctttatgaattccaaatggaggaactgaatagtgccatgtaaagactggcgagccatagtctatctttggcaagcttgtacaagcactattggaaatgtcatgctgaagaactgtcaactaggaacttcttcagttgatgaaacaccattcaggactgctgctacttgagcgattacttcttttaaggtcttaatcgttacttctcctggagtccgctgtagcttagaatggtcatcgtcagcagcactagatgctccggttattgccttttctgaaggaccatgctttttagttacatctttggccatttctttcgtgattctagccaaagtttcccttgcgaggatactttgcctgctgtgagactcagttctagtataatctgcaactgcgactagtgcattgtcattaactgaagctgtatcagattcagtcattccatccatcagcagcatcttcatcagacctacgtctaccagaccgcctactacggttagtactgcgatgagattcgctggcatcagtgttctgcgc

SEQ ID NO: 488997 - DNA, 180 bp, Homo sapiens
tcacgccatgtccacaaccaaaccaccacaaagccctcctactcttccaggagggaagctccgaccagcagagggtggaagcgttcagtcctgtaccccggagcttcccatccgcaaggcacttctcaccatgaatttcgtggatgcccagatccctgttccactaccattcctctcacc

SEQ ID NO: 488998 - DNA, 197 bp, Homo sapiens
tgggggaaaaaaaattttttttttttattccccccccaaaaaaaaaaaaaaaaaaacccagggggggggggggggggggggaaaaaaaaggggggggccccccaaaaggggggccccccccggaaaaaaaggggcacccgccaagggggggggggggggtgtggctataaagagaaagagggggggccttttctcta

SEQ ID NO: 488999 - DNA, 735 bp, Homo sapiens
tgcctccaaatcctgtccatctatcagttttcctgaatatcctagtaaaaatgctaactttattccaaaaatatgaacgaggcagtgtttttttttccagctgttctaaagagaaaggtaggggtgtgtgtgtgtgtgtgtgtgtgtgtgtatgtgacagagaaggaagggagaaaggggtagggagatatatatatgtgtttagagaaggcccaatttaggacacaacagattcttggaggaacttaaaagaataacatattctgctgacgcgtgaagagtgataatataggtttaatatcattctcttcacatggttagttccatggctcactcaaaagacgccaggcactgtattagacaccaaccataaaggtcacaaaatacagctaggaacaagaggaaacaaagccctgccctcgttgggccttagaattcaattgaactattacccaggagcagaacatcagccaaaaagattgatgtcttacacgaagagcaacacacaacaacaaacatcacaaacaaaccacaccatcgtctgtgcggccgcacctcctcggaccctcccaaaaacaacgctttcatagaacaaacaaaatcgcgttaggggaaagcgggcgccgccccgcacagctgcaaaacgcccacaacttggtcaacaaacgcgtgtacactagagaggaacacaccgcagggctacgacaaacgcaccgggaagggattcacacacca

SEQ ID NO: 489000 - DNA, 1025 bp, Homo sapiens
ggttcttctgtgtcctctgctgccttagagtgtccagtcatctgtggcctctggtagagcctgcgtgtgtattgtggtggattccaggagacgtaaagactgccagtgatcctcggcgcgcgcgtaaggccttagcaatactgcgtgcatccaatttgcaacattatgatgtgaattgttagtgctcgatacgcatatttactggttctcgtgacgcgagttgagtcaaatagccatggtagctactttgcatcagacatagactttactaatatagtgaaggtgctgactgcttatagatgatagctagcatgatacaccgggatcgttccctgggttaccttgcttgtcctcgtaacgccatgacccttgattcgaccgtgttccttggacgcaacgtaaaacagaagccttggtgaggccttatgacggagcacattgacaggatgggtagccaaaaccccccagttatagtgttctcaattttagcccaacgacttgtatgggcagagcagctatagtacacagatcctttcgcaaagaagcgacacgtgaggaagaatataaaaacctgtgcaacagtcacaagagtgtacattttacaggacagaccattcacacagtgctggatgacgtgtcacggtttgcacagaagggaggttcataactggggtttaaccgcaatggtttgccaggtacccagaagcaaaaattctgtgtctactgtgggagtaacatggttgtgcaaaagcccttttcattacgatttttacaagatttcaaaagcagcaccgttaaggactaaggccataagtggacatcacacaaaccttcttccaggctttgcacacacgacctggcggcgccaaacgtcattttctggcaattgccttccccaacagttcttaggcttccacctttccaacaattatcttcagtaaccccagaggtgcatatttcctgcaaacctgtggaacaccatggtgggaaccacgccttcacaactggcccctttcaaatcatca

SEQ ID NO: 489001 - DNA, 595 bp, Homo sapiens
  misc_feature (346)..(346): n is a, c, g, or t
gagaaaatgaaaatcttcaggccaatgagatcatgtggaataacttaccgccgaaagtttgccagtaatgttgaaaacgttagcggaagaacttatgccaaccccgccgatgcttttaaacacaggaggaggctgttttggagttagagaagagaattgaagaatcttctgaaacttgtgagaagaagtctgatattgtgcttctgctaagcccaaaaaccaggccacttgaagaactgaacaccagtccagtcccagccagctggagatgccactgaagccgaagttttccagccaccagaaggagatttacttagacgccaaaaagtcgccagcaaaactgatngggaaagagccccctcccgtagtaaattatgaagaagatgcaccgatcagttacatctatggaaagaaaggagaggctatcccaatttgaatctattcgtcacttccattgctggaataattaggtctcccaaatctgcactgggctcttcagcactttctgatatgatctccatcagtgagaagcctttggcagaaccggactggtaccctggtgccattccccagaatagaagctcaagaactgtta

SEQ ID NO: 489002 - DNA, 365 bp, Homo sapiens
ttctttggactaccagttaaattgtcaagagcacttatagggttctgtggacgaatttaaagttgaactaagattctatcttggataaccagctgctacatatacgggtgtgctctttcatctgttcgtaggtagctcgtctggtttcaggagtcttagcattggctctccttgcaaagttattcctagtttattcattatgcataaggtataggcgttagtccttgctatactatgcttagttataatttttcatctttcccatgcggtactatatctaatgagccaggtttcaatttctatcgcatacactttaatcgggtaaatggttaggctaaggttgtctggtagtaagatctagtagg

SEQ ID NO: 489003 - DNA, 611 bp, Homo sapiens
atgacccaccaatcacatgcctatcatatagtaaaacccagcccatgacccctaacaggagccctctcagccctcctaatgacctccggcctagccatgtgatttcacttccactccataacgctcctcatactaggcctactagccaacacactaaccatataccaatgatggctgcgatgtaacacgagaaagcacagtaccaaggccaccacacactcagcctgtccaaaaaggccttcgatacgggataatcctattctagttacctcagacagttcttttgcttcgcaggattctatctgagccttattaccagcctccagcctagcccgcttaaccccccaattaaggagggcacgtggtcccccaaggatggcatcgaccccgataaatccccgtagaagtccccactccattgtacagatccggattattcgcttccggagtatcaatgcaccctgaggctcagcagtagtcggaattatattaccctaactcgaaatgaaactaatttcagtgcactaggtaaattcgcaaggaattagctgggggtccctatttaaacccttccttacaaggcctccagtaggtacctgtcgaagtaccgc

SEQ ID NO: 489004 - DNA, 267 bp, Homo sapiens
ctccatggttaacaccgtctctagtacaaatagaaaactgagctgggcgtggcggcgggcacctataatcccagcgggggcaggaggctgaagcacaagaatcgcttgaacccaggaggcagaggttgcattgagccgagattgtgccactgcactccagcttgggtgatatagcgagactcagtctcaaaaacaaaacaaaacaatcttcatatgtacccagtgtctttctcaatcctgatttttttttaatgttacctttttccc

SEQ ID NO: 489005 - DNA, 675 bp, Homo sapiens
  misc_feature (46)..(46): n is a, c, g, or t
  misc_feature (100)..(100): n is a, c, g, or t
  misc_feature (102)..(102): n is a, c, g, or t
  misc_feature (109)..(111): n is a, c, g, or t
  misc_feature (129)..(129): n is a, c, g, or t
  misc_feature (131)..(133): n is a, c, g, or t
  misc_feature (135)..(135): n is a, c, g, or t
  misc_feature (137)..(137): n is a, c, g, or t
  misc_feature (144)..(144): n is a, c, g, or t
  misc_feature (153)..(153): n is a, c, g, or t
  misc_feature (179)..(179): n is a, c, g, or t
  misc_feature (181)..(181): n is a, c, g, or t
  misc_feature (187)..(187): n is a, c, g, or t
  misc_feature (208)..(208): n is a, c, g, or t
  misc_feature (226)..(226): n is a, c, g, or t
  misc_feature (231)..(231): n is a, c, g, or t
  misc_feature (234)..(235): n is a, c, g, or t
  misc_feature (238)..(238): n is a, c, g, or t
  misc_feature (253)..(253): n is a, c, g, or t
  misc_feature (268)..(268): n is a, c, g, or t
  misc_feature (270)..(270): n is a, c, g, or t
  misc_feature (273)..(273): n is a, c, g, or t
  misc_feature (341)..(341): n is a, c, g, or t
  misc_feature (351)..(351): n is a, c, g, or t
  misc_feature (353)..(353): n is a, c, g, or t
  misc_feature (363)..(363): n is a, c, g, or t
  misc_feature (370)..(370): n is a, c, g, or t
  misc_feature (382)..(382): n is a, c, g, or t
  misc_feature (388)..(388): n is a, c, g, or t
  misc_feature (411)..(412): n is a, c, g, or t
  misc_feature (432)..(432): n is a, c, g, or t
  misc_feature (456)..(456): n is a, c, g, or t
  misc_feature (464)..(464): n is a, c, g, or t
  misc_feature (468)..(468): n is a, c, g, or t
  misc_feature (477)..(477): n is a, c, g, or t
  misc_feature (479)..(479): n is a, c, g, or t
  misc_feature (515)..(516): n is a, c, g, or t
  misc_feature (524)..(524): n is a, c, g, or t
  misc_feature (538)..(538): n is a, c, g, or t
  misc_feature (562)..(562): n is a, c, g, or t
  misc_feature (564)..(564): n is a, c, g, or t
  misc_feature (579)..(579): n is a, c, g, or t
  misc_feature (584)..(584): n is a, c, g, or t
  misc_feature (595)..(595): n is a, c, g, or t
  misc_feature (608)..(608): n is a, c, g, or t
  misc_feature (662)..(662): n is a, c, g, or t
aataaactgtacataaaactaaaaaaaacgtttccttgatacaaantgtttgaaatataaataccagtgtacctttaaaaatgtaaacatcttcctcccncncccaccnnncggccccccagaatactncnnncncncccatcngtcaccccngccccccccccttgggcccccgccangngacagngattactcacagtcccttttnagacattgttaaatgggncgggnaannggngccaccccaccaaanaggaggctgaaatancngcntgggctcagggcatctcagactctagtctgccaccgcctccgcaggccctggggctgcacctgggggnggattattgnanagttagtcanacctcgnggaggggggccngagggntccttgttggggggtgtgtgttnngggagtggggtcccctgagnggggggggagcttcccagtgagtntgtcagcntttntcctgtagntnaaagcagctgtatccaaaaagctctggataaaaaannccacgcanaaaggccagctcangaatcccccagggctgggggccancngccctccctccaaanaaatngccacgggaangactcttccagancccaggcagaggacacagaaccagaaaatggtcttcatcaaagtcctgtggggntgatgtggccaga

SEQ ID NO: 489006 - DNA, 94 bp, Homo sapiens
  misc_feature (17)..(17): n is a, c, g, or t
cacaattataaaatgtnagcttttaaggaaataaaaagagatccaggcagatatttacatagttgtcctgaatctgtgaaaaaatggcttcgac

SEQ ID NO: 489007 - DNA, 201 bp, Homo sapiens
ctagaggatccccattcgccgacgtggatgactgtgtcgtcaaaactcggtatggtgtgtcacctgtgcatccggatccacggtttcaacggaatgtcagaagtctggcgaaatgcacctatgcaagcctttgagtgaagctccttcctgagtacaactggtgggcctttaatgtctagaatgtgtcctgtcatggatgtt

SEQ ID NO: 489008 - DNA, 133 bp, Homo sapiens
ttcattttagctcctccagaaagacttttccagtatctccatggcctcagctaaagcttcccttcctcccccaccccaccgagtacggaatcttgctctgtcatccaggctggagtgcaatggcatgatcata

SEQ ID NO: 489009 - DNA, 122 bp, Homo sapiens
  misc_feature (22)..(22): n is a, c, g, or t
  misc_feature (25)..(25): n is a, c, g, or t
  misc_feature (76)..(76): n is a, c, g, or t
attatgccaagggatgtggtgntgnggttatggtcgtagctaatttttttcctaagcatgtctgtcatctcccttncttgctgattagctttcatatgactatattaaatggaagtattttg

SEQ ID NO: 489010 - DNA, 117 bp, Homo sapiens
atgaggactggacagagaggtctgcatcaccgctggtacctatactgctcagactcggtgctgcagtcagcacgagtatgcttcgcttcatcaggtgcccagatgatatgccgacga

SEQ ID NO: 489011 - DNA, 262 bp, Homo sapiens
atgtaaaatgagatatagcaggataatgaagacaaagatgcatatgtgagcataatatatttgagtacaactaagaacatgtttcacgtaatgaagtatccacatagaggaacaatgagcaagatgaataggtgacaaataagaaatgacattggtaattgacggggaagcgtaacaatttctgagaagggtaataacacagtgacagccgtgtttaaagatgataaaatggccagacgcggtggctcacgccggttatccc

SEQ ID NO: 489012 - DNA, 296 bp, Homo sapiens
ctccaggccctaggagagaccattagggcagtgctgatcccaattagaaaggttctgaccccagaatgggacatctccattgcacacgttctggctgctcgagccgtcctgtcttgtctcgtcccagcctccagcgtggctgttcgcacagggacctggtgtgccatcaccaaggcgctcatgggccacgttccagaccgaggcggccgcacaaatcagtagaagcctcccatgcccacctgaagaagctggagacagtatggaggcccccagtgttggggtagcaaggagtcagt

SEQ ID NO: 489013 - DNA, 297 bp, Homo sapiens
tgtttccctggattttcccatcccagggccacgcagagtgcagttcccctacacggccacggcattttgtccctttgtggggtggccatgggtggctcagtcccgtgggagcctttccgtgtttaaggccaagggcagggtggtgccccattcgttttgtgcctcacagggggccctaatgttttgtgctccaaatttttgcaggactggatttcggccgggacaaaggagggtgtgcccccacccacgttgttcccagggcccacgccccttgtcaattggaataaatttggtttc

SEQ ID NO: 489014 - DNA, 266 bp, Homo sapiens
  misc_feature (108)..(108): n is a, c, g, or t
  misc_feature (117)..(117): n is a, c, g, or t
  misc_feature (144)..(144): n is a, c, g, or t
  misc_feature (150)..(150): n is a, c, g, or t
  misc_feature (164)..(164): n is a, c, g, or t
  misc_feature (198)..(198): n is a, c, g, or t
  misc_feature (206)..(206): n is a, c, g, or t
agcaagcaggcccccccctgcccttagtgatgtttggagtcgttttacccttttttattgaaatgccctgggatttccttttccctttccctgccccccctgtccccnacaatttgnggttttgagttgaggagccttcccctntgttgntgaggaaatggtanaatgctgcctatcccctccagcccaatcccagtnaaaaaggngtgaagccccccccatgtttttgaacaatcaggtttttaaataaacaactgggccctcca

SEQ ID NO: 489015 - DNA, 646 bp, Homo sapiens
tgggaatgggggaggtcctaaggtagtttggggaaaggaaacagagtgttacgttgaggggaggggaatgtgggcaaaaaaaaatttgagaggggtaaaagggggcaaaaaaggtgaaggaaaggttgaaagggtttttaggagttgaggagggttaatatagagaacgatgtattttggaaaaaacaggagcgtatgtgacagggtgaagagtgctggtgaattgggcaagggggagatgaggggggtttgtacctcctgaaaaaaggaaatggggagtgggattggggagagtgggttcttagggaggttaggaaagtgacggccaggcaggagacctagggggccatataactaaaaggcgtatttgttttaggaaaaaagtagaaaaaagcctcattagaagtcttgggaagaacacaaggaatctttgggaagcagaaggaggattgataggggcatccatgatttatcagatgttttgtggcaaccagggaacgttttatttcgggaatctgccagcgaaaccgggaaaagggaaaggtaattggtaataaatactcagattaagtagagggagtggacaggaattaaaagaacaaccccgcgcggggtgttctctctctctctctctactctctctctc

SEQ ID NO: 489016 - DNA, 105 bp, Homo sapiens
caaacattttagtcagagttctgatgtgataaaacatcaaagaatccacactggggagaaaccatataaatgtgatgtgtgcgggaaagcctttagaattcatgc

SEQ ID NO: 489017 - DNA, 346 bp, Homo sapiens
ttatctgccacggaaggatgatcccatcatactatctgctggaatcaacgcatggcctcctcttggctgcattctgtcgttggccccagatgcagccggtcctgggcttctagtctgcgactgctgaaaccgggcctacccagcaccacatagaaatccaggccgtagatagccaatgcttggggtcatgtttgataccccagatcgatgtgtgcctggtatcccaaagccatcgtttccagtatctgagacagtagtgttggcttagctcatactcccgcgcctttagacccttctccctgatttcttctgccttggcccctcgaactgtgctgtggaccgtagg

SEQ ID NO: 489018 - DNA, 322 bp, Homo sapiens
gtcccttgcttttttttcccctgaaacctagaggagcaaacccatcctcgggggggtatgtgaggctcccaggcagagccccgccaaaggttcccgtcattcccaaaaattaacccttcaaggttttccctatgaactccaaacaaagtttatattttagggcaaaaccccatggttaagcccctgacaacttttttagggtggttgggttccagcccccccctcccagtccccagccccagcaggggccttccccttggttaaggttttcccgcaggctattttttttcccgggaaaactcttttcccatgactttttcca

SEQ ID NO: 489019 - DNA, 282 bp, Homo sapiens
cgcaatctgtcatcccaggcgcacttgctgacctgggcgacagagtgagactccatctcaaaaaaacacaaaaaatgtaacccagcaacgatcattaattatactagggatgctattaagggaacagtttaacaattagggcccaccagtcaaacggcctgagaaaatacaatagcattagacatgatactagcggagaaaggtgtagtttgtgtcatgattggaacccagtgttgtactttcatccctaataatactgctcccgagaagtgcgcctgggtg

SEQ ID NO: 489020 - DNA, 449 bp, Homo sapiens
  misc_feature (27)..(27): n is a, c, g, or t
  misc_feature (32)..(32): n is a, c, g, or t
  misc_feature (56)..(56): n is a, c, g, or t
  misc_feature (185)..(185): n is a, c, g, or t
  misc_feature (260)..(260): n is a, c, g, or t
  misc_feature (270)..(270): n is a, c, g, or t
  misc_feature (287)..(287): n is a, c, g, or t
  misc_feature (322)..(322): n is a, c, g, or t
  misc_feature (346)..(347): n is a, c, g, or t
  misc_feature (404)..(404): n is a, c, g, or t
  misc_feature (406)..(406): n is a, c, g, or t
  misc_feature (446)..(446): n is a, c, g, or t
cgtcattaagggttgactatcctgttngcatntcatattcatgtaatatacgcacntgacactcttggtgatctttgtttacccgttccccatctgccccgtccatcagccgctgtttcgcacataccccttccgcttatccctgcgttcacccatatgtaccacaatgccatcatatattcttntcccttccgctcctgtgcctgtggggcgggggcatccccttttatttgccgtaccgtttttcggcgccaatccgnacgtctccanctgccccttcctcgcgnggggcgcccaatcaaaaccaaagtctccccggcancgctctgtcccctgtctattcctnntttcggcgggcatattcctcttttgccggcgcagaacagtttcgggctgtgggtgtncntatatagcgtggggccaaagggagtaatcctttgcttttnggg

SEQ ID NO: 489021 - DNA, 275 bp, Homo sapiens
agcctgagcacagagcagactccatctcaaaaaataaaataataaataagaggccaaaatgttaaaaataagcaaggattgggcacagtgctcatgcctgtaatcccggtactttcggaagccaaaattggaggatcctttaaggccaagagttcaagatcagcctgggcaacatagcgagatcccctgtctctacaaaataataaaaaaatagccactgttttagtcccttctcatgctactaataaagacctacctgagactgggtaatttat

SEQ ID NO: 489022 - DNA, 1011 bp, Homo sapiens
  misc_feature (1010)..(1010): n is a, c, g, or t
gtgtaggcaggctgcggcagacggcgacagtggcggcggcgccatggctgtgcttgcaggatccgctggtgcctttggtgatcccgggctgacagtcagattagcacaggggctcaactcctggagagtgagggttgaagaaagcggcgggcagccgctgcgtccccgctggctcccattagtcaggttcctgacagcggtgcccgggagccttgtgtgacgtgcccgtggcggccggcgagatactcatgtattgccgtccagtggctgcgtgcctcgtccgtcctcatcgcccaatgcccctcattcgccggcctgtggttcatccgactccatgttcatgggtttctactgctcatcttcctcctgtagcggaagctttgcctgtttgtgccttggtttcccctggcacgccctgttccttatctgctatagactgctggggaatacttgtttccatgtaccactgctccgatgtccccgtttcctggatcgttgcttgactcccgggcgttgtggtgctccctacctgcgtctgccctgatacgtctttcctaggacgcacgaacatcgtggctggggcatggcattgacttaggtctctaaatgtgttgcatcctttccaatgccgcctctcgctgggtgtcacgtttctgtcgtgggcttgtttggctggaatgttcctccttcctatgttgactattggctcgcccggtgctttatttgcactgggcctttctcgtggggaggctcgcaaggaagcggttgtctgccccagtaaccactgggttggttggatgcagccccaatggtgaaatgtgcctggctgggacactgggttcgtggcgtgccgcgggggtcccaaagctcgccttgccgtgtccctctcctctcttgtgtggttcccgctcggtcgatccttggcggtagtggagagagcgcttagccttgggttacgagcgttcctcttgaggggacctctgagttggcgctcgcaccatgtttcgccng

SEQ ID NO: 489023 - DNA, 190 bp, Homo sapiens
  misc_feature (18)..(18): n is a, c, g, or t
aaggtctgatgcaactgnaacggtctgtcgtcctgaacgcgcaggaattctccaaccgtgccggcgctttcctgcacagcgacacttccgatactcacatcaggatcaagggacggctcgacaaccgcgacggtacgctggccagcaacgccagccacattgtcgttgaagggcagtttgataaccgtcg

SEQ ID NO: 489024 - DNA, 266 bp, Homo sapiens
aagtcaactacaatcacgattggaacgttaaaatggactagacactagattaagagcggactgaagacacagctaataacttagagtcgaaagagcacacaattgatgatacaggaaaaaatgctgacgaactggtgaaagaactaactcaggaaaagaaccttaaagtctttaagaacacatgagatgcaaacttatacggacgaaaaaaaaactgggcccgcaatgcattgggtagtgctcaatgcacgatgatgaagactatt

SEQ ID NO: 489025 - DNA, 1270 bp, Homo sapiens
agcagccaaggggcccaatccctcatattctccaagtttgacggaaagaaaaccaacaagaagacccgcaagggttaccacagtgaagaaatcttcagtacgtctatccagggatcggatcaaagaagggctggatgtgcaatggcgcgatttctggctcactggcaaccttccaaccatatcagaggttcacagtgatatctcacatgccttcaagccttcccaaatagcttgcggattcaccacgatcatcggcacatgtggattcccaggccgttgtgccctctgtagcaccaactgctggcccatgcattcacccacaggtggcaggccacagcaacaatcattacgcactgcccacctcacacgtatcacgctagcaatcgatgccttggcagtcagcgacagattgaccttctcccttcaccctatcccatccaattcctaccatttggctctctgcatggtgtgcacaacaccacagcagtggcccttaacacgtcctacactaatccccagatatcatcaatcggcgactttctcgccatatcccaaacgccccgcacttgcatgactggtgacgcagagcactgggctaccctacgtgtcaccaccccacattcactgaccggcagcctaccaagctcgcagctacactgcgaccgatacgcctgcaccaccacacgaggacccctcacccgacaccacctgcgccgagcacacctgcgccgccacctggctgaacaccggacccacaccacggccccacaagacccacggtcgacaagtgcccatcatggagctgcaggcacaagggccgagcacgcgggcctgacaacggacacggccaccaccaccatatgacactaccagcgcacagcaacaagggaagcacaagcgccgcaacaaaggacaacgtacaggacgcaccaccaccctagcagccaagaaaaccggcgggtcactgcacaacagacatcagcacgaacactgcgagctacagacaaaacacccaccacgccccggcccacacagccacccctaaacgcaagaggacagcaacaaacagcaataagcaactaaaaagagaaaaaaggagacaaagaagcagcaaaagagacaaagcgaagacaacacaggcgtagccagccacacgagacaaccataagaatagaagagccaacacacatcagcccaacaacaccagcaaccaccaccccccacactccaccaccaacaaaccatagcaaagaagaaaaataggaataac

SEQ ID NO: 489026 - DNA, 267 bp, Homo sapiens
cctggtggataaagaaaaggaagaaacaaaaaataagggctctgttcaaataagatggtaatcacagaatcagaagtagaaagcccccaacaaatcacgtagtaaagaaggtgcatttcactataccaacagaagagggccctcttaaacttaaaaactaagcaaacctttttttcctggccccacggaatctacttgttacttgaggtctatgaaaatccaatatatcatcataaacaaaataatctgacatctatactgtgctcc

SEQ ID NO: 489027 - DNA, 1392 bp, Homo sapiens
taaaacaaacaatttttttttggaggcgcctatttttgtgccaggcatcggtttctaaaccccccccaaaaaaaaaaacaaaaaacaataatatagaggcgagcaaacacaatttctgtggagggcaaaggaaagaggggcagtgtgagttaaacacggctacggggacacgtgaaacaccctgtggaggttgagtgggggcctcttgctcttataggccctccttctttgggccctccttcacgcgaactctccctccttccttctttctgtggcgggggagacaatctcccgtggaatacgcggtggggagaatacctctcaagaaggaacagagggggtgtccgcatcacagtgtgtgtgtggctctctctcacgcctctcctgcggggagaaacctctcacatctctgctgcgtgtcacatgtggcccctgctcgcccgctgtgtgtgtttcccccagcgtgtgagagagagaggaggcgccttctccggcgggggagaacaccatgtgggggcaagtgtgaacactgtgtctctctcagagagagagtgcccgcttgtgagagagagaagctctccctgtgagagtagtggcgcgtgtgcgttcctctctttgtgccccaaattgttgaagaggcggtgacaactgttgccccacactctgtgtgagaggcgccccacagcagagggttgtgtgcgcatagttgtcttcacaacaccagaacagcggtgggcgtgtctcctatgtgcacaaccatcattgtgtgtgggcggagggatacttctccatattctcccgccacaccaccagagtcctacaccctggtcggcggctggagtctccgttgatggtgctcctctgctgcacacagccgcgtttataacgacacatacttgttgttgggccctccactattgaggaacaacacctctctcttttcttcagtgatggggcggacaacaatcttccgccgagacacccccaccgcggagagaagcacaacaagctgcaagcgccccaccggggggagagaaggagcggaatcctccgcgcgcccgtcgatgcgcagcggggggggggtgcttccacacaaggagcggcacgagcaccactctatcacagtggtctttcattgtgggtggcggcgactccttacgatagcgacgaccgcccttcgtgtcgttggtggagggtgatgaacagttctctccccggggcgcacacctctgttgctgatgaagacgagcgcgccctctccgagaacacatcacccgttggcgcaggtagggacctatctccccacacccgcgggtgcgatggttgtaggtgcagacaaaacgggggggggcggcaaaacacacgccacaggggcggcggcttttaccaagg

SEQ ID NO: 489028 - DNA, 138 bp, Homo sapiens
ctgaaaagatacacatgtaagcttgaaccacaagcaagctaaatacacctattttctcctgtattaatacagtctttattaggctagaacacagtggtgccaacctggctcactgcagccttcacctccttgcctctg

SEQ ID NO: 489029 - DNA, 204 bp, Homo sapiens
cgtcttagccaagcccttctctataataggatttcctacatctctgagagtgctactatcttattttaaaggaggaacttccagcctggccaacatgtgtgaaacctccatctctactaaaaatacaaaaattagccaggcattgtggcgcatgcccgtagtcccagttactcaggagactgaggcaggagaatcacttgaact

SEQ ID NO: 489030 - DNA, 371 bp, Homo sapiens
  misc_feature (19)..(19): n is a, c, g, or t
  misc_feature (69)..(69): n is a, c, g, or t
  misc_feature (160)..(160): n is a, c, g, or t
  misc_feature (289)..(289): n is a, c, g, or t
  misc_feature (295)..(295): n is a, c, g, or t
  misc_feature (368)..(370): n is a, c, g, or t
aatggttccccttaaaatnaaaagccttactggaagaaaaattcctaatgcttataacatcctaacctncccatcctcataaatttgaaagcttccttccccccacacagctgtgtatctgtcccctctggtcttcctcagaatgtctgtatcctgagcnaaacccatcttgcccaggtacagtgcctcacgcctgtaatcccaacactctgggaggccaaggtgggaggatcacttgaacccaggagttcgagatcagcctgggcaacatcacaggaccctattgctnccaaanatatatatatatatattttaattttttttcacgtgtctttttttttttaaatcattgccttcaaccaactcannnc

SEQ ID NO: 489031 - DNA, 151 bp, Homo sapiens
ccttggcttctgtagccagaagtatcctctctggctcctgtgtattgtccctgccttgttatttttattattttgtgagaccctaatgccctgcggctgtggaaatggggtacttaccaataactcctctttgggagtggaaacgggcctc

SEQ ID NO: 489032 - DNA, 401 bp, Homo sapiens
aatctcccaaatcccaccaaacttgtggtttttccctattcctggctccagaaggtcattttctaatatatcaatttcagagctcaacagaatgtgttcatgagttccagtgggaagtgtcaggaactgtctagtcacatccattaacaaatccattttactccagaaaaactagaggaccatgtagatgatggggaaaagagggaaaggtgctgtgtgaaaaaaattagaaatttttgctgtatttaaaattacctgtataaaagttcaatttccttctttgccttttacattttattaagttttgtgttttaccaaaatgaggatttcccagccatcagactgataatacctacaaaataggtgacaacaagaataaaccagctttggggaaaaaaaaa

SEQ ID NO: 489033 - DNA, 243 bp, Homo sapiens
ttttttttgagacaaggtctgcctgtgttgccaaggctgcagcgcggtagccattcacaggtgcgatcataacactacagcctcgagccctgggctcaagtgatcctcctgctcagctcctcagtagctgcaactacaactgtaccaccacatcttggctgatttcaggattttaaaatgtgaattaaagtgcatttaaatgatgaatattgaagtgacttgtgagtcagtggcacatacagg

SEQ ID NO: 489034 - DNA, 271 bp, Homo sapiens
gggacatagatagagcgggaacttcaggggcatcatccacttattctcggttcaagtcccagcacccggcatctagcttctcctcaatcactcgggtctgcatcactgactctgggtctagggaagtcctcttctttctggagctccttctccaaccatccccctgctctcctgggacttctgcacctcccctcggtacacatctgtcccctcaccaaataagtgtgttcagggttatccgagggcctgcctgggtgccgatgaatagcga

SEQ ID NO: 489035 - DNA, 543 bp, Homo sapiens
  misc_feature (45)..(45): n is a, c, g, or t
  misc_feature (65)..(65): n is a, c, g, or t
  misc_feature (122)..(122): n is a, c, g, or t
  misc_feature (125)..(125): n is a, c, g, or t
  misc_feature (142)..(142): n is a, c, g, or t
  misc_feature (164)..(164): n is a, c, g, or t
  misc_feature (170)..(170): n is a, c, g, or t
  misc_feature (172)..(172): n is a, c, g, or t
  misc_feature (189)..(190): n is a, c, g, or t
  misc_feature (209)..(209): n is a, c, g, or t
  misc_feature (238)..(238): n is a, c, g, or t
  misc_feature (268)..(268): n is a, c, g, or t
  misc_feature (288)..(288): n is a, c, g, or t
  misc_feature (323)..(323): n is a, c, g, or t
  misc_feature (459)..(460): n is a, c, g, or t
  misc_feature (473)..(473): n is a, c, g, or t
  misc_feature (477)..(477): n is a, c, g, or t
  misc_feature (482)..(482): n is a, c, g, or t
  misc_feature (542)..(542): n is a, c, g, or t
taatggatcaaacaactgtgggcagtgaaagggaacaaaactggnagtttgtccatttgaatatnagaccgtagtttcttcttaatttccacactatttctcccatattccttaaacttctnggnatccttcatgccttacngctacccagatgcaataaagtnattgtncngtatttcttacaatatnngtgatatgcgatgttcagnattttttttttcacggcactagggacccngtgaaatgaggggatatgggtggggatggnttattcacagatggggtccnggttcggtggttgggcacgggcaccacagtgggcncctttgcgaagtggcaaacataattttgctttctgccttcaaaaacatatatccatcgcgtttaggcttcatgatactgctcctgcaaaaatgcaagtcgaaagggactgcagggactctcgctgggggccctgtnngcttcgcgccggnctcnaaccnatggcggtgacaatgctggaggggtggtgtggtcaaaaggaaaggctggatggcgggtgnc

SEQ ID NO: 489036 - DNA, 326 bp, Homo sapiens
ttcccccgaaaataattcccaactgaggcccttgggaaagggcgggttttataaaggcttcaggggggggtgaaaccaatggatgggtttctccaaaggttgggtaggtcaagcaaagggggttaaaacccctctccccctttataaagggtggtctggggtctagcatttattgagaggggggggttaacccccccccccctgattagggattggtgaaaaattttgggccttcgggcgggttttaaatttagggataaccaaccaaaaatatgttttgaagcaatggaattaaaaatagaaacggcccttttttccctttccca

SEQ ID NO: 489037 - DNA, 553 bp, Homo sapiens
tcacggcacgcccccttcgatggcggttgagcgcagcaggttggtttgctcggcactgccgctgatggtcttgacgatgctgccgatcacctgggactgggcattcaacgcctcgatgccttcaccggcctgttgcatgtgctgggccaggtcgcgcatcacgtccacggcctgggtgaccacagtggtaccgcgctgggcgctgtcgtcggtttgcaacgaggtgctgtaggcaatattggcggcctcggccaccgcctgctcgcggttgacctggtcggtaatgaccgtggcgaacttgaccactttgtacaaccgctcattggcgtccagcaccgggttgtaggtggcctccaaccacaccaggcggccgtggttgtccacgcgtttgaagcgcgcggcgacgaactcaccggcgttcaggcgcttccagcactgttggtattcggcactgttgtattcctgtggttcacagaccatacggtgatgtttgccttcgatctgcgccagactgtcacccatgcaggaccccctcgggggcatcctctagagt

SEQ ID NO: 489038 - DNA, 727 bp, Homo sapiens
tgtaggcttctaatactggtggttatgaacacagcacaggagagaatctgtctcatgaagggttctctgcagaatgtctccagtgatgaaagtcgagatacttggctgactagacatacatttggcagtcttagagactgaagagcgggcttattgacacttttctcccttcctttcattccacccaaatgacttcagattatgtttcctataccatttactggggataaattgtcactgaccttgttgattttttattttagctgtaacaattctgcttttctaagttattgccctgccctgtggttatatttacctgtaattcaccacagtaatctaacccagagcggcagacctcagggatgttcgggtaggaggtagtaacctcttcatggtttctcacccatatagaatggtagtaatgttcagacagcatgattcatgatctaaagcctataatacacgggcagtggcgctgcaaaaggccatggttcctagaatacttggcaaaaagaagcatcacaacattacggcttgagaactagtaaatcgaccccaactcctgcaggcaatagggcatggacttcatgctagaccatcgaatgggggaaaggtcacatacagaacgcaagcagggaaattgcaaggaaccagaaacaccgagcatgcaacgaaaaacacaaggaggacaaattaacactaagtggtaaaacaaacaaacctcaca

SEQ ID NO: 489039 - DNA, 1454 bp, Homo sapiens
gctgagccggcgacagagcccgggaaggcagcgagacgtgggcgccggcccagccggctcccgtggtcctgtcagggcactcaagcagcctagagaccgcgcatctggacacctaaccgagagccgctccgctaccgagacgcgggcccggagtgcgtagcgagcgagcatacacacatggtagcgacatggcatacaaagggacaaagaagagcgacgagcgagacagagaagcggacaccggacacgcagagaggcgcatcacacgagcggccgaacctcaacaccaggcaaagacgagcacgcaaaacaacaacgaacaaatagcatagaaagaaccccgaggaaacgggaaagacacggacaaaacacagcaagccacaacacaacgacgaggcgcagcgaaacgacgcgcgcacagatactcacaaaccgcgacaacagagcaacaaaacagagacgcaccgcaagaaagccccccacacgaaggccaacgcagaacaagacgccggaacaaacagagacgcacgccacacgagccaaccccaacagacaaagacacggccaaaagaccaagccaccagatggacacacagaacagcgaagagaacacaagccgacaccacagcacccgcacccagaacgaacccgcaccagaacgacaacgaccagagccacaactccaacccaacgcaagcgcaaaaccaacaacaagcaaacacggaacgcacacacacacaagaggaaagagacactcacaggccaacacgacggcacacaactagaggacgaaacgggcacacaacgcgccaacgagccccaagccccagcccgccagcagaagacaagacaaagaaccaagacaccagaaggccgcaacatacgcgcaccgcaaacaggtaagacaaaagagcaaaagaagacgcccccgacaaaccaatcacaacaacaacaccgggaaccgcacacaggacaaacccccacaaaacacagaccaagcacaacgaggcggacaccaggcaacacacaacaagagaggcaagccccgacgcgcgccaaccaccacaccaggcagacgaagcaacctgaagcacaccaccaacacacgcaccgaacccagagcccgaagaggaacacaaaccacaaaacaccacaataaagacaaaaacaacaccagaacgaaagccacaacgaccaactccccaccacccccacgcacgcaccacaaaaacgaacaagaacaacggacacagacagcacaccgccaccgacacaccacacagcagaggcaacaacaacaacaaaaaacacccaccaaaaaaagaacagagacaacagcacaaaaacaacaacacaaaccacagacgaaagaccacaacagacacacgcaaaccccaaaaagaaaacaacgaatacaaacaaaccaccaccaaaacacacccaaaaaaaaagag

SEQ ID NO: 489040 - DNA, 1002 bp, Homo sapiens
gacgatgtcgacgggaacgttcagctggaaactggagataatatacactattgtaattgataacaatacacactactggtgctgtaacgtgctcgcatagattatgctgttgaaaccagacaccagcccgctgtcagggcagtcagtttgtgccatgaacaggcaggcgatttggctttcattcgcacaccgcaggtgcatgtctggtacacagagcagatcattctcttctactcatacgtgcacattctcacagaggctgcacttaagcaacacctgtcacagcactgcgccgcatgcaatgctggaattcacaaatccacaggcaccagaacactggctacagacgtctgccgacaggagtgtcacgactattgctctcacaggatacacgtcattctactgacacgcatatcagcacttgacaccattcttgcacggaaactgctacccaacagttactcccaaaacagtacccacgtaacacaaccacgaatgaccccattgccaggactgcatcaacagttgactttgtgatccctaacagcaacttccctttggcagacaaagcatacgcacatccaaggtgcaccctgctgcgaaggtgaccatagttaggtcttaatattttcaacagacccgacgtgacccacatctagagcgagcaaccaatatacgaagttcctggtccacactacatttcagttcacttacatgaacgcccgcaggaacatgggtgtgaattgctgccatgagcagatggtttcggcctccactccaacgttgtgctggcatcggtgactgtttccggacattggttcggttgacgccctttcacctggcaatttccagcgaatcgtagacacccaggcactcccatcattggcaccaattgaacgctaagcggtacacctgcgtcatctctgaatcacttgcccctccgctcccaagaaaatcactgccattcacgacttaccactcccttcccaacgggcccccggt

SEQ ID NO: 489041 - DNA, 177 bp, Homo sapiens
  misc_feature (127)..(127): n is a, c, g, or t
gtcagctcggtcccagtggttacagaggcccaggaatttgaggctataagtgtgtatgattgtgccagtgaatagccactgcactccagcctgggcaagcatggtgagatccgtgtcccttaaagangcgtatctgctgtcgtctgaagtttgcgtattttaatcaccaacttaact

SEQ ID NO: 489042 - DNA, 895 bp, Homo sapiens
  misc_feature (324)..(324): n is a, c, g, or t
cgttcctcgaccgcctcccccgtctctgccggcgacttttcccggccttcccatgcttttggccacttggccgttgcccagaaacggtgtccgtccgatcccgggatttttccaccacctccggctttttctcgcacgccgtgacttcgcccttttctccagctgcttccaggggagtttttccaaaccccactatcctctctgggactggacagatcgctcgctgttggtgaatcacccaggagctatgggggagaattaaactccgccatgactgttaactgtgccttaaataaagccaataaacagtggctcataaaatanaagtcgcattccatatctttggatggccttttagaaacctcattggccagctcataaatggaagccattgctcatgttggcccaacctggggcaccgagtgatttccatctctggtaaagggtacacttttatttcccgtatgttgtaccatccaaacaccactactacctcttaagtccccgtatacctcctttttcatactggaaaaaaaagcttgtggcccatgggaccgtaagacatcataagatttttataaatatagtttatttttgtgggagataaattttataggactgttctttgctgttgttggtcgcagctaaataagactggacctttaacttttctacccattctgccagttaggtatgtttgccggagaaaagtatccagacgtttaactgccgttgactttctccccgttcctttgagggtcttctaacttattctttgttctttaagtagaattgccgtctatgattgtactttgaatcgcttgcttgttgaaaatatttttttagtgtattatccctgtctgttctgcaccataaacataacagcctctgtgga

SEQ ID NO: 489043 - DNA, 369 bp, Homo sapiens
  misc_feature (29)..(29): n is a, c, g, or t
  misc_feature (208)..(208): n is a, c, g, or t
tgaactggagaggtgaaggttgcagtggnctgagatcgcgaaacagagcgagactccatctcaaaaaataaataaataataaaattggccgttcacggtggcttatgcctgtaatcccagcactttgggtggccgaggcgggtggatcacctgaggtcaggaattcgagaccagcctgaccaacatggagaaaaccccgtctctactnaaaatacaaaattaaccgggcgtggtggcgcatgcctgtagtcccagctacttgggaggctgaggcaggagaatcacttgaactcaggaggcagaggttgcagtgagctgagatcatgccattgcactccagcctgggcaacaagagtgaaactccgtctc

SEQ ID NO: 489044 - DNA, 843 bp, Homo sapiens
  misc_feature (102)..(102): n is a, c, g, or t
  misc_feature (139)..(139): n is a, c, g, or t
  misc_feature (149)..(149): n is a, c, g, or t
  misc_feature (200)..(200): n is a, c, g, or t
  misc_feature (212)..(212): n is a, c, g, or t
  misc_feature (224)..(224): n is a, c, g, or t
  misc_feature (243)..(244): n is a, c, g, or t
  misc_feature (257)..(257): n is a, c, g, or t
  misc_feature (264)..(264): n is a, c, g, or t
  misc_feature (274)..(274): n is a, c, g, or t
  misc_feature (276)..(276): n is a, c, g, or t
  misc_feature (368)..(368): n is a, c, g, or t
  misc_feature (375)..(375): n is a, c, g, or t
  misc_feature (391)..(391): n is a, c, g, or t
  misc_feature (393)..(393): n is a, c, g, or t
  misc_feature (412)..(412): n is a, c, g, or t
  misc_feature (417)..(417): n is a, c, g, or t
gggctgtcatggcgggtgtgctgaagaagaccactggccttgtgggatggctgtgtgcaatactcctcacgagataagaatatgtacacaaagattcttgangtcttgaggaaatccctaaaaatgcagcatatagaangtatacagancagattacaaatgagaagctggctatggttaaagcggaaccagatgttaanaaattagaagancaatttcaaggnggtcaattagaagaggtgnntcttcaggctgancatgacntaaatctggnangaaaaatgagggaatggaaactatgggagccattagtggaagagcctcctgccgatcagtggaaatggccaatataattattacgtgacttngggtgtncatgggaactgatgtnanttaaatatctgtatataangacgngtccttataactgacacttttgtaatcaagacaggtgatatagacaactatgtaggacgactgttaaacacttggggattatggtaatatggtcatgtgaataaattttgatttatacagtactcacacaagtgttccaagactgattttctgtggaccgaagaggccatggaagattggacacattatcaacgaaagtcctaagatttcaaggctgagaccatatcaaacgtaactttcttcatagtgtggtcatccttcattacttaagttacccggaccggacggccttatatgttggccaccacgtttgatctccggggcgatacaggggcttccacgtcacagccgcggtgggccagcactggtcgccggttcaggttagagccacctgtggcaaccggtaacaatgccgcccagcccaaa

SEQ ID NO: 489045 - DNA, 474 bp, Homo sapiens
aaggcccggaaaccggacaagcagaggcggacgtcaccctgagcaaactgcaaggcgacaaggcggcaactgggtgtccaggccgcaagaaccaccatttccctgggagtccgtgctctcttcgaccccaaccctgggtacaagaaaatgatttgtggccccttccggccctaaggatggccaactaccagctccaccctcttaactccagtcatattacatcacttgtggcggcattatgacggacaacctacctggatgacattaatcctggagccgcgaaaattaaaccagacccccccaatgaggatttgaaaatgcggggaagctttgggaatttctggaccaccggaatgaaataactggggggaggggaaagaaccaagttaaaaatgggagaattcctgtttttggcccaaattcccgcccgtggggttgcccaaaagtcccatggagaaaaggtttcatttagaa

SEQ ID NO: 489046 - DNA, 442 bp, Homo sapiens
  misc_feature (1)..(1): n is a, c, g, or t
  misc_feature (373)..(373): n is a, c, g, or t
  misc_feature (432)..(432): n is a, c, g, or t
  misc_feature (438)..(438): n is a, c, g, or t
ntttcggcacagctctaaattatatgaaattgttccacatgtgacttggatcactgtgaacctgatcccattggagaaattagttttactaaacacaaatacattgttagtcatagaaacgtaacttaatgctttgaattccatatatctcaatgcttttaattccatatatcttttttacccacacttgttacatgcctattttcatgggagaggaaaaattatatacagtcatgttgagggctattactaatcttgctgtgtactcttctcagtgttcccaggcgtgtgggctgggacttccactagtgagaggggtggaattgccccggggttaaggccctggacacttcatggaaaccaacctttttanttggacattcacagttaggtttcatggccaaggttctctttggaggggctgttaccccnttttantttc

SEQ ID NO: 489047 - DNA, 1055 bp, Homo sapiens
  misc_feature (314)..(314): n is a, c, g, or t
  misc_feature (351)..(351): n is a, c, g, or t
  misc_feature (361)..(361): n is a, c, g, or t
  misc_feature (412)..(412): n is a, c, g, or t
  misc_feature (424)..(424): n is a, c, g, or t
  misc_feature (436)..(436): n is a, c, g, or t
  misc_feature (455)..(456): n is a, c, g, or t
  misc_feature (469)..(469): n is a, c, g, or t
  misc_feature (476)..(476): n is a, c, g, or t
  misc_feature (486)..(486): n is a, c, g, or t
  misc_feature (488)..(488): n is a, c, g, or t
  misc_feature (580)..(580): n is a, c, g, or t
  misc_feature (587)..(587): n is a, c, g, or t
  misc_feature (603)..(603): n is a, c, g, or t
  misc_feature (605)..(605): n is a, c, g, or t
  misc_feature (624)..(624): n is a, c, g, or t
  misc_feature (629)..(629): n is a, c, g, or t
gggctgtcatggcgggtgtgctgaagaagaccactggccttgtgggatggctgtgtgcaatactcctcacgagaaattcaaataagaaaaattacaaaaaaaaattggcagtgcttcggacctcactttgaaaaatactgattcaggctgggtgggctcacgcctgtaatcccagcacttggggaggctgaggtgggcggatcacctgaagtcaggagtttgagaccatcctggccaacatggaaaaaccctgtctctactaaaattagaaaaaatagccagaggttaagaatatgtacacaaagattcttgangtcttgaggaaatccctaaaaatgcagcatatagaangtatacagancagattacaaatgagaagctggctatggttaaagcggaaccagatgttaanaaattagaagancaatttcaaggnggtcaattagaagaggtgnntcttcaggctgancatgacntaaatctggnangaaaaatgagggaatggaaactatgggagccattagtggaagagcctcctgccgatcagtggaaatggccaatataattattacgtgacttngggtgtncatgggaactgatgtnanttaaatatctgtatataangacgngtccttataactgacacttttgtaatcaagacaggtgatatagacaactatgtaggacgactgttaaacacttggggattatggtaatatggtcatgtgaataaattttgatttatacagtactcacacaagtgttccaagactgattttctgtggaccgaagaggccatggaagattggacacattatcaacgaaagtcctaagatttcaaggctgagaccatatcaaacgtaactttcttcatagtgtggtcatccttcattacttaagttacccggaccggacggccttatatgttggccaccacgtttgatctccggggcgatacaggggcttccacgtcacagccgcggtgggccagcactggtcgccggttcaggttagagccacctgtggcaaccggtaacaatgccgcccagcccaaa

SEQ ID NO: 489048 - DNA, 352 bp, Homo sapiens
agcggcccaggttgtgtgatatatcctcctacccaaattgctcaactaagacaagtcctcgctggacgctcaggatgccagacctcatccattccaaaatatgcccggtgcatatccgaccagctgctcctagaaccaccatttagtactactgagaccagacttcttcacagagttccacagagtcatgtcaacacagcgtagttgctaacacatcaaacacagacaactgggtccacgctcctgcacgctgcagccagctgcagactacatcctcgctgtaccgcaccagttccacacgtataaatactgctgcagagagttagcaatccatcaccacagaccctgggat

SEQ ID NO: 489049 - DNA, 205 bp, Homo sapiens
gacagatgagtttgctaaggaggaagtagcagatctctacgaacttgtacagtatgctggacacattatccaaggctttacctcttgatcacagttggagtgtatatgtcacgtcattccctcagtccagggaggatattttgaaggtttggtagaatgtcccgtgtgtcacatctgttgagggtctgttctcgaatacctctca

SEQ ID NO: 489050 - DNA, 323 bp, Homo sapiens
  misc_feature (23)..(23): n is a, c, g, or t
tgagagggtctcaagttggactnttagtttacagatagaagaaattaatcacttatatctttagatgaatgcacacttacacaaacacatatacctgagaaggtatatagctctggaaaacttaattttgagttggtctggcaatattttccaggcctcctctctgtacccaattacagaaatgaactccctcctttctcagttcatttgtgtctctttattgggctgtgagaataagcagcccaacacttagtttggtctggtaccaggatgcctggcatactcctaccaggtcttcagagggaggcactgagagtgcatgg

SEQ ID NO: 489051 - DNA, 276 bp, Homo sapiens
acatgcctcgcaccactggatcgtcatatcaccggtcaccattcctagaccagattgacattctgacactcgccaaccgatgcactaattattgcgtagctgcacccaccgcactcctttgtggcgggactgaatggcacagttaaggaaagagggtgatcaaaaaatacaagtgtggccctctcgctgctcccttgcccaggaccacttgcattccagcactcgctttatttgctctctcgattcccctttcctcctcactgcttcccaagccca

SEQ ID NO: 489052 - DNA, 1027 bp, Homo sapiens
agcggggtgagtgtggctgggggtgcagagagcgcacgggaactgcgggggtctggggccgaacacgtgaccgcagccgggctcgccgggagtttctaggaaggtggtcaacgaagtcattgcgagtggaacttacagcttccttgagtcggactcagcattcagatactcaaagcaccgactgcaataccgtgcgtgcgaaatagaagagcagaacaggtttcaagacgacagatgagttgtcgaaagagagcagctaaggggtaatcacggaacgcagggccgctggccctgacacatatggctcatgacttatgcttcggcccaagattttgctcccgccgttaggaacggtatccgcgcgcggaatactagcggcccctcatcacgcccgagtcgggcgccatgatgaacaacaacgcgtcgcgaggatcgcatcgagattgcaccgtacgcctaccatgatagacacagcctggtacgcgctacgcgcgaacacgcaggattgacgactaccgtatacgagtagacgcctgagcgtggaacaaccaaaagacgcgtcacgaaggcagtacgttcgtgggaatcccggcgaacagattgaacgtgcactggactgacaggacaatcaaagtgggataggtacaaaggggccacaaggattacaagaacccttcttgagaggaaccaggcagggttgacacccagggtcgtagaaggtcccaagagctgaggtagaggggttgttcctcccctaattatcggccacgttccaaggcttatcccgggaagatcgcagaggattcggtctaggaacgcagagttgtttcattggctccggaattttggtggtacacctagttccttatccacttggtcatcggagaaacttgagtggttatacacattgattccgaccggctcaaaagggggaaatcgggggaaaacggaaagttgtgcacgaaaaataggatggcgcgcatgtgtcgtgaaccaagcggccacggcgtgagaaaaacttgagacc

SEQ ID NO: 489053 - DNA, 210 bp, Homo sapiens
acgcgcactgattattattggtatatgagtagagcatgatcacattatgttcaaggcattgaaacactgtcatcttcttatcactcctgtcacgaatcctagatactgaggagactgcccctgtgaggtccttgtgggcggcccccttgggagggtgtccctggggctttccacgacgaaggtgggggaaggacctttgcttgatggccc

SEQ ID NO: 489054 - DNA, 379 bp, Homo sapiens
  misc_feature (263)..(263): n is a, c, g, or t
  misc_feature (285)..(285): n is a, c, g, or t
ccatgcacagttggtggatacccacgtgatataaaaacaagtgtctacacaaaaacttgtgcacagatgttctttgcagcattatttataatagcccaaaattgaaacagccctaatttctatcaactaacaagtgaataaacaaaacgtggcatatccatacaaggaatattattcagcaataaaaaaagagatgaagtactgatatgcaccacaacatggaaaaaccttgaaaacatatcaagtgaagaatgccagaaccnatgaaaggcccacatattatantgatttcatttatatgaaatgtccagaacaggcgaatatatatagagagaaggcagattagtggttgcttaggctgaagggttggggaggacaa

SEQ ID NO: 489055 - DNA, 423 bp, Homo sapiens
  misc_feature (275)..(276): n is a, c, g, or t
  misc_feature (292)..(292): n is a, c, g, or t
aggttgtagtaagccgagatcgtgccactgccctccagcctgggcaacagtgagacacgataccccaaacctttgcttctagggatctggtaacagctgccccacccacaagaaatggagatctgggaccatggacaaatttctagagacctattttcctggattctgtgaatctcgccgaggttttcttccggatctcggtttctgcattttttgtttgtttgcttgcttttttgaaacggagttttgctcctgttgcccaggctggaatgcanntgcgcgatctcggttnactgcataccttcagctcccggtttcagacgactctacggactaagtcttcctaggcgatggtattacttgcgcccgcctccacgaggtcagcttctccagaccatcctcgccatcactgttcgctctccg

SEQ ID NO: 489056 - DNA, 165 bp, Homo sapiens
gcctttactaaagccacttttatagtcaactatctcttcttatttgtgtgattagaacttagaaaaatatttactagttgaagttattatcactgttgactttagttcttaaactcatttcacttctaatactttctgctataactgtccagcattttaatgaaa

SEQ ID NO: 489057 - DNA, 101 bp, Homo sapiens
  misc_feature (48)..(48): n is a, c, g, or t
acagcgtctcagcgtgcgtatgacactctgattcacagagatcatgtnctcaaagcgacattggggaattgggtggaccccatagattcaacttatcagta

SEQ ID NO: 489058 - DNA, 716 bp, Homo sapiens
agttgttaaacactgcgctttattttcttaagcagttgtggtgtgagtatcagaattgaaacaccttttttgtgggttcaacatatttacctttacatggtccatgactttttactaagttcagtgaatatgcctgtaattcagtgtatttcagttccgtcagaaagtgtaaatgttagtttcttggtaaagtccttttcttgcttaccttgactgttgatgtactgattgcagaagttcacttgtctcgtttgtgattcttccagatgtgatgcttgatattttctatatgcgagttagccatccacacccaggcatagcctggatacagtataaaacatagatacaattaaacagatggttgccaagcacaggaaaaccttatttctatattattcccttccttattttacagcattgtgagtaaatcagatgttgaacttcttttgccaagggaattatagctgcaggttctctctcactgccatcaaactgtacaaagcattaaacactgcgaaggtcaagctcacacagattattttggccacgttttgtattcaagggatttagtaacatcatattgtttccacccaggcagggaacgtagggcttacgtgttttaaaacacctctgctttctgatgtagccttaatattctgctattgccgcaattaaaaattgtcttcatgtacattttggaactaaacacgtgatgt

SEQ ID NO: 489059 - DNA, 899 bp, Homo sapiens
ctcaccgtctctctggtgtgtccgccccgcagggttgcatacctggggtgttctcgccagaggtgtgtgccattgtgcgttatgggccgccgggggtttttaccaattaggacgctgtaggaagtgctggtgtgtttgtcccagaacagagtatagtattctatttgggggaagccgcctactttctacttgtcgtccaagtgtgtggccccccacagggttgcttatgctcgcctgactgtcctttggcgacgccacgtctcggttgcctctggtgcccgccacacacccgctaaacaattctgggcgcaaatttgttgctcccactcgggggccacttccgttggttgtcaatcaggccgctgtcctcagacaatccttaatcccgctggtttaccacgctccccactctttaaaattgtttccaagagccgctccacagggctcgccggtgttaccttcgtatcctcctcgctcccgctggatgggccgccactccgcctcaggagcgtcctcacacctcactcggggggacatcacacggaggggagaggtttattaaaaaccgcacaagcccttggtggagttcacgagtgcattcttttgggcccaacaattatgttatacgccctcttatcttattttgcctgttgaacgtgcccttgtgggcgcgagcacttgactcgaatcacaatagttcctccatggcgataaaacaggatgaagtaattaaccccacccgttcgcagaggcggtgaggcgactatgaaacaagaggctacaccgcggagactcgtggccaacaagcgtttatcaacaccccggcgccgcccgatctccaacaaagcggagtagttcaatcgccccctgaaaaaccccatttgggcaacacacataca

SEQ ID NO: 489060 - DNA, 219 bp, Homo sapiens
  misc_feature (31)..(31): n is a, c, g, or t
cttgatgatatctccattgggggcttacatnggggattgattctattcaactcccttactctccattatattctattccattcgggttgttccattccattccattctattccactccattccattgcactcgggtttattccattccattccattccattccattccattccattccggaagtttccattccattgcattccattccattccattccg

SEQ ID NO: 489061 - DNA, 171 bp, Homo sapiens
tgggtgactggcggaagactatggacggcatgtctggcatggaacggccggaagaagactgtttgatgccgccagtctccgacctcacaatagaggccagcttgctgtgctgcgctctgagctcctgcttcatgcttctcctcctcgcagctcttgcgaacctcaagtcta

SEQ ID NO: 489062 - DNA, 348 bp, Homo sapiens
tcttctcccaaaactttcccccttaagggatttctgggcaagaaacaaaagcaaaattgtcccctccccccgggggttcagatgaaacctggggggaaaatcaggggccccccccaaagggggccttggggaagaacccagctggggttataaggaattgcccctgagaggggccccctatttttggtgggtccaggtcccgggtctccttcggaaatcaagctggaaatggcccccccccctgggccgggggccctggttttctggggaaatttttttttggtttttgggaggccctggggtaggagggggggttccggaataaaaatggggaaggttttgtttcca

SEQ ID NO: 489063 - DNA, 503 bp, Homo sapiens
aatttattcctttaggttccccctccataacccctttgccccctggccaatatagaaaggtgttttcaaaagaatttggccgtagattttcccacccctcataaggggcgcattcaataaggaaaaagttctccctcccgtattaaattggacataaatccccaaggttcttaaagaccccccagggacatgtttgttgcctgggattggtaaagaaaggttggtttttgaaccttgaaatttccccctggggttttttcccatcatttcggcataccccgcaaaaggaatctcatgttgactcccggcagaagttcaaggggccccagccggtctatttgttttgaggggaaaattgtgttttggaccccgtaacccatttggcccctttaatcgaggttttccaaattcccaggggggttaataaaaaatgataatcagttttttttgctaaaagctaagcccaatttgtaataaagtgttttataatccttccaaagcca

SEQ ID NO: 489064 - DNA, 332 bp, Homo sapiens
agagcagacacagcagcaatggagtgtgcacccgcagggtgtggtgcctcacacacgtaatctcagcactttgggtggtcaaggcaggaagatactttgaggccaggagtttgaaaatagcctagacaacaaagcaagatttcatttgtactaaaaatttaaaaatttgccaggggcggtggcacatgcctgttgtcccagctgcttgggaggctgaggcaggaagctcgcttgagctcaggagttcaaggctgcagagagctaggatcacaccactgcactccagcctggacaacagagtgagaacctgtctttaaaataataataataat

SEQ ID NO: 489065 - DNA, 653 bp, Homo sapiens
gttgctactctgtgatcactctctcctgagacatggtgatcgaactccaacatggacagcagtgagcaggcactgcatacgtccgcaggaatggaatgagcctcagcatagcgcggatgaaggtagccgtagatctgtgatgagggaggcggggcccgggtaatccacatacacgacaggcacgtggcgcaggaacctgtgtgagaggggcttacttccagggtctgtggggggattacaagccccaacaaactggattctctccagcttcacccatgtttgatctgaggtacggtaaaagcctccgtgctccagcatctgtctgatgaaggatatgaccctctgggtcccatatttatccatatctggcaagttgatttcatcacagaacaacaccagccactttccaagttgaacaggagccaaaaacaccccattaggtgtgcgcctgtactcgcagtagtgatcaaaagtcttcagaagcagctctggagtagtagcactggagaagttgagacccaccaagctccatgtcaggcaaggaccggagggcgctgaagactgcatggtcttgccagaaccaggagggcaacaagacagggcttgtgtcggcagccaagtgtcagaggctcgtggcggatggtcaggtggca

SEQ ID NO: 489066 - DNA, 396 bp, Homo sapiens
atctccatggagatgtcctggacaaagcaggctgaactggacaaaaagaaggtagagggggcaattgttcttgtctgagtagctgtgcctcccagggcagcatgctgcagctctcgctcccttcggtccaactcctctgccttcctggttgagctcctcctgtttcttcagcagctcagctgtggctgctgcagctgaggcctgagtgctgtatgagccatagttcttaggttctgtggggctgagctttctcgagggcttgcaaaggagggagctgagggttgagggcaattggggccaaggggctggaggctcctaggcttggtgatggctcccgggtctcaaaagggtcgtacaccgtcacgcgtggaataatggctggatggtatagggatt

SEQ ID NO: 489067 - DNA, 308 bp, Homo sapiens
gattcagaccggtcttggcatgggtatcgggatgagtatcgggatagccacgccgggatatggatcgatatggtggccgggggcgctatatagaccgaggcagcagaacaggatcatagaggctatgattcccggataggcagtggcagaagagcatttaggcagtgggtatcgcaaggatgatgactacagaggaggcggggaccgctatgaagaccgatatgacagacgggatgatcggtcgtggagctccagagatgattactctcgagatgattataggcgtgatgatcgaggtcccccccaaa

SEQ ID NO: 489068 - DNA, 365 bp, Homo sapiens
  misc_feature (219)..(219): n is a, c, g, or t
  misc_feature (227)..(227): n is a, c, g, or t
  misc_feature (253)..(254): n is a, c, g, or t
  misc_feature (258)..(258): n is a, c, g, or t
  misc_feature (324)..(324): n is a, c, g, or t
  misc_feature (343)..(343): n is a, c, g, or t
caatggtcgtaaataaaggctaagcgctggatttttccatggccccctgactcctcaggagcgcaggcagaggaggtaaacaggaggccaggttacccatgagatgaccagaagctcatccagggccgggaccctggttcattcgtgaattcttggcagcggctccaggctgggcacattatatgctgtcatgtgactggcctggtggccacctcttgntctcttgnaaaatgtgccactcttgtgcttaagnnaaanaaaggttgccgcctgacctgtcaagcacccaggcccttcttcttgacttccttcactttgaacccngaagggcaatttgggaggnaaaccacaaaagctttggcccc

SEQ ID NO: 489069 - DNA, 870 bp, Homo sapiens
  misc_feature (482)..(482): n is a, c, g, or t
agcggactcactgttgcggcacggagactgtgaagctctcgaggatcctcccggtgtgggtcggcggctcgcccgtcgttctccatacgccgtacggcccgttgcctccgtgcccggaccgtgtacctctgccgagtgagccaatactggacctgagtgcagaagatcgaccaggctcgtgtccaagcgcgtgttgcggacagcggacggacggacactgggcagccatgacgagtgagaaggcgagcgacactgtagccgcgtgagcagcatgaaacatggtctcgagagcgtaatggagtcggcacaccgtgttcttgccgggcgccttgactagaggaaacctgccttgggggtcctgaaggatcccagcgatgcgtcccgagtgtcgtgcatcaatgtcagggctcgtagagtagcgagtggacctcacggaaatggaggaaattttgccaccatggttgtgaccgcgcacatagtanaggaccaatatacaatgatggtgccatcgattctctcgagatccagagtccctagggactcgggcgagttgcagtgtcaaagttggttgggagaggtgtaaacattgtttgaacttagttacacacctcgaaaactaaaatgctaaagcatcgaagcttcatggggccttttcgtgaatggtagcaatttctggaaccttgggcgtttgaatacaacgggaccccgttgggagcttttagactaggaacagattggacggtagatgagcaaggaatctccttggggcacaacacagaactttgggggcttcatgagtcttccactattggggaaggataggcctagcgaagggtttattgcgaccatatggccacatttgacttacct

SEQ ID NO: 489070 - DNA, 214 bp, Homo sapiens
ctcggcagataaagagttgaataaaatgtaccatcaggcaactctcgggttctacacttaggagccagatgagtaaacgggtcactgggtaatctagcacagtatctgtcacggaaaaagaaactgatgctgagtctacaactgagaaacagaagaaaaaacgtgtagtgacgctcgcattctgaagttttcgtgttttgtggggttaggtctg

SEQ ID NO: 489071 - DNA, 551 bp, Homo sapiens
tgacgcctggtgcagcggggtggttgcccggtggtgccctgtgtgttgccctgtggatgggtgaacctgctgtgtgtgctttcctgctgtgatgtgtttctgtgcaggtgtgcagtcctgtgtggcctggtggtctgctggcctgtgtgactgtggtgtgcctgtgtgtgcctgatgtgcctgctgtgagctctgctgggagtgcaatggtgccggagggataacgggacgttggattgcccctgtcaccaaggttggtgcctggcttggtcaagggacattgaatgatcaaggtcccgtggaggaagatctatctcgttctacccttgcccattaacggaatcagagatcattgactttcttcctggggggcctctctcaaggattgaggttcttgcaagcgattatgccagttgcaagaaggcaggacccgttgcctggccagctgcacccagggtttcaagggccatatggtttgctaatcggcggactaccaaatgggccacgtacggcgtctggggttgttcacggtgcttccaaggggagcgttg

SEQ ID NO: 489072 - DNA, 790 bp, Homo sapiens
  misc_feature (34)..(34): n is a, c, g, or t
  misc_feature (42)..(42): n is a, c, g, or t
  misc_feature (52)..(52): n is a, c, g, or t
  misc_feature (54)..(54): n is a, c, g, or t
  misc_feature (56)..(56): n is a, c, g, or t
  misc_feature (65)..(65): n is a, c, g, or t
  misc_feature (67)..(68): n is a, c, g, or t
  misc_feature (70)..(70): n is a, c, g, or t
  misc_feature (97)..(98): n is a, c, g, or t
  misc_feature (130)..(130): n is a, c, g, or t
  misc_feature (167)..(167): n is a, c, g, or t
  misc_feature (170)..(170): n is a, c, g, or t
  misc_feature (181)..(181): n is a, c, g, or t
  misc_feature (198)..(198): n is a, c, g, or t
  misc_feature (201)..(201): n is a, c, g, or t
  misc_feature (203)..(203): n is a, c, g, or t
  misc_feature (210)..(210): n is a, c, g, or t
  misc_feature (248)..(249): n is a, c, g, or t
  misc_feature (265)..(265): n is a, c, g, or t
  misc_feature (342)..(342): n is a, c, g, or t
  misc_feature (356)..(356): n is a, c, g, or t
  misc_feature (363)..(363): n is a, c, g, or t
  misc_feature (376)..(376): n is a, c, g, or t
  misc_feature (378)..(378): n is a, c, g, or t
  misc_feature (391)..(391): n is a, c, g, or t
  misc_feature (403)..(403): n is a, c, g, or t
  misc_feature (441)..(441): n is a, c, g, or t
  misc_feature (482)..(482): n is a, c, g, or t
  misc_feature (517)..(518): n is a, c, g, or t
  misc_feature (523)..(523): n is a, c, g, or t
  misc_feature (592)..(592): n is a, c, g, or t
  misc_feature (610)..(610): n is a, c, g, or t
  misc_feature (670)..(670): n is a, c, g, or t
  misc_feature (674)..(674): n is a, c, g, or t
  misc_feature (777)..(777): n is a, c, g, or t
tccgcggaccctgagcgcaagagccaagccgccngcgctgcnatgtgggccncncngccgccgcncnncnccggggcctggctcccgggagtccccnnctgcggtgccgccgaactgtccgtgaactccntagagaagtttcacttcaagtcatggatgtctaagcnccntaagacctacngctacggaggagtaccnccncnggctgcngacgtttgccagccactggaggaagataaacgcccccnncaatgggaaccacacntttaaaatggcactgaaccaattttcagacatgagctttgctgaaataaaacacaagtatctctggtcagagcctcngaattgctcagccnccccccngtaactaccttcncngtactggtccctncccccctcccgnggactggcggaaaaaaggaaattttgtctcacctgctncaaaatcagggtgcctgcggcagcttgctggactttctccncccctggggccctggagtctgcgatcgccatcgcnnccggnaagatgctgtccttggcggaacagcagctggtggactgcgccccggacttcaataatcacggctgccangggggtctccccagccangctttcgagtatatcctgtacaacaaggggatcatgggtgaagacacctacccctaccanggcnaggatggttattgcaagttccaacctggaaaggccatcggctttgtcaaggatgtagccaacatcacaatctatgacgaggaagcgatggtggaggctgtggncctctacaaccct

SEQ ID NO: 489073 - DNA, 104 bp, Homo sapiens
cacagcttaagctgtcagggttacaggcttgcccctctgaagccatggactgagctctaggttggcccctttcagccacagctgggtgcagctggtgtatagca

SEQ ID NO: 489074 - DNA, 234 bp, Homo sapiens
agtcaacaacagatggcagataagatagcagtcccataagattataagactgtattaaaactataccatttactatgttaagatacacagatacaaaccatggggtaacagtggcctacagtattcagggtagtacatgctgtacgggttaatagccggggagcaacgggttatctcatatagccaaggggtgtgtggtgggatatcccctccattggtataagtcacactagg

SEQ ID NO: 489075 - DNA, 387 bp, Homo sapiens
gttcccgtgtgcacacttccacgttactctgcatttcttccttcccaaaaaggtgggacccaccatgtccttcaacagtttgggctgacaaagcattattggcatggaaacaggagtaagcgcttacatcctaactcggtccgctctaaacaaccctgagatggtggagggccttgtcgttatcaacgtgaaccctttttgcgaaaggctggatggactgggccgcctccaagatctcaggatggacccaagctctggcggacattggttggtgtcccacctttttggggaaggaagaattgcagagtagcgtgaaattgatccacacctaccgccagtaacaattgtgaatgacatgaacccgggtaacctgtacctgttcatcaa

SEQ ID NO: 489076 - DNA, 128 bp, Homo sapiens
aatgcaggctgaacctgacctgggtactccctgcctctgccagcccctttctacaccctccgtggtccccatggcactgtgctctctcccctctgctagaatctcgctgagggattggtaggggaggg

SEQ ID NO: 489077 - DNA, 147 bp, Homo sapiens
  misc_feature (27)..(27): n is a, c, g, or t
  misc_feature (67)..(67): n is a, c, g, or t
  misc_feature (129)..(129): n is a, c, g, or t
  misc_feature (137)..(137): n is a, c, g, or t
cccatcaactctaaggagctgtttgtncatccactctggaaccgctcgtttgtggcctgtggcaatnacatcgccctcatcaagctctcacgcagcgcccagctggggagatgccgtccagctcgcctnactccctnccgctggtga

SEQ ID NO: 489078 - DNA, 220 bp, Homo sapiens
gtatcggccaacacgtttagtgctactaggagacaaacatactcacagtcatcactgcatagcgtcaaaaatgctatatttaaaattcctaacaatttgcatcatcacaatttaacgttgctcatataatttcttaggggaaaatgaagcagacagaagttcatttaaaagttataccctgagcattgaaaatctgcctaccatatatcagcttctttct

SEQ ID NO: 489079 - DNA, 101 bp, Homo sapiens
cctgggggacggctcctcttggcacctataccagccttcggccaggtcagctggctgagggagacacacactgagatggctggggttcccctgtgaacaag

SEQ ID NO: 489080 - DNA, 644 bp, Homo sapiens
ggtgtgctaacctggacgtgtgtcgccagtgcgagaggcgggagccggagaggtgaggcaggacccggtgctccactgtccgcctctccgagctcttgtgacgcggacctcagtgccaggattgctcggtggcgagctggctggcgcctgcgcagtgccggcagagggagttgcggacagcctgagagggctggctctggggaggcccctgggctgacggggacgtgccggggcggcgggccgctgtagcacggctggaggagtggctctggccgtcgtggtcctgtctttggccctgggtatgttcgggggcgctgtgttgcttggcgttggttaccgttgcgcggcgggcggtcaacgcttgcactccgcgcctcctgttgttgccttgccgacttccttccagccccgccgtgtccccggacctcttctggggaacctaccgccctcgacggtctacttcgggctaagacccgcagcccgaagcccctcctcaccggacttgatgtgggcgcagcagggcaccaccccggggactcctaagctcaggcacacgttttagcagggggacggtgtggtccctattgctgggagtccagcgacgggctctccttcgggcggccaacacatcaggatggggcctt

SEQ ID NO: 489081 - DNA, 157 bp, Homo sapiens
ctcgcccgattaccactcattgcagaaccagcgctccttgtagcaacatctcccctcggagcatggccacggtgtcaaagtccccgtcacatgatgttgggcccataggtggggtttttgacaccgtggccatgctccgaggggagatgtttgtctt

SEQ ID NO: 489082 - DNA, 412 bp, Homo sapiens
tcctctacccaagattcccctcatattggcctatgggctgcctttatggaggtcacctctgccaaacagtcctcttatagtggacactgtgatgtgccgccaaggttccacctcagggataaacaacttattctcttaaatgttggctgagctgccagaaggcatttggttgttagccctcttgggggattacttggtccaatgtcacatcttgccagggtggctccctcacctcaactcagggcagctctgtggggctttctcacctccagagcttccccttgggattgactgtgaccttggttgcagtttacgttactccctctgcataatcctgcttcctcacccactttccacagttgtcgatcccaagggccccctaacaaacttcctgcacactaatctctgcctc

SEQ ID NO: 489083 - DNA, 474 bp, Homo sapiens
  misc_feature (29)..(29): n is a, c, g, or t
  misc_feature (61)..(61): n is a, c, g, or t
  misc_feature (101)..(101): n is a, c, g, or t
  misc_feature (118)..(118): n is a, c, g, or t
  misc_feature (122)..(122): n is a, c, g, or t
  misc_feature (138)..(138): n is a, c, g, or t
  misc_feature (147)..(147): n is a, c, g, or t
  misc_feature (149)..(149): n is a, c, g, or t
  misc_feature (155)..(155): n is a, c, g, or t
gcgtccctgatggtcccaagacccaaggnctggtgggtacttctatttatgggcccttggntcttattcttcctctccgctgtttaattcaatcggggggncctttgatttctccatngaancgaagaattgaagacnggttgaacncnatcagngcccggtttcttgatatctaatactaatatactgatggagttaaacttccaggtacgaatgtgtccagaaacgaaccttaccctgggtttcctcagtgaaccagttaactctggcaaagatagcgatctagcctcaggggtttcagtcaagttgcgcttaaaagaatgccttaaaatctgtagttatggtgtcaaatataataaatcttcaccagctcatgcacgtacaagtctgaaatgtttcataaaaggtttagatgacctgataacatgtttctaaaacccagagagaaagagagagactgatacaaacgtcaag

SEQ ID NO: 489084 - DNA, 1134 bp, Homo sapiens
tgtcttcatagcgacgcgcgttgacatacgcgtcgtgcgtgtgttgagtatgtgaccgcggcgtcgcccctctttggggaacaaaaacatcgcgtggcgtccacgcagttgtgttgcgcaccactattttcccccgctgtctgggtgcaacacagagttttagctcttttcacaagggggctcgtctttctttttgaagagtcccctccgtggtgggggtttttatatgcgccttcccacacccccggttgccccacgttttggggttgaccccgtggaggggtaagagcccgcccctcattttttctaggcccttctgcgccaagagttcactgggcacagaccatttctccgggccctcatattgagcgaggcgtgggctctcgggaagtaacccgcggaggagccataagccccggtgccctggtcttccagccacgaatttgtatgggagagcccaccccccacggggtcaccccaacacaccacgtcttgcctgtagggtttggaagcttcttgtatgacgagcacgctctctccagtagccttgaagacaggatctccacgatctccacgtccctgtgtgtagagtctgccccctgtgacggtctccatcgtggaagatatttgtcaggagcccccctttggggagacacacacccttggagggaagagtggaggcccccgcttcagccccttccaggatgtggagccagacgtctcaaccgggggatctcttgctgcgcacccttggagtccagataactggcgcaccagaacaccggggccagaagaggacacagaccgccccaggccccaaggagtatgtaggcgacctgctgagccatctaaggtcacaagctggagggcgtgagatctgccacactactccgcctcgccctgctggagaagatggcgaggacctttatatctgttggtgatgcccttggaccagccagcacgacgtcccaatgccgaacccatccccaaagacccacccccccccggatagatggatggccaaatggtggtttgagagacccatagaccacccaagattttgaggcctttagccccccgaagccgggtaccccttggggaaccgggggccccattaaaaattcagaggttcca

SEQ ID NO: 489085 - DNA, 1208 bp, Homo sapiens
tcaccaagtaactctgctcggggtgaaccatatctccttatctactcaagtaaaccagtagtttatacttctgttcgacttactggttaaactcgtaataaagtactgttcccacactcataatataggcttactagtcatatcacacaacatgcgctagggtaggcatattcctccttcttcttcgtcaccgctagtcaccggcacttcttcgcctgcgtaacggcaagagcagcctatccctcctatatcctaggtactccacaacacaaaccaagttttatcaactcaggcccgattaatatcgggaccattatcccatatacaacctagttagaggcccaattactctcacactcggagacaaccctagatcacacaagcgcgtcattcactcgggttacttaactttatagcaactatctccaaactcagtttaccaccgtcaccaaggcaagcccttccccttcacttagcggaccaacaaggacaattatacgggcgacgttgtacgccatttccaccagcctatgtggacaggacattctcccaatccccaacttacttgcttgccccccgttgaatcaaccactctacatctacgccccacttgtcccgtcggcaccttacccacaggcctatacgaaggaaaaccatggtacaatgatttcgaacgaacacataccacagggccgcccattatccaaccacaccgtcacaaaccactaatacaacgtgcctaacagacctcacctccgtgggtcacgttccgttaattgtacacgcgcagccacctatatgcgcaacgcacttcaacgcaacatatcccagtacttgcacggaacgtgttatttcccctgttacagacacacacctccgccatcacttctcacacgtctgccaaccacccgcgcacgccccggtcactacagctaaccccctcaaactcaataccacaaccttgattaacgcctctgggacacctaccctggtcatatcaccccacattcattctacactcgtacccatcgcaacttcactttccaccccctttcgcctaccttaacatcataccacccataatcttacagggttaccaccccttgcatacaccccccaccacgccccactcattttcggcgcacatgcccacctctacactctcccccctcactcaattgcacgccaacttctatcctcacgccccg

SEQ ID NO: 489086 - DNA, 205 bp, Homo sapiens
gaaaatttttgggaaaaaaattttcccccgacttgctttcaaaaactgttagggaaagcggttgaggttggaccccaccattccaaaaaaaaaattgaggggggggttttcaaaaaaggaaaaacttccctaacttgtttccgggggggggttttaaaagcagggttttttttcaaaaaaaaaaattaaagggtttttttgccca

SEQ ID NO: 489087 - DNA, 354 bp, Homo sapiens
  misc_feature (280)..(280): n is a, c, g, or t
atagaagtctacactctgccaggcttgattgcagtggcacgatctggctcactgcaacctccacctctcaggttcaagcaattctcctcctcagcctccataatagctgggattacaggcgtgcaccaccactcccggctaatttttgtatttttagtagagatggggtttcgccatgttggccaagacggtctcgatctcctgaccttgtgatctgcctgcctcggtttcccaaagtgctgagattacaggcgtgagcctccgcacctggctggaagtntttttttaaaaaagggaaaactagattttctgaaagcttcgtttttgagagattttatacttacctctttattg

SEQ ID NO: 489088 - DNA, 446 bp, Homo sapiens
caatactataaaggaagtgactttgactgcgagttgaggctgttgattcactcagagtctagcaggaggaattagttggggtcaacaggtgctaagaatcaatagacacttcgagagaagcaactcaagaccaccatcaaggcttttccaggaactgctgtcctcagttccactggacagacgctgggttgctcctacttcgagacggaacaaatccccgaatacgggggtatgatacgaaaggtggcatctataaaccgatttcaagtacgctatgaaagtacctgataggtactttccttgacaacgtttacggttccccctaattccaacaaaacgcgggaacagtatgtactaaccaaggatccccgtgtcaatttggaattactgcacctaacatctattgtgttgtaccccggaaaattgggaagaggaaccccgttaac

SEQ ID NO: 489089 - DNA, 136 bp, Homo sapiens
agtgtgaacacgtaggcttggattaaggcgcaccgcgcatttctcaggcatcagtccagtcagcacattcagcacagttgtgcaagcatgcatccagatgtcgcagggcacaggttccattgtgttgcatcatttg

SEQ ID NO: 489090 - DNA, 991 bp, Homo sapiens
  misc_feature (442)..(442): n is a, c, g, or t
  misc_feature (894)..(894): n is a, c, g, or t
tggggtttaatttttttccttggcttttgtcccgaccccgggggggttgaaaaacggggcccctgggggaaaaccccctttggtggggggggaaaaaattttcttccttgtaatctaaggacaatttcctttccccgagctttaaaaaaaattattcccaaaaaattctctgtggggaagattatactcgtggcgagccagaattttgcgacaaaacaacggtgcttcattcctctggtgtgtgggggcgacagcgcttcagtgagcgtctacaccactaattaatttaaactgtggacatcttcttcgggagaagagaggcgcaacatactgggggcggcgaaaaacattcgtcagccctgtatatgcttctcatagagaattccccacttggaggggcgccttcagaggagatacgagcggccttttttttcaccccaancaaatttcttcacactttttgtggtgcaccctctttatttgtcagctagcggaggactatctattatagctagtcggtaatattcgggcgcccaaggaagacacttctttaacaacctcttactaactcactataaacccccgcgggggcggtcttctcacaatgttaacacgcactcctcttcttgtttcctacaagaggttagttcatatcattccacccgcctctggggggaacttctccggggaacacatctctccaaggcgtacaaaccacgaggatcaaccccaactaacgagagggcgccgaagaggcgataaatccctcctcgaggagggggacgcaaatagcacacatcatctacgaggggacactctaacgacggggggcgacgaagaaacacgatctttctctcccctatatattgtggcccccagaggggccacacttcnccctatacgggaacactgcgcacaggtaaaatggcggacacagctccagaggcccacagggtggggggcaccctccagtggggtccagatatgccgc

SEQ ID NO: 489091 - DNA, 409 bp, Homo sapiens
agttttatattcttcgatcaatatcttctcaattactgttccctacccccaacccctagtaaccattattttactctctgtttctatgtgtttaacttttttagatgccatatataagtgaaatcatgtggtattttcacctggcttatttcatttaacatgtcatctaggttaatccatgttgtcacaaatgacagaattttcttctattttaaggccaaatagtattccattgtgtatatataccacattttctttatctgtttatctgttgatggacacttaggttgattccacatcttggctattgtgaatagtgttgcagtgaacatgggagtgcagctatctctccagatcctaatttcaattactttgaataaataccctgtaatgggattcctggaccaaa

SEQ ID NO: 489092 - DNA, 297 bp, Homo sapiens
aaacgcagagaggacgggaggcagaggctaactcgacacggagcgcgcgcatgccgttgccatcgaggctgtcctacagacagaaccgggtgtcatggatgtgaaccgggcggcggaggctcaacttgaggcggagtgcgcggatgccgctcgcatcgaggccctcctgcaggcggaagcagacgtcttggacttgaaccgggcggcagaggctcaactcgacgcggagcgcgcagattgccattctcatggaggccctcctgcaaggcaggaactggacgtcctctctgcggtttg

SEQ ID NO: 489093 - DNA, 81 bp, Homo sapiens
gggcgtggtgcggagggcggtactgctaatagatatggagcttctctttgggaaacgaaaatgtcctaaaagtattatgga

SEQ ID NO: 489094 - DNA, 324 bp, Homo sapiens
ggctttgtgttcaccagggaggacctcactgagatcagggacatgttgctggccataggtgccagctgctgcccgtgctggtgccattgccccatgtgaagtcactgtgccagcccagaaccactgggctccgggcccgagaagacctgcttttttccaggttttagggtcaccattaaaatttccaggggcaaccattagaatccttgagtgagtgcagtgtcaagctcgagcaaagcggaccagcgacaccgtgctgacatgtcacactcccctctccttggctggtcatcagagtttcgcatgcagactcaccatgaggct

SEQ ID NO: 489095 - DNA, 206 bp, Homo sapiens
agttcacgcataataatctagtcatggggatcaggggtgtaggtgtgccttgtggtacagaagtgtgctagggcatttttaatcttagagcgcaaagcctaatatcactgcgcccgatcataaggggatggccatggctaaggttaatcagatacgtatgggtaggttaggtagtacatagcagataaggccaggcagtcctgcag

SEQ ID NO: 489096 - DNA, 468 bp, Homo sapiens
tcactatcacacaagcctaactctcttcactctatgaaagctgagagagtgtggaagctgcagaagaaaagtttgaagctagcagaggttggttcatgaggtttaaggaaagaagccatttccataacataaaagcacaaggtgaagcagcaagtgctgatgtagaagctgcagcaagttatccagaagctttagctaagatcattgacgaaggtggctacactaaacaacagattttcaatgtagatgaaacagccttctattggaagaagatgccatctagaactttcatagctagagaggagaagtcagtgcctggcttcaaagcttcaaaggacaggctgactctcttgtaaggggctaatgcagctggtgactttaagttgaagccaatgcttatttaccattctgaaaatcctagggccccttggggcttaagggacccttggggcttaagggacccttggg

SEQ ID NO: 489097 - DNA, 676 bp, Homo sapiens
cttggataattaatgggaggtttcagtcgatcaggacaaaatctgtttagtcccccaaattactgatcaatagcatagcgggctgctatgtttgctcggtacggtaactcagccactggcgaggaaagctccacatcgtagacagtcaaagtctctgcttctacaagaataggacttcttcctctccttaatccgagcatagcagactgtgatgtcattgtctgtgatttcaggaatgactgggccgcgagcatttataggaaagaggtctcgttacaagggactcttgacatacagagctcctgagtaacttcaacgatcataccacgtggactaagaaactttcaaaatttttaatgaacaggctgatgccttcatgaaattcaagacaaagaagaaaaatactcaatgttattggactaactaatcaaaaggataatgatttcataattttctatttgacaaatgtgctgattcttggaatgtttcattctccagatttatgaacatttctcttgagcaactggtaaagtatactttggtaaacaaacacttgacaacatttccttttgctctctatctgagtgccccagaattgggaatctattcattaagtattccatatgtctgatggtagttacacgctatttgcacaaagttcacaaaaaacaccgca

SEQ ID NO: 489098 - DNA, 762 bp, Homo sapiens
tggaaagggggttccactctgtgttgcccgggcgggactgtgcaagggagcgatcccagctcacctacaacctcgcgcctcccggggttcaagcaatttctccgtgcctcagcctccagagtagctaggatttacgggcttgagccaccacgcccagctaattgggtatttttaagctagcagagggggttccctccagtgctggggtcgaggcggggtcttgaactctcccgagcctcatagtttgatccacccaccttcggagcctcccaaaggtggcgggggcgataacagggctgtgacgccattggtggcccacgccccacgtggataaggaggtttcaagtgggcggtaccggggttgcgaatctaaatctcacttggggggttaatattaagctcctttttaggccatgtttttaatttttttgcacaaacaccagtacacgtatggggttggtagcgcctctatgggcttctaattccattctgggccccacggtgtctgcgctcaacatcctccagggttaacagacacgcctcgtgaccccttttaaaccggttatgtaatttccctacgaggatatttccctataaccatttaagagtttcctcacagaccatagggggagctggtggtttaacaaatcctcctttaaaaaggcgtggtcttctgtggtcacacactggttgttggaactttccccctaaactttggggggccgcaaacaccggattggggcaaactcccctgaattctgt

SEQ ID NO: 489099 - DNA, 145 bp, Homo sapiens
acaagatctcttggactcagtgctcagagcctggcctggttgtgagtgtgtgtcctgtgtgtgtgttgcgggaggggaggactggggctggaagtcagcacccaggaagatctgtcctcctgttcttgatggaagcgtcgcgcat

SEQ ID NO: 489100 - DNA, 476 bp, Homo sapiens
  misc_feature (41)..(41): n is a, c, g, or t
  misc_feature (76)..(76): n is a, c, g, or t
  misc_feature (222)..(222): n is a, c, g, or t
  misc_feature (276)..(276): n is a, c, g, or t
cgcacatttagtggagtcccattttggcttagctcattagngtggctaaccaagagataacggtaaatgtgacatngattggctcttactacagcttcagtgatggggggaggaaaagtcccaacccaaggggctcaaacttctaaggggtactcctctcatcccctttatccttctccctcgacattttctccctctttcttcccaggaccccaaagccangggcaacagatcagtaaagaagggggtcagagtagaaccccggaagtatttttnaatcctacctcaaaatttaacagttacctgagagatttaacattatctagttcatggaatcatggtatgtggtcagggataaatggcacacctgggaattcggctttctaaaggaaatcaattgatgggaggaactttccaaacaccactttactggtggttatatagccaatataactatctctactaaaggtgcggag

SEQ ID NO: 489101 - DNA, 236 bp, Homo sapiens
ccaatagtgctggagtattgcagtgtgtgagccacatgcactccagtcctgtattttgatcttcttaagaatagtatctttggtgctaatgatccgtgatggtttgcacctcagggagcattgtcttctgcttcgcttaggttcgtgccataatagaatatatgtgtccataacatttttagaggtttgatgttaaaggctagaggccgctcagcttcctgaataatgcctcggtt

SEQ ID NO: 489102 - DNA, 383 bp, Homo sapiens
  misc_feature (359)..(359): n is a, c, g, or t
  misc_feature (379)..(379): n is a, c, g, or t
ttattaattgcagtgtctttggaacaggtacatattttaatattattagagaaagaatttctggcctgcaaataattggatatgaaccagagaataaatatcttcttacattgcaggagaaagtaaaacataacatcctgtttctatccacagatacttaagagggaaagggagaaggaaaggaaagaatggaattgggaattacatggcataacttgggatacctgttttacagctaaatcatttgtgatctgatttccatgttggtgggacttggcctgtttctggcaggttcctcctgccttccctcattttccccagctttcttcattcatcacagggttcttttttctaccatncttctgtgggtaaaatctangggg

SEQ ID NO: 489103 - DNA, 163 bp, Homo sapiens
tcgtctttgataggagagtaggtcagtttggaattgtgtgtagtatatgtagactatatgtggcagcattagtcagcagtgaatacataagtctaaagtcaggaaatagagtagggctagagacatacatttgggagttatcagcaaatagatcattaaatat

SEQ ID NO: 489104 - DNA, 628 bp, Homo sapiens
  misc_feature (508)..(508): n is a, c, g, or t
  misc_feature (511)..(511): n is a, c, g, or t
  misc_feature (539)..(539): n is a, c, g, or t
  misc_feature (547)..(547): n is a, c, g, or t
  misc_feature (554)..(554): n is a, c, g, or t
  misc_feature (560)..(560): n is a, c, g, or t
  misc_feature (562)..(562): n is a, c, g, or t
  misc_feature (565)..(565): n is a, c, g, or t
  misc_feature (583)..(583): n is a, c, g, or t
tgtatgatgctaaagtacttcacaccaggtccgtccacaggtgggaactcaataatactaaaggtgctgataccagcacatttagtagagatagtatatgggctatataacacaagtaaaggggtgttgggaaagttcctccattcattggatttcctttagaaagcgaattccagggggtgcaatttatccatgaccacatacaaggattcaaggaactagataaggttaaatctctcaggtaacggtaaaatttggaggtaggattaaaaaatacttcaggggttctactctgaccacgtcctttacggatcggtggccctgggcttgggggtcaggggaagaaagagggagaaaatgtcgagggagaaggatagggggatgagaggagtaccccttagaagttggagcccatggggtggggacttttcctcccccaatcacggaagcggtagtaggagcaattcatggtcacatttacagttatctctgggttagccacactaanggngctaagcaaaaaggggaccatgccaaanggattttnattgganttggangngcntcaggtgaattttttttnctacagcagacacagggccctaataatacttaacccaggcaataa

SEQ ID NO: 489105 - DNA, 702 bp, Homo sapiens
  misc_feature (48)..(48): n is a, c, g, or t
  misc_feature (93)..(93): n is a, c, g, or t
  misc_feature (122)..(122): n is a, c, g, or t
  misc_feature (175)..(175): n is a, c, g, or t
  misc_feature (181)..(181): n is a, c, g, or t
  misc_feature (183)..(184): n is a, c, g, or t
  misc_feature (187)..(187): n is a, c, g, or t
  misc_feature (189)..(190): n is a, c, g, or t
  misc_feature (192)..(193): n is a, c, g, or t
  misc_feature (195)..(195): n is a, c, g, or t
  misc_feature (198)..(198): n is a, c, g, or t
  misc_feature (201)..(201): n is a, c, g, or t
  misc_feature (204)..(204): n is a, c, g, or t
  misc_feature (258)..(258): n is a, c, g, or t
  misc_feature (262)..(262): n is a, c, g, or t
  misc_feature (271)..(271): n is a, c, g, or t
  misc_feature (280)..(280): n is a, c, g, or t
  misc_feature (286)..(286): n is a, c, g, or t
  misc_feature (297)..(297): n is a, c, g, or t
  misc_feature (318)..(318): n is a, c, g, or t
  misc_feature (369)..(369): n is a, c, g, or t
  misc_feature (426)..(426): n is a, c, g, or t
  misc_feature (434)..(434): n is a, c, g, or t
taggtggggaggacgaggccataaatactgcaggagggggggaagggnggggtagggggaggggaaaggagggtgtggggagggagatgggtnggggggtttagacactggtgggttggggnggggggcgggaggtgggtgtgactggaggtgggaggaggttgagttggggggntggggntnngantnntnntngtngtnttngtacatttcggccttttcctcggccgtggggtggtggtagtggtggtagtgggngacnaggtggttnatgttggtntggggntgggtgaagtngatgtggtggatgggctcgcncgtgtaccagtgcaggaaggggttgggcgggaacatgggggtgaactgctnggagatgggcttgaacagctcctggatggccgtgctgttcccgatgaaggtggaggngattttgnggggggggggggggatgtgagagagggggaggttgaggttgttggggatggactcgaggaagtaggtggtgttgttggtctggatggccagcatctgctcgtccacctccttcatggacatgcggccccggaacacggtggccaccgtcagtagcggccgtggcgcgggtcgcaggcggccatcatgttcttggcatcgaacatctgctgggtgagctcgggcacggtcagggcccggtactgctggctgccccgggctgtgaggggg

SEQ ID NO: 489106 - DNA, 633 bp, Homo sapiens
tgtatgatgctaaagtacttcacaccaggtccgtccacaggtgggaactcaataatactaaaggtgctgataccagcacatttagtagagatagtatatgggctatataacacaagtaaaggggtgttgggaaagttcctccattcattggatttcctttagaaagcgaattccagggggtgcaatttatccatgaccacatacaaggattcaaggaactagataaggttaaatctctcaggtaacggtaaaatttggaggtaggattaaaaaatacttcaggggttctactctgaccacgtcctttacggatcggtggccctgggcttgggggtcaggggaagaaagagggagaaaatgtcgagggagaaggatagggggatgagaggagtaccccttagaagttggagcccatggggtggggacttttcctcctcctacctcaaaatttaacagttacctgagagatttaacattatctagttcatggaatcatggtatgtggtcagggataaatggcacacctgggaattcggctttctaaaggaaatcaattgatgggaggaactttccaaacaccactttactggtggttatatagccaatataactatctctactaaaggtgcggag

SEQ ID NO: 489107 - DNA, 314 bp, Homo sapiens
ttcgtcattactggtcacatcttgcagatgatgaggacaaataccgtctctggtttagcgatgttgtcgcacgtaccgcgtcgttaattgcccaatggcagacggtcggctttgctcatggggtgatgaataccgacaacatgtcgctgctggggctgacgcttgattacgggccgtttggttttcttgatgattacgaacccggttttatttgtaatcactcggatcatcaagggcgttacagctttgataatcaacctgccgtcgcgttgtggaatttacagcgtctggcgcagacattgtcgccatttgtt

SEQ ID NO: 489108 - DNA, 423 bp, Homo sapiens
gaggtccaggcagtgtctctgacggagctgctctttgcacacgaggagctgaatatggaaataggtcaggggtatggccaggtttcccctcccctggtgaacgggagaagacccacttttcatgatttgccatgtggtgcctcagtgattctcggtaacaacggcttcatctggatttacccaacacctgagcacaaagaagaggaagcagggggcttcatttgcaaacctggagcctgtctctcttgcttgttcgagaggtgatataccggcttcggaactgcatcatctcgctggtaactcagaggatgatgctgtatgataccagcatcctgtactgctatgaagcattcccttccacatcagatccacgacatcttacagccaagaaataatggaggagattgtgatggacacaagcca

SEQ ID NO: 489109 - DNA, 319 bp, Homo sapiens
accgtgttgagcggtctggtctctgtgaggttgcgggttcgatccctggtctcactcagtaggttaagatccagtgttgctgcaaggtgtggtgtagctcgcagatgtgcctcagaggtggtttcgctgtgactgaggtgtaggcctcaggtgtagctctgatttgacccctatcctgagaacttccatatgccgcgggtgcacatgtaaaaagaaaaaatttgcaaagtgcttaaatcgtgcttggcgcggtgtaagtgctataggtgagcgtgaactattttccttattattattcagactgtagagcctttggggg

SEQ ID NO: 489110 - DNA, 305 bp, Homo sapiens
acttgctacaccaaaataaaaaaaaaaattagccatgcacagtggcacgcacttatagtcccagctactcaggagactgtggtgggaggatggcttgagcccaacaggtggaggctgcagtgagccaagatcacttcactgcactccagtctgagtgacagagtaagaccctatctcaaaaaaataaataaaaataaaaacaatatggatagtagtgaaagtgacactattgttaaaatagttaaaattcatcagcttccttcataatggtacctcactttccaactcccttttctttctattaa

SEQ ID NO: 489111 - DNA, 477 bp, Homo sapiens
  misc_feature (32)..(32): n is a, c, g, or t
ctttctctttctcttttcttttcttttttctnttttcttttctcttttctttccctttccctttctctttctctttctcttttcttttctttcactttatttaagctgtcggttcttcacctgtaaaatggagaagaataatacctaaccttgcaggactgttgtaaaggattagagaaaataaatatttgcaaagtgttcaacacagggttcaggaactgatagatgctagtggtacccttctcatccccatcctcatccagttctgtggttctggttaattcttacaggttttgatgtgaaggaccatgctcagaagcaggagaccgctaacagcctgccagcccctcctcagatgccctgccggagatccctcagccctggctggtgagtcaaggtcccaccatctcagtggtcatcgctggaggcctgggggtacttacgggctccaggggcctgtgatggaagcccggtgtg

SEQ ID NO: 489112 - DNA, 131 bp, Homo sapiens
aggtactccccgatctttcctacgagcgcaaggtggcccgggatgttatcagaaggcgcagactaaagagctggcatgactttgccatcgcggccttgactaggcgacctatgagcggatgttccgctggc

SEQ ID NO: 489113 - DNA, 2304 bp, Homo sapiens
  misc_feature (799)..(799): n is a, c, g, or t
  misc_feature (1134)..(1134): n is a, c, g, or t
ggccggggcgcctgccgcggaacattcgcggagtccagtgcttaagtacgcaggcttggaccttttatctctcgccggccgcgggaaccctgttgtgagctcggtatactccataggtgcacacccgctgttgaacagcagagcggcgcccatgagttctgaactccccagtttcccagcgatacgagttcgaattggattcgcaggcagttaacaattggcgggctgttggacacaacggctgcgcaactgggcgcttatatcatagcgccgttaccaaaagcagcactcatttacgttgtcagccagcacttccctccgaacaaatacacccgcttagttgattagcaaccctttacacatttccaggaataagggacaccgcccaaaaggaattagttaccagattgcttttaggccacacttgggacgcgaatttcgggcagaacacatacacggcctgtgggttgtacacctgggccgcgcagagttagcggccggtgtaccccaaacacactgtgtccccaaattttccttggctttggattgggccagcgatctccaacacacaagagaacattctatcacacgggagcacgacgctttgggagacgacccaacgtggtgtgtgggcccccctactgagaattcaatctcaaagaggaaaagagcacgaggaaactttttcagcattgtgcgagcaccttatatgggagtggctagcaacattcagggtttcgtccgtcagacatgtacctgggacttggttgaaactataggaactggccttaacgcaacncatcgtgatcctggattacaaccattctggcatgggaactccaaaacagtgggtggaatatcttggccaaacgtggctagcttatcacatatttatcgcgcatttgtgcttgcgttggaacactctcgttgtggcccaatttgttatactcagaaaaacacaacacaaagcgcgaaccccatatacataaagacacgcaagcacaacaagctagcccaaacaaaagaaaagactacttgtgtgcgtcgcgctcataaatcataacacctgctgtggcggcagaaatagacacagtgttaatgcactgattggtgtgtccaaagccgcgcgcatantttatgatgatctctcatcttacgcccgccgcgacgacgatcagccagatgagtgaccagcgaactgcgtgacaaccacgcacgacaacgaagatgaagactcaatcaggatcatgacagacgaacaacgagcccgacacatcacacacaacacacgtcgatagaacgatcgacgccacacagatgacataacctgatagtactgaccatgacgagatactgagacagccactgacagactaatcaacgtcacactgagcgcaagccagcaacaaacagtgaagctcgaacgatcaagaggagaaggacgaggtgagcaggagacacaggagaagaaagagagagagatgaggaaccgaggcagcgagacgtagcacgggcgagcagcacggcgagccagaagagaccgcgagagcgagcgagcgcgcgcgagccggcagacagacgccgggcgcgcggcagccagcgaggcgtgaggagaggcgagcggagagagcaagagagaccaagagcagagagtggaagggaggtgaggcaggaagagaggaacagtgggagaagagaggagggacctagtaggcaggtagaacaaggagcaacgggccagagaacgagagaatagacacaagacagcagacataaaagcactaacgcagcaggacaagacggagaacagacaaacagagaagaacgagacaaccgacgaaacgagaaagaccaggaggcagagagggaaaaaagcggcagagaatcacgaacaggaagaagcagaaggaacaagatcagaaggaacagccgagatgaagcagacgctaggcagagggaaacacatgcgaccacggacgcaccaaccaagcgcagcacgagcagcacacagaaccacaccaatagaaatcacgaaccatgaagtcaagcaaaacaaaaccatcgaaaaacacaccaaagaacacacacaaacaacacgatagcacacaacacacaactagacagcagcaccaaaaaccacagaaaaacaaccgaaatacacacgacaaacaaacatccacacaaacacacataccacctaacacaacatacaatcaaacacatatacacacacacacaacaatagatacatacaccacaaacaacaaacacaaaacccaccccataacaacacaacccgaaacc

SEQ ID NO: 489114 - DNA, 878 bp, Homo sapiens
  misc_feature (27)..(27): n is a, c, g, or t
  misc_feature (34)..(36): n is a, c, g, or t
  misc_feature (40)..(40): n is a, c, g, or t
  misc_feature (69)..(69): n is a, c, g, or t
  misc_feature (90)..(90): n is a, c, g, or t
  misc_feature (93)..(93): n is a, c, g, or t
  misc_feature (95)..(97): n is a, c, g, or t
  misc_feature (116)..(116): n is a, c, g, or t
  misc_feature (140)..(140): n is a, c, g, or t
  misc_feature (153)..(153): n is a, c, g, or t
  misc_feature (155)..(156): n is a, c, g, or t
  misc_feature (207)..(207): n is a, c, g, or t
  misc_feature (235)..(235): n is a, c, g, or t
  misc_feature (248)..(248): n is a, c, g, or t
  misc_feature (253)..(253): n is a, c, g, or t
  misc_feature (255)..(255): n is a, c, g, or t
  misc_feature (264)..(264): n is a, c, g, or t
  misc_feature (273)..(273): n is a, c, g, or t
  misc_feature (276)..(276): n is a, c, g, or t
  misc_feature (302)..(302): n is a, c, g, or t
  misc_feature (304)..(304): n is a, c, g, or t
  misc_feature (323)..(323): n is a, c, g, or t
  misc_feature (339)..(339): n is a, c, g, or t
  misc_feature (369)..(369): n is a, c, g, or t
  misc_feature (383)..(383): n is a, c, g, or t
  misc_feature (400)..(400): n is a, c, g, or t
  misc_feature (404)..(404): n is a, c, g, or t
  misc_feature (436)..(438): n is a, c, g, or t
  misc_feature (455)..(455): n is a, c, g, or t
  misc_feature (475)..(475): n is a, c, g, or t
  misc_feature (623)..(623): n is a, c, g, or t
  misc_feature (665)..(665): n is a, c, g, or t
  misc_feature (680)..(680): n is a, c, g, or t
  misc_feature (779)..(779): n is a, c, g, or t
  misc_feature (811)..(811): n is a, c, g, or t
  misc_feature (846)..(846): n is a, c, g, or t
caggacctttttgtggaactataagtngcaaaannnaganaaagatgatgtatcccccccccagacatnccgtcgccgacgatgacaganatnannnacagctctatgaatcaganatttctggaggcttaatcaaaggngttggcaattttnanngtactttcttgacttcagagctacctctatgctgattttgatcgtcatganatccagatatatgagggggtagccaatntgcctcccttccngagananacattagtnttgataggngcncaaggtgtaggccgaagaagcttgananacaggttcatagtattgantcccactagatttggnactacggtgccatttacttcacggaaaccnagggaagatgaaanagatggccaggcatatnagtntgtgtcacgatctgagatggaagccgatattnnngctggacagtctttggnacatggggaatatgatggcnatctctatggcccccaattgattctcttcttgaggttgtccaaactggacggacttgcattctggatgtcaacccacaagcactgaaagtattgaggacatcagagtttatgccctatgtggtatttattgcggctccggagctaganacgttacgtgccatgcacaaggctgttgtggatgcaggaatnactaccaagcttctnaccgactctcacttgaagaaaacagtggatgaaagtgcacggattcagagagcatacaaccactattttgatttgatcatcataaatgataatctaganaaagccttttgaaaaactgcaaactgccatanagaaactgagaatggaaccacagtgggtcccaatnagctgggtttactgatgattcagtaaggttaa

SEQ ID NO: 489115 - DNA, 122 bp, Homo sapiens
gaccatggaaccaggtgaaacctgtttggccccttacccattgggtttttactccttcacaacggtcagcactcctctcccaacccccctgcccactgttttcaataaaatgtgagtggtta

SEQ ID NO: 489116 - DNA, 443 bp, Homo sapiens
aagctcccaaaggaaaactacaggttgagcatccctcattcaaaagcctgggacagaagtgttccagactctgtatatgtttggatttgagaatacttgcatatatataaaatgagatatgtgggggacgcgacccaagtctaaacacgaaattcacttatatttcatagacgccttctattcatagcctgaaggtcattttatgcaatattttaaataattttgtgcatacaacagtttggactcatcacatgaggtcaggtgtgggattttccacttggggcatcatactggtgctcaaaaagcttcaaattttggagcattttagatttaggattttcagattaggggtgctcaccagtaagtgttatgaaaatattccaaaatccggctgggcatggtggtgcccacctgtaatcccggcactttgggaggctgagagg

SEQ ID NO: 489117 - DNA, 739 bp, Homo sapiens
gattttaactctcctaagtgcctcatgtaagtggaatcatacagtattgtcatttgtgattgatgtattttacttagcataatgtcttaaaggttcatccaagttgtggcatgtatcaggattttcttccttttaaggttgataatattctgtagtacatatagaccacatttgtttacccattcattcatccatggacgcttgggttgcttccactgttttagctatgtgagtaatgctgctgtgaacatagtgtacaaatatctctttgagactctgcttttattttatttttttgcatatatacacagaagtggaatcgctggatcacatggtaattctgttttgattttttactgccatactgttttccacactagctataccactttatgtgcctacaaactgtgcacaagggttccaatttctccacatccttgccaacacttgctggtctattttttttttaatagtagccatcttaatggggttgatgtggtatctaattctggtattgattgcatttccctaactgattagtgatatcaagcatcttttcatatgttagtattgcctggttttacatcctacttgtaaaaacataatttggccacaccagtctgttactattctatttccttaaaaaaactccacactaggactgggggaattcctcggcccctagttaagggcctaatttccaagagtaaagaaccagggttacactataaagtagtat

SEQ ID NO: 489118 - DNA, 151 bp, Homo sapiens
  misc_feature (1)..(1): n is a, c, g, or t
nggctgtgttatagacgggagtatacctttggcagagctatagtaggagcttagatttctaggggcgagtcaggagccccagccagcccttcccaggccagcgaggcagtaggctgcctctgggtgagtggctgacagtagcaggtctgca

SEQ ID NO: 489119 - DNA, 265 bp, Homo sapiens
  misc_feature (112)..(112): n is a, c, g, or t
atccaaagaattcggcacgaggccaccttactaccagacaaccttagccaaaccatttacccaaataaagtataggcgatagaaatttgaaccttggcgaatagatattggncccgaagggaaaggttgaaaattatttcccaggataatttgggcagggcctcccccataccctctctgattattgattaaacctggatatccctttacgggagagacccacggttgagccccccgagcccagagcgtgctccctgaggaccgc

SEQ ID NO: 489120 - DNA, 898 bp, Homo sapiens
  misc_feature (206)..(206): n is a, c, g, or t
tggcagaccttttccccacggctgtgccagttgacctacgtgggccccctgcctcccatggcccaccctctggccacgaagggttcttctcaagtgtccgccgccactcattggggagcccgaaccgcccccccaccttggtttataatggggctcagacctccccacgcaatgggccgtgacaacccctatttggggaatcccanccttggaggcagggctgccacgggaagagggtacgtatcttgtgggtcccgccccttctttcaatgtggtgcgtgcaatatccgcccctttgcctgcctgatgtataggtccctggcaacctgggtcatatctgcgtttgctggctaccgtgtctgtgatgtccgcctgtcccggcctgtttggggttcccagcgactcttctggcaaccgggtgtgttctcgtggtataccccgtgagggggtgtgacccatagtaggttaatcaccgggtgtgtgtgtgtgtgtgtgtttgtgtgtgtttatgtgcacgcctgtatatgcatcaccacgtagcccggaggggcccttggggtttgagtcactgggatcttcctggtgagaggtaagagaagtcactgggcttaactgggcctctgaggcccgtatggcactcttggttgctgaggccaccctggacctgttgctaggagatagctggggaaggccccaggcccccccgggccgagagaggagacgaagatttgggaccatgggggaggagatgggaagggatgggatattctgggtccccgaacgggtgggataactcacgcaccagcttcttcactggtggggggtggggccaccaccttatttctccctggtcatgatttaccagaagaaaaattaaactgcttttggaacccaccca

SEQ ID NO: 489121 - DNA, 1016 bp, Homo sapiens
cgcttggtgttaaaaaaaatctctccctcggcgcccccatcgtttgttatctcttaagatatcatccacggcgttgctcctctaatataagggtaatatgtcacgagagcggcccctttcgtggggtggttggccgcgaagaatttattccctggcgccaacaccacgaagaggggccccccgaggaatagtagcgccgcaagaaagagggagaagagcctcctctcgggccccctctctctctcagagaaacgcttggagaaaggcccccacacgcgcgcacaagggcgctctttaaaataggggcgccccccacacagaaggggcccacgcagtggttgtggagaaaagaggggtggggtcccccaccccacggcgcctcccccacacagaagagaagaagaggagtattcccgcgcacacgctgtcaacacacccacacgctctttcacgcgcgcgcgcgcccgcagagagagcacacactcgggcgagcatctctctcgcgagagacacacagcgccctcacacattatatctctctctcgggagagagagaggcgctctctcccccacgcgagagaggatatcacacacgctgcttggagaccccacacatcatatgggcttatattcatcatctcacagaggttttctcgcgctcgagcccacctcgaggtcttcgcgccacatgtagaagagaagatatatagagaagacacacacaacacacaccacccttgtgtgtttcacattgtgtggagatgtttataatgacccacccacgcacaccacgaggtttaaccacgcggctcgttgataagagaagactgtatatgacacacttgaatgtggccccacaggtcacacacacaccctgagattctggcctgagtggagagaagaaagaaaggcacataatgtttcgaactggctccctgagatttcgagatgctttggagatgttgccccacccaaattgggatctattttaactgagtcccgctgccttattttga

SEQ ID NO: 489122 - DNA, 144 bp, Homo sapiens
gtcccacaggtgtgttgggccattgccttcgtccaagagggcaggcattgaatggtgtcgccaaactgtctggaacaggaaagctgggtgtggacacttcattgttctcgacccagatgcatgtccggggctcaggggtgtgcc

SEQ ID NO: 489123 - DNA, 982 bp, Homo sapiens
actgttcatagtaactcagggtgcctccagtcagtctttgcccgatacattcactggtcctgagacacttgtaatgtccgcgcaatgtcactgagaatgaggcactttctttctctggacacagcatgtactcttggccgtgtgtctgtctcccaacgaggtacctatggtgggtgcacgtcatttcgctactaactacgaagaccgacttcaggggcacgttcgtgtgatctgggcatggtctgcctgggcccgcctctgtgcagctcttgtctggttctgacgctgtccccttatgtggggtttgtgcctcttcttcggtgtcttgccatcctgcatgttatgttccttttctggcctagtaatttggccacccatgccgtgtcagaacggcatgccctggttaccaggcgggatgatcgggaggcttcgcgtagaatgtatgttgtgccaaacgtgtcatggcatgagtcgtgggcataacgccattgtgcctgcacggtctggccgggtgaccagtgcctccccagtgaggtggtggacatcgacgaaaatttgtctctacgtgcctgtcttcggtgctccacattgtacttcacgaacgcctagctgctactgccatatttttccctgccaagtctttgtcattgctggacggacggacgcaacgtgtgggtgtgaacaacacggctggggttgcttgcatttcgcactgattgagaacttcttctatgacttactactaacatgtgtgccgggactccttggtaggtggggtcaaaagcaattgggcctttaaaaaccaggggggtgtgtcattatccacatttgtagggccctagaaaggcgtctttaaagccaaagggttccacttcaacatcaagaacgcctggtgaaaaatcactccggtctcaaatacagaaacaatagaagggcaccgcagataagacacacaacctaacatctgggcatacaggtgatt

SEQ ID NO: 489124 - DNA, 635 bp, Homo sapiens
agtgagtcctgcttattccagaagatgaagttgcattagaaaaatcaagcctgattctaaaatggtcaggggttaaaactgctgccccaacttcatgggcatggatcttacccgtggcacaatgtggttccaggtctaaaaaatggcagacaatgatttaagctcacgttgatgtccagaccccccatgggtacctgcctcgtctgttctgtgttgggtttactaaaaaacgcccccatcagatacggaaggccttttatggtcagcccccacaggtccccccaatccggaaaaagatgatgggaatccttaccccaaaggggccgaccaattactttaaaaaagtgggccattaatttattcccgcccgccttgggaaaaacataaaaaaggcctgcccatctttttttcccccccctgatgttttcgttaaaaaagtaaaaaagctgaaaaagccccagttttaattggggaagcccctggagcttcctggggaaggccgtagttttggaaaaacccccgggggccagaccggggctaaaatttaaccagctgatggatattaaccccccggcccaaaatttgtttaaagttccgacttccaaaaggggccaataaaaagggccttttgtgga

SEQ ID NO: 489125 - DNA, 942 bp, Homo sapiens
gcaaccctgaagatatctagagatggtgaacaagcagtgtgcttatgatggagctaggactgctgatggaattgtcagccatcgttgaagcaaacaggcaggacagcttcagctgcctctcatcgactgagagaaaattgaagaaattcattatgataaagatgcctctatagtagcgttctttcgactagattcattcagtgaggctcactccgagattcctaaaagcagccagcaacttgagggataacataccgatttgcacatacgaagtgttgagtctctggtgaacgagtatgctgatcaagtggtgcacgggtatcgtcttattacgtcctctctgatctctagtatacaagtttgccgtgacaagactgtggcatatacagtagcagagacaccatgaccagtggctgaattcatcagtttatccagggactcatttgtggtatctgccctcacatgacagaagacaatcaagatgtgatacagggcaaggacttacttattgcttactatgatgtggactatgaaaagagcgctaaaggttcctgctactggagatacagggtaattgatggtggcaaaggaattcctgggatgctgggcacaaatcaactttgcttgtactagcgcaaaactttagcatgaactttctgatttggcttggagagcactgtggagagatccctggttgttgctatcagaactgatacgggagcagtttggcctgcacgaggaagttccggtaagggaggcccgggagaggtcccggcgggaaaattgagtggacccggaaagaatccctgaagtttgacatacccgagacattgatggtctgtacagttgtgccagaacttgcggacatggcgcgagaaacagtgtggggaaatcacgcgacgggaacgagaacgagacacaacacatcgagggacgcgacat

SEQ ID NO: 489126 - DNA, 271 bp, Homo sapiens
  misc_feature (1)..(1): n is a, c, g, or t
nagaggatcccgttcatttcgcccaggactgcgtgcttttgagatgagtgttggtgctccccccaccgccatgttgccactcttctgaagtaacagggagctgcgttacacagtgtgcagagtttggctaatgagtattcacgtgtgtggagtgtatgggtgaagagtattcagcgatgtgcacgtgtgtgtgaagattctcggcgcgtgctagtgtatggctgaagagtatttcactcgggtgcaaagtgtgccgtgaagagtattacac

SEQ ID NO: 489127 - DNA, 245 bp, Homo sapiens
aaggcaagaagatcgcttgagcttaagagtttcagaccagcttgggtaacattgggagaccctatctctatgaaaaatgaaaaattagccaagcttggtggtgtacacctatagtcccagttacttgaggagctgaggaggaaggattgcttgagcccagaagtttgaggtaatgagcgatattaacgccattgcactccagcctgggcaacacagtgagaccctgtctcaaaaaaaaaagaaaa

SEQ ID NO: 489128 - DNA, 385 bp, Homo sapiens
  misc_feature (208)..(208): n is a, c, g, or t
  misc_feature (385)..(385): n is a, c, g, or t
gatgcctgcctgctgtgcgctatgcggctgccgactgccgccgcggaagggatgcgagcgaggcgcgctggctctcgcttatgacgggccgggaggcgcgggggagccgccgggcggatggctgactgggcggcgcttaagctttaccaaagatacagggaatattgattaaaaagtgtatcccgctaataggcgagggcttgatttntttgccgcacggagggactattgaggcttttgccgcgatggaggggtcttctcaagaatcttattattattatttttctataagaggcccggcggatgggctcttggagagcggccgcactctctcagatctcggagattgacgagaggccgccgaccaaaaagggatcccggcttn

SEQ ID NO: 489129 - DNA, 323 bp, Homo sapiens
atgtaaccattgtggtaaagcctttactgtgatattcaaaggtgtggtaatttaaatatacttgcccatggcaagtggcagtgttaggaggtatggcctttctggggtagatgtggcctttgaggaagtatgtcactgtgggcggtgggctttgagatcctatgcttaggctcttcccagggtggaagagtcttctggctgccttctgaccaagatgtagaactctccagcaccatgtctgcttggacactgcccttctttctgccttgataatagactgaacctctgaatctgtataccacccccaattaaacatcctttat

SEQ ID NO: 489130 - DNA, 272 bp, Homo sapiens
aggcggactctgtgtgaacttgtgagctcagagtctgttcttgtgacttggactggggtgcacaggacaggacagaacacttggacgagtgactctctgtctgtctgtctgtctgtctgtctgtctcattggttggttgatatccattttcttaaggggcacatacctcagaccgcacacacacaaacacacacacgcacacacacaggggcacgcacacacacgcacacaacactccagtaccacctgccgtgtgggggtcccgaagctcg

SEQ ID NO: 489131 - DNA, 106 bp, Homo sapiens
atcggctatctgggaatacacagccaagtgggaactgaccttgagctagagcctcacccccctgggcctgtctctcctcagctgtagaatcatcacctctgagctg

SEQ ID NO: 489132 - DNA, 516 bp, Homo sapiens
  misc_feature (12)..(12): n is a, c, g, or t
  misc_feature (67)..(67): n is a, c, g, or t
  misc_feature (121)..(121): n is a, c, g, or t
  misc_feature (150)..(150): n is a, c, g, or t
  misc_feature (164)..(164): n is a, c, g, or t
  misc_feature (212)..(212): n is a, c, g, or t
  misc_feature (218)..(219): n is a, c, g, or t
  misc_feature (221)..(222): n is a, c, g, or t
  misc_feature (226)..(227): n is a, c, g, or t
  misc_feature (229)..(233): n is a, c, g, or t
  misc_feature (235)..(236): n is a, c, g, or t
  misc_feature (243)..(243): n is a, c, g, or t
  misc_feature (246)..(246): n is a, c, g, or t
  misc_feature (260)..(260): n is a, c, g, or t
  misc_feature (268)..(268): n is a, c, g, or t
  misc_feature (302)..(302): n is a, c, g, or t
  misc_feature (309)..(310): n is a, c, g, or t
  misc_feature (386)..(386): n is a, c, g, or t
  misc_feature (391)..(391): n is a, c, g, or t
  misc_feature (393)..(393): n is a, c, g, or t
  misc_feature (401)..(401): n is a, c, g, or t
  misc_feature (411)..(411): n is a, c, g, or t
  misc_feature (442)..(442): n is a, c, g, or t
  misc_feature (452)..(452): n is a, c, g, or t
  misc_feature (456)..(456): n is a, c, g, or t
  misc_feature (500)..(500): n is a, c, g, or t
  misc_feature (502)..(503): n is a, c, g, or t
tgacagcccagnctttactaactccataggttttctggatatttcaagcacacattaaaacaattanggagaggacatacatttatgatttatgcaaattaaggcacatcaattacaatcnatttttttaagttagtcagtttaaaaatnttcacttacaaaanttcaaaatatgtccaagctcaactttttagtaggaatgttagtttgtngggttnngnnattnncnnnnngnnccttagnggncaaacatgagacantgaggaangtggggctttgtgaaacacataaatacctgtgangttttgnntcatttggcccttaaaaatattgcttaacaagttaaacccagcttaattgtaggtaaatgcaagtatacccaaggnggggngngggggggnggcggggggnggcagattgtacttctgtggctggaaaaaangggcttcaanagcnctggccagttcattcagttccttcttcagcggcccaggatcacngnncccagggggggca

SEQ ID NO: 489133 - DNA, 685 bp, Homo sapiens
ccccggagttagaaaaatcctctttcacccccatacagccttaccgggaaaaagcacccccaattcttccatttatccctaatcccgtgccttgtttaggtcccgggtaagctgaaaaatggcccccttttcagccccattttcctcccgttctcccagggcccaaatcgaacattaaaggttcttgccaattgcgcctgccagccaccaaagaaagaggtgctccccacccgggatatcaagcctctgtctgcgtgtgaggagccaaaaaatatgtctcggaaggagctcaccatccagaatgggcataacaaagccagctgtgagagagctgcgcaatatgcctcagcctatgacagagtcatgtgcatctcagaggtggtcacccctcggctcctttgcactgaaggagtgagtccttatgatcactccaatacttggagacatgattctgtccaccccttagtagctcacaatacaagtcgtttcattcaagttggtgtaatcacctgggcagcagtggatgtctgccataaccgtaagcggcaaaacctggtacttgctcacgcccgagactttctcatcaacctcttccaagtccggcctgcccttaagaaaatgcccaggatcagtcttggggtcctctccaagggattccagccaaccaggggcccaataaaaaata

SEQ ID NO: 489134 - DNA, 888 bp, Homo sapiens
gtgctggtcggacaccgagctgctgtcaatgttgtagactttgatgacaagtacatgtttctgcatctggggatagaactataaaggtatggaacacaagtacttgtgaatttgtaaggaccttaaatggacacaaacgaggcattgcctgtttgcagtacagggacaggctggtagtgagtggctcatctgacaacactatcagattatgggacatagaatgtggtgcatgtttacgagtgttagaaggccatgaggaattggtgcgttgtattcgatttgataacaagaggatagtcagtggggcctatgatggaaaaattaaagtgtgggatcttgtggctgctttggacccccgtgctcctgcagggacactctgtctacggacccttgtggagcattccggaagagtttttcgactacagtttgatgaattccagattgtcagtagttcacatgatgacacaatcctcatctgggacttcctaaatgatccagctgcccaagctgaacccccccgttccccttctcgaacatacacctacatctccagataaataaccatacactgacctcatacttgcccaggtatcgaaatcgattatgtacataacactgtgggtaggagacgggatattagctgtaaggtgttgctagttcatggaactttctcctgccgtttgggtcaccaactcctgtaaagccgaggaagcagacaatgtgagacagggctgaagctgccacagtgtggacagtgcctttcaccaaggtagccagcctcagttctagatgattctagggtcctacttgtgtggtaagcctagtcattcctgccctagttatctagtagtactgttatgaaaataaaatgagatttgaatcagtttg

SEQ ID NO: 489135 - DNA, 954 bp, Homo sapiens
cccacgcgtcggcatggataccacatattaaaccatgtatatctgtggaatactcaatgtgtacacctttgactacagctgcagaagtgttcctttagacaaagttgtgacccattttactctggataagggcagaaacggttcacattccattatttgtaaagttacctgctgttagctttcattattttgctacactcattttatttgtatttaaatgttttaggcaacctaagaacaaatgtaaaagtaaagatgcaggaaaaatgaattgcttggtattcattacttcatgtatatcaagcacagcagtaaaacaaaaacccatgtatttaacttttttttaggatttttgcttttgtgatttttttttttttttttggatactggcctaacattgcttgtgctgtaaaaatagttaacagggaaataacttgagatgatggctagcttgggttaaaggtcttatgaaattttcatgaacaatccaagcataattggttaagaacccggtgttttaaatccagtgtaaggtggaaataaaagtttttatgaatgggacttttcaactactttctctacagctttccatgtaaattagtctgggttctggaaacttctctaagggaaatggtacattttttggaaatttattccttattccctctgggcagctaagtgggctcttaccaagtttaaacacaaaatttatcataacaaaaatactactaatataactacgtgtttccatgtcccatgatcccctcttttcctccccacccttgaaaaaaatgagtcctatttttccggggaaagggggggattgattacgaaaaacatgtagtgtgtcccatttaaaatttgggcatatggcattttctaacttaggaagccacaatgtcctgggcccatcatgcacatggggtagcattactgtaagttaggtgctcccaa

SEQ ID NO: 489136 - DNA, 392 bp, Homo sapiens
agctcccaacaagacagccataagaaggagaatagcttgaacttgggaggcagagtctgagcgagctgagatcgtccactgcactccagcctgggtaacacagtgtgactctgtctcaaaaaaaaaaaaaaaaaaaatttggccatatcccctatggggataggtgttccaggagggggctaaaggtgttaaaacggaaaggaaaacccaggtttacttggaatccacgggaacctttttaaggcctaggccttttccttaaaaaaaatccaaaccctttatttttcggttatccacacccattgggaggagggaaaatttcctaaaacccaatatctttgatttgttggggggggaccccaaaatggggaaaggatgtaaacatttggggg

SEQ ID NO: 489137 - DNA, 537 bp, Homo sapiens
  misc_feature (401)..(401): n is a, c, g, or t
  misc_feature (512)..(512): n is a, c, g, or t
  misc_feature (524)..(524): n is a, c, g, or t
gtgctggtcggacaccgagctgctgtcaatgttgtagactttgatgacaagtacatgtttctgcatctggggatagaactataaaggtatggaacacaagtacttgtgaatttgtaaggaccttaaatggacacaaacgaggcattgcctgtttgcagtacagggacaggctggtagtgagtggctcatctgacaacactatcagattatgggacatagaatgtggtgcatgtttacgagtgttagaaggccatgaggaattggtgcgttgtattcgatttgataacaagaggatagtcagtggggcctatgatgggtgagtgtgctaacagagtgtaaaaaagagaaaatctacgtcttaatccttccttatgtttatggtgttaaacataaccattccntgtttctaaaagcttatagattttacacaaaatatctgataccatatttctttaatccgtgtatttacctctccttggtttagtgtcctgaaatattcttccattcatttnattatacttgtntgctatggttgtc

SEQ ID NO: 489138 - DNA, 203 bp, Homo sapiens
agtgagtatgggagcagcggaacaggaatgccagacacaggctcgctgctgctggaaggagtggtgggacttccttcctctgaccggagaggcacaggttttcaccagattccagccaagaggctcctcacaggcgactgtaaattttggtacaagtcttgtaattatcgaattcaacaacttgttccaatttattaaaaatg

SEQ ID NO: 489139 - DNA, 4765 bp, Homo sapiens
gtgctggtcggacaccgagctgctgtcaatgttgtagactttgatgacaagtacatgtttctgcatctggggatagaactataaaggtatggaacacaagtacttgtgaatttgtaaggaccttaaatggacacaaacgaggcattgcctgtttgcagtacagggacaggctggtagtgagtggctcatctgacaacactatcagattatgggacatagaatgtggtgcatgtttacgagtgttagaaggccatgaggaattggtgcgttgtattcgatttgataacaagaggatagtcagtggggcctatgatggaaaaattaaagtgtgggatcttgtggctgctttggacccccgtgctcctgcagggacactctgtctacggacccttgtggagcattccggaagagtttttcgactacagtttgatgaattccagattgtcagtagttcacatgatgacacaatcctcatctgggacttcctaaatgatccagctgcccaagctgaacccccccgttccccttctcgaacatacacctacatctccagataaataaccatacactgacctcatacttgcccaggacccattaaagttgcggtatttaacgtatctgccaataccaggatgagcaacaacagtaacaatcaaactactgcccagtttccctggactagccgaggagcagggctttgagactcctgttgggacacagttggtctgcagtcggcccaggacggtctactcagcacaactgactgcttcagtgctgctatcagaagatgtcttctatcttttgtgaatgattggaacttttaaacctcccctcctctcctcctttcacctctgcacctagttttttcccattggttccagacaaaggtgacttataaatatatttagtgttttgccagaatctctcttgctttgccattaagcagaagaactagtttccctgtatagcctgctgggagagacccacttctagggtatgggggatgcagcttcaagcccagtgcccagtgtctccctgttaactgcaggaatgccaagcacctggccagagcagcccagccccaatatgcttaggaggagacagagttccctctgtatagcctctgggacaagaaaaagaaaacacaagaatgtatacactggaagatttgggcctcctgcctgccttctctttgtttctgttcctcttcccatctactcccctacgccccttcaaccttttttctctgtctgcttcacctgagaagaaagtgtatgaagagagtgtcctcctctcgcatgagccagatcagccagaaaatgcaacacttggaagagttaaatgctgttcagtgaagatttcagccccaggcctttgctgcaagtgaccctgtggcaacagtggattctcagacatgatactctcatcatatttgcaactcttctctctctttcttccccacacccaagaggaggattggtggtagggggcaggcagagggggtggggagaagtttcctgggctccatcaatggctgcatcttttctggactcagcagtctccttgattccatgtagagtgtggaaaggagttgctgattgcatttcctctcattaacaattgggtgtgtaataaaaagcattgtacttcatcttaaatcactggtaaggctcagcctacagaaagatttgaaatggccagagccaatcgcttggtgcattctgcgtaatggtttccatctccgatttcctcatcagggcctgtgaatacccaggtgcctgtatctttgccaagaccgtgatcaaggtagcttaagagagatggtcaggagaaaacactgtttttgttttttttgttgttttgttttgttttggccagttaaatatcatctctcaaatattgatctcaccgtgtcaaccttgcactgcacaaccttccttctgcttctcccacacccagtatttgcagaagggcaaagctgcttaagagagaggatcagggtgaagtttggcacacagggtttattaatggggcaaaaactgccttttcttcctcctcctgaccttattttgctcttcactctccccagccaataaagcgtctgtggcgattggtgaacagcataaacagctggacctcagcaagggtcaggcaaacccagtcactcggaaggcagctgtgtgagctgccaagctagtgggcttcaggtgcaagggtacctgtgccacaccaacctgggagcacacagaatactattaatgtgcacccagctggtctccccaggcaagaaggtatcctcttcccaaggtgtacccactgaatgttgttactacatattgagagtcattttatgcatatgcattctacctttcctgctttatgagtatttttaagcttttagttcaaggttatattcagaaaatatttcccagtataatgatacatcgtagcctaagaaatattttctcaatgtaattcccttcccagctacccaaatgctacagagaaatgttttctacttggccactatcagggttcgtcatctattgtgttgactattaatggctttttgattgggtaaggattttgctatagatgaaggtagagggctgtcagccctgaaaaacacacaggtcagacatttaaaaggcatgggtttcgagctgtctcaaaatattgcccaatagccataattttaccagcctttctgtcatatgctgctattacaaagtggaagctgttgaatgtttattggtgcccagggttttgctctccaatctaggttcagttgaaggaatattgtttctaagactgttttgagacatgtccagtacatcacaaaggagatcggggcgacccctgcagatgtggagccattagcccagttgaggatattctccaagttgtcctctctcctgctgatggaaatgggaatgaagttaagtggtctgaaaaacttgaatcgttcacatttctcagctctgggggtcatttaccagtttgttgtagaagaaataatcaggtaagttaaaagttcatttccagagaaggtaaaccccacttaccatctctgcatgatttcagtgggaattgattatcactaatccccaactgggctagaataaatgtaaagtttgacctttttaaaacgaaaagagagacaaagtctcagcacattccaaggagtggtagaaacagagctgaaggtgtccccattgtagattagtctcttctcactaaaatttactttccaacgtagggcctaaaggaaacctttcttaaagacaggctgaaaccccttcaaaggcagatgaggaggtacagacacgtgaccttttggtgcacactggagctacttggacaagaccagcatgccttgctgcacgtgtgtgtatttcactgctgagaacatcctttaacttggtgtgcaatttgaaaggatgtgaatcatggatggaaggccatttgtacatgtcctttggcaaaattctttctggtgtctcctaacttcagagacagggactctttttggatctctattgacaagtaataaaagtctggccctcataacttgtttccgaactagaaaagtctgtgagacccctacatcattctggtttttttgcttgagtaagaacaatccttttttatttttcttctgtacagtctaaagctacagagaaaaaaaaatgcactcttcccttgccggctcctggtaccattggtctgaacagctgtagttggtctactccttacttagcacttgattgtgtggggaaacaaaggtgggaggggtggggaatactggaaataatcagggcaatttttttctttcccataattggactagataccttggtactgttgaccttctcagcatctcccttttgccttagatggcaacaccctccagtctgtagcagagcagtccaacccagattagtgcagcccggaggcttagggtgcagcctccctggtcttcctccacacagttgttcaccaacagaccagacctcctttaaccacagtgtcaacatagtatcggaaagagagccatttcttaggggaataaaacagtttcgcttctttagctcatctgtggtgtcagaatccttggagctgaagagagaaatcaaaagagcatgatgatggctgcctggtttcaggtggaacttaatgcattgatctttagaagctccttctgttggaagttgagtacctgtgatctaaaatgtcctggaggcagatgacatctaaaatatgtgctttccaaccagcacagctggcgctcttagctcctgattggttgtgtgttttattaaggatcagtgcagttaagtcgtattttaaagtgttacctcccctcctaacccttccccttcttggacactgaaggaaaaggccaactagggtgttagccctctgggcaccaaggaaactaacagctttctcaaagcggtgaccactcaggccagcccagacaaatctgagggatggccagtgcactccaatgatgggacaggcctaacaacacatgtaagcttccccgagagctttcagctggttcacctctttgttctctagactcttaagtactgactgctttgacttttgtgattatgttatggtgatgtgtagtcagtgtaccaatatgttcacaacctaggatcatgataatggagtgtgttttgggttttttttaactgttcagaaaaaaagtaaattacaaatataagattaaagtgaaaaaaaaaaaatataaaaa

SEQ ID NO: 489140 - DNA, 400 bp, Homo sapiens
  misc_feature (156)..(156): n is a, c, g, or t
  misc_feature (180)..(180): n is a, c, g, or t
  misc_feature (185)..(185): n is a, c, g, or t
  misc_feature (202)..(202): n is a, c, g, or t
  misc_feature (206)..(206): n is a, c, g, or t
  misc_feature (210)..(210): n is a, c, g, or t
  misc_feature (212)..(212): n is a, c, g, or t
  misc_feature (234)..(234): n is a, c, g, or t
  misc_feature (249)..(249): n is a, c, g, or t
  misc_feature (264)..(264): n is a, c, g, or t
gcagcgatggaattacctggaacagttttttgtttttgtttttgttttggtttttgtgggggggggcaactaaacaaacacaaagtattttgtgtcaggaattgggctggacagggcagttgtgggttggggtggtttttttctccaattttttgnttgtttcttgttttttaataatgnttacnatctgcctcaatcactntgtntttnanaaagattccacctccagtcctntttcctcccccctantcaggcccttgaggntattaggagatgcttgaagaactcaacaaaatcccaatccaagtcaaactttgcacatatttatatttatattcagaaaagaaacatttcagtaatttataataaagagccctattttttaatgaaaaacctatcc

SEQ ID NO: 489141 - DNA, 534 bp, Homo sapiens
cggaggctcaggtggtggtgtagcaggctcccagacgactgccatgtcagctgtatctctgagtgcatgctgcactgcggagggacaggctggctcggggctcaggaaagatgctcacatgtgcctagaaatgtaggcgtcaagggaaggctgtgtgtgcgggcacctgagcggctgcgcttcccaggcatctgagttcttacggagccctaataggcacatccccaaatggttgtatgaggatgagcacaaaaatagcagatggggtcaccctcaccctccactgacaatggactgggatccgactcatgcaacattccttctcggccgtaggttccacatccatgggttaggtgtgctggcctggagcccgccggccccggtccccaccgcacaaggaccccatcacaagtgggtgtcatactcttcctccagaaacggattaagcaaccagcatgtgaaccttacgctctgtttacaggctgagtccccacagctcttccagcttcagccaggccagggtcaccttcagat

SEQ ID NO: 489142 - DNA, 4366 bp, Homo sapiens
cgcatcttactcccatcaggccaggtcacctttgacagaagctcctgcatggcataggcagagagcaggcattaggaaggacccctaagccttttccccattggcagctaagtgaatgttcttttctcttcaagcaagtaagaaatatcaaaaaaggggctaatgactatttgctctgttttcacacaggacccattaaagttgcggtatttaacgtatctgccaataccaggatgagcaacaacagtaacaatcaaactactgcccagtttccctggactagccgaggagcagggctttgagactcctgttgggacacagttggtctgcagtcggcccaggacggtctactcagcacaactgactgcttcagtgctgctatcagaagatgtcttctatcttttgtgaatgattggaacttttaaacctcccctcctctcctcctttcacctctgcacctagttttttcccattggttccagacaaaggtgacttataaatatatttagtgttttgccagaatctctcttgctttgccattaagcagaagaactagtttccctgtatagcctgctgggagagacccacttctagggtatgggggatgcagcttcaagcccagtgcccagtgtctccctgttaactgcaggaatgccaagcacctggccagagcagcccagccccaatatgcttaggaggagacagagttccctctgtatagcctctgggacaagaaaaagaaaacacaagaatgtatacactggaagatttgggcctcctgcctgccttctctttgtttctgttcctcttcccatctactcccctacgccccttcaaccttttttctctgtctgcttcacctgagaagaaagtgtatgaagagagtgtcctcctctcgcatgagccagatcagccagaaaatgcaacacttggaagagttaaatgctgttcagtgaagatttcagccccaggcctttgctgcaagtgaccctgtggcaacagtggattctcagacatgatactctcatcatatttgcaactcttctctctctttcttccccacacccaagaggaggattggtggtagggggcaggcagagggggtggggagaagtttcctgggctccatcaatggctgcatcttttctggactcagcagtctccttgattccatgtagagtgtggaaaggagttgctgattgcatttcctctcattaacaattgggtgtgtaataaaaagcattgtacttcatcttaaatcactggtaaggctcagcctacagaaagatttgaaatggccagagccaatcgcttggtgcattctgcgtaatggtttccatctccgatttcctcatcagggcctgtgaatacccaggtgcctgtatctttgccaagaccgtgatcaaggtagcttaagagagatggtcaggagaaaacactgtttttgttttttttgttgttttgttttgttttggccagttaaatatcatctctcaaatattgatctcaccgtgtcaaccttgcactgcacaaccttccttctgcttctcccacacccagtatttgcagaagggcaaagctgcttaagagagaggatcagggtgaagtttggcacacagggtttattaatggggcaaaaactgccttttcttcctcctcctgaccttattttgctcttcactctccccagccaataaagcgtctgtggcgattggtgaacagcataaacagctggacctcagcaagggtcaggcaaacccagtcactcggaaggcagctgtgtgagctgccaagctagtgggcttcaggtgcaagggtacctgtgccacaccaacctgggagcacacagaatactattaatgtgcacccagctggtctccccaggcaagaaggtatcctcttcccaaggtgtacccactgaatgttgttactacatattgagagtcattttatgcatatgcattctacctttcctgctttatgagtatttttaagcttttagttcaaggttatattcagaaaatatttcccagtataatgatacatcgtagcctaagaaatattttctcaatgtaattcccttcccagctacccaaatgctacagagaaatgttttctacttggccactatcagggttcgtcatctattgtgttgactattaatggctttttgattgggtaaggattttgctatagatgaaggtagagggctgtcagccctgaaaaacacacaggtcagacatttaaaaggcatgggtttcgagctgtctcaaaatattgcccaatagccataattttaccagcctttctgtcatatgctgctattacaaagtggaagctgttgaatgtttattggtgcccagggttttgctctccaatctaggttcagttgaaggaatattgtttctaagactgttttgagacatgtccagtacatcacaaaggagatcggggcgacccctgcagatgtggagccattagcccagttgaggatattctccaagttgtcctctctcctgctgatggaaatgggaatgaagttaagtggtctgaaaaacttgaatcgttcacatttctcagctctgggggtcatttaccagtttgttgtagaagaaataatcaggtaagttaaaagttcatttccagagaaggtaaaccccacttaccatctctgcatgatttcagtgggaattgattatcactaatccccaactgggctagaataaatgtaaagtttgacctttttaaaacgaaaagagagacaaagtctcagcacattccaaggagtggtagaaacagagctgaaggtgtccccattgtagattagtctcttctcactaaaatttactttccaacgtagggcctaaaggaaacctttcttaaagacaggctgaaaccccttcaaaggcagatgaggaggtacagacacgtgaccttttggtgcacactggagctacttggacaagaccagcatgccttgctgcacgtgtgtgtatttcactgctgagaacatcctttaacttggtgtgcaatttgaaaggatgtgaatcatggatggaaggccatttgtacatgtcctttggcaaaattctttctggtgtctcctaacttcagagacagggactctttttggatctctattgacaagtaataaaagtctggccctcataacttgtttccgaactagaaaagtctgtgagacccctacatcattctggtttttttgcttgagtaagaacaatccttttttatttttcttctgtacagtctaaagctacagagaaaaaaaaatgcactcttcccttgccggctcctggtaccattggtctgaacagctgtagttggtctactccttacttagcacttgattgtgtggggaaacaaaggtgggaggggtggggaatactggaaataatcagggcaatttttttctttcccataattggactagataccttggtactgttgaccttctcagcatctcccttttgccttagatggcaacaccctccagtctgtagcagagcagtccaacccagattagtgcagcccggaggcttagggtgcagcctccctggtcttcctccacacagttgttcaccaacagaccagacctcctttaaccacagtgtcaacatagtatcggaaagagagccatttcttaggggaataaaacagtttcgcttctttagctcatctgtggtgtcagaatccttggagctgaagagagaaatcaaaagagcatgatgatggctgcctggtttcaggtggaacttaatgcattgatctttagaagctccttctgttggaagttgagtacctgtgatctaaaatgtcctggaggcagatgacatctaaaatatgtgctttccaaccagcacagctggcgctcttagctcctgattggttgtgtgttttattaaggatcagtgcagttaagtcgtattttaaagtgttacctcccctcctaacccttccccttcttggacactgaaggaaaaggccaactagggtgttagccctctgggcaccaaggaaactaacagctttctcaaagcggtgaccactcaggccagcccagacaaatctgagggatggccagtgcactccaatgatgggacaggcctaacaacacatgtaagcttccccgagagctttcagctggttcacctctttgttctctagactcttaagtactgactgctttgacttttgtgattatgttatggtgatgtgtagtcagtgtaccaatatgttcacaacctaggatcatgataatggagtgtgttttgggttttttttaactgttcagaaaaaaagtaaattacaaatataagattaaagtgaaaaaaaaaaaatataaaaa

SEQ ID NO: 489143 - DNA, 4680 bp, Homo sapiens
gtgctggtcggacaccgagctgctgtcaatgttgtagactttgatgacaagtacatgtttctgcatctggggatagaactataaaggtatggaacacaagtacttgtgaatttgtaaggaccttaaatggacacaaacgaggcattgcctgtttgcagtacagggacaggctggtagtgagtggctcatctgacaacactatcagattatgggacatagaatgtggtgcatgtttacgagtgttagaaggccatgaggaattggtgcgttgtattcgatttgataacaagaggatagtcagtggggcctatgatggaaaaattaaagtgtgggatcttgtggctgctttggacccccgtgctcctgcagggacactctgtctacggacccttgtggagcattccggaagagtttttcgactacagtttgatgaattccagattgtcagtagttcacatgatgacacaatcctcatctgggacttcctaaatgatccagctgcccaagctgaacccccccgttccccttctcgaacatacacctacatctccagataaataaccatacactgacctcatacttgcccaggacccattaaagttgcggtatttaacgtatctgccaataccaggatgagcaacaacagtaacaatcaaactactgcccagtttccctggactagccgaggagcagggctttgagactcctgttgggacacagttggtctgcagtcggcccaggacggtctactcagcacaactgactgcttcagtgctgctatcagaagatgtcttctatcttttgtgaatgattggaacttttaaacctcccctcctctcctcctttcacctctgcacctagttttttcccattggttccagacaaaggtgacttataaatatatttagtgttttgccagaatctctcttgctttgccattaagcagaagaactagtttccctgtatagcctgctgggagagacccacttctagggtatgggggatgcagcttcaagcccagtgcccagtgtctccctgttaactgcaggaatgccaagcacctggccagagcagcccagccccaatatgcttaggaggagacagagttccctctgtatagcctctgggacaagaaaaagaaaacacaagaatgtatacactggaagatttgggcctcctgcctgccttctctttgtttctgttcctcttcccatctactcccctacgccccttcaaccttttttctctgtctgcttcacctgagaagagaagatttcagccccaggcctttgctgcaagtgaccctgtggcaacagtggattctcagacatgatactctcatcatatttgcaactcttctctctctttcttccccacacccaagaggaggattggtggtagggggcaggcagagggggtggggagaagtttcctgggctccatcaatggctgcatcttttctggactcagcagtctccttgattccatgtagagtgtggaaaggagttgctgattgcatttcctctcattaacaattgggtgtgtaataaaaagcattgtacttcatcttaaatcactggtaaggctcagcctacagaaagatttgaaatggccagagccaatcgcttggtgcattctgcgtaatggtttccatctccgatttcctcatcagggcctgtgaatacccaggtgcctgtatctttgccaagaccgtgatcaaggtagcttaagagagatggtcaggagaaaacactgtttttgttttttttgttgttttgttttgttttggccagttaaatatcatctctcaaatattgatctcaccgtgtcaaccttgcactgcacaaccttccttctgcttctcccacacccagtatttgcagaagggcaaagctgcttaagagagaggatcagggtgaagtttggcacacagggtttattaatggggcaaaaactgccttttcttcctcctcctgaccttattttgctcttcactctccccagccaataaagcgtctgtggcgattggtgaacagcataaacagctggacctcagcaagggtcaggcaaacccagtcactcggaaggcagctgtgtgagctgccaagctagtgggcttcaggtgcaagggtacctgtgccacaccaacctgggagcacacagaatactattaatgtgcacccagctggtctccccaggcaagaaggtatcctcttcccaaggtgtacccactgaatgttgttactacatattgagagtcattttatgcatatgcattctacctttcctgctttatgagtatttttaagcttttagttcaaggttatattcagaaaatatttcccagtataatgatacatcgtagcctaagaaatattttctcaatgtaattcccttcccagctacccaaatgctacagagaaatgttttctacttggccactatcagggttcgtcatctattgtgttgactattaatggctttttgattgggtaaggattttgctatagatgaaggtagagggctgtcagccctgaaaaacacacaggtcagacatttaaaaggcatgggtttcgagctgtctcaaaatattgcccaatagccataattttaccagcctttctgtcatatgctgctattacaaagtggaagctgttgaatgtttattggtgcccagggttttgctctccaatctaggttcagttgaaggaatattgtttctaagactgttttgagacatgtccagtacatcacaaaggagatcggggcgacccctgcagatgtggagccattagcccagttgaggatattctccaagttgtcctctctcctgctgatggaaatgggaatgaagttaagtggtctgaaaaacttgaatcgttcacatttctcagctctgggggtcatttaccagtttgttgtagaagaaataatcaggtaagttaaaagttcatttccagagaaggtaaaccccacttaccatctctgcatgatttcagtgggaattgattatcactaatccccaactgggctagaataaatgtaaagtttgacctttttaaaacgaaaagagagacaaagtctcagcacattccaaggagtggtagaaacagagctgaaggtgtccccattgtagattagtctcttctcactaaaatttactttccaacgtagggcctaaaggaaacctttcttaaagacaggctgaaaccccttcaaaggcagatgaggaggtacagacacgtgaccttttggtgcacactggagctacttggacaagaccagcatgccttgctgcacgtgtgtgtatttcactgctgagaacatcctttaacttggtgtgcaatttgaaaggatgtgaatcatggatggaaggccatttgtacatgtcctttggcaaaattctttctggtgtctcctaacttcagagacagggactctttttggatctctattgacaagtaataaaagtctggccctcataacttgtttccgaactagaaaagtctgtgagacccctacatcattctggtttttttgcttgagtaagaacaatccttttttatttttcttctgtacagtctaaagctacagagaaaaaaaaatgcactcttcccttgccggctcctggtaccattggtctgaacagctgtagttggtctactccttacttagcacttgattgtgtggggaaacaaaggtgggaggggtggggaatactggaaataatcagggcaatttttttctttcccataattggactagataccttggtactgttgaccttctcagcatctcccttttgccttagatggcaacaccctccagtctgtagcagagcagtccaacccagattagtgcagcccggaggcttagggtgcagcctccctggtcttcctccacacagttgttcaccaacagaccagacctcctttaaccacagtgtcaacatagtatcggaaagagagccatttcttaggggaataaaacagtttcgcttctttagctcatctgtggtgtcagaatccttggagctgaagagagaaatcaaaagagcatgatgatggctgcctggtttcaggtggaacttaatgcattgatctttagaagctccttctgttggaagttgagtacctgtgatctaaaatgtcctggaggcagatgacatctaaaatatgtgctttccaaccagcacagctggcgctcttagctcctgattggttgtgtgttttattaaggatcagtgcagttaagtcgtattttaaagtgttacctcccctcctaacccttccccttcttggacactgaaggaaaaggccaactagggtgttagccctctgggcaccaaggaaactaacagctttctcaaagcggtgaccactcaggccagcccagacaaatctgagggatggccagtgcactccaatgatgggacaggcctaacaacacatgtaagcttccccgagagctttcagctggttcacctctttgttctctagactcttaagtactgactgctttgacttttgtgattatgttatggtgatgtgtagtcagtgtaccaatatgttcacaacctaggatcatgataatggagtgtgttttgggttttttttaactgttcagaaaaaaagtaaattacaaatataagattaaagtgaaaaaaaaaaaatataaaaa

SEQ ID NO: 489144 - DNA, 399 bp, Homo sapiens
catgtcatccacaagctgcttcggccagcgcttattcaagtgagccccccgccgtggacacggaagtcgtttggtggcggtgaaaaagactgccccactgcaactccgcgcacagaatgctacaagaccgctcctccctccataagtccaagaacgcctcatcaccactgtactggttacagatcctgccccacgcgagggcatagtgatattaaaggaccacccataatgtatctcgtggtgagggagtaatattaaacttttcatgtcttcttagaccaattttctctcacaagaagggtaataatccggggaaatttttaccacaagaggaggggggaacgaaattttttcccgaaggctttgtaaaattagatctataaaacctcttcaacatac

SEQ ID NO: 489145 - DNA, 4710 bp, Homo sapiens
gtgctggtcggacaccgagctgctgtcaatgttgtagactttgatgacaagtacatgtttctgcatctggggatagaactataaaggtatggaacacaagtacttgtgaatttgtaaggaccttaaatggacacaaacgaggcattgcctgtttgcagtacagggacaggctggtagtgagtggctcatctgacaacactatcagattatgggacatagaatgtggtgcatgtttacgagtgttagaaggccatgaggaattggtgcgttgtattcgatttgataacaagaggatagtcagtggggcctatgatggaaaaattaaagtgtgggatcttgtggctgctttggacccccgtgctcctgcagggacactctgtctacggacccttgtggagcattccggaagagtttttcgactacagtttgatgaattccagattgtcagtagttcacatgatgacacaatcctcatctgggacttcctaaatgatccagctgcccaagctgaacccccccgttccccttctcgaacatacacctacatctccagataaataaccatacactgacctcatacttgcccaggacccattaaagttgcggtatttaacgtatctgccaataccaggatgagcaacaacagtaacaatcaaactactgcccagtttccctggactagccgaggagcagggctttgagactcctgttgggacacagttggtctgcagtcggcccaggacggtctactcagcacaactgactgcttcagtgctgctatcagaagatgtcttctatcttttgtgaatgattggaacttttaaacctcccctcctctcctcctttcacctctgcacctagttttttcccattggttccagacaaaggtgacttataaatatatttagtgttttgccagaatctctcttgctttgccattaagcagaagaactagtttccctgtatagcctgctgggagagacccacttctagggtatgggggatgcagcttcaagcccagtgcccagtgtctccctgttaactgcaggaatgccaagcacctggccagagcagcccagccccaatatgcttaggaggagacagagttccctctgtatagcctctgggacaagaaaaagaaaacacaagaatgtatacactggaagatttgggcctcctgcctgccttctctttgtttctgttcctcttcccatctactcccctacgccccttcaaccttttttctctgtctgcttcacctgagaagaaagtgtatgaagagagtgtcctcctctcgcatgagccagatcagccagaaaatgcaacacttggaagagttaaatgctgttcagtgaagatttcagccccaggcctttgctgcaagtgaccctgtggcaacagtggattctcagacatgatactctcatcatatttgcaactcttctctctctttcttccccacacccaagaggaggattggtggtagggggcaggcagagggggtggggagaagtttcctgggctccatcaatggctgcatcttttctggactcagcagtctccttgattccatgtagagtgtggaaaggagttgctgattgcatttcctctcattaacaattgggtgtgtaataaaaagcattgtacttcatcttaaatcactggtaaggctcagcctacagaaagatttgaaatggccagagccaatcgcttggtgcattctgcgtaatggtttccatctccgatttcctcatcagggcctgtgaatacccaggtgcctgtatctttgccaagaccgtgatcaaggtagcttaagagagatggtcaggagaaaacactgtttttgttttttttgttgttttgttttgttttggccagttaaatatcatctctcaaatattgatctcaccgtgtcaaccttgcactgcacaaccttccttctgcttctcccacacccagtatttgcagaagggcaaagctgcttaagagagaggatcagggtgaagtttggcacacagggtttattaatggggcaaaaactgccttttcttcctcctcctgaccttattttgctcttcactctccccagccaataaagcgtctgtggcgattggtgaacagcataaacagctggacctcagcaagggtcaggcaaacccagtcactcggaaggcagctgtgtgagctgccaagctagtgggcttcaggtgcaagggtacctgtgccacaccaacctgggagcacacagaatactattaatgtgcacccagctggtctccccaggcaagaaggtatcctcttcccaaggtgtacccactgaatgttgttactacatattgagagtcattttatgcatatgcattctacctttcctgctttatgagtatttttaagcttttagttcaaggttatattcagaaaatatttcccagtataatgatacatcgtagcctaagaaatattttctcaatgtaattcccttcccagctacccaaatgctacagagaaatgttttctacttggccactatcagggttcgtcatctattgtgttgactattaatggctttttgattgggtaaggattttgctatagatgaaggtagagggctgtcagccctgaaaaacacacaggtcagacatttaaaaggcatgggtttcgagctgtctcaaaatattgcccaatagccataattttaccagcctttctgtcatatgctgctattacaaagtggaagctgttgaatgtttattggtgcccagggttttgctctccaatctaggttcagttgaaggaatattgtttctaagactgttttgagacatgtccagtacatcacaaaggagatcggggcgacccctgcagatgtggagccattagcccagttgaggatattctccaagttgtcctctctcctgctgatggaaatgggaatgaagttaagtggtctgaaaaacttgaatcgttcacatttctcagctctgggggtcatttaccagtttgttgtagaagaaataatcaggtaagttaaaagttcatttccagagaaggtaaaccccacttaccatctctgcatgatttcagtgggaattgattatcactaatccccaactgggctagaataaatgtaaagtttgacctttttaaaacgaaaagagagacaaagtctcagcacattccaaggagtggtagaaacagagctgaaggtgtccccattgtagattagtctcttctcactaaaatttactttccaacgtagggcctaaaggaaacctttcttaaagacaggctgaaaccccttcaaaggcagatgaggaggtacagacacgtgaccttttggtgcacactggagctacttggacaagaccagcatgccttgctgcacgtgtgtgtatttcactgctgagaacatcctttaacttggtgtgcaatttgaaaggatgtgaatcatggatggaaggccatttgtacatgtcctttggcaaaattctttctggtgtctcctaacttcagagacagggactctttttggatctctattgacaagtaataaaagtctggccctcataacttgtttccgaactagaaaagtctgtgagacccctacatcattctggtttttttgcttgagtaagaacaatccttttttatttttcttctgtacagtctaaagctacagagaaaaaaaaatgcactcttcccttgccggctcctggtaccattggtctgaacagctgtagttggtctactccttacttagcacttgattgtgtggggaaacaaaggtgggaggggtggggaatactggaaataatcagggcaatttttttctttcccataattggactagataccttggtactgttgaccttctcagcatctcccttttgccttagatggcaacaccctccagtctgtagcagagcagtccaacccagattagtgcagcccggaggcttagggtgcagcctccctggtcttcctccacacagttgttcaccaacagaccagacctcctttaaccacagtgtcaacatagtatcggaaagagagccatttcttaggggaataaaacagtttcgcttctttagctcatctgtggtgtcagaatccttggagctgaagagagaaatcaaaagagcatgatgatggctgcctggtttcaggtggaacttaatgcattgatctttagaagctccttctgttggaagttgagtacctgtgatctaaaatgtcctggaggcagatgacatctgtgttttattaaggatcagtgcagttaagtcgtattttaaagtgttacctcccctcctaacccttccccttcttggacactgaaggaaaaggccaactagggtgttagccctctgggcaccaaggaaactaacagctttctcaaagcggtgaccactcaggccagcccagacaaatctgagggatggccagtgcactccaatgatgggacaggcctaacaacacatgtaagcttccccgagagctttcagctggttcacctctttgttctctagactcttaagtactgactgctttgacttttgtgattatgttatggtgatgtgtagtcagtgtaccaatatgttcacaacctaggatcatgataatggagtgtgttttgggttttttttaactgttcagaaaaaaagtaaattacaaatataagattaaagtgaaaaaaaaaaaatataaaaa

SEQ ID NO: 489146 - DNA, 501 bp, Homo sapiens
atcaatatttatgacattcagaagttggaatggaagaatactattggtaagcttttcagcatgtggcgaaataacattaaaattgacttattcagtaagtatacataaaaagttatatcactctcagcatgtgttaattcagctaaataaatcatgcttgttcagagtgggcaactgtagactctgtttgtatagcaaggcctttatctgaactactgtgtactcacaagattttaagaaaaatggaacataaaattccatgatcctatgagtcactgaatttgcccaatctgactgaataacaaaggaagagaactaccctcctcctgagtataaatgattgaattgattgaatgaatgaaagtgcttttgtgtgtgtgtgtaaacctcagatattttaatacaattatataattttacagggcttaatgcagctatcttgtcaattgcaactaaatgcatatgcaaacttctaaataaaagagagagtatgtaaagaga

SEQ ID NO: 489147 - DNA, 1196 bp, Homo sapiens
gtgctggtcggacaccgagctgctgtcaatgttgtagactttgatgacaagtacatgtttctgcatctggggatagaactataaaggtatggaacacaagtacttgtgaatttgtaaggaccttaaatggacacaaacgaggcattgcctgtttgcagtacagggacaggctggtagtgagtggctcatctgacaacactatcagattatgggacatagaatgtggtgcatgtttacgagtgttagaaggccatgaggaattggtgcgttgtattcgatttgataacaagaggatagtcagtggggcctatgatggaaaaattaaagtgtgggatcttgtggctgctttggacccccgtgctcctgcagggacactctgtctacggacccttgtggagcattccggaagagtttttcgactacagtttgatgaattccagattgtcagtagttcacatgatgacacaatcctcatctgggacttcctaaatgatccagctgcccaagctgaacccccccgttccccttctcgaacatacacctacatctccagataaataaccatacactgacctcatacttgcccaggacccattaaagttgcggtatttaacgtatctgccaataccaggatgagcaacaacagtaacaatcaaactactgcccagtttccctggactagccgaggagcagggctttgagactcctgttgggacacagttggtctgcagtcggcccaggacggtctactcagcacaactgactgcttcagtgctgctatcagaagatgtcttctatcttttgtgaatgattggaacttttaaacctcccctcctctcctcctttcacctctgcacctagttttttcccattggttccagacaaaggtgacttataaatatatttagtgttttgccagaatctctcttgctttgccattaagcagaagaactagtttccctgtatagcctgctgggagagacccacttctagggtatgggggatgcagcttcaagcccagtgcccagtgtctccctgttaactgcaggaatgccaagcacctggccagagcagcccagccccaatatgcttaggaggagacagagttccctctgtatagcctctgggacaagaaaaattaacttggcgtcgtttacaacgttgtgacttggccctgccgtacccactttcggctt

SEQ ID NO: 489148 - DNA, 120 bp, Homo sapiens
gcaaccgtctctactaagtgcaagatagcgcgtgtgtgcgcctgtgtccgctactcggagctaggcggagatccttgacccagagggcagagtgcggtgagcgagatatgcactgactca

SEQ ID NO: 489149 - DNA, 173 bp, Homo sapiens
catgctcgtgctgtctccaggcagcctgatcagtcttgaaggccacgatgttagtgatactttagctgtgactgtgagagttcagagggattccttcctaagagatattttagcggggtagtagaggttccagtcggtggtacctgagcgtgcgaattctgtaagtcatggtc

SEQ ID NO: 489150 - DNA, 168 bp, Homo sapiens
ctatcgatctgtctatacactttgaacacggaaaattcgtttatgtaattgtaacccccaaaaaattatgaagacatagaaattatacacacttttacaatgtataatttatgtcggccacacactagatatgttaacaacacgttccagatatactttcagagttcc

SEQ ID NO: 489151 - DNA, 243 bp, Homo sapiens
ccgggagcccttaaccctggaaacagggagtccagtttaggaggctgattttacagttataattatagagaagagacgacatagtgacttggattgggggcttgaggcaaagatgatgagaagtagtgtattctggatatgttttaaagtatggaccaacgagatagagagacgaggagtcaagaatgacactggcgtagggtcagcgactcactgcgtgaagccgagccctttgggaggcct

SEQ ID NO: 489152 - DNA, 670 bp, Homo sapiens
  misc_feature (670)..(670): n is a, c, g, or t
tgaggaccccggatggcgacatatcaagatgacatctgactgcattgttctgttggtccgaacttctaaacaaacactcataaagtaagtttaaacaatttggagatgtatgaggaaaaagtcttgttctgtgcagttcagactttgttaaaaaaaaaaaaaaaaaaaaaattgcccattccccatgtccatgatcttccatggtttttgttcatgcttatctgatttggattaggggacaaaaaagaagaggcggcaagttctcctatctcttgggagtgtaccgctcaggaaatctggctcatcaaagtccagctaacatacacagcggacacatcaaaggcaaacgggggtgctccgagaatgcagaggggaatagatcggaagggagttggcactgggcaccaccctctggtggcacgggcctcatatccctagtggcaatggtcaccaccatgatggctcaaggacttaggaaacatgcacagcatcttcaattcatcttctgccttagggcaggacgggcaaccaaacagtttcataaagaggctgcagagagaggggtaggttgcctgtgtcaggctgccaaatcttttgtcttttccctactctggagtcctatgccccagtctgagtattggccgtgaattgtcgccattcgagtacgacn

SEQ ID NO: 489153 - DNA, 831 bp, Homo sapiens
  misc_feature (41)..(42): n is a, c, g, or t
  misc_feature (47)..(47): n is a, c, g, or t
  misc_feature (49)..(49): n is a, c, g, or t
  misc_feature (68)..(69): n is a, c, g, or t
  misc_feature (142)..(142): n is a, c, g, or t
  misc_feature (166)..(166): n is a, c, g, or t
  misc_feature (220)..(220): n is a, c, g, or t
  misc_feature (371)..(371): n is a, c, g, or t
cgaaaccccgtgaaagcacacccccctgcgaacaaagtcannctgcntntcgatgaaaaaccgccgtnngcgatcaccctgcgtggcgagttgaaagagcaggcgctcaagaaggtcgatttctctgttgcgaccgaactgntcaccgagcctggcagtgtggtgntcgccctcaacgacacgctgaccaacaatggcgattatccgaaggaataccagnccctgtatcacagtaacttcagcacgccgttcctggagcagggcgcgcgtttcgttgcgccagtgaagcaggtgtcgccgttcaacgacaaggccaagggcgaactggccgactggcaaacctaccgtgcgccgaccaaggactatgacgnaacggtttacaacgtggtgccgtatgccgatgccaagggcgataccttgaccgtgctgcataacaaggccggcagcctgggggtttcggttggcttcaatacgcagacactgccggtgttttccctgtggaagaacactgatacccaagggcagggctatgtcacggggttggagccggggacgagtttttcgtacaaccgtcgttatcagcggccattgaacctggtgcctacgatcggggcgaaggaacataagcagctccgtatcagctacagcttgttggcggataaggcggctgttgaaaaggccttgaagcaggtcagcgagattcagggtgggcgggagactgaggtgcggcagacgcctttggtggatctgaccaaggggtgacattggctggagccttcacgcggggcccggcgttcttcatcgacgccggaatcgccctgcaactgtagg

SEQ ID NO: 489154 - DNA, 483 bp, Homo sapiens
cacgaggaaatgcggtggtgatcgccggttaccaggctgaaggcacgcgtggcgatgcactgctcaagggcaagcgcagcctgcgcatcttcggtcgtgatgtgccgatagcctgcgaggtggcgcaggtcgaaggtctgtcggcgcatgccgactggaaggagatactggactggctgcgtccggtcgatcgcgccccgcagcgcgtgttcgtcacgcacggcgagccggtcgccgccgacagcttgcggcagaagctcgagcacgagctcgcgtggtcggcgcaggtgccggagcaggacgaggagttcgaccttgactgaaccgatgcccgtcgaccgcgacgacagcttcgctgcggtgctcagagcagaggcggcggctcgttgatcagcgcccagaacacgcccatctgcgtcaccgtgcgcgagaactggtcgaaatcgacgggtttcacaacgtatgcgttgatgcccaggccgt

SEQ ID NO: 489155 - DNA, 386 bp, Homo sapiens
tttaggcctggctcactctgtcagccttattctaaagcgctagatataagctcatgtgactgctgctccaataaaaccaaatttatattcgataaagtgtggtcctcttattaattcactgtggtggtggggttggctaattccacacattggtaacacagttacacccatttacccagtagggccgccagggaaggattggattacgcagaaccagaagttacttgtccaatgcgcttcctgctggctctagagtgcatttgtttggaatttgctgctgtcgcgcataggttctgggattgagttaaatattgtgttagtgtcccgcaacaccttttaatttagtctcctgaaagaccgcctttagagtctcttctcatttttct

SEQ ID NO: 489156 - DNA, 223 bp, Homo sapiens
  misc_feature (51)..(51): n is a, c, g, or t
gtgtggcacctcccccctggcttgctctctctctctcctgctgccacgtanaacgtgctttgcttcccctttgtcttccgccatgattgcaagtttcctgaggcctccccaagccatgcagaactgtgagtcagttaaacctctttcctttataagttacccagtctcaagtagttctttatagcagcatgagaacggactaatacacacttgaacttgttct

SEQ ID NO: 489157 - DNA, 284 bp, Homo sapiens
acagtggcgtgtccatgaaatttcaattcatgacccatctcttccacatgcggtgagttgagagatccagtatagtcatatcatatctctggagcagatgatacttaatgggtgcggagcactaagctaatgttagtaaagcatatactttagggagtagggaatcccaaaacatcaaggcaagaaaagtgttatgcaagaactgcattgagctattactagcctggcactgtggatgatgcctagtcacctttgtcaagacgaggcatacgccaaggtacgca

SEQ ID NO: 489158 - DNA, 195 bp, Homo sapiens
ccaaaattggggtttttttttttccccaaaaaattttttttttgggggggggggggacgggcccccccttaaggggggcaaaaaacccccatttttttgccttttttaaccctttccctttttttttttttttaaaaaaaacccggggcccctttttttgggggggggggaaaaaaaaaaccccttttcccccca

SEQ ID NO: 489159 - DNA, 168 bp, Homo sapiens
ccaccacacccaaccaagaaatttcaacattaaatctgaacatgaagacctttcccttcttccaaatggaagataaggatatatttttaagaggactattcgcataaacacccatgtagttacaatctgtgacctaggcaggaaatgccaggtcgacgcggccgcgaa

SEQ ID NO: 489160 - DNA, 170 bp, Homo sapiens
ccccccgtttggtcccccaggaggacattttagcaagggggcctgcaagggagtgtgggactgggcctcatcctcgccggcgttggaaaccaaggccttgtatgcccccccttatgaagccctgtttcccagttactttcccttcccgaataaaggttcccaggtaatta

SEQ ID NO: 489161 - DNA, 297 bp, Homo sapiens
taagccaaatttagcagtgagaaaaaatattttaaggggtagagagagatgggtaaaaatggtggggtgtgtttttttttggaaagggagtctcgctctatcgcccaggtggggcttgaaggggcgtgatctgggttccccgacaacctcggcctccaagggtcaaggtgactctccggcctcagcctcccgagatagcggcaattattagccattgcaccaccatgtgccgggcataatatggatattcacagatacaaaccggggtttccccccaggggggccaaggcgggcgcg

SEQ ID NO: 489162 - DNA, 307 bp, Homo sapiens
ccccgtacttcatcggctccgccgggcggcggtgcgctgcgatgccctgctgtcctcagtctactcccggaggctgagcgtgggaggactcgcttgagcccatgagttctgggctgtagtgcgctatgccgatcgggtgtacgccctaagttcggcatccatatggtcacctcccgtcgcaccggggcgtacccaccacgggtgctgactgagatacgcgaggtgccgcagtcaactaggcgcccgtgccgattcggtaccgatgctcgatcttcgttaaatctctagctctgtagctcttttcctg

SEQ ID NO: 489163 - DNA, 774 bp, Homo sapiens
gtttcccagaccctcgtgtggaggcttggtcaaaaggcgaagacctgaagaaatactttagacgcaggatgaaggaggaagtggcagaacgggtagaaccaacccctgtcgaaacttcaccaacgtggactctagccccgcgactacagtctgccatccatcatcctagctcttacttgggagcccaagcaagaaggactaaggtgactgggacctgggcagatgggagaactgggcagtgggagaagagatcatgtaggaagtcagcaaggggctttgtttcggtccagggaaccaaatccagcactataaccgcgcaccagatcctgggagtcactggcagatagcaaatctaggaactaggtaatgcaaaggtgctgcgtcgtgccttctagctgagcagcccctccccatctcataagtcctcattcttagtattctataaaatggggattatgacatccatcctgtgtgtcctgttgacctgtttgtaaaggtagaataaggtaagtgagtatgaaagccactttaaacatgtaaagcactatattacaggcttcttctcactcaactgaccctagatcattaggatgggtagacatgacaagaaggaacgaagaatgcagatgcacgggggagcagagcactgtgaactctccattttggctacagaactatggtgctgggtctatggaacagtatgtcccggttccctttgacaggaagctaaggccaaagagggaatgaacgtcctggcaaatgttcgaggaaccg

SEQ ID NO: 489164 - DNA, 198 bp, Homo sapiens
tatcgttttctggtgatgttgtgctaccaatagggagtacacggccctccattggggcctgagaatcagtggacctccccgcgaggtgggcccggcgcgctcgctgggtgtttggcatgttcccacggggagtgccgggccgttttatggggtgattggatgtttccttctttattttataaaaaagggtagccatgc

SEQ ID NO: 489165 - DNA, 219 bp, Homo sapiens
cccaattttccccaactggacggggtcaggaaatgttccttttcccccagaaccttttttttttaggaaattatttaatggtggcaggtccccagggatttcccctttttttgtattgggcagggtagttgatgtaaaacccttttgtggatggaaaaaattttttttttattgctcttttagtttgggagggtaaaaaaaggtttttggttattttta

SEQ ID NO: 489166 - DNA, 104 bp, Homo sapiens
tggggctgtgggtccttgtgtcctgctgctgaacacactggggctgctctgacggacaaccgctgtctgctgccttcatacagatgctgaatcagctccaacgt

SEQ ID NO: 489167 - DNA, 256 bp, Homo sapiens
catgcggttacttctgctggccttctctccttaatgacattacactattctcaccagcacctcctaggtgacccagacaaattataccctagaccaaccccttaaaacacccctccccacatctaagcccgaagtgatatttcctactacgacctacacaaattctccagatccgatcccgagatatgcagggagatccatcatagacgtcagaacctgcaggacaatgcaaagcattggacaactaggaccgatc

SEQ ID NO: 489168 - DNA, 327 bp, Homo sapiens
tttagcgggacttgccaaaggtgctggaccatcgagacttgttatatgagcagctttccaaataccttcaggtgagaaatgtcatggagcgactccaggaagctaagcactcggagttatatatgcagggggatttgggctgtaacttcttcgttgacacagtgggcccagatacttcacgcatctatgtggccctgggatatgggtttttcctggaggtgacactggcagaagctctcaaggtcattgatcgaaagagctctttccttacagagctcagcaacaagctcaccaaggactccattgatatcaaagcccatatccaca

SEQ ID NO: 489169 - DNA, 1181 bp, Homo sapiens
ttcgcgcctggctgcccctcctcccgtctgtgtgttgtggcggcggcagtgtgtctcccgccgcgcctctggcttctggtctggtggtcttccttgtctctcctatttttcgcacatccggctgggtgtctttccgtcgggtactctctgtgtgtggttgatctcgccgccgtactcccccggtcagtcgggcttctttgctggtgttgttcgtcctacctgttttgtggtcgctgtcttctgtctgtcccctctcctctccttggttattgtctcgtcgtagtttgtggtatatttgttgtgttcggtgctccgtgtggtctgtgttcttttatctttggtcttgtgtcgtttcagtacgagtgttttatttttgttgtgtctgctgttttgtgttgcttcttctttctctttgtctgtctttttctgtgtctgcttctgttagtctttgctcgtgttagttcccctgtttgctctttgagctgtgttggtcccttgcgctgccctcttgcggtcctgttttgggtgcgtgccgttccttttttctccgccgcgtgcgcgtctccttccttgcttgtcgttctccctcctcttttcgcgttgcttttgctcgctgtctctctgtccttctctttcttttcttcgcttcgcgctctgtcgtccccgcgccctccttccgccctccctctcttctctcttccctccttcctcctcccgctgctcctctccgctcctccgcccctttcgtcgcgctcgttggctgtgtgttcttctgagccccgttcttcgcttgctcgcgccccctccctcgccccctcctctctccctcttctccctctcccctctccctctctctctctgtgcggctccgccggcgcgcgccctctcctccgcgccgctctgccggctcctctcttttcttcttctgctctcttcctttctcctctccccctccccccctctctctcctcctcctctcccccctccctccctcttccttctctctctctcctctctctcgctctctctctctctctctctctctctctctctgtgtctgtcgctgcgcccgcttcttctctcgtgttctgttgttttttttttttttgtgccaccacacacacacacacacacacacgcacacccacctcccccacccacctcaccacacacacaacaca

SEQ ID NO: 489170 - DNA, 352 bp, Homo sapiens
acagaggctgaatgggtgtgtgtgtgtgtgtgtgtgtgtgtgtgtgtgtgtgtgtgtgtttttaaagagctccttagtgtgtatattactctttatgtctttcttgctcttacaaagaggtgtcagaaatatagaacgctcttggtgtcggtgtgggaggaaaagacagatgacatgtggtaaaaagttatccacacaatactctcctttcggatatgctctgtatcgtctccagccagccctgtttatccgggttacagtggattcgtgggactcgtacccgtatgtgagaggagagggagagagagtgttctctctccactctgttctccttgatctgattcagtctcca

SEQ ID NO: 489171 - DNA, 1000 bp, Homo sapiens
agcccaggtgagagctctcttctcctttgagacctagttggaaaggcagagatagggtctctgaaaggaatagtgaatgacacctgtattttttggggaaacttcattgaacaagagttccattataatcattttctcttcacaagtaacctcttccataacagcaggaattttacatgagtttagatcattcctctatgggagggatttgcttcagaagtgcacttgattggaagtactcataagtgagtttcttgacgtttcgtaaagagtttccttatttgataaatacattctagcaatctgaacctttgactctttgcagctatgaatgtatacatactaggaggatttttctaactgatgtaatattttatcatacctagtatctctctgtcctagactcttcatatattatacatactcataacctctcatcaactgtactatactccacatttatttctcttcataccttatctcatgtaacaatctattaactactcactctattctcatactctgctatcatcctagacacactgtgaccttatccctctagcgtacttcacctaccattctttaccatctatcatactcactacattgctcacctgaaccacacttctttgctcacatgcctacggtaccattaattttctaccatcacctatccctgtcctaatctactcacttcctatcatctcacacttccttcttttccatttcgatcactctatattcattccactcacttttcgtcctcatctctcttcctctactcgatctattcgcattctgtacttccgatttctgctctctcttattctacctcattctattcctctcttgtacctctattctatatcttcatcattatacttcctcctctcatctctcattcactactcctgactcctccatcttctctcctctttccttactcctttatctctctattaccatcctctctcttctattctacctttatctctctcct

SEQ ID NO: 489172 - DNA, 872 bp, Homo sapiens
ctgtaatcccagctactcgggaggctgaggcaggacaattgtttgaacctgggaggtggaggttgcagtgatcgcgcaattgcactccagcctgggcaacaagagcaaaattccatctcaaaaaaaaaaaaaaagtgattgcaggcctttctgcagtaatgggtggatatgtcttagcctaaatgctgctccagtttatggctttggtccacgttgtatttactttggcgtgaaaaacccaacattgtgcattgacggggaaagtggctccaagttgctgggttgcttgctccgggcttggagcttgttcgaaagcagaaccaggcagaaccttcccttctttccatttccttagaaggcagttatagctgctggattctcgtctccttcttcccattctttgcagaagcagccaggcttgacacttgtgtgtctctcctgtgccaggattgacttatcctccctccagtggagaagctgaaaacggtgctgcagaaaggtgaaagactttccacattcaactttcctggagaagttacgcgttgaggacgccttgagccccagggggagacctgtcctttggctctttccttcccaattgcccgtcaggcttgaacttcgccttcccccgtgactctgcctcgggcctcgcagaggccggtggtcactttcggtcactcatttggcccctggagacgtctttcttggtgccttgatgttgaaagcgcctctctttggagcaaacaagcattctattgtgcaaccagagtagcaggggacctgctcagcaggttgtgacccaggtctctgaatctgtcatggcttggcttctgcaaaggtccattggggggtttaccaaccaactaggatgt

SEQ ID NO: 489173 - DNA, 149 bp, Homo sapiens
gtgtcccagaggcgcttcaaagacagtctagcatagtggtggatggcatcagggatagatgaaactccatggtgagaactcagtgaaattcgtccttggcctgttctgtttctgctgctctgtccttgactctgcacttcccctccgcc

SEQ ID NO: 489174 - DNA, 582 bp, Homo sapiens
  misc_feature (200)..(200): n is a, c, g, or t
  misc_feature (208)..(209): n is a, c, g, or t
  misc_feature (214)..(215): n is a, c, g, or t
  misc_feature (217)..(217): n is a, c, g, or t
  misc_feature (415)..(415): n is a, c, g, or t
  misc_feature (495)..(496): n is a, c, g, or t
  misc_feature (569)..(569): n is a, c, g, or t
tagcggaaccggaatttcaaggagagatctgaataaggagtactccaatagaacatagacaaaaggtcaataagcacatgaggaggttctcaagatcactagccatcaggaaaatgcatatgagatctacaatgagatatcacttaacactcactgggatagatatataatcaaagtgataatatcaagtgttgtggaangctgcaannaaganntnccggcagtgcagcaatgggcgctgtgtgtccaacatgctgtggtgcaacggggccgacgactgtggggatggctctgacgagatcccttgcaacaagacagcctgtggtgtgggcgagttccgctgccgggacgggacctgcatcgggaactccagccgctgcaaccagtttgtggattgtgaggacgcctcagatgngatgaactgcagtgccaccgactgcagcagctacttccgcctgggcgtgaagggcgtgctcttccagccctgcgagcggnnctcactctgctacgcacccagctgggtgtgtgatggcgccaatgactgtggggactacagtgatgagcgcgantgcccaggtgtga

SEQ ID NO: 489175 - DNA, 1128 bp, Homo sapiens
  misc_feature (114)..(114): n is a, c, g, or t
  misc_feature (266)..(266): n is a, c, g, or t
  misc_feature (268)..(268): n is a, c, g, or t
  misc_feature (281)..(281): n is a, c, g, or t
  misc_feature (313)..(313): n is a, c, g, or t
  misc_feature (323)..(323): n is a, c, g, or t
  misc_feature (327)..(327): n is a, c, g, or t
  misc_feature (348)..(349): n is a, c, g, or t
  misc_feature (365)..(365): n is a, c, g, or t
  misc_feature (387)..(387): n is a, c, g, or t
  misc_feature (392)..(392): n is a, c, g, or t
  misc_feature (417)..(417): n is a, c, g, or t
  misc_feature (465)..(465): n is a, c, g, or t
  misc_feature (625)..(626): n is a, c, g, or t
  misc_feature (634)..(634): n is a, c, g, or t
  misc_feature (637)..(637): n is a, c, g, or t
  misc_feature (640)..(640): n is a, c, g, or t
  misc_feature (643)..(643): n is a, c, g, or t
  misc_feature (649)..(649): n is a, c, g, or t
  misc_feature (652)..(653): n is a, c, g, or t
  misc_feature (657)..(657): n is a, c, g, or t
  misc_feature (660)..(660): n is a, c, g, or t
  misc_feature (670)..(670): n is a, c, g, or t
  misc_feature (673)..(673): n is a, c, g, or t
  misc_feature (688)..(689): n is a, c, g, or t
  misc_feature (696)..(696): n is a, c, g, or t
  misc_feature (715)..(715): n is a, c, g, or t
agcggtctcctgccaagcagcaggccccacctgtccggaacctgcaccagtctggattcagtttgtctggtgctcagattgatgacaacattccccgccgcaccacccagcgtntcgtggcgccccccggtggccgtgccaacatcaccagcctgggctagagctcctgggctgtgccgtccactggggactggggatgggacacctgaggacattctgagacttctttcttccttccttttttttttttggttttttttttaaanancctgtgatagttnctgtggagcagccagttcatggggtccccctnggggccccanaccncgtctctcaccaagagttacnngatttggctcatccanttccctacacttctagtgggtntcacncccaagattacccaccaagctcatncggggaaccacacccaacatttagacttgcgaacaagcagcccccagncgagggtctccttcgccttcaacctcctagggtctgtagcatctccctttccagggggggagggaagataacgtgcattggcccagagctgcctttactttccttttaaaaattttaagaagtttccttggagggggctggggaggggccggggtcacgnngagtcttntanttnttntttttnaanntatnacnttgggacacnttnattcccatattaacnnacagggnggtttagaagggacattcntaagtgaattgcacattaaaggttgtattcaccacacaggtgataacccccgggggtggtgttggcgacaaaaccacatatggggaggacatgcccctggagaaagcgccccaaaaatgtgcccccacccggtagttcgcccaattcgttgtatagctctacagagagaccaccatgtgtgggtaaaacaagggggggcacacacgtctatggccttaattgggggcccccaaaaattgctgggacgggcggaaattataacctccccttgggagcaagaataccctgcctcatctcttgtacaccccaaatcttcgacgagcgagagccccacaacacagcgtcatttgatcccttatccagacgttttgaaatcccgcgaaaaattcgggcggtgaggtgcacccactacg

SEQ ID NO: 489176 - DNA, 832 bp, Homo sapiens
  misc_feature (223)..(224): n is a, c, g, or t
  misc_feature (640)..(640): n is a, c, g, or t
tcccccgcttgatatttgtcgccccccacatttgtgaacgcaacccaccacacagagggataaagagagaggagatagggcccacccccgcatatataataggtgttcttcttagagcccgctctgtgttagaaaaaacacactgtgggagatttgtgttgctcctctgtgggcgcgcacacactatattatagtgcgcgatatcttatatatagaagaaagnnggtggagatatatttgtgatagacacacatacacacaggggagaaattgtgaggtattcctggtgtcccacagatatgagagatatgtccccccacacacacgggtgtgtgtacacacacgtgcgcccacaatacctgtgagcaagagagtgtcttacccacacagtgtggtataccccacgcgcacatgggctcgtgtgtggcgcacatgtgtgtgtgtgtaagacacacacaccccacggtttataggggccccaagagattttctctgccccacagaaagaaattataatgtttggcgctatattgaggccaccacatgttagccacactcttataagaggctccgcggatatgctttcctgagaaacgctgtgagaaggagaaatgtagtcacgagaaaagagaaaagaagncccacaagagataaaggtacacctcgggtgtcacaactaaagcgcccacaccctcgctccacccccagagagaaagcacaccctcttgggaggaaacccatgggaaggagcctgagctgctggaacctattccctatgaattcctggccataataggtgtttaaaaaaaaaatataaggacctctgggctac

SEQ ID NO: 489177 - DNA, 154 bp, Homo sapiens
ccatgtagcgctaaaaaccccatattggccccataacacacattttcaacaaccacgggactcgaggaaaggagcactcttcacagaaaggttcctcacagaagttcccaacagacacgcgggtggacacaaacagggcgcacgagcatacaga

SEQ ID NO: 489178 - DNA, 368 bp, Homo sapiens
gagttgagacctgctgcatgagctggctgagctgcggctagggatccgactgaggatgacagacggtggacgggtagacggaggaggcagagagcccgtgagcagctacagactcagaagagtggccgggcacaaaacaagggctgccccatcgacctcgtgtacaagaagggtgggggctgtcgcctcttgaatcgctccaccaagttccagcagatcgtccgtggcatgaacccaggtgctggatgtgccgctgactgtgaagatcctgcacaggcgtccagggagcgtgtgaacctggcgcaccgcttgctgaccgagctgggggactggggcgtgcactcgtcacgcttccatggccgttctcg

SEQ ID NO: 489179 - DNA, 255 bp, Homo sapiens
agcaagcaaaatcatgtttgttttgcaaattgggagcatgtcgcagaggaccagctgccaacagtgacctgagtggcccccacgctgtgacaaggcagtcttctcaatacagcgtcaacaacgggatcactgcatgtcatcgccagcacagcaaagacttacacagctcagaggtgtcttacatgtcccctgagcacggatgaagagtctactcgctgtgcacacgcacaatgacaggcatactatgctttgcca

SEQ ID NO: 489180 - DNA, 337 bp, Homo sapiens
  misc_feature (40)..(40): n is a, c, g, or t
  misc_feature (42)..(42): n is a, c, g, or t
  misc_feature (310)..(310): n is a, c, g, or t
  misc_feature (320)..(320): n is a, c, g, or t
tcacacttatttcagtgtttaatattagaagcatttgcgnanttttaatttttaaatttcatgatgtttttgtgaccagtaacaagccatatgaactcaactctcatttatatccattagccaatggtaaaattggtttgttatacattgtttcacataaaatcacagtttccaagaacctatggatgactttaggtgaggacttactgtatttttgatttagggcactactggggggagagagagagagagagagagagacagacagaaagagagagagagagaaacgtggaatgaggggcagcgattngaggattaantatattttgtttattgg

SEQ ID NO: 489181 - DNA, 473 bp, Homo sapiens
tacttcagtgaagcgtcgagaccgttccagaagtagagagacgagaccagaagccgagagcgaagaagatctcgaagtagagacaggagacgctcaaggagtagcagccggggccggcgatcccgatcctccagtcctggaaataaaagcaagaaaactgagaatagatctaggtccaaagagaaaactgatggtggggaaagttctaaagcagaagcaaaaaagcacaaagcatgacaaggcaggcatgaaacaagcacacacagcatgctggcaactttgaccagaataagctggaagcaagcaacatgcagcaaagcgaacagcaccagcagtagcaaaaatggcgagcaagcagcacgtaaaaaggctcatggaaaacataggagcaactgcacacggcacatcgaagagatgcaaacaagggcaaaaagtggagtttagaggcacgcaagatgatgcaccaacatgca

SEQ ID NO: 489182 - DNA, 566 bp, Homo sapiens
caagagcgaaactctgtctcaaaaaaaaaaaaagaggggggtgggattacttgaggtcagggattggagaatcagcctgaccaacatggtgaaaccctatctctactaaaaatatagaattagccaggcatggtagcgcacgcctgtaatcccatcttctggggaggctgaggcaggagaatcgctagaacctgggaggtggaggttacagtagccgagatcgcgccacttgcatttccagccggggcaacaaaagcgaaactctgtctcaaaaaagcaaaaaaaagaaaaaaaagcacgtgaccttatgaggctctcgctgatatggttatttaaaggactataaagagtttggatattacaattatgcaggggcccctatgtggggattataataaaaaaagcacaactgggtggtgtatacctacatgtaggttctgaacaagcaccagcctacacagcacatatgggtaaaacccactgctctataactggtctacgctaagcacaagatgataaatcggttaggttaaacttttgtatactgggtaagtaaaaaaagagtg

SEQ ID NO: 489183 - DNA, 1019 bp, Homo sapiens
gataccaactaaagcaggaataatcgagttcatccataactaatataaggacaaaattctgctggtagacctgcattagaggctctttcgatccgtatgcatgattgctgggaagaacaacacactgtctatgcaagcatagttaatgtgcaattcagtcttctcaatcgtggccacacactgtcattcacagtctcaaagtctctgcatattgtctccacgtcttcatccatcggcatcagtgtcattttaccaaccgtgcatcagtcctattcatagcctatatccaagtctcgtgcatgcagggttgcatgttaattgcaatacccttgacataatctatccacaagccactggtctcttcccaaactttacactagccaagctaaaactatcagcccatatacccctccttctaaaccgaattaagcgcaacgattatttatacctcttattcacgtctctgcccataattgtgcgggcacttccctagtcaccacgggccccacgctttaaccccggtcttgattaccctcagaaacaactatcggtcattctacgcggaggaacttcactccctaactctagaagaaccttaatataccaattgtccctgccccattaacacttgacaactatgcccaatatgctaagaactggtgccttgaacccacgagacatacttaacccacgtcaccatcacttcatgggaccctgtgactgactttcacggatccctcactacacagcattgcttacctgatttactgatcatcatcgtgtccatacctggtattgaccaagtgaagcaataccactgccacccgggatttcaatttcaaactgccgacttcacaattacccatgcttcacagataaatatagagaatgtaacctgtggattacctactacacttctgaacacacttcgacccataggcattaacacatctgacatctcgccaatccacccagtttggacatattttcatcacatgcaattggtttaaacctaatct

SEQ ID NO: 489184 - DNA, 217 bp, Homo sapiens
  misc_feature (19)..(19): n is a, c, g, or t
  misc_feature (33)..(33): n is a, c, g, or t
  misc_feature (75)..(75): n is a, c, g, or t
  misc_feature (80)..(80): n is a, c, g, or t
  misc_feature (164)..(166): n is a, c, g, or t
  misc_feature (170)..(170): n is a, c, g, or t
  misc_feature (187)..(187): n is a, c, g, or t
  misc_feature (196)..(196): n is a, c, g, or t
cgatggcatgatgagcagntccatctctcttgnaggtgtgtagtctttctctaggatcaggaacttgcagtcctngtgcnaaaggtcatcgctctgcacacttgtggtgcaggcggcggaggtggaaacgccagttttacaggcgcagaactctgtggcatgtnnngctncaccccatatgctgtgnaagtggtgntggtgccattgggccagcggg

SEQ ID NO: 489185 - DNA, 341 bp, Homo sapiens
ctcaaagccaacaaaaacaacatatactctggtagtatgtgccatgcccagatcaagtcgcagcccaatagcaagtctatgcagcatacttccattaaaaccaatgtatggcaagagtgatctgagactctggaaactatttgtcgtatgtggaacgggccagcagtgagtgtacagttctttatctcttctgtgccatggaccatttggaaatctggtaaagcctgactacattctaaaaatggtctcatggccaggcacggttcatgcctgtaatcctagcactttgggatgccgagtcaggcggacatgaggttaggagatcgagaccatcctggtca

SEQ ID NO: 489186 - DNA, 232 bp, Homo sapiens
ccactccgagagtcatgtataggccacctgatttctagtacacaaggtctggcagggaaatttcccatcttggttattataatatttacgcgtgtcccaatactctcacaaggcagctggtgtagatggcatgatcacacgctcactgcaacaatccgcctcccaagactcaagtagatcctcccacctacagcctacctagagtagctaaggactatcaggtatagcgcca

SEQ ID NO: 489187 - DNA, 448 bp, Homo sapiens
  misc_feature (4)..(4): n is a, c, g, or t
  misc_feature (17)..(17): n is a, c, g, or t
  misc_feature (50)..(50): n is a, c, g, or t
  misc_feature (154)..(154): n is a, c, g, or t
  misc_feature (191)..(191): n is a, c, g, or t
  misc_feature (205)..(205): n is a, c, g, or t
  misc_feature (268)..(268): n is a, c, g, or t
  misc_feature (278)..(278): n is a, c, g, or t
  misc_feature (280)..(280): n is a, c, g, or t
  misc_feature (356)..(356): n is a, c, g, or t
gggnaaaattttttccnatagtgaactctgtgggcgtctccccagtattnacccggatgataggaattgactccggctgcacacacgtacacacccacacacatctatctatacataaatgctgaagccaaacttgtcttgcagatgtagaaantgttgctttgtttctctgataaaactggttttagacnaaaaatagggatgntcactcttagaccatgcctaatgttactagagaagaagccttctttacggtcttctatgtgtncatctgaatncngaggggccttaacagcgatgatgaagttgttggtcttcggctgccatggacccaggataagacatctactttctcnacgtggtgacccctggcttccaggaactcaatctcttcctctgtgaactcactgtccacctgcaggaggttggactgcaggtccgggtgtag

SEQ ID NO: 489188 - DNA, 850 bp, Homo sapiens
ggcggtgtcagtgtggcggtcttgagtgctatcagatcggtatggcattggcgtcctggtgcccgcaaggcgggcgctatgctggctcctggtgcagctcgtgccttggagggcttcgtgggccccgagacgctggggcgtatgagtggggctgtgctgctccacgcggaagtcggagcctcctcccctggatagggtgtacgagatccctgtgactgtgatgcccatcaccttttgctgtgggaagatgcacattctgtgcccatgtgcttggcgctggccgatctttcctgacctgggacctgctggctacaatggacccaagtgttctacctgctcgcaccccgtcttcactgatgcatcctgctgtacaaagaccgaggcctgcatatatctttcaccacctgttgcctgccttctcgagggtgtcaagcaggccctctggctcaccaagaccaacgttaatatgaatgtgccttccctgagaaagtgcttagccttgttgatgatccaaggaaccacgatagagaaccaagacgagtgcgtactgagtgtgatcgtctcacgcccgtactctggcagaccactgcggaaatccccgaagagagagagctactgcccggtcatcgtggacaacctaatccatgctgtgtaaatctcagattctcaagcatcctacatctggccaggaggatctgtgtccaaaaactccagcgtttctaggcaacctggacaccgacgaggtcccttcaacgtacagagtccgcaggaacatggtggagcccggcgtgcagcctcacggagccacggcccaccacggctccagcgaggaccggaagcgcaaagaccc

SEQ ID NO: 489189 - DNA, 333 bp, Homo sapiens
gcccggtttccattttaaagcccgattttcaaaccaacccccatttttttttcccccttttaaagccaaaccaaacctttggattataggggttttggttctggggtttaggcccaaatttccccccaaaattttcggggatttgttttgaaacccgccttccggggggccccaaggggcgcctttagaaaaaaaaattattatttttccgggagagggattttgaatgaaattccccttgccgcccggttcccaaccaaccaaagggacgaggggggcttaggttaagttttagggcctggcccaacccccgctggtgggggtttcccggga

SEQ ID NO: 489190 - DNA, 296 bp, Homo sapiens
cgagttcccgtcagcattgcagcactgtcacattttgccagccgcagcagtgtcccgagacggtatttgccttcgcctaccagaggacggaccaataccggaactctgcctcagcactgctgtctgccttatctggccgcctgacgacggtgatttcgggcctattgaagactgcctgctcagtatgccgcttctcagactaagagcttccatgaaggggctgagaaccgacaaggaccctctcgattaagatcatctgtcccagaaccaaccaggctgcgatggaaatgctgaca

SEQ ID NO: 489191 - DNA, 350 bp, Homo sapiens
tcatgtcggtccaacgatggtcctcagtcgtacatgggaggtgaggcagaagaatgcttgaagctgggaggcgggggttgcagtgagccgagattacaccactgcactccagcctgggcaacaaagcgagactccgtctcaaaaaaaaagaaaaaaaaaaagaccaagcgtggtggctcacgtctgtaatcccagcacttgggaggctgaggcaggtggatcacaagctcaggagttggagaccagccgggccaatatggtgaaacctcatctctactaaaaataaaaaaaattagcccaccaggcccggctaatttttttatttttagtagagctgaggaccatcgtgg

SEQ ID NO: 489192 - DNA, 336 bp, Homo sapiens
gctcgacccaggctctggggcccagagggagataggccaagggacgagaagacaggagtttggggggccaagtgcagtggctcgcacctgtaatcccagcacttcgagaggcccagacaggtgggtcacttgaggtcaggagttcgagaccagcctggccaacatggtgaaaacccatctctactaaaaacacaaaaattagccgggtgtggtggcacacacctgtaatctcagctactcgggacgctgagacaggagaattgcttgaatctgggaggtggaggttgcagtgagccgagatcgtgccactgcactccagcctgggggacagagcga

SEQ ID NO: 489193 - DNA, 1138 bp, Homo sapiens
  misc_feature (1138)..(1138): n is a, c, g, or t
ctctaataaacggagcctaccttttgtaaattaatttcatcttatgtgagtttattgccgggtggaagggaggaaaatgttttagatcacacagaaactaggaagtgaatattgtaggtagagaagttggttatgtgtttggcatgttactgttttaccaaactgttcttttggttttcaatatggaaaggtgtccattggcaaaacaaccttttcttgaggattcatgtgatttctacaggaaatgaaaataagaatccatggagaaaaaatagctaagaaaattggatgcttaatctgaactaaaagagtagagtgtgtagtcactatcttaaaatacattaatagtaagatggagctctttgccactttggttcggggaggcagaattaagatctgtgggttaaagattaaagaggtttccccaaaacttcagaaaattcttaggtgctatctgtaactcgaggatagagccttgagttatactgaggtctgccagtggctcaatttaagcaaagactagatggcatttcccagaggccttgtaggctagagtacttgcctgtgtaacttcagacatccatttcctctggtatcctggagttcccctcgccattgggtgtcttagaaataagtcattattccagacctccaggaattatccgttgggggtgaacagggtgacggtgaagggcacgggggggacatcccacaagaggccgggacaccacaaatacggagaactggtgatgaccccatggggacacagtaatcaaaacagccacagagaatgatgccaaacacacaaaggacaccagagagaatagggaccaccgagacaaagaaagagaggaaacaaccgtggggaaacaaaccacaggtataaagacgcacccaggacgcgtctaacaacgaagaagggagagaacaggagcgaaaaagaaggaaaaacaagggagaagcgcggaggaaacgcagcaagaaaagaggagaccaagagtgatgagaaacaaaaccaagcagcaaacacagctacagacaccaagaagacgagaaagcaagaagaacagagcaaactcagagaacagaacagaaacgacaagaagatgacactacctcccatcccactctcataacn

SEQ ID NO: 489194 - DNA, 330 bp, Homo sapiens
ctgtcgtgcgttggatgacttgcaggagtttgtgagttacgttcattatttgctcggcagggcatgtatgtgctgggggccaggcatgtccaacatcgcagctccatcttcccttttctttgtcaaccacgtgtacagcaaggaacatacaacatggcccggtcagacagggactccatttcttgtgtgtccacgtccttgattcccttggcgtgagacaacgaacctcaggtatttaccccagacaatgatgcagcttcaccatcattttgcaaggctgaagcaagacgatcacttgagctccggagttcaagaccagcctgggcaata

SEQ ID NO: 489195 - DNA, 1063 bp, Homo sapiens
  misc_feature (691)..(691): n is a, c, g, or t
  misc_feature (753)..(753): n is a, c, g, or t
  misc_feature (762)..(762): n is a, c, g, or t
  misc_feature (780)..(780): n is a, c, g, or t
  misc_feature (797)..(797): n is a, c, g, or t
  misc_feature (799)..(799): n is a, c, g, or t
  misc_feature (811)..(811): n is a, c, g, or t
  misc_feature (816)..(816): n is a, c, g, or t
  misc_feature (831)..(833): n is a, c, g, or t
  misc_feature (835)..(835): n is a, c, g, or t
  misc_feature (850)..(850): n is a, c, g, or t
  misc_feature (853)..(853): n is a, c, g, or t
  misc_feature (855)..(855): n is a, c, g, or t
  misc_feature (859)..(859): n is a, c, g, or t
  misc_feature (861)..(861): n is a, c, g, or t
  misc_feature (863)..(863): n is a, c, g, or t
  misc_feature (872)..(872): n is a, c, g, or t
  misc_feature (874)..(875): n is a, c, g, or t
  misc_feature (877)..(877): n is a, c, g, or t
  misc_feature (881)..(881): n is a, c, g, or t
  misc_feature (883)..(883): n is a, c, g, or t
  misc_feature (885)..(885): n is a, c, g, or t
  misc_feature (888)..(888): n is a, c, g, or t
  misc_feature (890)..(890): n is a, c, g, or t
  misc_feature (893)..(893): n is a, c, g, or t
  misc_feature (900)..(900): n is a, c, g, or t
  misc_feature (903)..(903): n is a, c, g, or t
  misc_feature (907)..(907): n is a, c, g, or t
  misc_feature (911)..(911): n is a, c, g, or t
  misc_feature (974)..(974): n is a, c, g, or t
  misc_feature (998)..(998): n is a, c, g, or t
  misc_feature (1010)..(1010): n is a, c, g, or t
  misc_feature (1024)..(1024): n is a, c, g, or t
  misc_feature (1029)..(1029): n is a, c, g, or t
  misc_feature (1034)..(1034): n is a, c, g, or t
  misc_feature (1036)..(1036): n is a, c, g, or t
  misc_feature (1038)..(1038): n is a, c, g, or t
  misc_feature (1048)..(1048): n is a, c, g, or t
  misc_feature (1052)..(1054): n is a, c, g, or t
ccccggccgaggggggaaacaagcggcacgtacccgttcgctcaacaaaggattgggaccaagacagcggcgtcgcgcaagatcaatgccttacaaactggggtgaacatggaaaaacgccaaagtaccgcgcggaagaggttctcgaactccacaaggggggaaggtagcaggcctgaggggagcaaactggtgaggcaggacgcaaaacccgcaggctgtgacccactggaagcatgggaggagcgatgcgcccatccagcttcgaggcgtccatacacggaaccggacgtagcgccaaaggcacagaggctcgggaccgcagcccaaaggtaagcacagggcactcgggatgccacaggacacagctcagatttccagtctccaccaggaacctcttcagaaagtgtgctttatcgcatgatacagcatactgttgaaaggaagcctcagaggggggaagatcaggtcaaactccatctactctcctcatctctaacagctcaggatctcttagcatcttaattagatgtaattgtttgtctataactgtcaaaaagcttggttctgtgtctgtgtcttaataagacgagaggacgagcgattgagatgtatggagagaaaacagacctaatgctcctagttcctagagtagacatggagcggaggctggcctaagagttgagctctnggaactgcatgctgctggacagtatcactgtctttcctagatggcagtcactgaattccatnttttcaagntaatttcttgtgcctctnatagcccaagaatggangnttgatcagatcngacangattccttcctgttnnnanctgtggggtgtgccnatntntgcntnantcaggtttnannanaggntnanagncngtngggtganacnaccnaaantcttatcatggtctcagtcataatcattagggggaactctagccaaatggtttaacttctgcntgtgaactggggattggtggcagnaaaggtgatatnattctttctgatanctaantgcgngnanctttgataantatnnngctaaatga

SEQ ID NO: 489196 - DNA, 807 bp, Homo sapiens
agcggggtgacaggagcagcggtcgggagcccttagggaggcagacatgagcctgtagccaagtgccccagtgagccctcggttccagagccaactgatgcccctgtgcccactggacccaggccatgtaggcccgagtgcgttctagcagcagcgggcttacttccatcgcgctactagctttcgggccgtggcagacagtcgaccacctatcacttcgaatgcatcctaacctgcgatctacctccatctttgtcgacggcatgttcctgatgacttacatggctattcgaccaaggcgctcgccaaggagggtgagccagggttactggctgttgaaagacgtgcctggtacaagcacgatgtctcgaatgcaccttggatgcgcaatgcacgggcacttaacgcttggtgtcgtattgactcgtgtggcggtctcccgaggcatgagatttccccaaaggaccgagtcggggttcccgcgaggctgacgtccggaggagctctcccgagcttatttggaggccaatccgagtctgatcgagggcatgacccttccctgaatgctcgctgcgtgggcttgtggactgtctgcgctggtgtccgtacaaccttccgcatggttcactgccggggctcttgacgtgatgactgggggcattcccgggctggcgtgagagcccgcctgggcgatggtctgacggtgggccattcggtggttttgtcctggcacggactgtcatgggtggtagcccccctgtccggaccttgctggcctgggacgcgtgggagccggttccctcgggc

SEQ ID NO: 489197 - DNA, 329 bp, Homo sapiens
ttcccgaaacagagtctcactctgttgccaggctggagtgcagtggcagatctcagctcactgcaacctccacctcctgggttcaaacgcttctcctgcctcagactcccaagcagctgggactataggtgcatgccacaacgcccagctaatttttgtatttttagtagagaaggggtttcaccatgttggcctgaatggtcttgatctcttgacctcatgatccgcccacctcggcctcccaaaatgctgggattacaggtgtgagacaccacacccggcctgcacacttttacgtatattaaatagttcaagcacttactttaaat

SEQ ID NO: 489198 - DNA, 861 bp, Homo sapiens
atttctttcccctcctctcgcggtggttctctggtgccattcctcgtgggggccacaccatttcctctgcgctcccgcggggggggtgggtcttccccagatcggcgtgcctcggcccagcttttctccgcccgtagttcttgcgcgctgttgtgccaacgtttttgcagcggtcccacactacacatcgcgctgcggtttgcatacccgaccactgacttcttggttgttttgcactgtcggttggtgccactatcgcctgcgccggtgcgtgagttgtcgtccctggggcaacgcggctcccccgggggagaccggtcttctctttttgcggagcccgtctcgtcttgttggggcccgtcgcccccttctgttttctcttcgcgcagctgttgtcttcaaccctctcgtcgtttccaatcagtggttggcccacgtgatgcctcttcttggccgccctcacactccacccgcgggccctgttggggcacgtttctatccaggtggtctcaccgcccgcgccgcggagggacctccttgcgcgcgtgcgtggcccatcggcgcgcgcgcggcgtgtttgcgcgcgcatgtatgtggattcgcgccccgcacgcgcactcctccccatcgcgctgtgcgaacagtgtgggcctcccactcccgcggtcgcgcccctcgcttcccatgaggcccacacctggctccgcgccgcggaatcgcgcgtgctccggggcgcccagtcgggccacgataaagagacactccgcccctccaagaggagcgtccgcgcgagcccacagaggcgcgcaaatcaaaccaagacgacccctctggccacaacagaataacaaacacaacaaa

SEQ ID NO: 489199 - DNA, 861 bp, Homo sapiens
gggatggtcatgatctcctgacctcatgatccacccgccttggcctttcaaagtgctggtattacaggcatgagccaccgccacccagctgaggtttgtaattttttaaaaaagaactgctgggcccagcactttagggaggctgaggtgggtggatcacttgagcctaggagtttgagaccagcttgggcagcttaaggagaccccatctctacccaccccaaagaaaattagcccagtatggtggcatgggactgtggtcctggctactcggaaggctgaggtgggagtatgcttgagcccgggaggttgaggctgccgtgagccgtgattgcaccactgaactccagcctgggtgacagagcaagactccatctcaaataaataaataaacaacaaaattaaaaaatacaatacaaccattcacgaacattgaactttagataatgatacgcatgctaaagtgtaaatgggtcagggatactgaggtctggcaatcaattagaaatgcatcacaaagtcaggacggaaggatgtgagagatagatggtccggatagataagggataagcagattactacagtggaatgtttacaaatggtgtaattagaagatgggggattatgcattgggtgatgtattattcttcacctgtactgttgtttttgaaatttcatagtagaggtggaaaagagttaacaatgggtgagctgggaggaaaatgaagagcgagtttgggaaagagagaccagataatgcaacaggtggctttggagcatagagagatcagatggtgtaccaaaattgagagttaagatgcaagaacatacgactagataggaaagaataaacacaagcag

SEQ ID NO: 489200 - DNA, 232 bp, Homo sapiens
  misc_feature (2)..(2): n is a, c, g, or t
  misc_feature (8)..(8): n is a, c, g, or t
gnggagtntcctgacattttatttcaagagtcttgattttatttctagtctgtggcccagctctggcgcctgctttggctcatctgcacatcctctagagttctgagttcttccacatagcaggctttcctcacacgcggtgttttggggtgacattacgtaaggtgacttgcgtgctgattgttttgtaacacttgtcagaacaaagcaacgtttagagccaggaaacagt

SEQ ID NO: 489201 - DNA, 285 bp, Homo sapiens
cccggagaacgaccttgtgttaagtgcttagaacaatgcctgtatatatacgtgctcaagtcattttcctctttggcacagtgaggttcatatgaggtctcccagagaagcataggtacagaggataaagcaaagtatcacttcattattatctttgcagagtgctagtggggtaagctgaatctcacagaaagctcctttacctaagctaaatttaagcaataaaacttgtagagcctaaaacgtattctctgtgtattttcttttcttttcttttcttttttt

SEQ ID NO: 489202 - DNA, 128 bp, Homo sapiens
  misc_feature (43)..(43): n is a, c, g, or t
  misc_feature (54)..(54): n is a, c, g, or t
  misc_feature (111)..(111): n is a, c, g, or t
caaacaacaaataacttggaaaataggcttgtcaaatgatgtnaattcatcctntccaggggaagcagaaggtagaccagtgcaggttatcctcaagggcacatacatccngcttcactgctgcttgg

SEQ ID NO: 489203 - DNA, 1477 bp, Homo sapiens
  misc_feature (654)..(654): n is a, c, g, or t
  misc_feature (690)..(690): n is a, c, g, or t
  misc_feature (1046)..(1046): n is a, c, g, or t
tcacaaaccccggtcctggggggggggggggtataatactaagtggaaatgattaccatttaggggggaagaggcgctttgggtgaaagttaggccttttattctctctctgtggtctcctttctcgttcacgaggggaggaaattggaaagttaaatagaaacaccgacaccgggatattccctcgcggtctcgtgcacacctcgagaactccacgttaggaactttataccctgcggtgagaaacaaacacaaaaccctttataatatagcgcgggtgtgcccccactcgcgggagagtgtctcgcgtgtatctcacaccacatctgcgaggggtctgcgtataaccccccccatatgtgtgtgtgtgatatgatgtgggaccccctctatagaaacatatgagggaagtgtgccgcgcgtgtgtatatctccactgatgaggggtataaacctgtggtgtcccccgtgtgtggccctccacacgtgctatatgtgtggggatctccacatgtgtggggaggtatatttagtgatgagttctgcgccgtgtgtggagcgtggggtaacaaggtctctttatagcgcgtgtgtgctcagcgtgtgctctgcgagagaaggtgtgtgggggtctctctgtggctctcgcgaganggtgctgcggcccacccaaaagcgcggaaacatttntcttatagtgtgggccggaggtgtgtggggggatagttttatagagaggaccaccgccggtggtgggggggtatgtgtgtgtaagaggtatcaccgtgtgtgtggcgccattatacatataacatttataagagcgctctcccagaggaggggtctcttctcgcgcgactctttggcgcgtggggttctccaagtgccccgcgggcctctctatccccggggggcgcggagggtgctccaaatctctctccagccgtggggtcgtctaacaaacgtctatagacagaccacgtgtggtgtggtaaaccccctctgttgggtggggtgaggccccatctctcaatatacggggggcntcccccttataaatctataggggggcacaccaagggtgtgttattcttatgttgctataaccctgtgtgggccccgcggggtctagagcgggctaccccggcggggggccccgggtataaacaccgtttgtgctggcttcgcgctggggggacagaggcgggggagacgccccctactataaaaaacgcgggggggaaaggcccaaacacagggcggcaacacgcctcttgcggggcataccaccagggggcgggggggggccacaacaacatatggtggcccgggaaagactccccctatttacaacccctttcttataaaacccccttttcccataatagagaccacatccccgggtaacagaggggctgtccacccgagaagcgggggcaaccaaaggagaacccacgcgtcgggacacacacctcac

SEQ ID NO: 489204 - DNA, 1188 bp, Homo sapiens
ccagttgcttggagaagcccgttcaccgcctccagcgggggctctcctcgacatggacgcctgagacctgtcccctgcgctttctggtgagccgctccgctcccgcgcttcgcgatccgtgcagcactgcggcgcccgttgtacgctgcgaagaaacgctcagcgcgcgcatgcgctcattctgctcgaaggatcactgtgtggggagagggctcccgtgagttccctagttctgacaccctcggtgagagggctggtgcatgccttagtgatctgcggatgaacagtggagactctggataagccgcagtctccgtcagtgacacgtgcgtgggggtgagcccagagggtactgtctcgaaatataaaccactatcccttgttgtggcgtcgagccctcatcgtgaggatgggcctccatgacaacgcttggcgtcgggacttgccgtgcaatgctgtctgagcggatagcaaaagtagcgaccttccgtggcaaggactgacgctgacgttgccgggggagcccctttacgcccgtccatggccgcgcctgagcccccgtcgtggacgtcttggcagtgacgttccaggtggatactgcacacgcagccagaggcatgttgggacgaggaacaggcgcaagtggccccgcggataccgcggtgggtttcctggagctcctctgccgtggaaattcggaagcacgaccccgggggccgacgcattgaatcacatccatgatggccccccttggcacccgacgagccccagggacacttggactggccttgatcggtcggttgaagaccgcaagcagtgtccagtgataagcgttccccccagaggaaacaggacctccccaaatctggtgccacgggatggggcgacatgcgcgggaacccgcgccaaccaggctggggatcccacaacgcatatcagcaccgaaccccagagcccccgccaccgagaaaaaagtcccgccaagaacccctggagaggaaaaagccacgaagatgagcgggcagcccagaatccaagcagcacgggaacgtccgccggggtccccgtgggggctccatcgcccggccccctcacggagatcactctcaaggagaggagccgcagaagacgacaccaagttcacgggccgatggacgctcgcaaagggacaaaagaggggcgacggag

SEQ ID NO: 489205 - DNA, 969 bp, Homo sapiens
tggggggaaaaaaggggggccccggggggtaagggggccctctcgcggggggggcccccccccccccccggcgggcgacacgcgtggggatggttcttggcgccaaccggcaacaacactacgcaccgggggggggcgacgaaacaagtccggcggtgcgtgccacaaaaagagaaacaaaagagggtggtggggagaaaaccaagcagcaaggctgggcgacgaaaccaactacgacagccatgactactcaccaccaaccacacggcggggagggggcgcccccctgcgtatgtatctcagaaaagaggaggagcgcgcgagaggggggccgctgctcaacacctccgcccagaaaaaaaactatctcgggaggccggggaggggggggggggacacccctcgattattagatgatgacccccgccgcacgcggtgaaagatggtggacgaagggagaggacatcaagtgggggcgacacacagcggcggacaagcgtccggccataagaggacgacaaacaagagagggggagactgcggagcagagcacccacaaagaaaagggcccacgctgaaataacatacgacacaagcgagcatagcagcgagcgccaccggagccccgctcgccatccggcaggggcgcgagtaggcgacactatatactaccaccacaatgaatacagagagagtagtgagcctgaccacatcggagaagggcgccacttatcttccgagagcaaccgtcaatatagaggagacaccaggacagaagtgggtggggtccaaacacaagaacaacgtaatactggcagaccgattggaagagcaacaacgaaaaacagcacgaccacgtcggagaaaacaagtaattacacagaaagaaggaggactcctcattgatgtatggaaagcaaccacatacagatgtggggatcgacgagcaccaacccgaccagggaggag

SEQ ID NO: 489206 - DNA, 343 bp, Homo sapiens
gaagctagatttagttgatagcagatgaatatcatggatagaatttagttagaaaaatggttgattctagcttattatattaggtatgtgagctggggcaaatcgtttaatcttgagtctagttttctctaaaatgagacattaggctaaatgatttccgagttccagctagtcctagagttctatatctctacatagttgaattattttatcatgctgttgctggggaatatgactaacccttttgaagctactaattttatgtcgagctttaaagtccataattgttatcttcagaaaatattatttgacctacagtatgtccaaatcaatttaataaaat

SEQ ID NO: 489207 - DNA, 285 bp, Homo sapiens
ccgctgcgcggtcgctctagacggatcccagttccgggtccccactcttaggtatgtatgatgctaatctggtccctaagtaagtttcttccggctcctttggtatcttcctttctggtctttcctcctacctttggtctctgggggtttggggactttttttttttttttttttttttttttttttttttttttttttttttttttttttttttttttttttttttttttttttttttttttttttttttttttttttctatcaaaacagcaaggggggggggg

SEQ ID NO: 489208 - DNA, 342 bp, Homo sapiens
cggtatgacgagcttcggtatacgagcttctgggtgtaatcaataggacgaattcctgggaactgcggatatagcttgccacagtatcttatcagttaattgcattctatggatgtgctgggagtcagcttgcacaagttaagtccttgaggaagcggctgccagtgaaagagccaagatggagtccatctggcgctcttagctaagggagagtcaattcaggtggaaacaaggctgagtgattaaaggaaagggagagtctaaaaacagggttagtaaaaaccaggttggacactacattccccacattgtgtaaaaaggaggaatcaaaatcatttgatt

SEQ ID NO: 489209 - DNA, 150 bp, Homo sapiens
agtgtctggatttttttctcatctttttaaaatgcaatactgtttctatcagtctctcatgcatctatagctgcttcagacttttttcagctgtacctgagcatctgaaactgcaagaaagaaactcattaaatgtgattcttctcacta

SEQ ID NO: 489210 - DNA, 227 bp, Homo sapiens
agttctactaaaaatacaaaaaattagctggcatagtggtgggcacctgtaatcccagctactcaggaggctgaggcaggaagatcacttcagttcaggagtttgagatcagcttgggcaacaagagcgaaactctgtctcaaaaacaaacaaacgaaaaatactacttggaggcagagggacacgggtaaggacactaggctgagagactgaggctgatgtctagg

SEQ ID NO: 489211 - DNA, 1061 bp, Homo sapiens
  misc_feature (243)..(243): n is a, c, g, or t
  misc_feature (379)..(379): n is a, c, g, or t
tggagctaagttttttttataatttttctcacaaagagctccagaaaggcaaatagttatatcacttccccactctgaaatagcacgcaagacagatgatgcaggggaacggggtgtccacttcttttcgtgtgttctcagagcttccgtgcagcaggcctgaagtgacccgcaagcgggggcccagtgcagcggtgttcctcgtgcaaaggtgcagggtgtctcagtccacacacagcgagncacccagcactgtgggcttgaagtgtctcaccgggtgtgttctgtgctcacagaaagaactccacagcgtttagaactccccgaagaagaataattcccagaaaacgaggggttttatagccctctcacagagagngcccagaagacaggcgggtgtcgccagtgcccccaagaatgtgccaagaggcacctctatatatacgcgtgcacgcccctctcacacattgaccaaccgcttgtcacagagggttacaaaatgtgtgtcaacaagggtcctacaaaatgtgtgtcttgggggcatataaggggaacatcatttaacgggggacacgccaacacctattggcgggcacccaacacaattaacatgtgacgaggcgtctcccagacgggaaacaaccccttctcctgtgcgcacaattgttggcccgctgaccacaagaagacgaatgatgccacttttgttacagaccagcaacacacaagcacgcgtcctccacacactctgctgtgcggcggtcctcctcccacacgagtgttgttcttctcccaacgaccgaagaaaaagtagaaagaaaaaacacccgcagctggtggcactgttaggtgacgagatatattcttctataaagaacacgctgttgaaagcacacaaggggtggcaacagtactatcacacatacacaacaaggcggcggctgcgcgcccgcgggactcttcctatctagagaacgtgtttatattcccccctttctgaaagggggggggcgcccccaaaaaggggctcttatgcacgggggctggtgtttcacccccag

SEQ ID NO: 489212 - DNA, 810 bp, Homo sapiens
taaaaataagaaattagccgggtgtggtggcacgcacctgtagtcccagctacttgggagcctgagtgcaggagaatcgcttgaacctgggaagtggaggttgagtgagccgggacctgtgccattgtactccagcctgggtgacagagcgagattccgtctcaaaaaaaaaaaaaaaaagcccaccttgaaagcccgtgtccttctttctccactttgtgttgtggccctttccagtgtgggattatattcgagccatgtgttgtgtttttctccattaggtgccctttttctcctttatttctccagggcgttgtcgcttctcgtgaagtgtggtgtgtttttttttttcttatcttacattgtgtggttgtgagtttttcaaaaaattagccgtttacaagaacaggcccccgaggagcctttttccggccccaattgtgtgctctctccttactctcgtgcgtgctaacattattttttccccctctccgggccgccgcgggggacaccccgatggtgtttaagatcaagtagatgtcagaacatagtcgcgtagggctgtttgccgcagcggtgtgcaggcaggtccctccagtggcgtgtgtacaccaaaagcccgaggagaggctttaagaagctctcccgagccattcaaggcggggttgtttgaacgcccccctttgtggggcgtctccgaggggacaacttggtttgtccccccaggtgctttgcagctgttgttcgtgtttgaggtgcgcccaccggggtccccagcagggtcatgtgtttccccgccccgaggttccc

SEQ ID NO: 489213 - DNA, 131 bp, Homo sapiens
ccccccgggggtttttttaaaaaaaattttttttccccaaaaaagccccaaaaaccccccccccgggctttcctccccaatttttttttggggggttttttccccccaaaatttttttttttcccctttta

SEQ ID NO: 489214 - DNA, 428 bp, Homo sapiens
  misc_feature (1)..(1): n is a, c, g, or t
  misc_feature (37)..(38): n is a, c, g, or t
  misc_feature (75)..(77): n is a, c, g, or t
  misc_feature (370)..(370): n is a, c, g, or t
  misc_feature (389)..(389): n is a, c, g, or t
  misc_feature (398)..(398): n is a, c, g, or t
  misc_feature (421)..(421): n is a, c, g, or t
ntcctccaaaatccaaggaggtcctatgtattagggnnaactcacactgctaatgaagatatacctgagaaaaannnaatttataaagaaaagagatttaattgactcccagttccacatggctggggaggcctcacaatcacagtgaaaggagaatgaggagcaaagtcacatcttacatagtggcaggcaagagagcttctgcaggagaactcccattgataaaaccatcagatctcgtgagacttatttgctaccacagaacagtatgggggaaactgcccccattgattcagttagctccaccttagccccatcctttacacgtggggatggattacaatttcaaagtggaggtttggatgggggncacagcccaaaccatgttnaccctactnggtgtttgtgcctcatttttttngttttta

SEQ ID NO: 489215 - DNA, 216 bp, Homo sapiens
acaaattgaagttttgtggcaactctgtattgagcaagtcagagaaagtattttaggcccttggtgagtaagaaagtataaatcatcatcttgttgatatttgtgtattgactaaatgaacttgttgaaatgattttaagcttagggatagttctaaatatgaatatagatcacattcaaacaggtagtatgcacgaatgttgcatgaaatagaga

SEQ ID NO: 489216 - DNA, 636 bp, Homo sapiens
gatatacgagtagctttctaatcttgttaaattgcttattctaggtctgtaatttactgtaactggctactgggaaattacttatagaactaggagtacgtcatcagtaatttacatataaactacaaattattatactaccggctacatcgaaagtcagtccttgagatgtccattaggatgaccatctgtgtgagaatatgatcatgtagatgattatctccttatatagcctgtaaccagattaaggacatacaggctcttaacagcatcgaagaagcttcctgagttatcagcatataaccatggtgacaaagacctgctaacgtgataaagtgtgatccaaattaaggatgcgatcagaacttctattgtacagtaatagaattctattatgctgcttaccatcacttagacgatagattacaactcctgtatcgtacataaccaggtactaccagtcatatattgagctaaactgatctatcgaacaggtcaaacctctgcatcatgtagcctgacctgagagaggattggtgtacacataaaaaaaaaggtgggaaacactagcccagacatatcaagacacaaataccggaaataaaagtgtgaaacataaaaacagacaccaagaac

SEQ ID NO: 489217 - DNA, 181 bp, Homo sapiens
tgacctgaggatcccaggaatcgtgctggtgctataagctgcttcagatataacatggtttatctataatgttgttcatttaatagcttctaaaaggcctctttgttatacagtgctttttttctagttttatggacttgattactgtaataatgtcttgtttttagccatgtccttgtcc

SEQ ID NO: 489218 - DNA, 207 bp, Homo sapiens
tgagtcagctcccgccaagatgagctgcagcccccagagagagctctgcacgtaaccaagtaaccaggcccagctccaggccccaaatccgcaagcctctccccgctctggatcctgcactctaaaactcgactctgctgctcatgggaagcacagaattgctcctgattgaacccatcacggggtaccgaagctcgaaaatcggta

SEQ ID NO: 489219 - DNA, 796 bp, Homo sapiens
  misc_feature (451)..(451): n is a, c, g, or t
  misc_feature (649)..(649): n is a, c, g, or t
ccaattactctacaccgtgggccaggaactcgctcacggtatgtctggaagaagatgatcctaaacaaggctgtcgtgttgggggccctcaccctgaccagcgagacacagcccttgtggaggatacgacattgtggctgtccacatggcctcttacagtgcaaacttgtgccactactgacgggacgtatggccaatgaacacatgaatctggtggatacgacgagttctatatgtacctggaaaggaccgacactgtctgaaaaacgtctatgtcccacatacttagatactgacccggactgcgccctgacaagatgcgtgtgttcaaacatatctctgaccatactgactaaacgctagaactctaccgacattaccaatgaggatcctgaggtcacagagtctttcaagtcttgaatgtcctggagcacgccacaccctgatctgncttgaggacaacatgcttcctactgttgcaacataacctggctgagcaatgggcactcatgcacagacagtgcatctgagacttgatcactatgaaagagacatcattcttttttgaagatgaggcacctcaccttgctcccttattatgctcagattcatgactgcaaggtggagcactgtggcctggatgagcctntttctgaaacgctgggcgcctgagattcccctcctaatatagagctacagagaccgcggtctgggccccgggggtattgtgggcctggtgggcctttaggacccggttggaatccaaggctgggttcagtgcttcagacccgtgctt

SEQ ID NO: 489220 - DNA, 180 bp, Homo sapiens
aggctccagcttaacagatattatggaggtcagcacggtgctcacgtatcgacgtgaacttgtacatgggaggcatgcaccgcagtggtgaatacacgtacgaccaggatccatctttacgtatatttggtaggtcagcacgtgttctcactgtatctgacggaagcttgtcctagggag

SEQ ID NO: 489221 - DNA, 105 bp, Homo sapiens
gtacccaagaaatcagatatctggacgggattcagacttagaagtagaatgctcgcagagaggaaagtctgcgtctcattcgcaatttggtcccgtggcgcttct

SEQ ID NO: 489222 - DNA, 1308 bp, Homo sapiens
attgagctgctacggaagatccgcgagcaggttctccatcacccccagctgggagagaggcttaagctctgccagccaagcttggaatctgccagagctggctgggagctgtggacggcaatgaccgacgacttgcctggcttggctgctgctacaacacggtggtcagatcggacggcattatcacactcctcaactgaccctgagcttatcctatcttgcgatgcacataaacaacttctgctcaaaacagagcgggcaggctacatacgatcttccgttgcaaccccactggcagctctggacttctgtccagaacgtccgtccagctcactcctcagtcctgcctcactacttcacagacctgagcagcggctacctgggaaaccaacgcccgacacggcaacaagctgcgcagcggagccctgcacacaaccccagcatggcccaaagggcacgaacactgctgcacggcgccaatacgacacgcacgggcacagcaacacgcacacacccgcactggcccagacaggggcacacgcgacgcacgcccaacgccacggcacactgctgaagccgccaagcaacgggcccaaggccttcctggttgccacacaaccatgcacaccttggacacacgagctggactccgaaacgggctcccgcggccggcccaagaaaacagaccctagccgcgactcccccacaaaatctcctgactcgtatcccacagcaacgccacaccacgcgctatccccggaaaagccacgccggccctgcgcaccacgcaacgcggcacacacagggacccttggcggcagcgcccattgcaaccggcaagctacagagcttcccgccgcacgccggaaagggtaccgtaaccccgcaagggccccgccggcaacagccccacacggcggcacggaccccgatagacactcccttcccccttaccgcccaaagggggggcaacaggggcaaagggatcatctccgggacaaccttgcaacacaccgaacacaaagcggcccacacaccatgccgccataagacacgccaacactagcgaacgcgccccatcctctaggcgccgcctatgggaacaggcaacattgggcaacagcaacccccccacgggcagcgagcaaatcggggcgcaagcattaccgcgataaacccagaacgttggcgcaacaaggagggcgaaacccccgcaggccaataggcaaactttcccaccgtatttccccacgctaactgacgcagccgcctgtacgagcagcaagcccaacccccccgagtggtacc

SEQ ID NO: 489223 - DNA, 175 bp, Homo sapiens
actcaaagttatagctcatcatccccaccatcatagccaccatcaccctccttacctcatacttctacctacgcctattttacaccaaccccagtagaggcaaccggcagtagaggcaaccggcagtagaggcaaccggcagtagaggcaaccggcagtagaggcaacggcagta

SEQ ID NO: 489224 - DNA, 465 bp, Homo sapiens
gcataaacgcaaggtcgacgccaaaatcgacggacacatttttttccggatggaacagattaaaaaaacaaaaagctatacagtcaaaggtctggggttgaagagcgtgaagttcacagctcctccacacacgcccaactgagcatgtccatccggtgagggggaaccagagccttcctgtaaaccatgagagcttaccaaggtctggtatacagaatagtgctggcccagtaaactcaaccggtgggggagggggtaggggattttccatctggtacgtaaagaaagaaggtctgggtatccttcaggatagaaaggcattctgtaagaagtagtgtccagagttacaaatcagtacgggtaagagaaaagcaattcttcctctgggggaccaggaggacaagaccgacgaaaagagaacacagaagggggggggaacaaagaacgcctcgtggggtaggaggt

SEQ ID NO: 489225 - DNA, 542 bp, Homo sapiens
  misc_feature (463)..(463): n is a, c, g, or t
gtccccaagtacccacttcctgcctctctcattaacccttccgtagctgctcaccatgaccccatcagaatccagttaaaagactcttccaaatttcccagcgttcctcaataccccatctctctaacccaccaaaagggcctacagcccatcgtaaacaagctctgctcatgcagtcttcttagaccaacacactctccatataacacccctatcctccctgttaaaaagtctgatggctcataccgactcgttcacaacctccaagccatcagtcaagctgtcctccctattcatcccatagtccataacccctatccacttctctctctcgtcgctaccaacaccaccctctacactgcaattgacctgaaggatgccttctttaccatttccctacaccctgattcccaaaacctatttgctttcacctggactgaccctgacaccctccatgtcacancaactcacatggactgtcctccctcagggcttcagggataggcctcatttctttggaaaagctctagcccgaaacctca

SEQ ID NO: 489226 - DNA, 994 bp, Homo sapiens
  misc_feature (40)..(40): n is a, c, g, or t
  misc_feature (73)..(73): n is a, c, g, or t
  misc_feature (310)..(310): n is a, c, g, or t
  misc_feature (579)..(579): n is a, c, g, or t
  misc_feature (604)..(604): n is a, c, g, or t
  misc_feature (608)..(608): n is a, c, g, or t
  misc_feature (634)..(634): n is a, c, g, or t
  misc_feature (644)..(644): n is a, c, g, or t
  misc_feature (652)..(653): n is a, c, g, or t
  misc_feature (667)..(667): n is a, c, g, or t
  misc_feature (676)..(677): n is a, c, g, or t
tttctgcttccagaggccgggatacggagtcgcccgaagncggtgccgcagccccctgcgcccccggtgcccncgacatgtccttccgcaaagtggtccggcagagcaaattccggcgatgtgttcgggcagccggtcaagaacgaccagtgctatgaggacattcgcgtgtcccgtgttacctgggacagcaccttctgcgccgtcaaccccaagttcctggcggtgattgtggaggccagtggagggggtgcctttctggtgctccccctaagctaagacgggccgcattgacaaggcctacccgacnggtgtgtgggcacactggtgacctgtcctggacatcgactggtgtcctcacaacgacgaagtcatagccagcggctcggaggactgcactggtcatggtgtggcagatcccagagaacgggctgacctccccgctgacagagccggtggtggtactggatggggcacaccaagcgagtgggcatcatcgcctggcaccccacggcccgaaacgtgctgctcagtgcaggctgcgacaacgtggtactcatctggaatgtgggcacagcnggaggagctgtaccggctggacagnctgnaccctgacctcatctacaatgtcagntggaaccacnatggcagnntgttttgctcagcntgcatgacnngagcgtgcgcatcatcgaaccccgtgcggtgcgacctggtggcagagcgggagaaggctcatgaggggcccggccatgcgggcatcttcctggagatggcaagtgttcaccacaggctttcagcgatgatcgagcgatagtggggctctggggaccagaaaacctcgaggaaacatgggctgaggaatggatcagaagggcctgttgcctttatagacccaccacagtgtggcacgtctgggaggtgatccagttcgttttggatcaagactctcaatcattctgaagtacacaggccacggttggatgcaagcata

SEQ ID NO: 489227 - DNA, 458 bp, Homo sapiens
agacgctgcattccctttgagaaatcaacatttggtagtttgttttaatgccggaacagtagtacttggatggaattttccatccactgaaggaacaaagtacattcttttctctcgcaacatagccttgaatcttgaaaagggatcaaactttcacaggaagttgtttgcataaaacatatactattgtctcttggtatccatggggaattggttccagaatactctataaattaacagatgctgaagtccctcatataaaatggcatggtatttgcatataacttgtacatatacccccatatattttaaatcatctctagattacttataacaccagctgggcacggtggctcacacctataatcccagcactttgggaggctgaagcgggaggattgcttgagtgcaggcgttcaagaccagcctgggcaacatagtgagaccctctctctatc

SEQ ID NO: 489228 - DNA, 238 bp, Homo sapiens
tatgctcggtacccaggatgcagccataattaaatcatttgaacaaaaaaaaaatgggcactctgattaaactggcattacagcctgcaggacacctttgggccagctgggttttactctagaatttcactggtcgtacccacccgcacttctttccaccctcacttctctccttcacgcaacagtgcaagattctattcctctcccgtggagggattccttcttagaagttcagacc

SEQ ID NO: 489229 - DNA, 322 bp, Homo sapiens
aagactgtgttataatcaagaacgaaagtcggagtcgaagacatcagatacgtcgtatcgacataaacgatgcgacgggatcgggggtatcccataccgcggctctccggaaacaagtttgggtccggggagtatgtgcaagtgaacttaaggaatgcggaggcaccacagagtgtagcgcggtaatttgaccaacaggggaacctacccggccggcacggacaggattgacagattgatagctcttctcgatccgtggtggtggtcatggcgttcttagttggggagcatttgctggttatccgataacgaatgaatgagc

SEQ ID NO: 489230 - DNA, 161 bp, Homo sapiens
ctggcgcacaggcagcccaattagggctccatccctgactcctttcagccatagaaggccccaccccagtctcagttttacttcactcaagcagtaggggtgttgcaggagctggacgacctgctggtggacctggaccaccagcgccagagcgcgtgcaa

SEQ ID NO: 489231 - DNA, 247 bp, Homo sapiens
gggggggcccccccccaattagcctgcctggtgttggccttagttccccggaactgtttgggggccctggggatggccccttgggttggggcccccatggccagcccaggcggggtttgttttttgtcctgttcccccccacccctcccctgggggcctgattccccctccctgggggccccctccccccgttcctcccgaaatggttttttcttttgtgggtttaataaaaacttcccccgttcca

SEQ ID NO: 489232 - DNA, 1011 bp, Homo sapiens
cggagggaaggcagccagcaccctcatgtcacacgatgaggacagacgctccaggaaggaagggggattccccgggaccacatggcccgacatgagcagatcccaagtcgaccagaagccacaaggtctgcccctccagatcccgtgcgtcgagcccaacatcgtaggatgcagtccagcatcatgtagagagatgggaagcgccccgggatgccgtgctggagccccggatgccaccacgcaaggggcgcagcaccactggagccacccgcggggacatcacacgcgatacattgcggtcatggccacacgtcgcggacgacacacggcacgtggacacaacagtgagaaccactagagaagaacgcgactcctggtttgaccgcaaagccaaggatgcaacacacagttcccggcgagacactgattcccatgggccatcttagaacgtaacctgagagacacaaaggcgagcgtagcactaaactcggaacccactgtagtacgaacacgtagcaggctcaagcagggcaaaagaggcacgtgaaatagtagagcactgtacaatttcattcgattacacatactatacgagagcacatacagggggatgcccatggaggcaagtcgcttccgactccacacgaggggagaaaaattccgaaacactatacactggggtaattgtcctatgtaggtcacggcaataatcccgaggtcgtcaagtataaaggaaacaatacataggcagcgcgactattgaccgttagcgactgaggaaacaggactctgagagactggggctccgcggtaaacaacaaagtggtacccaatggcgatgtcctggaaacagccgtggggctcggcgtcgtcccccacccctttggtggatccgcacacaaacccaataacttgggtaaccacattagggcggactccacgtaccagttggtctggacatgtcaagagcctttctcgggaatcagggcgcggtagattaggccttttaca

SEQ ID NO: 489233 - DNA, 150 bp, Homo sapiens
gtggaaagtcgagttaccgagctcgcctctgcattcagaaactgctatacctcttcagccttgcagaggtatgcagcagatgccaggaaagccaagtacatccaatacccaatcttttacctcagatttgccatctccagagcatgccct

SEQ ID NO: 489234 - DNA, 151 bp, Homo sapiens
cggcactatgctatactacgtaccgtctgctagctctgactttgactggcttgtgtgtggcaagtagttaacaaaggaggagaaatgatgaaccgtcgtgtgtggtctcttgggaaatcttttcataccaggtgattctattcaaaaaccc

SEQ ID NO: 489235 - DNA, 712 bp, Homo sapiens
cgtttgagacagagcaagcatcagaactagaatcagatatgatgtgttgggattatcaaattgggaatttaaaacaactaaaataaatgtgttaagggttctaactgaaaaaacgtagagaacattcaagacctgatgtgtaatataaacagagaaatggaaattctaaaaactaaaaggaaatgctggaaatcaaatccgctataactaaaatgaggatggcctttggtggctcatcagtagactgggcacagctggggaaagaagcagtgagcttgaagacaggttgaaagaaacttcccaaagtgaaatgcaaagagaaaaaagaaatgaggaaataaaacgagatcatccaagaatgaggaagaatttcaaaggctgtaacataagtgtaattgaactaccggaagacaaaggagaatggcagcagacagaaatatttgaagtaataatgcctgagaattctacaaaattaatgacagctaccaaactagagatctaggaagcttggggaacaccaagcaggataaatatcccaacaacaaaaaactacacctaggcatgtcatattcaaactgtagaattctacaaccgaacactctgaaaaaagccagagggaaaaatcagcttatctatggaggcataggaataaacacatagtaggctacttaccagaaaccatgaagcagaagagtacatgaaaactttacag

SEQ ID NO: 489236 - DNA, 248 bp, Homo sapiens
ctgtacgaatattgcacgagacgtgattgagggccatacgctcatctcactctatacagagagagtgcgatataccaacagacaacattattgccatgagtatctattgaaagatccgcttatactgaatgtcccgccaggcttctagttctgtgcatatggccaacacgcggctctaaagcatcgatgggcaccctggttcacccacaggatgtataggcacacctgctccttaagctctgatgctg

SEQ ID NO: 489237 - DNA, 114 bp, Homo sapiens
ggcattatcatctacttggaggtgaggcagagatcgctgaactgggaggtagagcttgcagtgagctgagatcgtgtcactgcactctagcctggagagcaagactctgtctcc

SEQ ID NO: 489238 - DNA, 223 bp, Homo sapiens
gagtatctctgagtagctgaacgtgagactggacatgcgagttgtgtatcatgtactgtgcatccagcgagcttctccgaacttgtctttgacacactacacataaacttctaaggtcggcatcagtctttcagagatatactcccctttcctgttgtctgaccatataaaccaaacatctctcgcaagctctcttcactgatggcttcaggccgggaccgag

SEQ ID NO: 489239 - DNA, 285 bp, Homo sapiens
aagccttttgaaaataaaactgactgggggggaaggggcttaatgaaaaacagctggaaaaacagtggatcaacagggtaggcccagatcccaaaaggcctggccaggcagggaatgtgtctttaccaaatggaacaattttgaacttccaagatcaagcctttttgttgctgaggggaaaaaaggagctctgtaaagagggtcccgcttacttccattcgccaggggccctggaaagccttcgggggggaaggaaaaacaattaaaccaaacttggggtctgga

SEQ ID NO: 489240 - DNA, 167 bp, Homo sapiens
  misc_feature (66)..(66): n is a, c, g, or t
  misc_feature (117)..(117): n is a, c, g, or t
ccaccaccctccccaccccctgggggccagagcttgcacaaagtcccccccataatacaggggganccacttggtcaggagacagggaggggttcattccccctggtgggactggtngggatctgtagtttcccacaacctctcccacctctttctcttcaaaaaaa

SEQ ID NO: 489241 - DNA, 99 bp, Homo sapiens
atctggtctggaagcccgagaagggcacagcagagatcctatgtgggtcacggcaccagtgctcactgaagagttctcctttcgtcccccgggttaccg

SEQ ID NO: 489242 - DNA, 360 bp, Homo sapiens
ttccggtacggggtcatgtggtatttttggtggtttgggtggttttcttaaaaaacaagttaaaacctgacgatttctggcaggcggtgtaagcatgttacctgtgggtggcttggtgtgtctgttaaatgattgtcatatgtaaatgctaaaataaatcgacagtgtctcagaactgaataactgcagtgactggatgctctaaaacagggtaggacttaagaatagatggttttaaatccgggaaatggtgatggtgacccatgagtggaggaccttccagtcctaaagctgataaagtgtgtagccagaagagtacttttttttggtaaccacggtctcgaggggtgtcagggtacc

SEQ ID NO: 489243 - DNA, 209 bp, Homo sapiens
gagctggcaccaagttatcacaacagttatcaatataaaaccccctggcataacccagtaccagacgcccctcttcgtctgatccgtcctagatcagcagcagtcctactgtctccgcatctcggtctcttctgctcgatctcgtactgttctcgtgatagagggatccgtctagatgtcgacgctgcagggacatgcaatgcatgggc

SEQ ID NO: 489244 - DNA, 367 bp, Homo sapiens
gactttgctggatcccagtgaaaatcttaattacacaataatctggaataccagttataatatttattaattatttcttcccagctatatggtagcagctaaagtttgttgttaccaaaaaatatgccatcttggaaaaatgtcttatattagttgtgtgtcttatagaataagttggatagaatgttcaagaaagtttatgttggaaacagcaagaagaagaagaagagaagaagaagaagacgaaaaccaacttttcctctcacgtactactgctcgcctttcgtcctatgattaatatatggaatcaaactggctattccaacagtagtagtagcagcatctcctcccttactcttgtcgacgc

SEQ ID NO: 489245 - DNA, 1118 bp, Homo sapiens
gactgcatggaaagcagctcctcctatggagcagggtatatgccgaacaggtcgatggtcgaccaagatcgagtatacgtaggttctcactcctagatcagacaccacgcctgaacccacgtactcctcatgtccttcgaattgttgtctggggaatgggtggtgtgtggtggattgggtaccataactgctttgtatagatcgcaagttatggagtctaaggtagtatagtgtggtgcgtgaagagttactacttttgcaatgtgaccatgagaaaattgtatgctcttagggagtgcactatgataaggagtgcactggtggatgtgcgagacgtaggaaatgatgcataggactagggaagcgtagtgatttcgatgggtgtatgcctagaaggtacgtgaagaatcttccacgtgatgactaggagaacccatgaatctgcatgttctccgtgtgctctcccatatcctcgcgaatcctctgtatgtgtcgcgtgttataaatcgctggaactatgatcgttggtaggactggagatagctagccgtggagcgtgtgagagaaggacgtcacatggcaggctctctgggaggaccttgcacgtaatccgtacttatgatcttgtggtcgatgagacagacgatggccgtgcatttgtggtaataatctgaaaacgtagtcagcatttaaaacgtcatcgtggctaatgcgagtggccgtcacccttgcacctgcatctcacatcttctgtgatcagcatggcagtggtgagtatagtcagcatcaccagactaatctagtcctgcctgcaacagtaaccctttctggaaagctagatattgtccgcaacaagaactcagtccatcagaggaatataaagctatggtattggccaggactggcgacaagagatcgtgtatggacattagctcccgagcgctggcccttctgggaccatatcagggctagatcttcttacctccaggggttcaaagccattctcccgctcagcctcctgataagccctgtgcttcactttggtacatcaggaacgctctatcaagaataacattttcaggcaaggttgagggaccatttgaaccagatgggagaaa

SEQ ID NO: 489246 - DNA, 351 bp, Homo sapiens
tctgagctcttcatccatggcttgcttcatttgtcagaacttgaacggttctgtagaagggagtctacgaagtaaaaggtccttaaccttagaaattaagaattaattatttacccttttttttgagacagggtctcactctgttgcccaggttggaatgcagtggcgtgaacatggctctcactgcaacctcaacctcctgggctcaagcgatgctcctgccttagcaccccaagtctctgggactacaggtgcacgccaccacacctggctaattttggtgttttttttgtagagacagagtttcattatcttgctcaggctggtcttgaactcctgagctcaagcagt

SEQ ID NO: 489247 - DNA, 262 bp, Homo sapiens
cgatgccagcaccgccgccatgaaccccgaatatgactacctgtttatgctgcttttgatttggcgactcaggcgtgggcaatgtcatgcctgctcctgcggtttgctgatgacatgtacagcagagagtcatacctcagcaccatcgtggatggatctctcaatgatccgaatcactcgagctgggttcgtcataactgttctacctgtcgaggattctcgagaccaccgaagtgcggccaagtgcaatcgggttcctcag

SEQ ID NO: 489248 - DNA, 157 bp, Homo sapiens
gctgttctcatgatagtgtcacgagatctgatggctttatttattttaatttttttctgagacggagccggcatcctgtccgtcccagactgggagttgcagtggcacgcgttcttcagccttcatctggcaggcccttcccgtccttccctggagt

SEQ ID NO: 489249 - DNA, 112 bp, Homo sapiens
gtactaacttagattacttttcttaggaaaaggtgttagaacttttaactactgaaaataaatggtcctattcagttgggcagaccatgatttacattcgagagtacctagt

SEQ ID NO: 489250 - DNA, 166 bp, Homo sapiens
agatgtttggatcggggcagtcagaggggggtgcagcccgggggcggcccaactccaggggaaggtcaccttcccagttcatccatccccacccttccagctccccatccatcctggtgaaagccatttccaccactcaataaaacctggcattcatccttcaaaa

SEQ ID NO: 489251 - DNA, 353 bp, Homo sapiens
agggatttttgaaacaccttttgggggcttgggaacaccagtggggccaagggttttttttcccggtgtcaaacagggatttggctttcccgggttttttctgggaaacccctttttggggttttttgggtttggggggaaaaagggccctttcccttaatgtaacccgttagctttccaaaggccctcggggcctggctttttttagggtttggacaatgggggcccccctttgcctgctttttttgcccaaaagtccccgggtgtttagggggtgttttaacccgcccccccccctttttttaaaaagggcccttttgccccttttaaaaaaaaatggggggggggcccca

SEQ ID NO: 489252 - DNA, 516 bp, Homo sapiens
ggtaatctatataaagaagagttctaggccaggcgtggtggctcacgcctataatcccagagacttgggaggccaaggtggacagatcgctatgaggtcaggagtatgagaccagcctgaccaacaaggtgaaagccgtctctactagaaatataaaaattagccgggcatggtggtgcccacccataatcccagctactcgggaggctgtggcaggtgaattgctggaatctgggaggcggaggttgcagtgagctgagatcgcaccactgcactccagcctgggcgacataacaagactgcgactgcgtctcaagagaaaaaaaaaagaaaagttataaaatggagagctcatggaaagtgccaataacttgtccttggcattaagtctccctggtgtcagagggtgtgataggagtctagttcttgtaggtagctctgcaggacgcggtatagaggtataagtaaggactgacagtcataatatgatgtccaaagccaagaaggttacagata

SEQ ID NO: 489253 - DNA, 113 bp, Homo sapiens
atgtgatgtttgaaaccagcgcgcagttgaatcagatcaaagtaattgcatcctattttatatgatgggattttgtttaagatttcatttggtaaaaagaattttgtggttta

SEQ ID NO: 489254 - DNA, 336 bp, Homo sapiens
ttatcaacgctacagacagatttccggggtccagtgtgctgctttgctctctgggatggggagctgctgacccattacagaggcttgaggtgtgcgggggccatctagtatgtccattacctggagtccctcaatcacgcctttggacagcctccttttgaaagtgtccgaagcctttttacttagcctcaagcaaactctagctcccacaattcagtgttgggtcctctgtgcaatatcatagtggttatcccagttataagcttgaccaaaggggaagagagacacttgggggatctctaggggatgagtgctagaaactatttatatattttt

SEQ ID NO: 489255 - DNA, 206 bp, Homo sapiens
cagatatcctggaaacagcccagtacaatgccataggattcattctaatctctccgttttcatatttgcgatacccttaagcagggagaaacctcacagtcccttaccttcagctgttgtagcttttgctgcattaacacaaactcttattggctttatcccatgttgtcttacgtggccccatcataataaaggttctctgtgcc

SEQ ID NO: 489256 - DNA, 150 bp, Homo sapiens
tccccaaataaaagctaacaactcaccatgtccgttgtaaccaacactccagattgacacaaaatagactacgaaagtggctttaacactactctgatcacacaactacgctaacgaccacaaaactgggacttacgatacccccaccta

SEQ ID NO: 489257 - DNA, 722 bp, Homo sapiens
cagcgggcgggaaggaggcgttcgtctcaatttgtcggcttgcggggagacttcagtgagtcgctgtctctgaacttccagcctcagagcactgccgcccttgtccccgatggccatgggccgggtctcatgacttgtgccctctcgcttcctgacgctcctggcgcatctggtggtcgtcatcaccttattctggtcccgggacagcaacatagaggcctgcctgcctctcacgttcacccccgaggagtatgacaagcaggacattcatccaattcctctctgcaggctggtggccgcgctctctgtcacccctgggcctcttttgctagaggagctggccggtttcctctcagggagtctccatgttcaacaaggaccaagggctcatttccgttgggggtcactgtaggcattcgtgggcctgtcccttcttcatattcgagcgttgagagtgcactacgtataggtacatattagtcttctgcagtgcccttccagctgtcactgaactggctttattcgtcaccgtctatgggctgaaaaagaaacccttctgattaccttcatgacgggaacctaaggacgaagcctacaggggcaagggccgcttcggattcctgaagaaggaaggataggttcgggttcccctcggaaatgcttctgtggaggtctttgtgaactatagttaagactggatatccgattggttatgctttatt

SEQ ID NO: 489258 - DNA, 630 bp, Homo sapiens
  misc_feature (5)..(5): n is a, c, g, or t
  misc_feature (90)..(90): n is a, c, g, or t
  misc_feature (95)..(95): n is a, c, g, or t
  misc_feature (111)..(111): n is a, c, g, or t
  misc_feature (113)..(113): n is a, c, g, or t
  misc_feature (116)..(116): n is a, c, g, or t
  misc_feature (119)..(119): n is a, c, g, or t
  misc_feature (154)..(154): n is a, c, g, or t
  misc_feature (174)..(174): n is a, c, g, or t
  misc_feature (230)..(230): n is a, c, g, or t
  misc_feature (244)..(244): n is a, c, g, or t
  misc_feature (283)..(283): n is a, c, g, or t
  misc_feature (302)..(302): n is a, c, g, or t
  misc_feature (376)..(376): n is a, c, g, or t
  misc_feature (393)..(393): n is a, c, g, or t
  misc_feature (418)..(418): n is a, c, g, or t
  misc_feature (422)..(422): n is a, c, g, or t
  misc_feature (432)..(432): n is a, c, g, or t
  misc_feature (437)..(437): n is a, c, g, or t
  misc_feature (454)..(454): n is a, c, g, or t
  misc_feature (466)..(466): n is a, c, g, or t
  misc_feature (536)..(536): n is a, c, g, or t
  misc_feature (563)..(563): n is a, c, g, or t
  misc_feature (592)..(592): n is a, c, g, or t
ctggncctccttcaatgggctttttccgccaacgaggacagttgactcggcccacatccatgtcctatcccccagcccgcttctcccctncttancccagggaggagacantngangtnatgggggcagccgggagggaggggccaaggcagtnatgctttcgggtaagaagtngggctgaggctgggggcacagggaggagctgcccaggtgcagttaccattgctcanttacagaccctcanagcttggccagggctgaaggtaccacacgggtgttggtnaggcaggctaagcgcgganggctgcccccaacgagctgggggagcggccgcggctcagggctagccctctccgctctcactcatgacctgccnaggtcgtccgtagcctnctcattccggcctgggaggcccctntttngcagcccatnttaangccaattaaatgctttncctcctgcagcntgctctcttttaattccctctaatgccccttcgctttcttcataaaccagttgggatctccacggtagtncccatcattctaggtcactgccaagcngcccaaagccatcaaggtcctctgctctnctgcgatgtcttttccttcaaagaggtcaacagtttgg

SEQ ID NO: 489259 - DNA, 132 bp, Homo sapiens
gcgagtatgtgttcggcgatgcatggtcaaaagaaggaaggatacttcaggctagagtagctttttgttggaattttcacaacttcagaaaaacttcatctcacggtttagaagcatcggttttattgactt

SEQ ID NO: 489260 - DNA, 788 bp, Homo sapiens
aagtgcacacatcttttagtttcccagtgcatataaaagttgattatactaagctgtagttatattaagtgtgaaaatggcagtatgtctagaaaaacaatgtacatgtcaatttaaaaatgcgttattgctaaagaatggtaacaatcatctgagccttcagcaagttaaaatctttttgctgatggaaagtcttgcctacaagttcatggctttggacggatcagtagctactgaaggttggggtggctgtggcaattccttaaaataagacgatgataaagtttgccacgtcagttgactccttcatgaaagacttctctgtagcatgtgatggtgtttaatagcattttatccacggtagaacttttttcaaaatcggaattagtcctttcaaaccctcttgctgctttattacatttacacaattacatttgtgtaactttctttttttttttttttggaaacaaagtctggcccgtggtccctaaggcgggagtgtgtgggcatgattccagctcatgggaacctcggcccccggggttgaagcgatctccggcctaagcctcccaagtagcggggatcacagggcgcttggcacaaaccgggatagtggggaatccaagtaagagacagggttaccccggtgtgggccaggtaagtcgggaactccgtgaacctcagggtgaatcaatccgactaagcctcccaagtgcggaatcaccggcttgagccaacaagcccgacacaattggtggaattcaaaaacacaggggagatcgcacaca

SEQ ID NO: 489261 - DNA, 248 bp, Homo sapiens
cttctcttccccaaggaggttcttgctgaacaggtgttgtcaggtgcacattcgaggagcccgcgcgtaggtgtcgctgccagagtgcccctgggtgcgtgcactcctgtgctggccctctgtttccaagagctgtgggtgggaggggaccctgaaccttgggcactagagggatggcatagaggagcttctagaaggactccatactgtgtagtactctaggttctagcacctgtggtccgagcgga

SEQ ID NO: 489262 - DNA, 139 bp, Homo sapiens
attggtggcccgattttcttttttggggccccctggcttttcccccaaggggttgcctttgggggtcccctttttttttttttagctggggaacccgtttttgtgggcctttttttaaagacaaaagagaagaccttta

SEQ ID NO: 489263 - DNA, 354 bp, Homo sapiens
tgggaggcatgggtgggggaaaaggacccggggttcaaagcccggcgggggccaggcaaagtgtgtgttttctcccttccccccccttagccccaaaatgccgcaaaagggtcaaacaaaggcctggttgcccctcttgcatgttttttggggtttttcctggagtatgaaaacccccaaggactccctttccctcccttttgatgccaaagcagaccaagctgtccccctccagtttcatggtgaagtttccagcttttcaagcttaaaaaagtttttggaaaagtccctttcagctcatgcagctttcccaagtgtgaaaggagtgggttgggggggttttccctgccccca

SEQ ID NO: 489264 - DNA, 321 bp, Homo sapiens
acatgcagagaaccctcaaagttcattaagaaaacagtcaacccagcgaaaaattaggcaaaaagattcgatgcctgtagtcccagctacttgggaggctgaggcaggaggattacttgagcctgggaggcagaggttgcagtgagccaagatccactgcactcaagcctgggtgacagagcgagcctccttcaaaaaaaaaaaaaaaaaaaaaaaatcccccccggggggggattcccccctttttttaattttttaggggggggggggggggggaaaaccctgtccccggggggggggggctcaaaaggggtttttttt

SEQ ID NO: 489265 - DNA, 2630 bp, Homo sapiens
  misc_feature (1)..(1): n is a, c, g, or t
nagcaggctggtaccggccccaagtcttatgatcacccccgctcctggagcacgaagatgcagacgatacttttcccggaggcaagagggcgtcttcacgcaggcaccgagaagctcccactagtgtatgccttaatggtgccgctcttgtccgcgtctacgcttgggaccttggcttctgacttggagagtgtacagctctgcccgacggcaacccagcttgggaagagaagccccagcgtgggctggggctcaaggcgcaggaaggccgagcccggcgcggacgcaggcggctccgggcgggctcagcacccccaggcaccgtctcctagtgaccgcggcgctcgcgggcctggcggccgttgtccgggcgactgcgcacgcgggcacccccgcggcccctcccctgggcgcgcgcgcgacctgggtgccatggcggcagcggcggtgacaggccagcggctgagaccgcggcggccgaggaggcctcgaggccgcagtgggcgccgccagaccactgccaggctcaggcggcggccgggctgggcgacggcgaggacgcaccggtgcgtccgctgtgcaagccccgcggcatctgctcgcgcgcctacttcctggtgctgatggtgttcgtgcacctgtacctgggtaacgtgctggcgctgctgctcttcgtgcactacagcaacggcgacgaaagcagcgatcccgggccccaacaccgtgcccagggccccgggcccgagcccaccttaggtcccctcacccggctggagggcatcaaggtggggcacgagcgtaaggtccagctggtcaccgacagggatcacttcatccgaaccctcagcctcaagccgctgctcttcgaaatccccggcttcctgactgatgaagagtgtcggctcatcatccatctggcgcagatgaaggggttacagcgcagccagatcctgcctactgaagagtatgaagaggcaatgagcactatgcaggtcagccagctggacctcttccggctgctggaccagaaccgtgatgggcaccttcagctccgtgaggttctggcccagactcgcctgggaaatggatggtggatgactccagagagcattcaggagatgtacgccgcgatcaaggctgaccctgatggtgacggagtgctgagtctgcaggagttctccaacatggaccttcgggacttccacaagtacatgaggagccacaaggcagagtccagtgagctggtgcggaacagccaccatacctggctctaccagggtgagggtgcccaccacatcatgcgtgccatccgccagagggtgctgcgcctcactcgcctgtcgcctgagatcgtggagctcagcgagccgctgcaggttgttcgatatggtgaggggggccactaccatgcccacgtggacagtgggcctgtgtacccagagaccatctgctcccataccaagctggtagccaacgagtctgtacccttcgagacctcctgccgctacatgacagtgctgttttatttgaacaacgtcactggtgggggcgagactgttttccctgtagcagataacagaacctacgatgaaatgagtctgattcaggatgacgtggacctccgtgacacacggaggcactgtgacaagggaaacctgcgtgtcaagccccaacagggcacagcagtcttctggtacaactacctgcctgatgggcaaggttgggtgggtgacgtagacgactactcgctgcacgggggctgcctggtcacgcgcggcaccaagtggattgccaacaactggattaatgtggaccccagccgagcgcggcaagcgctgttccaacaggagatggcccgccttgcccgagaagggggcaccgactcacagcccgagtgggctctggaccgggcctaccgcgatgcgcgcgtggaactctgagggaagagttagccccggttcccagccgcgggtcgccagttgcccaagatcaggggtccggctgtccttctgtcctgctgcagactaaaggtctggccaatgtcttgccccaccccgccagccgcgatacggcgcagttcctatattcatgttatttattgtgtactgactccatctgccccgtcaaataaaaaaccacaaggttcgagccgccgggcccgacaaaaaaaaaaaaaaaaaaaaaaaaaaaaaaaaaaaaaaaaaaaaaaaaaaaaaaaaaaaaaaaaaaaaaagaaagcaacaaaaaaaaaaaaaaaaaaaaagaagagggggggcggcgccggcgccaaacccccccggggggcggcgcctccccccccccccttaaaaggggggccgccccggggggtatccacactatatactagagcaagcagcacgccgcggcggttctaacacaacacgcggcggggcagaggaacaccaaacacttctagtcggggcgtgccatgcgagcagaaggcccccccccccccggggcgggagataaaacgacgcgaggcgccaacacccaacaagaattgcggccccggggggaaaaacaccctactccgcggggcggtgactgataacaacagcccactcactgtctcgaacaaaaactctccggcaacatagacacaaatattg

SEQ ID NO: 489266 - DNA, 442 bp, Homo sapiens
gccgtgtacggtttcgtgccgattccgcgcagctcgtgcaggcaaggccgaggataaggagtggatgcccgtcaccaagttgtcccgcttggtcaaggacatgaagatcaagtccctgtaggagatctatctcttctccctggccattaaggaatcagagatcattgattccttcctgcgggcctctctcaaggatgaggttttgaagatcatgccagtgcttctctagacccgtgcctgccagcgcactagttttaagggatctgttgctattgtcgactaccctgctcaccgttgctctgtttcctaaccgctctcaaggagtctcccaccgctatctctgcctccctcatcttcgccccttctccatactcctcacctcctacacgttactcgcctctcacccttgctccgccccccctactccccttccatcgctccc

SEQ ID NO: 489267 - DNA, 2369 bp, Homo sapiens
  misc_feature (1)..(1): n is a, c, g, or t
  misc_feature (872)..(872): n is a, c, g, or t
  misc_feature (941)..(941): n is a, c, g, or t
nagcaggctggtaccggccccaagtcttatgatcacccccgctcctggagcacgaagatgcagacgatacttttcccggaggcaagagggcgtcttcacgcaggcaccgagaagctcccactagtgtatgccttaatggtgccgctcttgtccgcgtctacgcttgggaccttggcttctgacttggagagtgtacagctctgcccgacggcaacccagcttgggaagagaagccccagcgtgggctggggctcaaggcgcaggaaggccgagcccggcgcggacgcaggcggctccgggcgggctcagcacccccaggcaccgtctcctagtgaccgcggcgctcgcgggcctggcggccgttgtccgggcgactgcgcacgcgggcacccccgcggcccctcccctgggcgcgcgcgcgacctgggtgccatggcggcagcggcggtgacaggccagcggctgagaccgcggcggccgaggaggcctcgaggccgcagtgggcgccgccagaccactgccaggctcaggcggcggccgggctgggcgacggcgaggacgcaccggtgcgtccgctgtgcaagccccgcggcatctgctcgcgcgcctacttcctggtgctgatggtgttcgtgcacctgtacctgggtaacgtgctggcgctgctgctcttcgtgcactacagcaacggcgacgaaagcagcgatcccgggccccaacaccgtgcccagggccccgggcccgagcccaccttaggtcccctcacccggctggagggcatcaaggtgaggacctccctgccccgccgcgctccaggccctgcacggctgagcccgagaggaccggcgctcagcccgggtccccacgctgcncccggcgctgctctgcgtcggtcccgcgcgctcccactcactcgcctgctgtcgctctccgggccgggncgacttggcccttcttggcagcgcggtctggcgccccagctgcccgctgtgcgccttttccttaggtggggcacgagcgtaaggtccagctggtcaccgacagggatcacttcatccgaaccctcagcctcaagccgctgctcttcgaaatccccggcttcctgactgatgaagagtgtcggctcatcatccatctggcgcagatgaaggggttacagcgcagccagatcctgcctactgaagagtatgaagaggcaatgagcactatgcaggtcagccagctggacctcttccggctgctggaccagaaccgtgatgggcaccttcagctccgtgaggttctggcccagactcgcctgggaaatggatggtggatgactccagagagcattcaggagatgtacgccgcgatcaaggctgaccctgatggtgacggagtgctgagtctgcaggagttctccaacatggaccttcgggacttccacaagtacatgaggagccacaaggcagagtccagtgagctggtgcggaacagccaccatacctggctctaccagggtgagggtgcccaccacatcatgcgtgccatccgccagagggtgctgcgcctcactcgcctgtcgcctgagatcgtggagctcagcgagccgctgcaggttgttcgatatggtgaggggggccactaccatgcccacgtggacagtgggcctgtgtacccagagaccatctgctcccataccaagctggtagccaacgagtctgtacccttcgagacctcctgccgctacatgacagtgctgttttatttgaacaacgtcactggtgggggcgagactgttttccctgtagcagataacagaacctacgatgaaatgagtctgattcaggatgacgtggacctccgtgacacacggaggcactgtgacaagggaaacctgcgtgtcaagccccaacagggcacagcagtcttctggtacaactacctgcctgatgggcaaggttgggtgggtgacgtagacgactactcgctgcacgggggctgcctggtcacgcgcggcaccaagtggattgccaacaactggattaatgtggaccccagccgagcgcggcaagcgctgttccaacaggagatggcccgccttgcccgagaagggggcaccgactcacagcccgagtgggctctggaccgggcctaccgcgatgcgcgcgtggaactctgagggaagagttagccccggttcccagccgcgggtcgccagttgcccaagatcaggggtccggctgtccttctgtcctgctgcagactaaaggtctggccaatgtcttgccccaccccgccagccgcgatacggcgcagttcctatattcatgttatttattgtgtactgactccatctgccccgtcaaataaaaaaccacaaggttcga

SEQ ID NO: 489268 - DNA, 394 bp, Homo sapiens
cagtcctcgcagccggggtaacagaaggggaccctggtcttaaaaaaaaaaaagaaaattacctggataattaaggggaagctttaagttccatacctatctgaaatgatgccaaaggtgtaataataattaagcttggacagggagtaggtgacaataatactttgggtagggaatacggctaggggcctaaaaaatagtgggcatctggaatttctatacataagtgggaggcgggaagggggcggatccatttggtggtatcaccgggtactttatagatctccacctaaacaagtaacactagaaactgggcccttctcgggtacccaccagtaggtccactctcggaattatgcccggaaaaattaggatcctagggcggaattggcat

SEQ ID NO: 489269 - DNA, 2066 bp, Homo sapiens
  misc_feature (1)..(1): n is a, c, g, or t
nagcaggctggtaccggccccaagtcttatgatcacccccgctcctggagcacgaagatgcagacgatacttttcccggaggcaagagggcgtcttcacgcaggcaccgagaagctcccactagtgtatgccttaatggtgccgctcttgtccgcgtctacgcttgggaccttggcttctgacttggagagtgtacagctctgcccgacggcaacccagcttgggaagagaagccccagcgtgggctggggctcaaggcgcaggaaggccgagcccggcgcggacgcaggcggctccgggcgggctcagcacccccaggcaccgtctcctagtgaccgcggcgctcgcgggcctggcggccgttgtccgggcgactgcgcacgcgggcacccccgcggcccctcccctgggcgcgcgcgcgacctgggtgccatggcggcagcggcggtgacaggccagcggctgagaccgcggcggccgaggaggcctcgaggccgcagtgggcgccgccagaccactgccaggctcaggcggcggccgggctgggcgacggcgaggacgcaccggtgcgtccgctgtgcaagccccgcggcatctgctcgcgcgcctacttcctggtgctgatggtgttcgtgcacctgtacctgggtaacgtgctggcgctgctgctcttcgtgcactacagcaacggcgacgaaagcagcgatcccgggccccaacaccgtgcccagggccccgggcccgagcccaccttaggtcccctcacccggctggagggcatcaagaaatccccggcttcctgactgatgaagagtgtcggctcatcatccatctggcgcagatgaaggggttacagcgcagccagatcctgcctactgaagagtatgaagaggcaatgagcactatgcaggtcagccagctggacctcttccggctgctggaccagaaccgtgatgggcaccttcagctccgtgaggttctggcccagactcgcctgggaaatggatggtggatgactccagagagcattcaggagatgtacgccgcgatcaaggctgaccctgatggtgacggagtgctgagtctgcaggagttctccaacatggaccttcgggacttccacaagtacatgaggagccacaaggcagagtccagtgagctggtgcggaacagccaccatacctggctctaccagggtgagggtgcccaccacatcatgcgtgccatccgccagagggtgctgcgcctcactcgcctgtcgcctgagatcgtggagctcagcgagccgctgcaggttgttcgatatggtgaggggggccactaccatgcccacgtggacagtgggcctgtgtacccagagaccatctgctcccataccaagctggtagccaacgagtctgtacccttcgagacctcctgccgctacatgacagtgctgttttatttgaacaacgtcactggtgggggcgagactgttttccctgtagcagataacagaacctacgatgaaatgagtctgattcaggatgacgtggacctccgtgacacacggaggcactgtgacaagggaaacctgcgtgtcaagccccaacagggcacagcagtcttctggtacaactacctgcctgatgggcaaggttgggtgggtgacgtagacgactactcgctgcacgggggctgcctggtcacgcgcggcaccaagtggattgccaacaactggattaatgtggaccccagccgagcgcggcaagcgctgttccaacaggagatggcccgccttgcccgagaagggggcaccgactcacagcccgagtgggctctggaccgggcctaccgcgatgcgcgcgtggaactctgagggaagagttagccccggttcccagccgcgggtcgccagttgcccaagatcaggggtccggctgtccttctgtcctgctgcagactaaaggtctggccaatgtcttgccccaccccgccagccgcgatacggcgcagttcctatattcatgttatttattgtgtactgactccatctgccccgtcaaataaaaaaccacaaggttcga

SEQ ID NO: 489270 - DNA, 97 bp, Homo sapiens
atttgacaagacccataaatctgaaactgatacgagagaagtgaattctggctttttttacaagagtgcagaaagagaaaaactcataaaagctgaa

SEQ ID NO: 489271 - DNA, 2755 bp, Homo sapiens
  misc_feature (1)..(1): n is a, c, g, or t
nagcaggctggtaccggccccaagtcttatgatcacccccgctcctggagcacgaagatgcagacgatacttttcccggaggcaagagggcgtcttcacgcaggcaccgagaagctcccactagtgtatgccttaatggtgccgctcttgtccgcgtctacgcttgggaccttggcttctgacttggagagtgtacagctctgcccgacggcaacccagcttgggaagagaagccccagcgtgggctggggctcaaggcgcaggaaggccgagcccggcgcggacgcaggcggctccgggcgggctcagcacccccaggcaccgtctcctagtgaccgcggcgctcgcgggcctggcggccgttgtccgggcgactgcgcacgcgggcacccccgcggcccctcccctgggcgcgcgcgcgacctgggtgccatggcggcagcggcggtgacaggccagcggctgagaccgcggcggccgaggaggcctcgaggccgcagtgggcgccgccagaccactgccaggctcaggcggcggccgggctgggcgacggcgaggacgcaccggtgcgtccgctgtgcaagccccgcggcatctgctcgcgcgcctacttcctggtgctgatggtgttcgtgcacctgtacctgggtaacgtgctggcgctgctgctcttcgtgcactacagcaacggcgacgaaagcagcgatcccgggccccaacaccgtgcccagggccccgggcccgagcccaccttaggtcccctcacccggctggagggcatcaaggtggggcacgagcgtaaggtccagctggtcaccgacagggatcacttcatccgaaccctcagcctcaagccgctgctcttcgaaatccccggcttcctgactgatgaagagtgtcggctcatcatccatctggcgcagatgaaggggttacagcgcagccagatcctgcctactgaagagtatgaagaggcaatgagcactatgcaggtcagccagctggacctcttccggctgctggaccagaaccgtgatgggcaccttcagctccgtgaggttctggcccagactcgcctgggaaatggatggtggatgactccagagagcattcaggagatgtacgccgcgatcaaggctgaccctgatggtgacggagtgctgagtctgcaggagttctccaacatggaccttcgggacttccacaagtacatgaggagccacaaggcagagtccagtgagctggtgcggaacagccaccatacctggctctaccagggtgagggtgcccaccacatcatgcgtgccatccgccagagggtgctgcgcctcactcgcctgtcgcctgagatcgtggagctcagcgagccgctgcaggttgttcgatatggtgaggggggccactaccatgcccacgtggacagtgggcctgtgtacccagagaccatctgctcccataccaagctggtagccaacgagtctgtacccttcgagacctcctgccggcaagtatctcccaactgggggctgccttcaatcctcagaccaggaacacccatgacacaggcacagccctgcactgtgggcgtgccccttggcatggggccaggagatcactgggttatcccggttagtgatgccctcacctctccccacaagttgtttacccaatggctggaaaggggtggctactggtcatcgtgaccactggagtcaacacagactgatgtacccacagacaccaaaacttgccccctgagttctgaagcaaggggcaaggctgggcccctagcttgtcctgcccattcctccaggtgttgatcttgattccacttagagaagctgaagctgtgcctccctcccctgtcaagccagttctttcctcttcaggtggctgttctggcccagccccttcccatccccaaggagcccttcagcgcgccctgttgcttctgctagcctacctttccctgccaggcccttgctcagggccatggcatttaactaagtgcacctgtgatcttggccaaaaaaccattgcaactcacagtaagagactgggtttcggggaaggaggggctagggacattttggcactggcctgccctattgtctcccatcctagtctgtcctggtccctggcaacaggaacctgggcagcttatcctgcccacaggtaagcccctgggagcatccacaactggggacctgctcagtgccccccctgccttacagctacatgacagtgctgttttatttgaacaacgtcactggtgggggcgagactgttttccctgtagcagataacagaacctacgatgaaataggttgggtgggtgacgtagacgactactcgctgcacgggggctgcctggtcacgcgcggcaccaagtggattgccaacaactggattaatgtggaccccagccgagcgcggcaagcgctgttccaacaggagatggcccgccttgcccgagaagggggcaccgactcacagcccgagtgggctctggaccgggcctaccgcgatgcgcgcgtggaactctgagggaagagttagccccggttcccagccgcgggtcgccagttgcccaagatcaggggtccggctgtccttctgtcctgctgcagactaaaggtctggccaatgtcttgccccaccccgccagccgcgatacggcgcagttcctatattcatgttatttattgtgtactgactccatctgccccgtcaaataaaaaaccacaaggttcga

SEQ ID NO: 489272 - DNA, 2010 bp, Homo sapiens
  misc_feature (1)..(1): n is a, c, g, or t
nagcaggctggtaccggccccaagtcttatgatcacccccgctcctggagcacgaagatgcagacgatacttttcccggaggcaagagggcgtcttcacgcaggcaccgagaagctcccactagtgtatgccttaatggtgccgctcttgtccgcgtctacgcttgggaccttggcttctgacttggagagtgtacagctctgcccgacggcaacccagcttgggaagagaagccccagcgtgggctggggctcaaggcgcaggaaggccgagcccggcgcggacgcaggcggctccgggcgggctcagcacccccaggcaccgtctcctagtgaccgcggcgctcgcgggcctggcggccgttgtccgggcgactgcgcacgcgggcacccccgcggcccctcccctgggcgcgcgcgcgacctgggtgccatggcggcagcggcggtgacaggccagcggctgagaccgcggcggccgaggaggcctcgaggccgcagtgggcgccgccagaccactgccaggctcaggcggcggccgggctgggcgacggcgaggacgcaccggtgcgtccgctgtgcaagccccgcggcatctgctcgcgcgcctacttcctggtgctgatggtgttcgtgcacctgtacctgggtaacgtgctggcgctgctgctcttcgtgcactacagcaacggcgacgaaagcagcgatcccgggccccaacaccgtgcccagggccccgggcccgagcccaccttaggtcccctcacccggctggagggcatcaaggtggggcacgagcgtaaggtccagctggtcaccgacagggatcacttcatccgaaccctcagcctcaagccgctgctcttcgaaatccccggcttcctgactgatgaagagtgtcggctcatcatccatctggcgcagatgaaggggttacagcgcagccagatcctgcctactgaagagtatgaagaggcaatgagcactatgcaggtcagccagctggacctcttccggctgctggaccagaaccgtgatgggcaccttcagctccgtgaggttctggcccagactcgcctgggaaatggatggtggatgactccagagagcattcaggagatgtacgccgcgatcaaggctgaccctgatggtgacggagtgctgagtctgcaggagttctccaacatggaccttcgggacttccacaagtacatgaggagccacaaggcagagtccagtgagctggtgcggaacagccaccatacctggctctaccagggtgagggtgcccaccacatcatgcgtgccatccgccagagggtgctgcgcctcactcgcctgtcgcctgagatcgtggagctcagcgagccgctgcaggttgttcgatatggtgaggggggccactaccatgcccacgtggacagtgggcctgtgtacccagagaccatctgctcccataccaagctggtagccaacgagtctgtacccttcgagacctcctgccgctacatgacagtgctgttttatttgaacaacgtcactggtgggggcgagactgttttccctgtagcagataacagaacctacgatgaaatgagtctgattcaggatgacgtggacctccgtgacacacggaggcactgtgacaagggaaacctgcgtgtcaagccccaacagggcacagcagtcttctggtacaactacctgcctgatgggcaaggttgggtgggtgacgtagacgactactcacagcccgagtgggctctggaccgggcctaccgcgatgcgcgcgtggaactctgagggaagagttagccccggttcccagccgcgggtcgccagttgcccaagatcaggggtccggctgtccttctgtcctgctgcagactaaaggtctggccaatgtcttgccccaccccgccagccgcgatacggcgcagttcctatattcatgttatttattgtgtactgactccatctgccccgtcaaataaaaaaccacaaggttcga

SEQ ID NO: 489273 - DNA, 105 bp, Homo sapiens
tgaactacagacaaacactattttatttaaataaggagacagcaacaagtgatggtgcacatggcccagaccagtacaccttgcactggcacagcctgatggcat

SEQ ID NO: 489274 - DNA, 2873 bp, Homo sapiens
  misc_feature (1)..(1): n is a, c, g, or t
nagcaggctggtaccggccccaagtcttatgatcacccccgctcctggagcacgaagatgcagacgatacttttcccggaggcaagagggcgtcttcacgcaggcaccgagaagctcccactagtgtatgccttaatggtgccgctcttgtccgcgtctacgcttgggaccttggcttctgacttggagagtgtacagctctgcccgacggcaacccagcttgggaagagaagccccagcgtgggctggggctcaaggcgcaggaaggccgagcccggcgcggacgcaggcggctccgggcgggctcagcacccccaggcaccgtctcctagtgaccgcggcgctcgcgggcctggcggccgttgtccgggcgactgcgcacgcgggcacccccgcggcccctcccctgggcgcgcgcgcgacctgggtgccatggcggcagcggcggtgacaggccagcggctgagaccgcggcggccgaggaggcctcgaggccgcagtgggcgccgccagaccactgccaggctcaggcggcggccgggctgggcgacggcgaggacgcaccggtgcgtccgctgtgcaagccccgcggcatctgctcgcgcgcctacttcctggtgctgatggtgttcgtgcacctgtacctgggtaacgtgctggcgctgctgctcttcgtgcactacagcaacggcgacgaaagcagcgatcccgggccccaacaccgtgcccagggccccgggcccgagcccaccttaggtcccctcacccggctggagggcatcaaggtggggcacgagcgtaaggtccagctggtcaccgacagggatcacttcatccgaaccctcagcctcaagccgctgctcttcgaaatccccggcttcctgactgatgaagagtgtcggctcatcatccatctggcgcagatgaaggggttacagcgcagccagatcctgcctactgaagagtatgaagaggcaatgagcactatgcaggtcagccagctggacctcttccggctgctggaccagaaccgtgatgggcaccttcagctccgtgaggttctggcccagactcgcctgggaaatggatggtggatgactccagagagcattcaggagatgtacgccgcgatcaaggctgaccctgatggtgacggagtgctgagtctgcaggagttctccaacatggaccttcgggacttccacaagtacatgaggagccacaaggcagagtccagtgagctggtgcggaacagccaccatacctggctctaccagggtgagggtgcccaccacatcatgcgtgccatccgccagagggtgctgcgcctcactcgcctgtcgcctgagatcgtggagctcagcgagccgctgcaggttgttcgatatggtgaggggggccactaccatgcccacgtggacagtgggcctgtgtacccagagaccatctgctcccataccaagctggtagccaacgagtctgtacccttcgagacctcctgccggcaagtatctcccaactgggggctgccttcaatcctcagaccaggaacacccatgacacaggcacagccctgcactgtgggcgtgccccttggcatggggccaggagatcactgggttatcccggttagtgatgccctcacctctccccacaagttgtttacccaatggctggaaaggggtggctactggtcatcgtgaccactggagtcaacacagactgatgtacccacagacaccaaaacttgccccctgagttctgaagcaaggggcaaggctgggcccctagcttgtcctgcccattcctccaggtgttgatcttgattccacttagagaagctgaagctgtgcctccctcccctgtcaagccagttctttcctcttcaggtggctgttctggcccagccccttcccatccccaaggagcccttcagcgcgccctgttgcttctgctagcctacctttccctgccaggcccttgctcagggccatggcatttaactaagtgcacctgtgatcttggccaaaaaaccattgcaactcacagtaagagactgggtttcggggaaggaggggctagggacattttggcactggcctgccctattgtctcccatcctagtctgtcctggtccctggcaacaggaacctgggcagcttatcctgcccacaggtaagcccctgggagcatccacaactggggacctgctcagtgccccccctgccttacagctacatgacagtgctgttttatttgaacaacgtcactggtgggggcgagactgttttccctgtagcagataacagaacctacgatgaaatggtaagggtcaactgggctattactcttgtgggctggcaggggcttagacaagtgaagtacacacctctccaggtctaaggatgtgggcccaaattattccttgggcatatctggttggtttccctttggtcacccttggctggcctggccatagagtggggacaggttgaacaccccaccaccctgctgcccacagagtctgattcaggatgacgtggacctccgtgacacacggaggcactgtgacaagggaaacctgcgtgtcaagccccaacagggcacagcagtcttctggtacaactacctgcctgatgggcaaggtgagggcctatggccaggcctggggggggtgccctgaggtacaagcttccctttacccagccccgtctgcacaatggaggctgttcctggctgcttttccaaatagtttctgcttcctggtgctcccaaaggcatccttaagtgactttagcagactgccccaggacctgtactgtttattgggttatatccatccctattattcctgatgcccagcttctactccg

SEQ ID NO: 489275 - DNA, 1371 bp, Homo sapiens
cgatgttacctcctcaggccggagagtggccaccactctatatgccaggctggaagccaggtcctggccatatggctcaagcttcctttggagaaccttctctggccactctaatagggggtgggcctctttcttcttagggccaaattagggcttaaactgagaaaaggaactgctctgggtcttcctgtaaggcctgatgtgacagaaaccaggttcatctgacccaaaagtccaggtgggggacaagtgtacaaggcccctcagtgcctgaggtcagggctgctgctgcctttggggtaggtagggaagtgcagcctgccactgttgcctcccaatatgggcttggtgggcattgatggtgggtgccctgtgcaggagtgctgagtctgcaggagttctccaacatggaccttcgggacttccacaagtacatgaggagccacaaggcagagtccagtgagctggtgcggaacagccaccatacctggctctaccagggtgagggtgcccaccacatcatgcgtgccatccgccagagggtgctgcgcctcactcgcctgtcgcctgagatcgtggagctcagcgagccgctgcaggttgttcgatatggtgaggggggccactaccatgcccacgtggacagtgggcctgtgtacccagagaccatctgctcccataccaagctggtagccaacgagtctgtacccttcgagacctcctgccgctacatgacagtgctgttttatttgaacaacgtcactggtgggggcgagactgttttccctgtagcagataacagaacctacgatgaaatgagtctgattcaggatgacgtggacctccgtgacacacggaggcactgtgacaagggaaacctgcgtgtcaagccccaacagggcacagcagtcttctggtacaactacctgcctgatgggcaaggttgggtgggtgacgtagacgactactcgctgcacgggggctgcctggtcacgcgcggcaccaagtggattgccaacaactggattaatgtggaccccagccgagcgcggcaagcgctgttccaacaggagatggcccgccttgcccgagaagggggcaccgactcacagcccgagtgggctctggaccgggcctaccgcgatgcgcgcgtggaactctgagggaagagttagccccggttcccagccgcgggtcgccagttgcccaagatcaggggtccggctgtccttctgtcctgctgcagactaaaggtctggccaatgtcttgccccaccccgccagccgcgatacggcgcagttcctatattcatgttatttattgtgtactgactccatctgccccgtcaaataaaaaaccacaaggttcga

SEQ ID NO: 489276 - DNA, 380 bp, Homo sapiens
cccccccatgcccagctaaccacagaaactttcatctcttcattttttctttgggccccattaatacctaagacaggtagaaagggtcccaaaaaaaccccattggtaatggccgattgccggctgcagtcatcgcccccagatcagggtggtacaggatcccttaaggtaataaaaggtgagggggcatgaagaataatgagcccagggaaaaaagaagcaggccaaagtagcagataaaatgccggcaaagcccaaatgaatgttttcaaaaagctcttgtatttttttgcccagtgtaaaaatccttgctatttcaggatggcgggtggcctgctcagtaacaaacatgttccaaataaagattttgcatgaaagta

SEQ ID NO: 489277 - DNA, 1674 bp, Homo sapiens
  misc_feature (1)..(1): n is a, c, g, or t
nagcaggctggtaccggccccaagtcttatgatcacccccgctcctggagcacgaagatgcagacgatacttttcccggaggcaagagggcgtcttcacgcaggcaccgagaagctcccactagtgtatgccttaatggtgccgctcttgtccgcgtctacgcttgggaccttggcttctgacttggagagtgtacagctctgcccgacggcaacccagcttgggaagagaagccccagcgtgggctggggctcaaggcgcaggaaggccgagcccggcgcggacgcaggcggctccgggcgggctcagcacccccaggcaccgtctcctagtgaccgcggcgctcgcgggcctggcggccgttgtccgggcgactgcgcacgcgggcacccccgcggcccctcccctgggcgcgcgcgcgacctgggtgccatggcggcagcggcggtgacaggccagcggctgagaccgcggcggccgaggaggcctcgaggccgcagtgggcgccgccagaccactgccaggctcaggcggcggccgggctgggcgacggcgaggacgcaccggtgcgtccgctgtgcaagccccgcggcatctgctcgcgcgcctacttcctggtgctgatggtgttcgtgcacctgtacctgggtaacgtgctggcgctgctgctcttcgtgcactacagcaacggcgacgaaagcagcgatcccgggccccaacaccgtgcccagggccccgggcccgagcccaccttaggtcccctcacccggctggagggcatcaaggtggggcacgagcgtaaggtccagctggtcaccgacagggatcacttcatccgaaccctcagcctcaagccgctgctcttcgaaatccccggcttcctgactgatgaagagtgtcggctcatcatccatctggcgcagatgaaggggttacagcgcagccagatcctgcctactgaagagtatgaagaggcaatgagcactatgcaggtcagccagctggacctcttccggctgctggaccagaaccgtgatgggcaccttcagctccgtgaggttctggcccagactcgcctgggaaatggatggtggatgactccagagagcattcaggagatgtacgccgcgatcaaggctgaccctgatggtgacggagtgctgagtctgcaggagttctccaacatggaccttcgggacttccacaagtacatgaggagccacaaggcagagtccagtgagctggtgcggaacagccaccatacctggctctaccagggtgagggtgcccaccacatcatgcgtgccatccgccagaggtgagcacctgaagctgttctcactggagcagggggagaagactgggcagggcctccacagaagtccttgtctggggccaagaggacagaatggattaacccatttgggattaagttccatttgttagaccaggattgggacccactgaaagacaggcaattaacaaaggcaaattagccctccttgcaggcacacaatgggcaactggggttagatagagattgagcacttctttctgattagataaatgacctcttatctttgaccccttatctgaccccgtcacagcaggaaaagggtttttaaataaacaactttcttccagggaggaggacctcacgactccccgacccct

SEQ ID NO: 489278 - DNA, 1762 bp, Homo sapiens
  misc_feature (1)..(1): n is a, c, g, or t
  misc_feature (872)..(872): n is a, c, g, or t
  misc_feature (941)..(941): n is a, c, g, or t
  misc_feature (1123)..(1123): n is a, c, g, or t
  misc_feature (1128)..(1128): n is a, c, g, or t
  misc_feature (1178)..(1178): n is a, c, g, or t
  misc_feature (1184)..(1184): n is a, c, g, or t
  misc_feature (1196)..(1196): n is a, c, g, or t
nagcaggctggtaccggccccaagtcttatgatcacccccgctcctggagcacgaagatgcagacgatacttttcccggaggcaagagggcgtcttcacgcaggcaccgagaagctcccactagtgtatgccttaatggtgccgctcttgtccgcgtctacgcttgggaccttggcttctgacttggagagtgtacagctctgcccgacggcaacccagcttgggaagagaagccccagcgtgggctggggctcaaggcgcaggaaggccgagcccggcgcggacgcaggcggctccgggcgggctcagcacccccaggcaccgtctcctagtgaccgcggcgctcgcgggcctggcggccgttgtccgggcgactgcgcacgcgggcacccccgcggcccctcccctgggcgcgcgcgcgacctgggtgccatggcggcagcggcggtgacaggccagcggctgagaccgcggcggccgaggaggcctcgaggccgcagtgggcgccgccagaccactgccaggctcaggcggcggccgggctgggcgacggcgaggacgcaccggtgcgtccgctgtgcaagccccgcggcatctgctcgcgcgcctacttcctggtgctgatggtgttcgtgcacctgtacctgggtaacgtgctggcgctgctgctcttcgtgcactacagcaacggcgacgaaagcagcgatcccgggccccaacaccgtgcccagggccccgggcccgagcccaccttaggtcccctcacccggctggagggcatcaaggtgaggacctccctgccccgccgcgctccaggccctgcacggctgagcccgagaggaccggcgctcagcccgggtccccacgctgcncccggcgctgctctgcgtcggtcccgcgcgctcccactcactcgcctgctgtcgctctccgggccgggncgacttggcccttcttggcagcgcggtctggcgccccagctgcccgctgtgcgccttttccttaggtggggcacgagcgtaaggtccagctggtcaccgacagggatcacttcatccgaaccctcagcctcaagccgctgctcttcggtaagtccgcagatactcctgggaagggccagggntgcgnttggtggccacttgaggctcgttggaccacgtgactctatttgaaatggntgcttnagagcagccttncagaggattaccaaagtgaaggaccttccccgtcctcgaaatagggtaacactccctcttatcccaactccctgcagtccattcttccatcacagggctggcagggtgagcctgaggctggtgtctaaacgtttcattgcacctgtcttccgtgccacctggcctccgtgacaaacatatttgcaaacccagggccattcctgcctgccgggggatggaatgggttaggagctggggccaaagtagaacatctgagcacaagtcattacctccaaggcagagggtcctggttggggattatgccaagccctgtcagaatgatgtcatatgcatgctgtttgtagggaaatagattatgctgtcagtcctgttgtgggagaggcacccaaagctggttgttgttattattactattactattgagtaacgttgaagtctgtgccaggcactattttaggtgccaggaacacagcattgaactaaatataaacaatgaaacaaaaccctgaagctgacattcaaatgaagaggaaacagacaataaacaaacaaataaatataaaaaa

SEQ ID NO: 489279 - DNA, 1174 bp, Homo sapiens
  misc_feature (1)..(1): n is a, c, g, or t
nagcaggctggtaccggccccaagtcttatgatcacccccgctcctggagcacgaagatgcagacgatacttttcccggaggcaagagggcgtcttcacgcaggcaccgagaagctcccactagtgtatgccttaatggtgccgctcttgtccgcgtctacgcttgggaccttggcttctgacttggagagtgtacagctctgcccgacggcaacccagcttgggaagagaagccccagcgtgggctggggctcaaggcgcaggaaggccgagcccggcgcggacgcaggcggctccgggcgggctcagcacccccaggcaccgtctcctagtgaccgcggcgctcgcgggcctggcggccgttgtccgggcgactgcgcacgcgggcacccccgcggcccctcccctgggcgcgcgcgcgacctgggtgccatggcggcagcggcggtgacaggccagcggctgagaccgcggcggccgaggaggcctcgaggccgcagtgggcgccgccagaccactgccaggctcaggcggcggccgggctgggcgacggcgaggacgcaccggtgcgtccgctgtgcaagccccgcggcatctgctcgcgcgcctacttcctggtgctgatggtgttcgtgcacctgtacctgggtaacgtgctggcgctgctgctcttcgtgcactacagcaacggcgacgaaagcagcgatcccgggccccaacaccgtgcccagggccccgggcccgagcccaccttaggtcccctcacccggctggagggcatcaaggtggggcacgagcgtaaggtccagctggtcaccgacagggatcacttcatccgaaccctcagcctcaagccgctgctcttcgcatcaccagtgtcaccagcagccacagcccctgctccatcactgccttctgtgccttggccttaatgaactgaggttgagggttttatagggctgttcctgcacccagggagccaacagaggagatcctgcaggggtttgcacagctccgaggtgcccggacccacctggtgaggccccaacatgctgactgggctgtttgtttttgattagcacacagcaggggactgtagaggctggaggcacctccactgggcttgcagattactggcacctaataaactgaagaaacctggaaaaaagaacaa

SEQ ID NO: 489280 - DNA, 409 bp, Homo sapiens
ctggttgctcaggtctcccattacagtcttcttggtcttatgaggcagtttgtgctcctgtaaactccttagcacactaccagcacacccaactgagctttttttggtaaagacagggtcttgctatgttgcccagtctggtcttggcctcaagcaagcctcccacctcagcctcgcaaagcaccgggatcaaggcattagccaccacacctgtcctaaactgtatcatttaatggcttcagacagcatatttaagagttatgcctagattttcttcttttttgatcactacttttaaaacgggcttcaagccgagcgcagtggctcacacctgtaattccaacactttgggaggccaaggtgggtggatcacctgagatcaggagagttcgagaccaggctaaccaac

SEQ ID NO: 489281 - DNA, 415 bp, Homo sapiens
acaaggaagtgccattgctgtctagctagctactgttgtggtcgaagcagatataattaacaaaaacaactggttacaatagccagctatcgatataacatgatcgaaggggatgtccaagttcgctggtaaactagcccttcatcatgactatcagttctattacacatacaagtaattggacgaaggcgtattctgtggggtggggagatttgttaagagccacgtcgcttgtggtacgggtttggaagcataaggaccttatctttcatataggccaaaaacaaaaggtgaaattgatacacccattttatagtgttcccacacagacatattgacaatgttacatagcttgtttatggaagccagagttgacgtcgacgcggccgcgaatttagtagtagtaggcggccgc

SEQ ID NO: 489282 - DNA, 127 bp, Homo sapiens
gtactgtgccggatcaggcggatgtcataggcttcctgtgtacactgagactcagaagtgaaagggggctattcctagttttattgctatagccattatgattattaatgatgagtattgattggta

SEQ ID NO: 489283 - DNA, 110 bp, Homo sapiens
aaaactagtggtcggatatagagcaccatcggcgcagctctacaaggtttcaagccggcttcctgggccgcatgaagacgatcgcctactacccgctgcccgacgaggtg

SEQ ID NO: 489284 - DNA, 1355 bp, Homo sapiens
caagtctcgtggcgatgaccagtcattcaatcgaaacatccgaaaactgcagttgtgatcatatgcggacggaaaggtacaaggcgaccccaggattatatcacaggatgaccggacctaggccccagtggcaaggaacctttactgaggagctgtacatcaaagaaaaagggttctttaggtcacccaccacgggccccatggctgccgtgcagcatggatcctgagctagccaagcgcctcttcttatgagaaggggccactgtaggtacatacctagaacatggcccaaggcgaagcagagttatgggatatagactaataaactacctgggagcgtacgggtcccaagatgccgggagcgtgaagcatgataccctaccagagcagtaccactgtccatccgactacagactgctgctggacgaccggctagatacctgacaggaagtgaggcccatcagtcatagggttaactatcgcttcagccttgcaccaagcggaagggctggacagtggctagcaggctagggaggcaccactacaagggaaggaggtaagaccctgtactcccaggcaccctagagtgctggaaggtaggagagccactagagggcacaaacgctaccagcgacgctggacagagttacctaggcagcacgataaccgcaatattgcccatgccctagacacagaaggtgggatctgcaacatacaaccaaagcttccagtcaatgcgaaaaggccaaacaggtcagggagcaaaggcgaagaaggacccgacgtacatcggacaggaatcctgggagcgcatagaaaccggagtgtgcctaccctgggggcagactgcccatgggcagggcaacagccacgagaaccgccgtagagcgtgcacgcaatcgaaccccccgtaggagggacaacaggagggggaacaagcgttgacccaagcaggggacatgggccccggcgtgaccaacagaaaggacgcccaggagacccggacaagaaactaccagacgaaacaaaaagacagacacagcgaaataagatcccccaaggggcgggcacagcccggccagagaacaacaagcacaacaggaggggcccgagacaagccctggaagacagtgagcacaaggaagaaaccgcagacgccccaggagagtacgagcacacaaagaaccaggcgacccaagagaaagcgcggaaaaagacggaaagacaaaacagacacagacacatagacacacaaaacaaaaaaagaaaaagcacgtaagagagcagaaagaaagaaggacacaagaaaaaacaagagaaggaaggtaacgaagaaacaggaaacaacaaacaaa

SEQ ID NO: 489285 - DNA, 92 bp, Homo sapiens
actttgactccggttttggaaccttacctctcctccttagccccaaatgctgtttcgggtcctattcaaaaaaagttatttctcctggtcta

SEQ ID NO: 489286 - DNA, 191 bp, Homo sapiens
ggcacgagggccagtggtgcttaatgctgtgaccatggcatcttagcccgcacacacaggttcagatcctggctttcagatgtgcttctctgttagttagggatagatatgtaacctctccagccctttgttttggatgaaaggtgcgttattcacctcaggggattcatccattagtcctgtgagagcct

SEQ ID NO: 489287 - DNA, 393 bp, Homo sapiens
gactctagagtgatcccgtagccacctgcaggtgcttcatcctcaccctcccacacttcctctccgagccctaccagtacaccttggccagcactggtgagtggcctccaacccctgcctcaaggggtaaggaatgggtgaacatctcacaaagttagtggggatactcctagggcagtggataccactccaggaagagggcatatgaagctcacactataccgaagtatgtagagctatggagcaactgaactctggtttgttcaggaaagtgtgcagtgcatggctcacctcctgctgtgattccctgtgcttcatgccaggaatgacccaagctccacctccctggggacactgtgagcagtttctgcaggtgggtacttgggtaccgag

SEQ ID NO: 489288 - DNA, 484 bp, Homo sapiens
ttcgagaccagcttggccaacatggtgaaaccctgtctttaccaaaaatacaaaaactagccgggcataggtggtgcacacctagcaatcccagtctactcagagaggctagaagcagagagaatcactatgaacccggagaggcagaggctgcagcgagccgagatcacaccatggcactccagcctggtgatagagctagactccatctcaaacaaacaaacaaaaaaactcaagggagtggctggggcatgaaatcttgcagtgcttaagaagttaatgcatcacgacaacgaagatcattgcagaaatgtgggagctttcagctgctgggtcttaaaaaaccaacacccccaaagtacggtgctttgtcctgctgaactgaagaagcctcaagatctctctaacttccccctcctgcttcctctgtgtctcccgatgcacaggatgcagttgtactctgaagtttcctgaagtctggaca

SEQ ID NO: 489289 - DNA, 419 bp, Homo sapiens
caggtgttcatttatatctcgggcatggtgtctagtgatatatcgacttaagcggtaacaaagaagcatatgtaaagaaatacaacgatgcaaataaatgggcgtgcccaaggctaaaagatgctttcttctttcacagactttaaagttttataagtcatatcgtcagttgttgtgtaacaaatgcccttttcaagaatagagaaagggtttccttcagccctctaaaccatctcaaattccaaattaagtaaagatactgcatttggttggtaaattaactcaatgtcttatacttgttaaaaatacttgattcaaattctagaatcaatattctcaaggtaggatttataaatggtggagagaaacttaggtgctaccagtgagaaaccccactctagccagcaaaagtcttcatt

SEQ ID NO: 489290 - DNA, 652 bp, Homo sapiens
tttcctgggtgggaccttaggaatccagtgccctgagactatgtctttattatttatgcctagtatctcagtcttcccacactggcaaagagtatagcaactggtggttagtgataattgacaaggttctgtccaggctgcttttttgaggtctttgttttagtaagctatgaatggagctgtctcttgcatgatgaataaacactctaccattgtctccactgcccctagctgtagtactggctgataggattatggtggaaattgtgttattggtaatctttgagccttgagagaggtagaaattgttcagaaactgtgtcctctggtttctaaatctattccccacgtgcctccaattttcttgtgctgtgcattttaaattaatcatgttttttcttaattaaatactctttcacagcaatgatttccaactctggctgacgtaagaattgctggggaagtttgaaggggggaaaaagaaagctctggggtggagtccaggctttgatagttttttttgtttgtttgtttgtttgttttttttttttgaggaaacctattgatatatgtatttgattgactctaaaaagttgttgtattggaacatgaagaaaacatttaaataaaacaagattctgaaacaagcaaa

SEQ ID NO: 489291 - DNA, 427 bp, Homo sapiens
  misc_feature (169)..(169): n is a, c, g, or t
ataccacgggctgtacgaatttgggacgagggcagccaagcaaaccacacactcttgatcaccagatgtgtgtatcacagagagcggtgagtatgtgagtctcctctattgtgctgatggactaccacactgtgaaggccagagggtgggtgtgcctgaataaccttcncttcactggacagtgtcccccagttgtgggaccaagtctattttgagcttgaggtgcacaatcttaaggtgggggcctcaagagagggcacagacccttaatctcttgttctttccctggctgtaacaagctgtctgtcccgccttgctcaacaacttggttcatatgattgagcgcgggaactgtgaacaagcccctgtccgtggtgggccccttaaggaatagcaccgttgggcccctggccttttagcacgggtg

SEQ ID NO: 489292 - DNA, 432 bp, Homo sapiens
cattccgacatacactcatgtgtcaatgccagtatatataattgcaggaatactataggtatttatatcataagtaaattattttctttactctcaatagattattagccacagacttaatctgcttgaaataaacagtaattccaaaacaaaatgtagcagtacataaggattttatgataattagccaattacacagcatcctgaaatgtttcttttagggtaaaatttaatagattgagtagaatatgaaacgaaaatgttctcaagatgttatttatgactatacaaaattgctaatgatttataattcacttagaattcacttagaattgtactttacctgagctattgcatatgaagaatttagtaaaatatgtaatatatagtaactgctcagtaaactttgatacttttattgtctccttccat

SEQ ID NO: 489293 - DNA, 691 bp, Homo sapiens
  misc_feature (233)..(233): n is a, c, g, or t
  misc_feature (367)..(367): n is a, c, g, or t
cctgaacagagacatgcttcaacagacactgaacgaggtgtgctgatatgtgtgttcctggtgcacttcactccctggattgtatcccacatacactagctctctcgacacaaggactaatctcgttgcgcaagcaggtgcttgatggactcttgacatggccagctcgtaagatccgacgagattgggtaggctcctaggtcgttgatggttgtctagatcgatagccttgntttagttgaacttgcgctgaaggttggagccgtcggcagaccgcttacgaggacgcgcgagagcacacgagccaaaacgggcttttccgaaagcgttccaattgggactttcggaggtccctccaacttgttgncgggtggcactctctcttagcgttgagaagggggcacggaactaggaaacggataataaggttaaaacacttaaggaacctttaaattttttccgaacctttggaggcatagttggttccctctaactgcatttttgtaggggttgggataaaacatacctgtacatcttttgtgcggttggccaaaaagttccaggggaccttgttctctccctcccaagaggggcaagtggggtatttcaacccagcgagaggtagcttgagttgccgaattaacgaatgggcggaaaactgtggggcgccacattgaaggaactggttggg

SEQ ID NO: 489294 - DNA, 116 bp, Homo sapiens
gtcacatgacatctgccctcacccacccgaggctctgcccaccgcctggaccactatgtaggttttcagcctttcaaaggcttttattattaacatcatcattacttcagcaggag

SEQ ID NO: 489295 - DNA, 1491 bp, Homo sapiens
  misc_feature (161)..(161): n is a, c, g, or t
  misc_feature (231)..(231): n is a, c, g, or t
  misc_feature (276)..(276): n is a, c, g, or t
  misc_feature (294)..(294): n is a, c, g, or t
  misc_feature (441)..(441): n is a, c, g, or t
  misc_feature (643)..(643): n is a, c, g, or t
  misc_feature (804)..(804): n is a, c, g, or t
  misc_feature (930)..(930): n is a, c, g, or t
ggcgcggccgctccgcagcttagcaggccgggtactcatcgcagatccacgccggggcacaaacacagcacagcagtaacctgacaagtggggagacttctgcaccgagtcgggcaggacctgcattcaggggtagacaatacacaggacaccagagttgnctcgtgtcccgacgcggaggtaggccgcgtggaggccgaggacctcgtgacgtacgatcagatcggatantctcagggcagggggaccctcagtttgcgcgggacgtgtcttaancgtcctcttccatcccgntctttaagaagatcacgtatgacctatgcgagaggcgtccgatgcgatgcgcgcgagctccggccaggctgagactcattcgtcttctgcagggggagcattatggtatgtgggtgggatagaggatcgtatgtgtggtgcagatcnctggcagcgactcatgtgtacacactattcccaggagagggtttgtaactcgctcacattcatcaaatgtatggcgtggcatctacgtggcggaagaagtcgcgcggaaaccaagaacatggcgcgagagaacatttgcgcatggacacgactagggggggactccatacaaggaggggtcccggggcgaagtctcctgggnccgacgaagtgtttgcacgcaactcgaatacacctgggggggggtgcacacgaaaggcacggggacccgagaagcgtccagaaccgatggaatcagcacattggcggatgacgctggggactcgggagagagaatagcatgtagatggctggggacacgcntcggagggggggggggaacacaagaggattttggcgtgagagccggggaggccaattgttgggcacaggggcgggggaaacaacggggaggacctgtgggcttgtacggcacaaaggggaaggcangaggggaaagtgcgacagtttggggcgtgaaccaccgagggcgggaaatttcggcgctgagtgggggatcccacggttcgggttttttttgggcctttggtcatggggtccaaatgaagtatacaaacactttacgacagcacaaagatcaccgagcggggagagatcacatccctgggggggaggaaagacccccaaaagcggcccatggggcggttaccatgaggcagccacgacaagctaatggggggaagacacttggacatgaaccctttccgtgagcccggggaaccctgtggcaacagaaaagattgcaagaaaacgggacaacgaacggggcatggccccgagactggcgtccctacacccacggattggcgcctccgggacaccgctgggccccacgtagtccccatagtaccgggggcgcccggaggtggaggcgggggcaactcacaccccggcgcgcaaaatgactccgagagggccgaacaaaataggccggcggctaacacaggggacacgcggggagaaaacaccaccaactggggggggacagag

SEQ ID NO: 489296 - DNA, 164 bp, Homo sapiens
ttttaaaaaaaaataaaataaaataaaagccgggggggggggggggggtcctggggcccccgctatgggggggggttgtttgggccccggggtttgggggggcggggggccaggtttaggccaaggccccccggggggggggacagggccgggtcctttttcca

SEQ ID NO: 489297 - DNA, 693 bp, Homo sapiens
gaccaggactagggcatgcgatgatccaaccttgctcactgacggctttcagtgcccggcatggagctctgcgcatccatagactgcctatgagtgtgcatgtgcacaggtctcaacagcagaggaacacgagtatgtgcacattgctacattgcattctagatcaggatggatgtcctattgtcggcatattccttggcaaccctagcagtgggtatcaagattggctcttgacccatcgtaagggctgtaggatggatcctctacggtcttgtcaggttctgttgcactgattgtcggactgtgcatgcctgcttgagtatcaataccatcatgcgtagtagggctgagcttggtgatgagactatgctaagctattgcataggctgaaatgatgcggacacctaagaggactatgcatgaaggcctgattactgtgtcctggtgtacatagactagcgaggcatattgggccatgtggagactctctgtgacgttggagactcttactaaggcgttgagagtctgactcccgatgctggatcccatgccgttcgggcctcagaggtcaatgaatctcagctgtctcttatggaggatctacgtgagccaactctctcatcgccttgcttgatccatgccctgtgaattattaccatgatcacaggaacagttttgtaaccggctgactcc

SEQ ID NO: 489298 - DNA, 1089 bp, Homo sapiens
  misc_feature (370)..(370): n is a, c, g, or t
acaatgactccgaagctccaggctctgatcttttttcgcgtgttctcggcttccactgcagccatgtcagctccctcttgctggtgagtctcagacccattcacaatcctgcattcttattagctgctttgtctgtggccagctttggaccatgtccttggtggagtttctccctgggaaaagacgtccctgacagtctcatggttacagaactcgctactgttgcggaactaatctgacaacacataaaaacagtgggtcgctgcacgtttaatagtacacgctgcatggacattggacttgcgctcgagagagccgagttggcatgggtctctctattgagtgtcgtctccgcttgctatgtcttctngcgtagtcgtcgtgccgttcaatccttgtgttcgattgtctcctatgcctcatacgactcgattagcagagctgagggcaggcgtcttcatatcataattgcgcatccagagacgtcgtttgccgagctttttggcgacgcgagtcggtggaccgggtgtctttacgtggccgtccgttgtatctttatgctcatctcattgctcgagtgagattccgtggtagaatgctagcccgcgtaggtggcggctggctttcggtggattctgcttgtcgcgcactgggccttgtgcgtgggctcctatcgctcgcgcattcggtcactgcgttccagcggagcgattcgatcttgataattccaggactacgggtaagctggtagttttgggcggaccccaggctgcggatcttgggttagacaccttgcgatttcacatggacacacgttggggacgcaacatgaggaccaggcatgggtacccaccaagaaaaagaacattaaatatccgtatagaaaatgcagtgcgcaacaacctgcggacaaaacacaattattgagagacaaaggcgtacattgtctaattgacaccttcccatattgtccacgaaagtaggatcagataacaacaaacgggaaaagtaaaaccccgcttgtgtcggatccccaaaggaacaacagagaacacagatttgacgaatatcactataagaacatcacta

SEQ ID NO: 489299 - DNA, 506 bp, Homo sapiens
tactacccccttcttcctatgtcctggtccctgtagacctctattctgcttcctccatgacttagactattccagatatctcatgtaactagtcatatagcactggatttggtgtgcgtatggttgtgtcattttacagctcaacataatgtctccaaggttaattcatgtgatatagcatgtgtggaatgtcattgtgataggctgtgtactagttacatcgactgtctacacatttcgttaatccattgatctattcacggacacttggatggcttctacctttgggcgtgctgtgactagtgctgcctgtgaacctgtctgtaccaatatctgtctgagtgcctgcctgcacgactatcgactgtagacccagaactgcattcgctcagtcatacggtaattctatctcgcactcttcagaggaatcatcatggcatttgccatggcagccgcatagtactacatttccaccagttatgcgcaactggtgcgccactcggggc

SEQ ID NO: 489300 - DNA, 192 bp, Homo sapiens
gccttacactgggttcgagttctgtaaccggaatgaatctggttctcattctgggaaattaatgagactactaatagtctcccaatgtctatttgctactcttaccttgggagcacatccctgctttttttttttttgggaaatggattttccccttttgccagggtttggggccaatgtggcccacctttg

SEQ ID NO: 489301 - DNA, 300 bp, Homo sapiens
aaaaaaaaaaaaaaaaagggaaaaaaaatgaaaaaaaggaaattctcaaattctcataaagagagggggaaagggctggatgggtgtgggattttataattggtttccagaattttttaccatctgggtggaggcatatttctggaatagtttttccgggtctaaatttcctctcataaagggacaggattggatatccgggagtcatcattctcgggaaatctcagtttaactcagacgggtgctatatagagtattatgttcatgcccatgtttgttgtggggggagagacccagacg

SEQ ID NO: 489302 - DNA, 529 bp, Homo sapiens
  misc_feature (242)..(242): n is a, c, g, or t
  misc_feature (460)..(460): n is a, c, g, or t
aaaaaaaaaaaggattagtgaaagttacatgcatagtaggtagagatgatgacagaagaaaatgtgacagataaactgacgtggtacctccaagagttatgagggttaatactgatggttctgtatatttaaaaggggaggaatttaagtgtcagtaaggaaaaggagactatcaaaaataaccaagagaatttggatagtccaaatagaagttgtagaaatcacaggattgataaaatagnagattagacatagctgaaaaattagtaaacaagagaaaaaattttccagaacataccacggagagatgaaaagatggaaaatgtgaatgcaagtttatgtaacatgaagaatgatgttaacccatttttaacagaaactcaagaagaatataataaaaaagaatggagaagaggaggagataattccaagagataatggttgagaatattttataatnaatgaatgacatgagcctttaaatacaggattaacataaaatccaaatagagtaaataaaattaaattg

SEQ ID NO: 489303 - DNA, 174 bp, Homo sapiens
actctagaggatcacctctatactaaaaatacataaaattatgctgagcgcattgttggcacactcgcctgtttatccctatgtctactcagtgagtgctgaggcactagaatcacttcaacccaggaggcggaggctgcagtgagctgagatcacgccactgcattccagggg

SEQ ID NO: 489304 - DNA, 911 bp, Homo sapiens
gagtaacgaaaaggcggttctctggaagctgaatgccgtttgcggtgccctaagaggccgtgactctgtatgcttcgacactccagatgcgatcaataccttggcttcattagtcctcaagaaatttcttttcacggacgcagaccataatcgcctaggaatctaggatagtcgagagatgcaagcgacagtagcttcctttgctcatcctgagcctcgcatatcttaggcctccaaatgcgcatagtagatctcatccatgatggaattaatacgaagatgaggtatgtcagatgttattgatctatgagagctctgatatccttggtatgcttagtttaaactcctttagatctgaagactgcgaactattccctggtgctgacagtggcctcagctcttcatggtcagctgcaggtcgccttgtgacgaatgtttgctgtaaatgacctcatgtttcatgggagatgccttgtcacgaaaacgctgccaagtgacatggtatttcgggcagcttatccagcatttgaagcctttgtctggttatttgtagtctattttcaaacttatcaccgatgtgggcactcttgcaaaagctgttggtcatgctgtggcaagctcttgaccttattctgacttcagtcacttcttgatatgactttgatgttggccatctttgcctctggctttcgtcatgcccattgacagtctcaacaatatcgtgaaagactatatcggactcaagtcccactgggtggtacatgccctttcttcttcttcttcacatagccattatttttcgatgaattttagatctttgcaggaagaaggtttgaacgaggagttatatctaagttgtgagacctgagtctctatgttctgggcggaggttcctggggtgtttggcttcc

SEQ ID NO: 489305 - DNA, 438 bp, Homo sapiens
ctgcagcctgcccgtttatggctgaagtgagccacctgtccaagagacactagctactttgtcattgcagtcctcagatgatgaggacagtgacagatccaatcaatcacagctttctgctgagtgctctagaaggaagacctctggccacgtatacactccaaggaccgtgagatcaactgtgatgctctctctagaaagatgcggacaatcaattggccatcaggcttgacaacagggaagtcatatgtgctcttgttaagaatagacaggtgtcgggagggcccggtggctcacccctgtaatcctagcactttgggaggccaaggtgggtggatcacctgaggtcaggagttcaagaccagcctggacaacgtggtgaaaccccatctctactaaaaatacaaaacttagccaggcgttgatgccaggtgcctg

SEQ ID NO: 489306 - DNA, 860 bp, Homo sapiens
ggtctggagttttggggtgctgctgtgggaactgctgaccggggaggtgccataccgtggcattgactgccttgctgtggctatggcgtagctgttaacaatgctcacactgcccatcccaatccacctgccccgagcccttcgcacagcttatggcgactgctgggcgcaggacccccaccgcaggcccgacttcgcctccatcctgcagagttggaggcgcctgaggcacaggtcctacgggaaatgccggggactccttcctattccgtgcaggaaggctggaagcgcgagatccaggtctcttcgacgagctgcgagccaaggaaaaggaactactgagccgcgaggaggagctgacgcgagcggcgcgcgagcagctggtcacaggcggagcagctgcggggcgcgagcacctgctttggccagtgggagctagaggtgtccgagcgcgagctgacgctgctgctgcagcaggtgggaccgggagcgacgcacgttgcgccgcgccgccgggacaatccaagcgcagcaagctccgggcgcgcgacggcggcgagcgtatcaggcatgccacatcgacttcaagtcacgcatcaccgtgcaggcgtcaccccggcttgaccgggaggagaaaccgtcttcgaggtcgggcctggggattccggccactttccccggttccgagccatcacaagttggagccctgcagagccaggccaggcattgtggggcgccatttcccccgacgtctggaggactccagcaatgagacgggggaaagcatgctgggatgtggtcccagtcccccagcctgcggaagcccgaatggacgcgaaggtccgcattgcgagccacat

SEQ ID NO: 489307 - DNA, 387 bp, Homo sapiens
tatatgcggatcgcagacaaattagttggggaacacctgcagggcgtatgcgtagatggcatcgtgtcatcacttccagggtcatcgtgggctacactactgtcagcatcctccatccaggtatgcttccgatcttcctcctcaatcccaatcccaatcacggcacgcatgacggcctggcaggtggccacactcccagccctgtcacattcctcggcatcctggatccactgctcacggttgatctccacaccgttggcccgcagcgaggtgatggctcggtcgatgatcttctccaccatctgcgtgttcccattggcttcctccagcttagcagccgtgatccagatatgtcggtctgtaggaatgttctcccgcgccttgttc

SEQ ID NO: 489308 - DNA, 435 bp, Homo sapiens
tgctccggctcctgcttgcttgggagtcccggatccgctgtcgccactcggggcccttccgcagaggcgccctcctttccggcgtgggagtcttcagccaacctcccacaatcaagttccccccttctcaggaatggaaatagccatcccccaatttcctagattcccgccgtctccccgtcccttcttccccagggtggaagtcttgaaaccaccgtcccctcctctcttccaactgcctccctccttactgagaatggaaatccactactccctccctctctcccgggtggattccctcggccctgctatctggtctattacggccctcttgggttccgaagaccaagctctgtaaacactcccatttctaggccaccttgttctgtttatgtcccttgtgcaatatcttccctactgctaaaaatcctttgg

SEQ ID NO: 489309 - DNA, 129 bp, Homo sapiens
caaagtctggtcctggggagggaatcccagtgactgccatttacagagcagctcatcttgggacaagagcattacagccatcgtgccatgatatcacagctagcccagctgagaagcgggcttgatggc

SEQ ID NO: 489310 - DNA, 450 bp, Homo sapiens
accccggacgcattcagagtctgtgtgtgattcaccatgtaatatagaataagtgaggaaatgtgtgcaggtcatttcaacagatagaaaaaggcactcgataaaattcagcactcaaggaggctaaaaaactcttggcaaactaggaatagataggagtgcctttaatctgccagaaggtatcttcaaaaaccctacagttaacgttaggcttactgagggatgttaaagtcttttctcctaagatagaagataaaactagggcatctagtactgtggtttctgttccccattgtgccagaagttgtatccaacgcagtatggcatgaaaaaaaagagtaggattgagaagaaactgtgtttcatagacagtgtgattatgtccatggaaaatccgaacgcacctgtagcgtgctgtcagaattcatcagtgaatgcgtccgtcgaagt

SEQ ID NO: 489311 - DNA, 127 bp, Homo sapiens
gatctggtaccagcggtaagaagagcgagcaggttccatctggagatctcataccccgagactggtgtggcgagacaagggaggcaagacgagcactcgttcccgaggctcgtagatgcttgttgta

SEQ ID NO: 489312 - DNA, 616 bp, Homo sapiens
  misc_feature (51)..(51): n is a, c, g, or t
  misc_feature (62)..(62): n is a, c, g, or t
  misc_feature (67)..(67): n is a, c, g, or t
  misc_feature (71)..(71): n is a, c, g, or t
  misc_feature (75)..(76): n is a, c, g, or t
  misc_feature (85)..(85): n is a, c, g, or t
  misc_feature (97)..(97): n is a, c, g, or t
  misc_feature (106)..(106): n is a, c, g, or t
  misc_feature (109)..(109): n is a, c, g, or t
  misc_feature (130)..(130): n is a, c, g, or t
  misc_feature (139)..(139): n is a, c, g, or t
  misc_feature (142)..(142): n is a, c, g, or t
  misc_feature (144)..(144): n is a, c, g, or t
  misc_feature (147)..(147): n is a, c, g, or t
  misc_feature (157)..(157): n is a, c, g, or t
  misc_feature (170)..(170): n is a, c, g, or t
  misc_feature (184)..(184): n is a, c, g, or t
  misc_feature (189)..(189): n is a, c, g, or t
  misc_feature (198)..(198): n is a, c, g, or t
  misc_feature (200)..(200): n is a, c, g, or t
  misc_feature (224)..(224): n is a, c, g, or t
  misc_feature (226)..(226): n is a, c, g, or t
  misc_feature (244)..(244): n is a, c, g, or t
  misc_feature (292)..(292): n is a, c, g, or t
  misc_feature (297)..(297): n is a, c, g, or t
  misc_feature (306)..(306): n is a, c, g, or t
  misc_feature (340)..(340): n is a, c, g, or t
  misc_feature (354)..(354): n is a, c, g, or t
tcgtttttttgtgaattttcttcttgcgtattcatatagtgcttggttggnctcctgcaggntctcntgcngggnncaggaaganttggaaaatgtnaggggggtnggntgaggggtcaccgggccaganttgggaaanttngnggnagaggctgtnggtagggactganttcccttggtgatnttttnaggtatgananttacggccccctcaagcagattantnatagttaagtttacacanccagttttggtcaggtttttttggatgatacccaatggcacatggggnaaaanttccttgantctctgagccagagttgccagttgcacatggggngaaggaccgggggngggagggaaagaagactgggctgactgggggcgcaatctggggtgtctttgtcgcttcatgtgctctgctttgtcagctggagtgagccgtgtccctgtctggcccaattccttggccaccagctgttgtacacggagtcaaactcctcattcgcttcccctagttggcgatgaacaggacgaagccaccttacttgatacaccgtgaaagggacgaaaagtgaccacagcagttctgagacccaggaggcatctgacaccg

SEQ ID NO: 489313 - DNA, 189 bp, Homo sapiens
gatggctcatgatggagacatcagaaatagtcaaaccacatctaccaaatgccagtatcaggcggcggcttcgaagcctaacagtgactgtttggatgtaaagtgtatatattagattgtgctggatgaagcagatgatgcaggataagttgagccaataatgacgtgaagtccatcttgagcctgtgt

SEQ ID NO: 489314 - DNA, 378 bp, Homo sapiens
  misc_feature (64)..(64): n is a, c, g, or t
  misc_feature (69)..(69): n is a, c, g, or t
gttgttaaaggtttttcccccaagaatatttcctttgggtggggaaaaaagggggagcgggggnaaaanttaaaaccccccccttccatggtgggatccggggggtttttttttttttaaaaaaagtttcccgtggaaaaaaaaaggggggaacaggggaaatttttttttttttccgttagggatgggggtttggccaaccgttttacgaaaaaaagccttttccttttttcgggtaaattaatgggagggccggcaagcccccctttcccgggtttttggggttgggggagaatttttgggaggtaccccgtgtaaatttttttcggggccccgggatggaaattaagcccccagggttgccttggggcccttgga

SEQ ID NO: 489315 - DNA, 316 bp, Homo sapiens
ggggttcccaaaaattcccccccaaaaagttttttttttgggttttcgggggggggcccccccggggccccccccctttttttttgcacccaattttggggggggcccccagggatttaaaaaggggggcccctttttttttgtgggggggcccgggggcccccccgggggtttttcccaaaaaaccccttcccccttgggggggggacccccccccttttttttttttttttttttggggggggggggggggccccttttttttgcccccccccctttccccccccctttttttttcctttttccccccccccca

SEQ ID NO: 489316 - DNA, 748 bp, Homo sapiens
ggcccctttgggggtgccctccaggtttttttttggaggcgcgccgggtgtccacgcatcatatggttcaccccccccgacgtcctctgttcacgccacggttgagcctattttagcgcgctgaaagtggcgtctgactagctttcgggtgcccaccagtgcctgcagggcccctctcctgggcttcacgaggcactctttttgctcaaggttgcctttcctctccctggcctccaggtctccgcctgtgttgtcccccaggttagtagctcgcgcgtcatcgcgcatgctttatgtgcgcctcaacattcttctgtttctctcctcctcatcacccattctgggcaaccccttgcgtccacccatccagatctaacacttctgatttgtcaccataccatgatgtgtgatcaacccctgggagcttcaccgctcacataaagtatttatttcttgcctccagtgttctatctctcgaggctgacgccttatatagaacaatgacctctgctccttttcatggccagaaaattgccacggggcttatgtgcaggaccacttccacgttacatttcctcatggctctccgaactctctaacttataagtgttgtgtacccccacccaggcagtatccatgaagccccagggactagtcctatgatgttcttagcctgttatttttgtgatgatttctgtgctcttcaccgtttgcaaattgtaaataaaacagaaattataaaacaata

SEQ ID NO: 489317 - DNA, 659 bp, Homo sapiens
  misc_feature (177)..(177): n is a, c, g, or t
  misc_feature (347)..(347): n is a, c, g, or t
  misc_feature (371)..(371): n is a, c, g, or t
  misc_feature (390)..(390): n is a, c, g, or t
  misc_feature (469)..(469): n is a, c, g, or t
  misc_feature (543)..(543): n is a, c, g, or t
  misc_feature (554)..(554): n is a, c, g, or t
  misc_feature (592)..(592): n is a, c, g, or t
tttttttgtgtatgagaatgatttatttccgtaccaaggttatcaggcttccagggggcagggctgggaatgaacgtagatatccggggcaaaagacatgatcatcctggctctatccctaggcattccttacagacgtggctacctgctttatgggccccctggttgcggaaagancagttttatgtgagtattcaaaatttctcttaacttggcaaaacgaagcctttgtggaaacactaggctgatagggttggaaggggaaatgaatctggggatcggggaccaggataaacatgaaacgtgtggaacatcagggtgttgaggttaaaatccaggcctctganacacatgtcccccaggcggttgangaaaattactgggcctgangaaacatttcccaggttgcctgctacctccctgccaccccatgctcccatagcacacccctggcttggggaacttggancacagcatcctgcctgctgacctcccccgactcccacctcctcctgaatgaaccgactccaccaccctgctgancctttgccccnccaccaaaaccctggtacccctgaagatttttgaaatncctgctttccccccatccccaaaacttggcttgttgaaaattaatttaagggttttccttgaagaat

SEQ ID NO: 489318 - DNA, 280 bp, Homo sapiens
ggaggtcaaggctgcagtgagccatgatcatgccactgcactccagcctgggcaacagagtgagacactgtctcaaaaataaaaataaaaaaaaaaagacaaacaaatggccaacagatagatgaaagaatgctgaacatctctaatcataagagaaatgcaaattaaagccacaataaggtatcacctcacacctgttagacgggctattatcaaaaaggtgaaagataagtgttagcaaggtcacagagaaatggaacacttatacacggctggtgaa

SEQ ID NO: 489319 - DNA, 832 bp, Homo sapiens
agcagtggctcacgtctgtaattccagcaccttgggaggccgaggcaggcagatcacgaggtcaaaagatcgagaccatcccggccaacatggtaaaaccctgtctttactaaaaaaaaaaaaacaaagcaaaaattagccaggcgtggtgggtgcacgccggtagtcccagataactcgggaggctgaggcaggagaaccattggaacccgggaggcggaggctgcagtgagccgagatcgcgcacgggactcaagccggggcgacaagagcgaaactcggtctcaaacaacaggaaagaacattccctaacttaggaacagaaacgaagacacattaccggaaaaactaccgggtatgacgtctcaagttctccttggtgggcactgggactggactatctggggcacatccccagcagggaatctatcttggtccagaagcctggggagcaaaagagggtagaaggtgtgtcactacccgtcttggctcacaggccagaagcagcgcccgggcacgtgccaaatggctctgggcaaacaagtggaatgcgcggcggaacggggggacacaccgggcggagacaaaacagtgacactcggccctaaagagctgagggacaagggtccacagcaggcacgcgatatccagcccagacctggagcactacggagggctggacgaataggcgaaacaggggacagccgcccaccaccacaaggggcccagcgaaacgggctgaagccagtgcccaaaaggaggacaatggcaaagcacgcaatgccgaacgataaccggaggcccgctagaagaccaggacaggtgcacggac

SEQ ID NO: 489320 - DNA, 105 bp, Homo sapiens
agatcggtcgatcaggttggaagcctctgacaaggtgggccagaacctttggatttggtttgggggctaagaatcacgctaatggctcagagtaacatacaaagc

SEQ ID NO: 489321 - DNA, 167 bp, Homo sapiens
gagcgttgtgacccccagaggagggaaggcaagcgctgcgagccgctccctcaggtctccaggagtctctaagacactcttcccctggggatagtagagaaagttgtcccgatggcacctgatcctgctacagacggacgatcaggttggactttctttgcgcctac

SEQ ID NO: 489322 - DNA, 749 bp, Homo sapiens
ggattacaggggcaccaccacgactggctaatttttgtgtttttagtggagacggggtttcgcagtgttggccgggctggtttttgggctcctgacctcaggtgatccacctgccctggccttccaaagtgctgggattacagtcgtaagcctctgcgccctgctgggtgggcttttttataagtaaaaataaaagttatagaattggctgggcgtggtgcctcatgtctataatcctagcactttgggtggctgaggcacgtggatcacctgaggtcaggagctcaggagcggactggccaacatggtggggccccgtctttgctaaaaatacaaaaattagacatggtggcaggcacctgtaatcccagctactcgggaggctggggcaggataattgcttgaacccaggaggtggaagttgtagtgagctgagatagtgccactgctctccagcctggatgaaagagtgagacaatgtctcaaaaaataataatattaaattaaagtaatagaaattcacggatgacccttttctgttactttctttgaagtgcttccttattccacttatcttcttaactaggcccaaaacttattaacccgacttacaaatccgagattcacattgtcttattgcgttaaactaaagcattatagaccacttcctaattcagttctcggttaacgcgctaacgtcaacggcacacctcttaaatgcacctgggccgactttttttgcgaaccag

SEQ ID NO: 489323 - DNA, 889 bp, Homo sapiens
gagacgttcttcgccgagagtcgtcggggttacatgcttcaacagtgcttggacggaacccggcgctcgttccaacaccccgggaacgggccgaacaccatagacagaccctaccagaaactctacaccgaaacactcggaactggaccaccaaggaccccgacacgaacgatccagagacacggacagacaaacgacgaagaccggaccgaacaatataccataaatacgacgacaagaaagaccgacgatacaacatcgacaggacgagaccagaagataacaagacagagaaacaagaaggcggcaataagagaagagatcaaccgggagagaatataacgacatcaatacagatacaccagacgagagaatgacaaccaagaaacagcgaacagatacagaagtaggaaagacaccaacgacaagaaaaacaaccaataaaccacaacaaactgaagcggagagaggaaacaagaacacgaagaacacacagaacaaagcaagacgaaaccaaaacgagagacgggacaaacataaagacgaaagggaaaataaaagcaaaaccagacacagaagaagacaagaagcgagaggaaaagaaagaacaagacaaggaataacaaggcacacaacagtagcgaacacacgtcaaatacgtggcaagacgaggaacatggcaaaagaaaaagatggacaacgcaacagagcgacaaaaagcaaagaatacggcggagcgaggaagacgcaaacaaagcaacggtagagagaggaacctagagaagaaggaaggccaaagaaggcgaggaaacacgaagcaacaacccaggcacagacacagagacacaagaaaacaaccgaggacacagcaacagagaggggcaccagg

SEQ ID NO: 489324 - DNA, 319 bp, Homo sapiens
acatgtacatacgtcaaggaaaagagcaggcatgtagagaggtagaaataagaccgtattagccagtcaccctagtcgagtgaaagtacaagtgtctcgattggagttaggggaggtaggcaggagaagccagatcactcaagccacaccgaggctttatttctctctaactgtcactggaaaaccattgaaacagaatcaatcacttcatttatccattccacaaatctttactgagtatctactatgtgccagacaatgtttatagaccctcggagatacagcagtgcaccaaaacaaagttccttaccataggcag

SEQ ID NO: 489325 - DNA, 352 bp, Homo sapiens
tacatcctgagatgttggcttacggctgctggtgagggcaagcctgaaaaggcctgggcccctagacgcatctgggcatgaggggcaggtggcaattgctgtgatcgcctgggaccaccgaagaggggcaacacagcatcacacgtgagtatggcttctgcgcggacccaaatgtagaatcagtcgggaagcttttaccattttgctttgccatgttagagttcttctagggtggttcaaaagggaccaaacaaaccatcgatacaaactcgaaggttctaaggagtagcagtgccaccggacaggaaggcctgtaatggaaagcatgtgaacctggagctcttggaaaggt

SEQ ID NO: 489326 - DNA, 142 bp, Homo sapiens
cagtggaggtaggtatgtagtaagaggccactatactgcccataccgccctaacccaaatagtatggcagggaaaattttttatgacatacacgaagtgtctaaaaaggaaaaaaagtagttgagtagggggagaataacct

SEQ ID NO: 489327 - DNA, 239 bp, Homo sapiens
gacattgatggctgctgactgcttagggtgggggttgctgaaggtggggtgacagtggtaatttcagtgatttttggtttggtttggtttctttaagagacagggtctcattctgtcactcaggttggagtgcagtggtacgatcatagttcactgcagccttgatttcccgggctcaagcaatccttctgcctcagtcttcccagtagctaggaatatcaagaatcggcccgggtacc

SEQ ID NO: 489328 - DNA, 127 bp, Homo sapiens
agtaatatattttattatttttgagacaggtcttcctctgtcacccaggctggagtgcagtggcaacatctcagctcactgcagactcgactctaatgttcccttggatattacttagtaaaggcca

SEQ ID NO: 489329 - DNA, 264 bp, Homo sapiens
ttttctatcccagtaatttcatatcccgccttactaagattcataagataaggagaaataaacaactagtttacagactagcaaatgctgagagattttgtcaccaccaggcctgccctataagagctcctgaaggaagcactaaacattgaaaggaacaactggtaccagccaccggtaccaacatgccacactgtaggaggaagaaactaacaccaaaacacaagccggtagttctggggaaatgctggcagaccaagggcg

SEQ ID NO: 489330 - DNA, 116 bp, Homo sapiens
tacagcactcaggtatggactatgtacataacaatacaagaggcgtttgtttccacggtggtcactatataaattgttctgtgtataaataaaacaagcctgtttttgatcttcca

SEQ ID NO: 489331 - DNA, 146 bp, Homo sapiens
cctttttttccggaaaaaaaacaagttttctttcaaaaagggaaaaaatgggggcccccccaccttttctgttaaaggggggtttctttatatggccaaccgggtggaccccggaatgagaaaaaaccgccccaagttttttttta

SEQ ID NO: 489332 - DNA, 898 bp, Homo sapiens
ttacaggcgtgagccaccgcgcccggcctagatttctaagggagggtattatccattcatgaaggtccaaacccatgaactaacacctcccagtaagccccacctgcaacgttggggatcaaattttaacaagagattggtaggggcaagcattcaaaccatagtaagagttaaatttcctttttaaaaaaatcactgatatgattccatttcgccatagataagaactagtatttcagcctaccatcgagtgtgcttatagctcaccgaaagggcactctgtctcgggaatacagatttgcctagaggtatcctagtgcagtcaaaggaagcgcaatgagggatagagaaggttagtgatggagacaccagcgctgcattttgcaaccaacaatgtaaaaattttacggtttggttctgctaacttactacagtttacattcctctcagctgggagaattgttgagttttttcttaagatagaaaagcaattcagacaatctgaaatctccacaagaaggataagaagcacagcagaagctattctaggcaggaagtcaatccattcaactgtctgtgctccaaacaattgtctgcactgggagtcgtacgaggtacagacaacagccagacctctgatcctctcattagtgatttcagaagaaattaccagtcagctgagtaattcactgagtaaacatttggcactgacagaggttagacggataactatttgtatcaccatattcatgaagctggaatattttccattacttgtatcatatatgaatggaagatgttaaaaggcctctcatcttgtaagatggatatgaaagaacactttctgagaaatgaaattattcacacaccagcgaggtggatggaagagaaaaaaaaa

SEQ ID NO: 489333 - DNA, 186 bp, Homo sapiens
cccgactagcccgacagtggccgcgcccgcctacagccgcgcgctcagcctggcaactcagcagcggggtctcggagatcctggcacactgcgtgaccgctggctgcgtgtccctgtgatgtcaaccactatcgccccgtgacgagctgactggtcaatgaccaatggatggctgtggtgtgagat

SEQ ID NO: 489334 - DNA, 1020 bp, Homo sapiens
gcacatttgctgagtggcaggaatctaatagccactggcatatcagagatcaagaaggtttacacaagatgctgggaacatttggtagaaaatgagaaaggactcaaggagaacttaccagcagatgtatgtggtaaacataccagtgctaacagttcagatcaagagcgaggagacaattagaccactgagtcagggaacctcctggaacactagcatggagagccctgatagttcccaagacaatgacatcaacaactcagatttatctgaagatgaaattgctaaccagagatatggattattgtaccaagacatagaggctgataaagatgaggtacttaccctagaatgtagcttagactagccagatttccttaggctctgcttttccttatgtctctcaccaacttcattttccatcattgatctccttgacagatgtacctcttgatacctatgtaagccaaacacaaacaggttgacaaaaaaaaaaaattctaaataactgattgtgctggtaatcagtaaagtccttcttaccattcccattaccgagtctctctctctctctctctctctactctctcctcatcacttattccatgtaacacactaaaatgtgcatacaccacttgacgcaacgaagagattcaacgttccgtggtcacctacagtgtggactccccatccaaataaaaaaacccgagaaaaatgatcaggacacaggcatcacgaaaacggggaaaatcctcggggcaggcagcgcactacagcgatcgatagcgcggagtggaaatggcaggatagcagccccaaagcctagtatcaagagtggcccgtaaaatggagaacgccagggggaagagacgaaacgagcggaacacacccccaatattggagccaagacaaacgacagggatcaggtaagcccatattaagcagacagggtataccacgggagaaaagcgacacacaaaagcaaaaggcgaaatcaagacgacacaagacagacaagaa

SEQ ID NO: 489335 - DNA, 1037 bp, Homo sapiens
  misc_feature (844)..(844): n is a, c, g, or t
  misc_feature (846)..(846): n is a, c, g, or t
  misc_feature (855)..(855): n is a, c, g, or t
  misc_feature (861)..(861): n is a, c, g, or t
  misc_feature (877)..(877): n is a, c, g, or t
  misc_feature (879)..(879): n is a, c, g, or t
  misc_feature (882)..(882): n is a, c, g, or t
  misc_feature (892)..(893): n is a, c, g, or t
  misc_feature (900)..(901): n is a, c, g, or t
  misc_feature (903)..(904): n is a, c, g, or t
  misc_feature (921)..(922): n is a, c, g, or t
  misc_feature (925)..(926): n is a, c, g, or t
  misc_feature (929)..(929): n is a, c, g, or t
  misc_feature (936)..(936): n is a, c, g, or t
  misc_feature (990)..(990): n is a, c, g, or t
agcggggcggctccgcgcctcgcgcccagtccgcgggccgcgccgccgctcccgccgctcccgccgctcccgcagccgccccgccgcccgcccggagccccgcgtccctaggcctggctcccgcctgcccgagacccgcccagcctgccccgctcagccgccagagaagatgcggctgctcccggaatggttcctcttgctctttggcccgtggctccttaggaaggccgtcagtgcccagataccagagtccggaaggccgcagtacctggggctgcgccccgccgcggccggagcgggtgcccccggccagcagctcccagagccaaggtcttcggacggcctaggcgtgggccgcgcctggagctgggcctggccgaccaaccacacgggggcgctggcccgggcaggggcagccggggcgttgcccgcgcagcgcaccaagaggaagccgtccatcaaggcggcgcgcgccaaaaagatcttcggctggggggacttctactttcgggtgcataccctcaagttttcgctgctggtgaccggcaagatcgtggaccatgtgaacggtaccttcagtgtgtatttccgccacaactcgtccagcctgggcaacctcagtgtcagcatcgtgccgccctccaagcgtgtcgagttcggaggagtctggctgcccgggcctgtcccccaccctctgcagtctacgctcgccctggagggggtgcttcctgggctggggcccccgctggggatggcagcagcagcggcggggccggggcttgggggctccctcgggggcgcactggcggggccgcttgggggcgcgttgggcatactaaggccncncgtccgcgnttcccnaacccgtagcgtctananaancccccgagcnngaccccnncnngtgctgtacgccccacnncgnntanttcaagnaccccgcgcaaacaaaaaataatctttgcccgccttcccctccttgtctttggntttttgtgcggttgctcccctggtgcccgggtgggcgctctccttgc

SEQ ID NO: 489336 - DNA, 119 bp, Homo sapiens
gcggccgcctactactactactactgctcgaattcaagcttctaacgatgtacggggacatgttcataaagaggattatttttgtaaaactattaaaagttttgcttttctcgaaaaaa

SEQ ID NO: 489337 - DNA, 1801 bp, Homo sapiens
agcggggcggctccgcgcctcgcgcccagtccgcgggccgcgccgccgctcccgccgctcccgccgctcccgcagccgccccgccgcccgcccggagccccgcgtccctaggcctggctcccgcctgcccgagacccgcccagcctgccccgctcagccgccagagaagatgcggctgctcccggaatggttcctcttgctctttggcccgtggctccttaggaaggccgtcagtgcccagataccagagtccggaaggccgcagtacctggggctgcgccccgccgcggccggagcgggtgcccccggccagcagctcccagagccaaggtcttcggacggcctaggcgtgggccgcgcctggagctgggcctggccgaccaaccacacgggggcgctggcccgggcaggggcagccggggcgttgcccgcgcagcgcaccaagaggaagccgtccatcaaggcggcgcgcgccaaaaagatcttcggctggggggacttctactttcgggtgcataccctcaagttttcgctgctggtgaccggcaagatcgtggaccatgtgaacggtaccttcagtgtgtatttccgccacaactcgtccagcctgggcaacctcagtgtcagcatcgtgccgccctccaagcgtgtcgagttcggaggagtctggctgcccgggcctgtcccccaccctctgcagtctacgctcgccctggagggggtgcttcctgggctggggcccccgctggggatggcagcagcagcggcggggccggggcttgggggctccctcgggggcgcactggcggggccgcttgggggcgcgttgggagtgcctggggccaaagagtcacgcgctttcaattgccacgtggagtatgagaagacaaaccgcgcgcgcaagcaccgaccgtgcctgtacgacccatcgcaggtgtgcttcaccgagcacacgcagagccaggccgcctggctctgtgccaagcccttcaaagtcatctgtatcttcgtctctttcctcagctttgactacaaactggtgcagaaggtgtgcccagactataacttccagagtgagcacccctacttcggatagcgcccctccccagccagtcctgagcctcccgccaaatcccagcctcactaggtgggacccccttcccagtgttctgccgctcctgtggccatgtcgcccactccttccactctgggggcggaggggaatggcttctcgggaccctcagctagcgtgggtgcccttttccttatgcggagtgcccgcaaggctggggtagccccctccagtacaccccaaagtgaaagggataagagtgcagccccagaataggcggggcttggaggcggtcccaatgtcccctgggtccacagtgggtccccttttcacccttggcgctaggctgcgcactccctttccccgcagctttaataactcctggcctggcaccctcaccccaccctgactttcccatcccccagcgcttgtcctgcttcaccctaccccgcctaagactgtaaaggcctaaaaacctcggcctgtcctcccaccattctgcctgccatatgcctgtccccttttcctccaaaccctattagggtaccggaagcagaacccctgggctgaggccctggccctgcccccggcccctgcccctgcccgcccccctccagtccaggcagtcgagctccacctgccctctcctgctgcttcctctcggtgatattttttctacgccaaaacagacgggaaagggaacaaaataaagtgaaatccaatacaaaa

SEQ ID NO: 489338 - DNA, 1683 bp, Homo sapiens
agcggggtgactggcgaagaggtgaggtaataaggacagaagcaaggcaaagaggggtcaggacgaggtaattggatgagagacaacacaaacgtctaaagaaaacaggccgtcagtgcccagataccagagtccggaaggccgcagtacctggggctgcgccccgccgcggccggagcgggtgcccccggccagcagctcccagagccaaggtcttcggacggcctaggcgtgggccgcgcctggagctgggcctggccgaccaaccacacgggggcgctggcccgggcaggggcagccggggcgttgcccgcgcagcgcaccaagaggaagccgtccatcaaggcggcgcgcgccaaaaagatcttcggctggggggacttctactttcgggtgcataccctcaagttttcgctgctggtgaccggcaagatcgtggaccatgtgaacggtaccttcagtgtgtatttccgccacaactcgtccagcctgggcaacctcagtgtcagcatcgtgccgccctccaagcgtgtcgagttcggaggagtctggctgcccgggcctgtcccccaccctctgcagtctacgctcgccctggagggggtgcttcctgggctggggcccccgctggggatggcagcagcagcggcggggccggggcttgggggctccctcgggggcgcactggcggggccgcttgggggcgcgttgggagtgcctggggccaaagagtcacgcgctttcaattgccacgtggagtatgagaagacaaaccgcgcgcgcaagcaccgaccgtgcctgtacgacccatcgcaggtgtgcttcaccgagcacacgcagagccaggccgcctggctctgtgccaagcccttcaaagtcatctgtatcttcgtctctttcctcagctttgactacaaactggtgcagaaggtgtgcccagactataacttccagagtgagcacccctacttcggatagcgcccctccccagccagtcctgagcctcccgccaaatcccagcctcactaggtgggacccccttcccagtgttctgccgctcctgtggccatgtcgcccactccttccactctgggggcggaggggaatggcttctcgggaccctcagctagcgtgggtgcccttttccttatgcggagtgcccgcaaggctggggtagccccctccagtacaccccaaagtgaaagggataagagtgcagccccagaataggcggggcttggaggcggtcccaatgtcccctgggtccacagtgggtccccttttcacccttggcgctaggctgcgcactccctttccccgcagctttaataactcctggcctggcaccctcaccccaccctgactttcccatcccccagcgcttgtcctgcttcaccctaccccgcctaagactgtaaaggcctaaaaacctcggcctgtcctcccaccattctgcctgccatatgcctgtccccttttcctccaaaccctattagggtaccggaagcagaacccctgggctgaggccctggccctgcccccggcccctgcccctgcccgcccccctccagtccaggcagtcgagctccacctgccctctcctgctgcttcctctcggtgatattttttctacgccaaaacagacgggaaagggaacaaaataaagtgaaatccaatacaaaa

SEQ ID NO: 489339 - DNA, 174 bp, Homo sapiens
atcagagcataccctcatccaggcatatttgctgctccatttgagatgctgccatcataagatacacgtcttaactcttagcattaggagccccagtgaactattctctgaatatcacaacagaatctctcttatttttaattgtgaatgactactataggtagagctcgcgaa

SEQ ID NO: 489340 - DNA, 1802 bp, Homo sapiens
  misc_feature (1783)..(1783): n is a, c, g, or t
agcggggcggctccgcgcctcgcgcccagtccgcgggccgcgccgccgctcccgccgctcccgccgctcccgcagccgccccgccgcccgcccggagccccgcgtccctaggcctggctcccgcctgcccgagacccgcccagcctgccccgctcagccgccagagaagatgcggctgctcccggaatggttcctcttgctctttggcccgtggctccttaggaaggccgtcagtgcccagataccagagtccggaaggccgcagtacctggggctgcgccccgccgcggccggagcgggtgcccccggccagcagctcccagagccaaggtcttcggacggcctaggcgtgggccgcgcctggagctgggcctggccgaccaaccacacgggggcgctggcccgggcaggggcagccggggcgttgcccgcgcagcgcaccaagaggaagccgtccatcaaggcggcgcgcgccaaaaagatcttcggctggggggacttctactttcgggtgcataccctcaagttttcgctgctggtgaccggcaagatcgtggaccatgtgaacggtaccttcagtgtgtatttccgccacaactcgtccagcctgggcaacctcagtgtcagcatcgtgccgccctccaagcgtgtcgagttcggaggagtctggctgcccgggcctgtcccccaccctctgcagtctacgctcgccctggagggggtgcttcctgggctggggcccccgctggggatggcagcagcagcggcggggccggggcttgggggctccctcgggggcgcactggcggggccgcttgggggcgcgttgggagtgcctggggccaaagagtcacgcgctttcaattgccacgtggagtatgagaagacaaaccgcgcgcgcaagcaccgaccgtgcctgtacgacccatcgcaggtgtgcttcaccgagcacacgcagagccaggccgcctggctctgtgccaagcccttcaaagtcatctgtatcttcgtctctttcctcagctttgactacaaactggtgcagaaggtgtgcccagactataacttccagagtgagcacccctacttcggatagcgcccctccccagccagtcctgagcctcccgccaaatcccagcctcactaggtgggacccccttcccagtgttctgccgctcctgtggccatgtcgcccactccttccactctgggggcggaggggaatggcttctcgggaccctcagctagcgtgggtgcccttttccttatgcggagtgcccgcaaggctggggtagccccctccagtacaccccaaagtgaaagggataagagtgcagccccagaataggcggggcttggaggcggtcccaatgtcccctgggtccacagtgggtccccttttcacccttggcgctaggctgcgcactccctttccccgcagctttaataactcctggcctggcaccctcaccccaccctgactttcccatcccccagcgcttgtcctgcttcaccctaccccgcctaagactgtaaaggcctaaaaacctcggcctgtcctcccaccattctgcctgccatatgcctgtccccttttcctccaaaccctattagggtaccggaagcagaacccctgggctgaggccctggccctgcccccggcccctgcccctgcccgcccccctccagtccaggcagtcgagctccacctgccctctcctgctgcttcctttaacggtgatagtttttctactgcccaaaacatattaaagggcaaggggancacaaatttagtatccact

SEQ ID NO: 489341 - DNA, 134 bp, Homo sapiens
cacgcgcatatgggagtggaggttacggaaaaactgcgcggcccaggcttgtctctatgtcaaccatgtctccgctcgggcctgcctccatggcatcatcatctcagctctggctgagtgttgccaggtaggaa

SEQ ID NO: 489342 - DNA, 1566 bp, Homo sapiens
agcggggcggctccgcgcctcgcgcccagtccgcgggccgcgccgccgctcccgccgctcccgccgctcccgcagccgccccgccgcccgcccggagccccgcgtccctaggcctggctcccgcctgcccgagacccgcccagcctgccccgctcagccgccagagaagatgcggctgctcccggaatggttcctcttgctctttggcccgtggctccttaggaaggccgtcagtgcccagataccagagtccggaaggccgcagtacctggggctgcgccccgccgcggccggagcgggtgcccccggccagcagctcccagagccaaggtcttcggacggcctaggcgtgggccgcgcctggagctgggcctggccgaccaaccacacgggggcgctggcccgggcaggggcagccggggcgttgcccgcgcagcgcaccaagaggaagccgtccatcaaggcggcgcgcgccaaaaagatcttcggctggggggacttctactttcgggtgcataccctcaagttttcgctgctggtgaccggcaagatcgtggaccatgtgaacggtaccttcagtgtgtatttccgccacaactcgtccagcctgggcaacctcagtgtcagcatcgtgccgccctccaagcgtgtcgagttcggaggagtctggctgcccgggcctgtcccccaccctctgcagtctacgctcgccctggagggggtgcttcctgggctggggcccccgctggggatggcagcagcagcggcggggccggggcttgggggctccctcgggggcgcactggcggggccgcttgggggcgcgttgggagtgcctggggccaaagagtcacgcgctttcaattgccacgtggagtatgagaagacaaaccgcgcgcgcaagcaccgaccgtgcctgtacgacccatcgcaggtgtgcttcaccgagcacacgcagagccaggccgcctggctctgtgccaagcccttcaaagtcatctgtatcttcgtctctttcctcagctttgactacaaactggtgcagaaggtgtgcccagactataacttccagagtgagcacccctacttcggatagcgcccctccccagccagtcctgagcctcccgccaaatcccagcctcactaggtgggacccccttcccagtgttctgccgctcctgtggccatgtcgcccactccttccactctgggggcggaggggaatggcttctcgggaccctcagctagcgtgggtgcccttttccttatgcggagtgcccgcaaggctggggtagccccctccagtacaccccaaagtgaaagggataagagtgcagccccagaataggcggggcttggaggcggtcccaatgtcccctgggtccacagtgggtccccttttcacccttggcgctaggctgcgcactccctttcccctgcccgcccccctccagtccaggcagtcgagctccacctgccctctcctgctgcttcctctcggtgatattttttctacgccaaaacagacgggaaagggaacaaaataaagtgaaatccaatacaaaa

SEQ ID NO: 489343 - DNA, 935 bp, Homo sapiens
tggctcatgcctgatgcctgtaatcccagcactttgggaggcccaggcaggcagatcacctgaggtcgagagtttgaaaccagcctgggcaacatggcgaaaccccgtctctactaaaaatacaaaaattagccgggcatgatgatgcacgcctgtaatcccagctacttgggaggctgaggcaggagaatcgcttgaacccatgaaattggaagttgcagtgagccaagatcgcgccactgcactccagcctgggcaacagagcaagactctgtctcaaaaaaaaaaattcagctgatgcttggcctttggccacttcagggtcttcggggtcataactctttagggcgcatataaactcattgtggcctgtttgatgagcccattttacatctcgaggattgtcgagatacccaactttctcagatagttatccatgaagcaccaacgtcatgggcaatttccacgaagaacccatttgtgcctgtatagcaactcgatctgacatctggcaaatacggacatatctagggcttgataagtggtggagctgcttcctttccatgctacaacgctgtacagcttttagtacaaaaagcgaccataagagcaatctttaggaacatgtgcccgcaaagttagcggcttgcgtgtttctggacccacaccattttactgactgcacgccgtccattagacacctcaacagcttaaactttcaaacagaattacagccaggaaacacgttaccattccctgggaggggctcacccacgtttcaaacccctttaacaggcctgcgcgcgcacgttgcactcccacgccttgtaaagtcggcgagccactctgagatcggcccatggcaggccgagcacacggaggtcacgaagtttgagacgacagcctggccaatttgcggaaacccctttctacta

SEQ ID NO: 489344 - DNA, 338 bp, Homo sapiens
tagcagtttgagttggtgtagtgtattcttggttatcaaaatactcatatagctttggggattttgtgaattgtggtaaatattcagtgagtgtgtgtgaaaaatcagtgatacattacgtggtacagtctcagtcccataaaatgtggatgttggtgcctacacacaggatctaaaagaaatatgttcaaacttataaacgtggcttggtgaatgtggtgaaatgaacttgtggtccttgtggctgtggtgtttttcacaatttcccttataagtggcactattactaatcttttacaaaaataagaggtttattttacaaaaacaaaaaaagagag

SEQ ID NO: 489345 - DNA, 451 bp, Homo sapiens
caagatgggaacttcttgaataagaacttggaattgatgctgccagggtctcctccaactgtgataatatgaggatgagattctaatttttttaatatcaggtccagccttctgcctttaagcagacctgcactcttggaggaagctcaaattcctgtttgccaaggctttcccactccacgcacctggcaaaagggattgttcttcctgcatggctcttctcgctctaaacaaagctgtctcattttcatcgtccagggacatgcctcaaatgtcttttgctcacacagggctctcttccccatgtgctaaagtggatcaccctgtttttttctcatgatagaaccctagttatttcctacatgaatcttactacactctgacaattgtatatatttgtttactttcttagtgtttatcttcccaataaactccatgctggatccccaaa

SEQ ID NO: 489346 - DNA, 841 bp, Homo sapiens
tccgactgacccccggaaggttgatgtgcgctgcggatcgccggtctcgcctatgtctgccattttcaatttcagagtctattgattgtaatcttgctgcttagtttgtccctgtgcttattttcgatccttggacacccagcctcctgggctgcaccttcagactggatatgctgggtatacttttctggacagtgtgcctaggaagttggtgaccggagagagtccttgtgttgcaggtatgctgtctagtaatggccttcagcttcctcttcatacagtagctggggaaaattgccagaatgtggttgccatcgagcactctggatggtgaacacggactggactgcggaaacactctgggaggggactgttaagtctttgatctccgaacatcggtgagataaatttccagatgctgtgctctattgcaatgtcatgggaccaaatgttctgtataaccaatataagatgtaccatttaatagtctgtaacaatcaagctcagtgctgtcatctacgatattacactgcttgcaaatgtatgcgtgtgtcctccagatacgcagttttaagtgcgggtatctcctaggggcgcattagtagaccacccgcaactgtggtggacatttacgccgagcgtccttcgctgtgattgcaagttgttttactcgtttttagaatgggaccttttgggcgtaggctttctattaccctggccgttcgtgtggggagggggggtaaactagaagggcgggttcccctggccccctttgtccttacaggacctttctctggaccgttttgacggtttattttacacgctttctcgcggggggtat

SEQ ID NO: 489347 - DNA, 716 bp, Homo sapiens
  misc_feature (167)..(167): n is a, c, g, or t
  misc_feature (203)..(203): n is a, c, g, or t
  misc_feature (208)..(208): n is a, c, g, or t
  misc_feature (211)..(211): n is a, c, g, or t
  misc_feature (219)..(219): n is a, c, g, or t
  misc_feature (242)..(242): n is a, c, g, or t
  misc_feature (253)..(253): n is a, c, g, or t
  misc_feature (255)..(256): n is a, c, g, or t
  misc_feature (570)..(570): n is a, c, g, or t
agttaatactctagaaatatctgtgtgttgcaattcaaatgtatgttgagattgtgaaaagcgcttcagtgccactagcttaccggtacactagactaagccctggatgacttatgcatgatacagtaccaggaacaacaggtggcctaaatacatgaaaagcagtntaagctagtgacactaaagccagtcttgtattactntattnttnacagaatngttttgaaaactgtgctacaggngactgatgtgngnncaaataatatctctttatgcagaaggaagtctttttttttctttttttttttaagaagtatggctttttatgcatcctttccaatcggagggcatttgaagttgcatggacgtgataaaagctgatgcaaaacaagaaagaaacaaacaaaaaaaaaaaaaccggcaaactggtttaccaaaaaactcaaacaatgtgaccagggccggtccaatttccacagttctcggctggagtccagtggctaccatagtgtttcacaatgtgacatttcctgggcgaaaaaaattctctacacacttgcgtcgcacgcngtgcggggtacctacttcccaggcataggttcctcaaagctgcagtagaattagtgtctccactcaagcgtgttcaacttggggctatatatcatattagaacctttatagccatccggggaaaaagctgcccccacctcaatgat

SEQ ID NO: 489348 - DNA, 300 bp, Homo sapiens
  misc_feature (25)..(25): n is a, c, g, or t
  misc_feature (58)..(58): n is a, c, g, or t
  misc_feature (80)..(80): n is a, c, g, or t
  misc_feature (84)..(84): n is a, c, g, or t
  misc_feature (178)..(178): n is a, c, g, or t
  misc_feature (218)..(218): n is a, c, g, or t
acactgcaaatcaaggtggaacccnatatggactgtctgcaaattgcccaccaaccgnaacaccgaacccctagggcttntccntgcccgtttccaggaacctttcaccgtccaccctcctgcgacggggcacgtagtcttttcttgctctggaacccctgggaggttgagcagtganagagggaagggactaacgtgctccggaagggtggaggttnctcttctaagtccttggtctaaagagccctgtcacttttttctctcccacttttttttttctaaataaaatttgccaacttg

SEQ ID NO: 489349 - DNA, 141 bp, Homo sapiens
  misc_feature (132)..(132): n is a, c, g, or t
caggatccatcggtgacatttcatcatgtcatcatgtcatcatcactagcaagttcgttctgcctgaactgtactttctttacagacccaggcgtggcagctttattaccctttcttttctttaatctacgnactttggac

SEQ ID NO: 489350 - DNA, 242 bp, Homo sapiens
  misc_feature (27)..(27): n is a, c, g, or t
  misc_feature (89)..(89): n is a, c, g, or t
  misc_feature (96)..(96): n is a, c, g, or t
  misc_feature (220)..(220): n is a, c, g, or t
ctcgccctgtcagtgattccaatgttntcgtaacggggggattctctgccttttttgtatcaaagaacaagcaaatggacccccgccgntgcaggngcccatagccatcggtctctaaagcgagtgggctagcagcgtttgttttgttggtttggtttttttttttctgaaggtgggacagtcactccctcctccctcccacccctgtcgcatccacgtncgacctggaggactggatcaga

SEQ ID NO: 489351 - DNA, 124 bp, Homo sapiens
tctgcggttatcacgaaagggtcagaccagtggcacagtgtcagttgagttcagtccaagcagggtgtgatttccaaggacttagtacagtgtgactaaacagagaatctgttgtccccaatgc

SEQ ID NO: 489352 - DNA, 258 bp, Homo sapiens
tacccggatcaaaacaaatcctctcctgtaatccaaaggggtctacagggtgtgtcagtgacagggtgacattcaccagacttcttggtaatccagtagctgaataagttggattgaactagatatctatctatctgcctttgctgaaatataaatgaaggcaaggaaattcggagtttggtcttccgattcatacccctagcagctgatgtaatatttggacttggatctcaaattcatgaggatagaccctaagaa

SEQ ID NO: 489353 - DNA, 207 bp, Homo sapiens
agctacttcaacggaaactagctcatctgtagagactgctctgcaacccttccgggaagccatagctctgcaatggtaacgccgtttaaccatatttctttggcaaaatgtttaagagggtgctgtggaccccttttgtcacggggtaggtttaggtcccgatctactgttttttgtcttacagtaaacagcttggtctagcaatgt

SEQ ID NO: 489354 - DNA, 422 bp, Homo sapiens
tgcgtcttgtagacatattgtacgagttacctgaatcacagaacagctacatacaacatagatgaatctatgtaaacatatagtagagtataaggagccataaacaaaggagaacatagtccttacataaaattcaaaaacaggcaaaatagtctgtgatgtacgaagtgagaacactggttataaaaggaaagccatcgaaaaggaacacaagagatactctgggttgctgggaatgtactctttcttgaccagtgttctagttacacaggtgtgctcacttagtaaaaatccttgagataagaatataaggaattatagtatacttagcatacggatattatacctcagataagatgtaagtggaacaagaggctggatacagcaggtacacacctgtaataccaagcactttaagaagg

SEQ ID NO: 489355 - DNA, 172 bp, Homo sapiens
agtcccactcttatttatgggactatgtcctgtgcagcaacgtggatggagctggaagcattatcctaaatgaactcactcagaaacagaaaaccaaataccacatgttctcacgttataacgtagaagctaaacattgcagtacacactggatacaacagaacgggaaccg

SEQ ID NO: 489356 - DNA, 241 bp, Homo sapiens
  misc_feature (104)..(104): n is a, c, g, or t
gggccccccccccccccacttttttgcgataatatttccagcagcaattttagctaccttaggaggaggcagggcaaaaaaggcgagggcctgccttttacctnccgtgtcctttgcaggaaggagggaggcccccttttgaggttattttattccccccccccccccccaggcagggttggaaaaaaaggacttttttaacccttgttttgttttttaaaaaaaaatctgtaaaatttga

SEQ ID NO: 489357 - DNA, 217 bp, Homo sapiens
gacacggagctggaactgaagctggggtagcagctgggctaggtagatcctaggctaggctaggctaggctaggctataggcgggcacagctagagcccctaggcaatacggggcacgagcacgcttcccaagctaggggtgggcaaggaaggcaagtcgatcgagctatgcgattgacaccctatagggatctagggctaaacctcctagggctat

SEQ ID NO: 489358 - DNA, 119 bp, Homo sapiens
atggatggtcaggcctgtggtatcatcgtagggaacatcatcggctctggaatcttggtctcgccaaaagggagtgctggagaatgctggttctgtgggccttgctctcgatcgtctgg

SEQ ID NO: 489359 - DNA, 960 bp, Homo sapiens
  misc_feature (40)..(40): n is a, c, g, or t
  misc_feature (67)..(69): n is a, c, g, or t
  misc_feature (75)..(75): n is a, c, g, or t
  misc_feature (94)..(94): n is a, c, g, or t
  misc_feature (107)..(107): n is a, c, g, or t
  misc_feature (109)..(109): n is a, c, g, or t
  misc_feature (134)..(134): n is a, c, g, or t
  misc_feature (136)..(137): n is a, c, g, or t
  misc_feature (144)..(144): n is a, c, g, or t
  misc_feature (150)..(150): n is a, c, g, or t
  misc_feature (155)..(155): n is a, c, g, or t
  misc_feature (170)..(170): n is a, c, g, or t
  misc_feature (175)..(175): n is a, c, g, or t
  misc_feature (204)..(204): n is a, c, g, or t
  misc_feature (216)..(216): n is a, c, g, or t
  misc_feature (223)..(224): n is a, c, g, or t
  misc_feature (228)..(228): n is a, c, g, or t
  misc_feature (230)..(230): n is a, c, g, or t
  misc_feature (232)..(232): n is a, c, g, or t
  misc_feature (244)..(244): n is a, c, g, or t
  misc_feature (254)..(254): n is a, c, g, or t
  misc_feature (260)..(260): n is a, c, g, or t
  misc_feature (279)..(279): n is a, c, g, or t
  misc_feature (283)..(283): n is a, c, g, or t
  misc_feature (285)..(285): n is a, c, g, or t
  misc_feature (298)..(298): n is a, c, g, or t
  misc_feature (303)..(303): n is a, c, g, or t
  misc_feature (316)..(316): n is a, c, g, or t
  misc_feature (320)..(320): n is a, c, g, or t
  misc_feature (325)..(325): n is a, c, g, or t
  misc_feature (443)..(443): n is a, c, g, or t
  misc_feature (660)..(660): n is a, c, g, or t
  misc_feature (932)..(932): n is a, c, g, or t
gcacagtgagcagaaagaaggggcgttctcacacaaagangccacaaggactgcaattaaataaatnnntttganaagccttcattggcttacngcctatgcctccncntcttgctatcaggcgtacatcattncnnccatgtngggcantttcntggggatgtacaggngatantccatggggcctgggggggcctcaatggncacatcatccanggggggnngggngngngcagaacagggngggggggggngagggngggtgctggggtgcagcgnctgngngtggtcctcaagngtggntcttcgttctggngcgnggggngggacactctgcaggcctgaaaaggaatatacttccatatcatgccatctcttacactggcattccttgcctatgcatgtgcatggcttgccctggtttagcttggaaactgattganagtcagagagatcactggctttgagacttgcttgggggacttgggtagcgtcagaggggtcttccttcttactctctgatgggagccttggaacagaagttctcaaaggctcaacgactgcccctgtgtgattagcatcgagagaagtagagctttctcctgcactgaactctttaggggatgaaattcccagcccactgctgccatcaggtgagtnagtttggcttttgtgcttgagttgactgctggaagaagacgctattgtactgcaatgtataaactttggaggatgaaggacaggagacttagaacgtcgacgacgctgagttctccctgctcctcgtgaagacttccttgtagatccgtgccaactgtctttagatgcacatgtggttttaggtttggtatcatctgttgctgttctgactggtgctctgacacctgttccttctccaacagacagagatgctacagaaccctgatgcatcnctcttaattttttgaaagcagttgtaga

SEQ ID NO: 489360 - DNA, 233 bp, Homo sapiens
  misc_feature (94)..(94): n is a, c, g, or t
  misc_feature (166)..(166): n is a, c, g, or t
ccattaaacatcccctcttctcccctacgtcttcactttccatccagcctctggtaaccatccttctactctccatctccatgagtgtgatcgntttaatttttagctcccacaaataaatgagaacatgcaaagtttgtctttctgtgcctggcttctttcactncacatcatgaccagatgttggagcattctggatgttccacctgtactactacacacttggattagat

SEQ ID NO: 489361 - DNA, 440 bp, Homo sapiens
  misc_feature (4)..(4): n is a, c, g, or t
  misc_feature (79)..(79): n is a, c, g, or t
  misc_feature (86)..(86): n is a, c, g, or t
aaangaaaacaccgagagttactgaaaagcaaaaagttttgtagtgtgccttgaatttagtaaaacaagtacccactcnccctgcnaccttaaacaagcactttgtttttgttttatttttttgagatggagtctcactctgttgccccaggctggagtgtagtggcatgatcttggattactgcaacctctgcctccccaggttcaagctgttctcctgcctcagcctcccgagtagctgggattacaggcgtgtgccaccatgcctggctaatttttgtgttattagtagagacgggatttcaccatgttggccaagctggtctcaaactcttgacctcaggtgatccacctgccttggcctcccaaagtgctgagattacaggcacgagccaccatgcctggccttaagcactttttcacggatttacaaacaatcc

SEQ ID NO: 489362 - DNA, 201 bp, Homo sapiens
ctagtactctaaggatccccccgccgtacagttgcgcagcaggtctcgatgtgaacaagctctagcatgttgtgacaatgtaggtaagggaagtcggaaggcggatacgtaacttcgggataaggatttgctctaagggctggtcggtcgggctgaggcgcgaagcgtggctaggcgcgcgccgaaactgatacggcgggg

SEQ ID NO: 489363 - DNA, 299 bp, Homo sapiens
  misc_feature (38)..(38): n is a, c, g, or t
  misc_feature (41)..(41): n is a, c, g, or t
  misc_feature (52)..(52): n is a, c, g, or t
  misc_feature (105)..(105): n is a, c, g, or t
  misc_feature (249)..(249): n is a, c, g, or t
  misc_feature (288)..(288): n is a, c, g, or t
tcggcttctcgtcttgctctctctggtccctccggagnccngccgcgcgtcntcccggggaagcatggcaatgaaagcggtgtgcgtgctgaagggcgacggtcnggtgcatgggaaccatccacttcgagcaagaaggcaagcgggtgaaccagttgtgttgtcaggacaaatttacaggaattaacttgaagggcaagcatgggttcaaggtccatcagtatggggacaatacacaaggcttgtacnagttgcagggaccttcatttttaatccttaactcttaangaaacatgggt

SEQ ID NO: 489364 - DNA, 178 bp, Homo sapiens
ccaccacccctggctcatatccaattaaaagcagtatatcaaagaatgagccagctgggcccggtggctcacacctgtaatcccagcactttgggaggccaaggcaggtggatcagctgaagttaggagtcgagaacagcctgacccaacatggagaaaccccatttctactaaaaat

SEQ ID NO: 489365 - DNA, 379 bp, Homo sapiens
ctagctcggtaccccagcggactatctccgttgcggctggattcttcccaggcccttaccgctgccttagaacaagctggcgggcagcaacctgacgagggttccggaggcggactcatagatcgggctcgagcggaatatgacaagtacttcacgcccgggggatcagagcgtcgcaacgtcttcgcagatcgcgacgagctcgaggagatccgcagcaaccttgctaaaggacaagagaggctcgcagaggtcgacgaagtcgtcgactccctcagcagaatcaacgaacaaatcagccacgatcagaccggggtggcatccaaaaagaccgactgccaaaaagctgaggctgcccttgcgagcctcaccgaactcg

SEQ ID NO: 489366 - DNA, 171 bp, Homo sapiens
ggttggtggagaggagatttccgaaactcggtggctagttcattctggcagcacatattattatgtctggatgtgactcatggcagtttaaacatttcttctggttggcatcttagtagaaagggaaaataaccactccgggtcgtcttttcataaattttcatattttgg

SEQ ID NO: 489367 - DNA, 166 bp, Homo sapiens
cccgaacgcgcacgatggcgcgtcctcatttttactaaaaatacaaaaaattcgccaggcatggtggtgtgtgccttaatttcagctcctcaggcggctgacgtagatcatctgagctgggaagtcaaggccccagtgagctgtgaataggccactgcactccggc

SEQ ID NO: 489368 - DNA, 332 bp, Homo sapiens
  misc_feature (40)..(41): n is a, c, g, or t
tgaagggcttaaagatgaggggaggaagggaaaactcagnnctaagttaaatattctggggaaatgattaccttttccattcctttgatggatttttactgacatacgttcttttgtaatgggggcgtgatatcacaaaagaatggggcctttggaacttgatatagttgagtttgacccctggctttactctgtattgtgttttggggattaaatgagaacatttacagagctcctcacacaaggctagaaccacgtagatactcataaacgtcagcatattttgtgaataaagccctttcattcctacagaataaagtggtttaatggta

SEQ ID NO: 489369 - DNA, 236 bp, Homo sapiens
  misc_feature (55)..(55): n is a, c, g, or t
  misc_feature (153)..(153): n is a, c, g, or t
  misc_feature (155)..(155): n is a, c, g, or t
aaggccgtcgccggcgatgttgcgacggccgcggatccgaacgtgctgcagcagnacgtgacgcagcgcaatccggccggcgcgcagaagtggaagctgctggtcacgctggcggaacccggcgattcggtggacgacgcgacgaaggtctgngnccgcagcggacgacgatcgacgcgggcacgctcgtgctcgaccgcgtggaggcgcaggacagcgggccgtgccgcgatgtg

SEQ ID NO: 489370 - DNA, 353 bp, Homo sapiens
gtctgagcaagcggggatacggtataagggggtgtgtcttttctcaaccccacacttggaatatatgtagcttcaaaggagccatagggggagtatttactacagaaatgggcaaaggctaaaaggcagggctggagtttttatttggtggacggtgtagatttaagaaagtgatgcaaaaatgttaataatatgaattaagtatgaaagttggcatgcctgaagctgtaacataaggaggggcagaaaattggaggaaatattcttccagtattcgagaagtattatccaattcaggagagcagggactcaggtcacggatgaaggaatgaagttcaaatattcatctctgt

SEQ ID NO: 489371 - DNA, 554 bp, Homo sapiens
  misc_feature (475)..(475): n is a, c, g, or t
tttccaggcagaatgaggcttaagagagtccatggaagttaatacagagaaagacttcctaacaactagagctgcctgaaaaagcagcagcctgtctggcacggcagtggctgctgtggctcaaagggtatggaacatgaatgcacagcccctgaatagaaacgctgaggggacttcagcctccaggatccttccaacactaagactctgagacatcttgaaatagttcacttactgctgtctggtgtcaaatcatcatttcctaaagtcactatgactcatggttcctgaggacaacttttgtccccatatcccagatgtattcactttgaagttttaagaaagaagacaaacttgtaagcagggagtttgtgtttggctgtcagtgataacccacagatatttctcatctccctctccctgtgatatattttaaaagcacaccactatagggagtatacttggaggaaactgncaaaacgtcctcaaaacccaaggagtcacaattgatgtcccgccttcagaaacagccaggtaaatccttccatagacta

SEQ ID NO: 489372 - DNA, 394 bp, Homo sapiens
agggggcatgtcaggtctggggcccagagctctcccatgattgaagtttgccaccctcttgcagacagaggattgaaagcctggcatagaatatctagctattgtataagttttataggacaacagagagcatgaataacccttgggttgtctttggcagttgctttctagaaattcccttttcccaataagtaaaagaatcaaaatatcacccccaagattggcagatgcagaagtatcacctaaagtcagcttctaccttctaaactcttccatgggtcattcaaagaggttgtgccagccaggtgtagtggcacatgcctgtagttccagctaccagaaggctaaggtgggagggttgcttgggcagcatagcaagaccccgcctctacaa

SEQ ID NO: 489373 - DNA, 316 bp, Homo sapiens
gcagaccgcctactaatactactaaattcgaggccgctcaacttttttttttttacacattataaacccgccagtaaattattttgtagtaagatttagaacatataacatacagactgaaatatctgagtcagcatgaacagtacatattcttactagaggcagttacatggaaaaccaggttattatcaggttatttagcaagtaaggaatccaaacaagaggagactaaacttaagacctataactcgtccatgaagaaatggggcaaactttatctaccaccagaatgcattagcttccagaaagctgtgga

SEQ ID NO: 489374 - DNA, 131 bp, Homo sapiens
cgttttgcgtgtcacttacgattaaagtccttacgtgatctgagttcagaccggagtaatcctaggtcggtttctatctacttcaaattcctccctgtacgaataggacacgagaaataaggcctacttca

SEQ ID NO: 489375 - DNA, 897 bp, Homo sapiens
cagcgttgcccaagtctctatactttaacggtcaaaacatggcaaaacatataaaacttttaccccggctttttaaaccgtaatttccgcgcaacaattgtcccccccctaacttctgttagcccttgtctccagaaacatctatttttggcaatgaacaccttcccgaccagcaaaacatgggccttttaacacacccccccgtcctcctctcttaaaagtctcccgcgccacctttcctgacacacaatcttctgcagacatcggggcagaaatgccaccctccccagagaaagtcgccgctccttccctgcaaagatacatgtgtcagaccccccagatcttttggttcaccccgcaaaacctctatggtatattgttgccccaccccccactttagtattctacccccacttgtcataaacaccagagaaaattctttgttgcttatccaggtcttctctccaaaaagtcttttcgctcacctatacagtactacattatgagacccccccagtacaaccaccacaaaatcgttgctttgactccccacgtatacccaaagcggcgtcctctttatccacaatatgactctcctggtgagtgggataccaaacatatatgatgctgagaacctcccttaattgcgtgtctcgacacgcgaagcgatatggaccccgcaccactattctggtgggtgctacatcacccccgcccgcataggaattttgggaaggtaacatgttgttcgtcactttacactgtggggggttgatctctcctcggcgaacaataaagatgtgttcattttgcttcacgcaaacaagccagtaactttattttttagacccattccccaacaaaaacttcaatggtaaaaacgacccacataacaaa

SEQ ID NO: 489376 - DNA, 192 bp, Homo sapiens
cggcaacgcttcggatgggggggagatcccaagctcagtccccatgaaagttcgagggccggtcaggaggcaggggcaggtccgggtccaaagcaaggacaccgacagcatcttccgactccagtcggcagctccagcgacttaggacacggatgtgaagtcccacgctgctggctccaagcagcacgagag

SEQ ID NO: 489377 - DNA, 1180 bp, Homo sapiens
ttgtttcaagttggccaaattgacaagatgcgagaggtatactgcgttccactcccgacccggggccacggtagctggggaccctgtttcgctccctacctcgtgatccctcgtagagctcagtggttcctgctctttcttgcagtgtgtcccaggcgccctcggtccagggcctgggctgacccgactcgctggcgcttcatggatgaacttccaaaaggtggacaagatcggagagggcacgtacggagttgtgtacaaacgccagaaacaagttgaccgggagacggtggtggcgcttaagaaaatccgcctggacactgagactgagggtgtgcccagtactggcatccgagagatctctctgcttaaggagcttaagccatcctaatattgtcaagctgctggatgtcattcacacagaaaataaactctacctggtttttgaatttctgcaccaagatctcaagaaattcatggatgcctctggtctcactggcatacctcttcccctcatcaagagctatctgtaccagctgcctccaggggcctaggctttctgcccattctcatcgggtctccaccgtaacgaacacttaaaacctctagaaaacttggcttattaaccacacgaggggcgccatcaaaggctagcacgcactttgggactagccagaagcgttttggaaggtcacctgtgccggaactttataccccattgatgtgggtgacccctgttgtgtgacccgaggtcctcgaatcctctctggagcgggcacaatttatcccccaccttgtgcggcacatttggagcgccaggggcggcacctctgcgccgaacagttgagtgtgcagcggggcctaaatccctgcagaaaaccagtaaaacacaaaatttggagcattatatagtcgaggagccccccacactgggtgtgggcgagggcggagaaactattagtgcgttagagaaaaatcaacgggcggggcataaaatagatactctaccccactcacataatgaaacagaatgtaacatggtagctgcaacgcctcattatgacgagcgagcgaccggcactcctcacttaaagcgcgcgaccgcttcatactaaaagaacgaccaacaagcaaagacacacgtgagatgatgtcatacctaatctcgcaggcaaaatac

SEQ ID NO: 489378 - DNA, 719 bp, Homo sapiens
  misc_feature (18)..(18): n is a, c, g, or t
  misc_feature (63)..(63): n is a, c, g, or t
  misc_feature (84)..(84): n is a, c, g, or t
  misc_feature (86)..(87): n is a, c, g, or t
  misc_feature (89)..(90): n is a, c, g, or t
  misc_feature (93)..(96): n is a, c, g, or t
  misc_feature (100)..(103): n is a, c, g, or t
  misc_feature (112)..(114): n is a, c, g, or t
  misc_feature (122)..(122): n is a, c, g, or t
  misc_feature (124)..(124): n is a, c, g, or t
  misc_feature (140)..(141): n is a, c, g, or t
  misc_feature (148)..(148): n is a, c, g, or t
  misc_feature (159)..(159): n is a, c, g, or t
  misc_feature (164)..(164): n is a, c, g, or t
  misc_feature (182)..(182): n is a, c, g, or t
  misc_feature (184)..(185): n is a, c, g, or t
  misc_feature (215)..(215): n is a, c, g, or t
  misc_feature (220)..(220): n is a, c, g, or t
  misc_feature (257)..(258): n is a, c, g, or t
  misc_feature (262)..(262): n is a, c, g, or t
  misc_feature (266)..(266): n is a, c, g, or t
  misc_feature (270)..(270): n is a, c, g, or t
  misc_feature (278)..(279): n is a, c, g, or t
  misc_feature (285)..(285): n is a, c, g, or t
  misc_feature (328)..(328): n is a, c, g, or t
  misc_feature (336)..(336): n is a, c, g, or t
  misc_feature (339)..(339): n is a, c, g, or t
  misc_feature (343)..(343): n is a, c, g, or t
  misc_feature (346)..(346): n is a, c, g, or t
  misc_feature (348)..(348): n is a, c, g, or t
  misc_feature (350)..(351): n is a, c, g, or t
  misc_feature (354)..(355): n is a, c, g, or t
  misc_feature (358)..(358): n is a, c, g, or t
  misc_feature (363)..(363): n is a, c, g, or t
  misc_feature (380)..(381): n is a, c, g, or t
  misc_feature (383)..(383): n is a, c, g, or t
  misc_feature (388)..(389): n is a, c, g, or t
  misc_feature (393)..(393): n is a, c, g, or t
  misc_feature (403)..(403): n is a, c, g, or t
  misc_feature (409)..(409): n is a, c, g, or t
  misc_feature (413)..(413): n is a, c, g, or t
  misc_feature (418)..(419): n is a, c, g, or t
  misc_feature (421)..(421): n is a, c, g, or t
  misc_feature (423)..(423): n is a, c, g, or t
  misc_feature (432)..(432): n is a, c, g, or t
  misc_feature (437)..(437): n is a, c, g, or t
  misc_feature (449)..(450): n is a, c, g, or t
  misc_feature (455)..(455): n is a, c, g, or t
  misc_feature (467)..(467): n is a, c, g, or t
  misc_feature (470)..(470): n is a, c, g, or t
  misc_feature (477)..(477): n is a, c, g, or t
  misc_feature (482)..(482): n is a, c, g, or t
  misc_feature (489)..(489): n is a, c, g, or t
  misc_feature (495)..(495): n is a, c, g, or t
  misc_feature (499)..(499): n is a, c, g, or t
  misc_feature (501)..(501): n is a, c, g, or t
  misc_feature (503)..(503): n is a, c, g, or t
  misc_feature (505)..(505): n is a, c, g, or t
  misc_feature (512)..(512): n is a, c, g, or t
  misc_feature (519)..(519): n is a, c, g, or t
  misc_feature (527)..(527): n is a, c, g, or t
  misc_feature (529)..(529): n is a, c, g, or t
  misc_feature (538)..(539): n is a, c, g, or t
  misc_feature (546)..(546): n is a, c, g, or t
  misc_feature (548)..(548): n is a, c, g, or t
  misc_feature (556)..(556): n is a, c, g, or t
  misc_feature (576)..(576): n is a, c, g, or t
  misc_feature (581)..(581): n is a, c, g, or t
  misc_feature (583)..(583): n is a, c, g, or t
  misc_feature (591)..(591): n is a, c, g, or t
  misc_feature (597)..(597): n is a, c, g, or t
  misc_feature (603)..(604): n is a, c, g, or t
  misc_feature (642)..(642): n is a, c, g, or t
  misc_feature (649)..(650): n is a, c, g, or t
  misc_feature (709)..(709): n is a, c, g, or t
accggaattcccgggatnggcgtttgagtggcaagttgtttgttacagcgaacaccagctgcnccccgcgccgggcgccgcgcncnntnntannnncctnnnnaaatactannnttcttaananctcatagcaagaaagnntattcanctttaatattnaaatngcctccctagtaagatantnnttaaccatattcataccaatatcatcaaanaacantatgcgcacaagcacagaaatccgtttatctcatgcnnagtngtancgtnattccaanncacacnacctcttacccccaatcaccagtactgtataaaaacaccagtntacaacancancatnccnananncannaanaatcnaaaataaaaaataaatnnanaaaannaatnaatacatatnaaacanttanaaaannananatattaaantaatntttaaaaataannaattnaataaaaaattnaanttaaatnttaantaaaaanaaaaanaatnantnanttaattntaaaaanttataaananaaaaaaaannaaaaatnanaataaaanaagcaaaaacagctaaagtnaaaanancataaatntatccncaacanncaaaagctcagcccagcttaaaaatttgcagcaaaatncaaatgnntgcaattaaaatcaatataagctaaaaaaaagcttgcaagcaaattgcttttcaaaagnaaaataatgc

SEQ ID NO: 489379 - DNA, 203 bp, Homo sapiens
  misc_feature (1)..(1): n is a, c, g, or t
  misc_feature (33)..(34): n is a, c, g, or t
  misc_feature (36)..(36): n is a, c, g, or t
  misc_feature (52)..(52): n is a, c, g, or t
  misc_feature (55)..(55): n is a, c, g, or t
  misc_feature (62)..(62): n is a, c, g, or t
  misc_feature (79)..(79): n is a, c, g, or t
  misc_feature (95)..(95): n is a, c, g, or t
  misc_feature (116)..(116): n is a, c, g, or t
  misc_feature (124)..(124): n is a, c, g, or t
  misc_feature (135)..(136): n is a, c, g, or t
  misc_feature (151)..(151): n is a, c, g, or t
ngcacaagctgaaggcagacaaggcccgaaagnngntcctggctgaccaggntgnggcccgnaggtctaagaccaaggnagcacgcaagcccgtnaagagcgcctccaggccaagnaggggggngatcatcaagnntttatccaagggggnagagaccaagaaataaaacctcccactttgtctgtacatactggcctctgtg

SEQ ID NO: 489380 - DNA, 158 bp, Homo sapiens
gctgtcagatttatcatcgacatgagagacaggacccacctggaattgtacatcttgtctttatgaagtgacttaatgatagattacgcctcaatctgaaactctcctgtgtgattgggctatcactgggatcctctaaaggtcgatcgctggcatga

SEQ ID NO: 489381 - DNA, 1008 bp, Homo sapiens
tctggaggctgtggaatcagaatacaggcatcgtggggtctatcacaggctccaagtattatgtgcgcatcctgagcaccatcggatcgggagctgtcaaggcccaacgcctcagtggccctccataagcacagcaatgcactggtggacgtgctgccccccgaagccgacaggagcatcatgatgctcacctcagagcagaagccagatgtgatgtacgcggactatcggaggcatggtgcatccagaagcaggaggtgcgggaggcccgtggagctcccgctcaacgcattgtcgagctctacaagcagatcgggatcgaagtcccccccgaggccgtcctcatgtatggctcgcacggtggcgtgtgggaagaccagtgtgggaaaggcggtggcgacatcacacaaaagctgcatgcatccgggtcgtgggcttcggagctgtgtacagaagtatctgggtgagggcccccgacgatgggtcggggatgtgttccgccgtggctaggatgaatgccagctgccatcatcgttcagtagatggagattgatgccgtcgccaccaagagattcgatgctcagacaggggccgatgagggaggttcagaggatcctgcatggagctgctggatcacgatggatggatttgatccgaatgtcaatgtcgcggtgatcatggcacgaaagagcagagaccctggatccggccctggttcgggcaggacggggtggacggtagagattgaagttccggtttcctgaccgcgggcagagagattgattttctccactatcatagaagatgaaccccctgaggggttgactggaccatttgggtgcggcgatagtttcggagcggtttactccttgccgcgaggacattgggcggaacgcgaatgtgccgttgaacatacctggtaaaggacgcggaggacccccaccaggggttccccctcacccttcgggccatacaccactgtcctttcgaaggtggtttttttgcatt

SEQ ID NO: 489382 - DNA, 422 bp, Homo sapiens
gcatagccatatcctgttcgtgtgcccaacctcgtgaccccgccagcgacgcgcagtacctgccgccgctgcacaggataggcacagctgcactggccgatgagtttgtggtaagtatctggcccaagctcaactacactctgctgattacagccctatgacgtttccagactgaacaggtatcaaaagatatgccatacgcgagtgctgaaccggagcagatggaccgacttgaggagtttcccaacacctgtaaaatgagggaggagctaggagaactatcagagcagtttcacaaatatgcagcacaattgggtgaaatgttgtatatgtctgtccctgcagtcgctaaattgagacgtcttttagatagtctctcaagggaagctttaccagacatcttgacatcaattatccgaaca

SEQ ID NO: 489383 - DNA, 497 bp, Homo sapiens
accgggagacctcacacccaatataaggggctctgcttgggattgtctgtgctccccacaaaggttgtttaaccaccggtgctccctctttccctcctcagcggcgactgcacggggagaagaaattttctatttcctatagcgtcggggtccccacaacggagggtttttttgagaaaggcgtcggcgacacaaagaagtcttgctgcacgttagcgtactcccggcgccagaacctgcgacaaagtaccgcactgtttttggtgtaaaagttgcgttgctccggtcagagcttctttgtaacgcgccggttatcatggtccaacacgccgttgttgttttctcagaggagtacgactactgggggaatacatatcctaaaatgcgaagagacgctttttttggccccgggcaaaaaacaaagggggaaaaacaatccccgggaaccaaaaggccgatttctttaccaaaaaacggcctaaaaaaaccacaagaaa

SEQ ID NO: 489384 - DNA, 300 bp, Homo sapiens
gtcaggcttagccccaacaactcagaatttcacttccttgtacgggccctcactttctccacctggccccggggcaggtctagagggtctagaagtctgttgatcgtgaaggtccataggcaaatccagtcacttggagagcctggagatatttaacatacacggcccgtgtccccgtttcccaaggggactcgatttcctcagcactctcgtccactgtaccttgcccacaccccttgggggaaaacaaatgtattatttctatttggtgaatactatcctagaaacttgctgggcata

SEQ ID NO: 489385 - DNA, 384 bp, Homo sapiens
  misc_feature (384)..(384): n is a, c, g, or t
cgcagatgaggaggccacaaagtgtctgtgccccaaagacacaccacgtgtagacacacaagctgtatttgaggagagtggtgatgtggaccatttatatggacatgatatatgtcgtggatgtatggggaatctaagagagcgtgtcattggtgtgatgctgggaggtctaacacaaacaaggtggatgccggcattcaaggggagcctgtggaatgagatacacacatatatattacaagggataatttagaccccatacaaggttatataagaggcattggtattttctgggtggtggattaatttttctgtgggcttactgagctttgtgtattacatacatgctctgaagtttctgggtagatcttttcttgagctgtn

SEQ ID NO: 489386 - DNA, 323 bp, Homo sapiens
ctcggtgctgcatgtgtgctatgtgactatgtatgtgatatggtcggtgtgtcccaccaaatctcattgaatgtagctcccataattcccatctgtcatgggagggactggtgggaggtcacgaatcacggggcggcaggagagagaataagtgcaacaggggaaatgcaagacacttataaaaccatcagatctggtgagattcactcactatcatgagaacagcatgggggaaactgctgccgtgatctgattacctcctcctggtcctgcccttgaaacatggggattatggggataccaggggcacatgcatgcaccca

SEQ ID NO: 489387 - DNA, 150 bp, Homo sapiens
ggacaaggagaacagagaaggcaggtcttgttatctagagctagacaccagctaatatcttgggaaggccacctaccttgaataagaggttgcctttggtcaatcctatcagtttgggggtaagggaaaggttttctctcctgtctgtga

SEQ ID NO: 489388 - DNA, 381 bp, Homo sapiens
tagggtcttagggagagtaaatagtaatgaaggattataaagcactttgctaatataaaatgcacatcaaagctgaataataatcttactttagggtgaagggtttccattagcagagtaaaaataaaaaggacaaagggtagtgttgctttgtacctttgataacagttgtacaaattcacaaagtgctgctattgaatcctcattgccctgtgaactctcaacccaggaattttggctccccctcccctaaacttctctaaagtacttcctcttacccactcagtgttggtgaatgggcaaccttcccttaagaacggggtacccgaggctcgaaattcggtaaattcattgggtcataagcttgttttcctgttgtga

SEQ ID NO: 489389 - DNA, 433 bp, Homo sapiens
gcgcactacggggagcgctgggccgggcaccgggcttgtgtggatgatagtgagcgcgctcgtctgacccccgtgcccagccaccccagagcacacataaacggagatctacccaaggacctgaccagaggactctgtacactgtacctcagacaccgcagacaggaaaacagtttagcactcgagagagcgacgccgaaggcgagagcgacggcagagcggaaagcaagacagaaaggaaagagaaagcacggacacacagagcacaacagaacgccagaggaagcgaagaagagacgcgacaagaagacgccaacaacaagacgacaaccgaagaacaacaaacacaacccgagccgaaaagcacacaagaagcacaaacacaaacagcgagacacagaagcaaacgagaacgcacacgaaacgaaacacc

SEQ ID NO: 489390 - DNA, 456 bp, Homo sapiens
acctggactgttggattgcacaactcctatacacagatcactctgacgggtgctgcctggagtggtacaacatggtgaccctgcacatttccttgttaacctaactgaatctatcagatagaataaacgatggagatattgacaaaaaaatctcgctcatctcccatttacccaggttatcaaggagtgaaagcctggtatctgctggtaacaggccaggtggctttagacaagtcccttttcctctctgattctcattttgcccatctggatcaaaaagacctctagaggactttccagtagtaagtctccactatttggggattccctctcgttagtgtgggctaagtcagtctttaacatctgatgggaatcaccatggtccttggaaaggagagggaaattggagaggagaacagtagctgtagatgctaacactgacagatcccaaaatga

SEQ ID NO: 489391 - DNA, 122 bp, Homo sapiens
gccggcagtgtactcgacggcagtgtacacgccggcagtgtaaccgccggccagtgtcacacgccggccagtgtaaaccgcgcggccagatgtaaaacgcgcggccagtgtcaaccgaccgg

SEQ ID NO: 489392 - DNA, 442 bp, Homo sapiens
cacgagggccgagaagagaaagttgcccaaggccgccgccaccttcagcgtcgccaggaagaggccgacgggcgtggcttctccccccgcaccctccctaagcgtccgctgcacgatatcggtcagcaatgcccaaatggcgaggttcatgccgccgaatgacgcgccaagccccaccagcagtaccggctcggcgaccgaggcgggtgcgatcatcaacccgaacatcgcggcgatcgccgcgccatgggcgccgatcgcgatcgtccgcggcgggagccgccgcgatgccgccatccacaggggaagcgtcagcgattgcgacagcgtgatcgtcaacagcgcgggtcccgcccagctgggatcggcatgaaccgccttgccgtaaaaggggagcgcacgctggaacaggggcaccagcgccgcctggaacgcgatgacg

SEQ ID NO: 489393 - DNA, 892 bp, Homo sapiens
ggagtccgattgtggagagggcgagctgagtggttgtgtggtcgcgtctcggaaatcggtagcgctggcggctggttcgctctgtacatagtcgatctcactttgcttctaataatccctgcaagggtgatcaactgatgaagagcagattgcatgaattcccagaatgctctgtgtcactatgttgacaaagatggtgaatggaactagtagacagatcgagaaggaggtgggagctgtagatgagatctcttgggtcgagaatccgcaccagaagcacgagttacacggacatgattaatgaagtagatgctgatgatcaatggcacaattgacttccctgaatttctggacaatgatggcagaaaaatgaggacacagacagtgaagaagaaattagagaaggcattccgtgtgtttgataaggatggcaatggtatattagtgctggagaacttcgccatgtgatgacaaaccttggggagaagttcacagatgacgaagtgatgaactgatcagggaagcgatattgatggtgatggtcaagtaaactatgaaggagttgtgtgcaaatgatgacagcaagtgaagacttgtcagaaagggggttattccttggtcacaattggttattgccctttcttggttggacttatctgtcaagggtctccctacggtcaaaaagttttgctgttttgtaattggccttcttctccaggtttttccttatcttagtctggtcctaacctttttgaaatggccgtacgttctgtgttccggatttacccggcttaataagggtgtccaggcaccggggcctcagaattgaaggccgtggtcaggggaccggggcatatgacggggcccacgggcagcgttggggcactacacc

SEQ ID NO: 489394 - DNA, 117 bp, Homo sapiens
gatggccgaactctctcagactacaacatccagaaagagtccaccctgcacctagtgtagcgcctacgaggtggcattattgagccttctctccaccagcttgcccagaaatacact

SEQ ID NO: 489395 - DNA, 231 bp, Homo sapiens
ggtgcaagcttgcatgttgttgctacgacccaagcagggatccccctttgcactatcgagtagtaactcccgtatggaagcccccattccgtataatgaattacatcacaagacgtcattgcacgcatgagctagtcccctacaattaggcttgaaaacagattcatttcccgaatgtctacaccaaaccactttcaccgctacacggtctatgggtaccgacgctcgaag

SEQ ID NO: 489396 - DNA, 220 bp, Homo sapiens
cctaatggaactgccgcaagactaaattttagctcaatggggaaagagagagaaaaagcgggtagagcctaatgggagagtactattatataataatttactttaggggttagcagatgcaaactacacatttagaatggataagcaatgaggccctactgtacagcacagggaactgcatccagtctcttgggatagaccacgatggaagataatcgga

SEQ ID NO: 489397 - DNA, 367 bp, Homo sapiens
tagcgatcctattctgcaccacagccacttacaaatgtgttgaatacaatgtgctcgatttgtgaatgaattgattcactagtggtataggagcaaaggattgatatcagacctaggataatacaggctgcttgagaataacctcagtctcctataatacagtcttcttggaaactggagagactaatgggggtgttgtatctgtttcccatgttgcacctggtttggagcagctattagatggcatggaggccttatgcctacgtgaccagaacaacagattgataggcaaaagaggttaaagctttcacgtgtcaaagtgtcctaaatacaccatggtccttatctagggaaggcatacatgcct

SEQ ID NO: 489398 - DNA, 383 bp, Homo sapiens
  misc_feature (368)..(368): n is a, c, g, or t
ttaagacagagtctcgttctgtcaccaggctggagtgcagtggtgcagtcttagctcactgcaacctccaactccctggttcaagcaattctcctgcctcagcttcccgagtagctgggattacaggcatgtgccaccacacccggctaatttttgtatttttagtagagacagggtttcaccatgttggccaggatggtctcgatctgctgaccttgtgatccacccgcctcggcctcccaaagtgctgggattacaagtatgagcgactgtgcctgggcccaaacagttctttaaaattctccatcctatgattaaaaagcagcatgttgttctttctttagattcagggaaacagaagtgaagtnttttgaaataaatat

SEQ ID NO: 489399 - DNA, 271 bp, Homo sapiens
  misc_feature (249)..(249): n is a, c, g, or t
gtcccgacccccaggtggtatagcttagttacactttcgtttattgctaacggttcactcactgctgtttcccgtgggggtgtggctaggctaagcgtttacgagctgcacttgttagcgtgcttgactgcttgtccccttttgatcgtggctgatttagagaggtgaactcacatggaacggggatgcttgcatgctgtaactcttactaacgagctcaatagacaaggctaggaccaacacctatcngtgaacacatctccgcacttac

SEQ ID NO: 489400 - DNA, 187 bp, Homo sapiens
tgattctgcgagcctcaagctcgaagtcacgctgcagatcactgccggaggcaacatcatcctcgagtgggcatcaacaaggacagccgggggacgaccaggcctgccggcatcgcgatcaacaccaagccacgtgaagacctaggtactggtcgagaacggcggcacggtggtgatcgggcggcat

SEQ ID NO: 489401 - DNA, 1574 bp, Homo sapiens
  misc_feature (361)..(361): n is a, c, g, or t
  misc_feature (650)..(650): n is a, c, g, or t
  misc_feature (768)..(768): n is a, c, g, or t
tggcgcacacacactcctgtgctgtgtggtgctcgccttgctgttcgcgtggtgtcgtaccaacagaacattacgacaattttcaaagggggggggtttggctccttctctgttgttttcttggtgaagagcagaacattgtttagggaagatttgggggggatagaaaaggatagaactgtggagatgttccaaccaagtgggggatttttttttgggtagtggggggcccaactttaatttatttccgtggagaagcatttttgtggagttgaattcgcccaaagtagtgttatagggttccccgcccccgctctttgattcgtgccccgagacggtcgtgtggggaccagctagtggnccccgagcgtttttgcttaatatgtcccaaactggttgtattcccgccgtggaaagatgtggccgccttgcgcgtcttgtgcgctatgtaaaatgagagggctctgtggcctctgcacaacacaccagggatagtagggtccgggcgcgcggagaaccgtcagagccctcacattgtggggacaaccgattgggccccccacccctggtgggacaaccattttaaagggggcgtgtccttcttggtggtggcttctattgaaacatgagtaggcttgtgccctcctggngtgggagaaagtttgtataacttgtttgtgggtgccatcgagcacgccacacaaaaataacatgttttacaccgcgcctcctctttcgggggtgtttctcaagcggagatatatgtgncgcgtgctgctttataggacttgccccgcccaacattcgtcgggcgccgtcgtttggagagaaattgtctcacgcggagtatacacctctctcccgccgctgtgggcccttatatgtaatattttctactctcctcacatgttaaagggtgttgacacacatttgtgtggacacacaaaaggtgggcacattttggagacaccacacttaagagggggggctccccccccttgggtggaagacctccacaagacacacaacatgtttcacacacagacacaatgtgttataaaatgggcgctcgcacttttttggagagaatttctgggctgtggcctcttcacagtggcactctcccacggagaagagacacacactgggcactctgtgcctctctctttcacagaatgccctcgaaagggagagtgtcttctgagaggccaaggtgaatagtgcctgtggagagtgatggagcggctctcccacttctggacacccgcgggcctctctctgtgggagacctctgggctccctctctccgctggagacctcggggcatttcgctggtggaagcacctgtcagcactctcctgggcacattaccctcccacggcgccacgcacaccacctggcacaacaataatagagacctgaggtggctaattgtatttttgggcttgggtgtgtaatgctcttacacattgggtaaaaattgctgtttttttgacaaattaagtgattgttttgtttaactgtaagtttggaaatccacccttaaggaaataaattcccaaaaaaaataaaaa

SEQ ID NO: 489402 - DNA, 105 bp, Homo sapiens
gcggccgcctactactactactgctcgaattcaagcttctaacgatgtacggggacatgacaaaataaaataaaatggatgattcattcttaagtgcagaaaaaa

SEQ ID NO: 489403 - DNA, 858 bp, Homo sapiens
gcgccggttccttgtggtggccgtgaaggcgcgaagtctgagacccgggcctgcacgctcgtctgtcggcgcaatgggttcgatcgctagtctgcccgcgcgctgttctcttcgtcatggagtgtcgtgtcagtgctgtgagtaacgaggcgcgtgggcggccgtccgtggcgggttgggtggaccgccctccgtgggtacgggctgcgcgccaggcgtggcgtgcgtcgacgtgcggcgatcggtagacgtgtcgtacgcgaaggcggcaaatgtacgcggatgtgccgttatttatactcttgagaactctgagtacaggatgttggccgagcgctccgctcgcatgttccggacgcagcactgctgtccgggggtcggatcagtttcgcgcggcgtagcttcaagaggctgccgtcgtgcgccgggttggtgagctggggcgacccaagggatccctgagtcttgaacggtacgcccgtagatgaggcagccgccgcgttctagcgtccaggggccggcggcgggtctaggttgggatagtctccaggagctgttcggggccctgcagcagctctggggctcgaggtgctttgagtgggcggctcgttccggacacctgttgctgggcgacacagggaacttttacacacgacttacacggatcacggggcctagagtacgacccagatcgcttgattaccgcagaacttgaggattccccgaggtcttgcagtgctcaggaaaaccccggggctttgcaatctactgtaggcctaacgaaagtggacaattcgcaagggaggaaaacccttgggaaattactcggacggggttccagggatggttgtgaactcc

SEQ ID NO: 489404 - DNA, 134 bp, Homo sapiens
ctctgggctgagtcgcgtgctgactcggatatatcttgtgctcatgggtggggacttgtagcagcaatagcactgcgggtctttaggaagtgtgattaactgatgttcccagtgtgtgtcttctttgttgatgg

SEQ ID NO: 489405 - DNA, 122 bp, Homo sapiens
tgcatgtctagagaccggttcagtcactggatagaatcatctaagctcctgtatcagcactcctcatcatcactcatctgccaaggctcctcgctcgatctggtgtacctgagctcgaattc

SEQ ID NO: 489406 - DNA, 423 bp, Homo sapiens
cgaaggctgactgcgacatcacatgcgtggtcgactgaggctcgtgactcaatgcgacataaaatggcaataagaggcatacaaattggaaaagaagatcagaaactagcgtccgtatgccacaggacatgcaggtgtatgtagagagtcccagagaatctatgtttcaaatctcctagaatgaacgaggtgagcaagcccatacgacacatggtcaatgcaaaagttaaccatatttccacatgcgagacgaacaaccaggaactggctatttttaaaaagtaacatgtacagtagctcccccaccacatgttatacacagtcagcccttgtgtctctgggttccacagcgtcagactaattcaactgcagatcaaaaatatcttgggggaaaaagactttaaaaatacagtatagcaacta

SEQ ID NO: 489407 - DNA, 324 bp, Homo sapiens
  misc_feature (18)..(18): n is a, c, g, or t
  misc_feature (33)..(33): n is a, c, g, or t
  misc_feature (55)..(55): n is a, c, g, or t
  misc_feature (67)..(67): n is a, c, g, or t
  misc_feature (85)..(85): n is a, c, g, or t
  misc_feature (91)..(91): n is a, c, g, or t
  misc_feature (175)..(175): n is a, c, g, or t
  misc_feature (195)..(195): n is a, c, g, or t
  misc_feature (216)..(216): n is a, c, g, or t
  misc_feature (256)..(256): n is a, c, g, or t
  misc_feature (260)..(260): n is a, c, g, or t
  misc_feature (275)..(276): n is a, c, g, or t
agaaaacagtctttctgngtatacctacggatnagggtattatttaaactgccancaatatccaagncatggtcaataacctaancataantactttagaaagagtgaccaggccatgtatagaaatgtctgcttactgtagactttaaaaacaaacaaaaaaacaaacaaattnttggagcatttaatcatttnttttctccttttatctccttntgtaatcttattgtctcctgagtaaatatacacataaatntttngggattcattgctgnnagattatatcaggtgtttacatagtgtctactatatgctgttgataag

SEQ ID NO: 489408 - DNA, 1024 bp, Homo sapiens
aaatgcacggaagccagactggtctcaggagcggctaaatgcccttccgtggggatgtcgtctttctgagactagccctgctgtttaggacctgggtaccacaatgagggtacctgccgagggagtgtccccaaaagagatccacgactgatcatgtgatttatgtgtggcactgtgttcgtgtatttgtcggctacttgtgtcttgaaatctagaattatttcacgccacaaattggtcactgtgtatggctccatgggaagagtagataatggggcgtatatggcaaggcccaggtctatgtaggtttctgtgttccttgattcaccacatattagaacaattgaccattataagtgttctccaaatcacctgttggtgcctaatcacttaagtcattaatccattactgtagtatcttgtttgaaaattgtgacatatcttatccgtgtggtgtggggcacaagggagtggtcgttcagacgttgggttcatagttcatttgactgtggatgtacacaatggatacaggcttgacagctttgcatgctcccctttctacatggtggctgcatatgcggatgcaagcgcacatatacaaggtcccacctagcaaaagtgcaacaaataagataaaagaaacatagcccaaattgagaaaacacaagactcgagggaaatacccactgtatacagcgaacccacacgccacctaccgagacctcaggctcattggtacaaaacatccaacagcctaaccacaccgacatctgcaaccagcgacaacttgaacgcacccacctcacacctacgactaacaaccacccccaacacgcctcaccacgcaaccctcacacttacccatcacccacaccacactccaccctccacaaacataccatacccccaaatatccccaaacacaccccactaccacactcccacacctccccacatatcactcaaaaacaactccccccccaatccacccgtcacaaaccacacaccacatactctcctcatc

SEQ ID NO: 489409 - DNA, 83 bp, Homo sapiens
tgcaaaagacattggaggagcggggtacggtgactacgactactggggccagggaaccctggtcaccgtctcctcagcctcca

SEQ ID NO: 489410 - DNA, 110 bp, Homo sapiens
tgacagacaaagatcagtgttgcacggtcccagcagtccattggatcccttagactcaagctaaggaatgggagtgcaaagggttccctgcctcacccacgcagctccca

SEQ ID NO: 489411 - DNA, 285 bp, Homo sapiens
acaaattctcccacctcagcctctagagtagctgatactagaggtgcccgctaccacagcgcactaatttttgtgtggtgtgtgtgtgtgtgtgtgtttgtagagacagggttttgctatgttactgaggctggtctcgaactccgtgggtacaaccaatcctcctgacttggcctcctaaagtgctgggatagcaccacgcccagtccgctgctcttatttatagtctacccagtgatgtgtccttacagtcaggtgatccagtacatcaccagatagtctctg

SEQ ID NO: 489412 - DNA, 990 bp, Homo sapiens
cgtcatctactctaccatctttgcaggcacactcatcacagcgctgagctcgcactgatttcatacctgagtaggtcctagaaataaacatgctagctttattccagttctaaccaaaaaaataaaccctcgttccacagaagctgccatcaagtatttcctcacgcaagcaaccggatccataatccttcttaatagctatcctcttacaagcaatatagctctcccggacgaagtgaaccagtaaccaatactaccaatcaatagtcatcattaataatcataatggctatagcaataagagtaggaatagccccctttcacttctgaagtcccagaggtggacccaaggcattccctctgacgatccggcctgctttcttctcacatgacgaaaaactagccgcccatctcaagtcactatatccaaatctctcccgtcactaagagcgtaagccttctcctgcactctctcaactcttatccatcatagcaggcgagcccgaggtggattaaaccaaatcccagctacgcaaaatcttagcatactcctcaattacccacataggatgaataatagcagttctaccgtacaaccctaacataaccattcttaatttaactatttatattatcctaactactaccgatgcctactactcaagttaaactccagcaccacgaacctactatatctcgcacctgaaacaagctaacatgactaacacccttaattcattcaacctcctctcctaggaggctgcccgctaacggtttgtgccacatgggccttatctgaagaatcacaaaaaatagttcctatcccacatatagcgcatacctctaacttttttactagctattatcactaaaatatccaattaaagaaaagggtgggttaaaccccttccctggctaagagcgatcctctttaattaaaaaaggggttcggccccttaggggataggagagggatcacaatttctaaac

SEQ ID NO: 489413 - DNA, 1326 bp, Homo sapiens
agcgggggtcgggctcacgccatctgtaccccccccatcgccccgtcacacagccgagtcaccttttccctttctacactccaacaatatatgagcagacggggaagcgtgatcccgggaccgcaagacaagccgacgcagcaccacagcggaccagtactccacgacaccacagtgatccaccgcgagggacacgcggcagaacagggaccaccccacagggatacagggcaccgcagcaccgacggaacacacgccccggcagccagtcaggaccaacaaggactagctgcaacagagccccgccagacacgcacggaccagcagcggacaccagagagaagagacgggaggaaagcagcgaagaaagagaaggaagggacgcgagagaggcgggcagggcgaggcggaaagcagagactgccaggaaacagaggcgcccatatgaggggagcacgagtagggaaagaagggggacgccgccgaggagagcacagacaacaggcggtagaagaggagcacaatgccaggcgaacacagcacacgacacgcagaccaacacgcgctcaggcaggccacacgtcgagacaggccgcggacaggcccagctacacaccaggctagcgcaacgcgaaacagaggagcgtcagatagagagggaagcacagcagcacgacacgcacgacagcactcactaggcacgcacgagccaccacagactacacaccagaacagaccaagacaggaacgacacacagccgccagccgcaccgcacgggccagcggcgaacccaccgccagagtccacccaccggcgccgccgacgcgcccgacgcagacggagacgggaggcgcacccagcgaccgcacacctgcaacgaaccacacagacgcacggagcagccaacgacagccgacaccaccaacacaaacagctacatacacagcacggacggcacaccagcactacacacaacacgacgcgcacgaccgccaggcggacggagccaagagcgttacaccacccaagcgaacctgaccgacgaaccacgcggtcacagaccataccgagcaaggcaaggtgggcggggagcgccagggcgctacggacggagcgccggcgagcaggaagctggggcgaaggggggacgcggcggggcacggactcaaccgccgagagcgcgccgggacgcagccgcgcggaggccagtcaccgccggcgcacacgagacacgccacagcacgggaccagacgagcaggcagggccggaacagcgagtggccgcaggcgcgaccggcgcatcagacgagcgggacgcccgcggg

SEQ ID NO: 489414 - DNA, 116 bp, Homo sapiens
gtgaccgaagcatgggacgagaaccctggctggaggtccatctagccctctgcggaaagccaagcgagctcgcctctgctcctccagcagttcggacacatcttcccgaagcttct

SEQ ID NO: 489415 - DNA, 425 bp, Homo sapiens
  misc_feature (414)..(414): n is a, c, g, or t
cagtagctggtttgccttattggacctactatatttatgttgatttccaggtgtagcaagtgcatgagcatctaaacaagggtaggaaaaccagggctcatgggccaaacctggcccccttcttattttgtgaataaagttttattggaatgcagctaagcccatttacttatagactgtctaatggctgcctatgtaccacaacaggagaggtgacaggtttgacaaaggccatgtagccgtaaagtgtaaaatacttattacctggttcttgcagaaagaatttgcccacccctggtctacagcaactctgttgcaggtcaagtaaaggtaggtcatttcactcagtaccacaattcaataaaaaaaaaatcttctgatattaaagtaggctatccctcaccctccaaatanaaaaacaaaaa

SEQ ID NO: 489416 - DNA, 249 bp, Homo sapiens
  misc_feature (52)..(52): n is a, c, g, or t
  misc_feature (146)..(146): n is a, c, g, or t
  misc_feature (183)..(183): n is a, c, g, or t
ctggtctcgaactcctgacatggtgatcctcctgccttggcctcccaaagtnctgggattacaggcatgagccactgtgcccggccaaaatagagttactttaaatttaagtagaaaatttaaaattgttaattgccacattaagnaaaggtttaaaaaaggtgaaattaattttaataaaanattttccagtatattcagaatactattttcaacatgtaattcaacataaaaaatggttaatgaggt

SEQ ID NO: 489417 - DNA, 216 bp, Homo sapiens
ggtcaccgctttcagttcagtcgtggcaccacatctctcacctaacctgctacaagagtctactgctggttatgcttctccgaccctgcatctactgaagcctttccccacagcagccagagaaacttttcaaaagtacaaatgtgatcaagcaagtcactattctatttcaaaccttcaattgcttctcagagcacttaaaagacaaacctttct

SEQ ID NO: 489418 - DNA, 175 bp, Homo sapiens
ttgacaccaagcgggtggtattctgtcattttatagctgttagccccgtaccattgaagaaaaccaggactcagcttcaatcattactttgcggcggtcttaactgtaacaactgggttggagggcatgatggtaaggtgagaggcatttgatgggtagcgatggatgacctgag

SEQ ID NO: 489419 - DNA, 360 bp, Homo sapiens
acctgaggaccacagctaatatacggaccatcccaagacaactacagaccgtatctcatatgaatatagatgcaaaaatcctccacaaaatactagcaaacctaacccagcaacatattaacagaattatacaccatgagcaagtaggaattattccagaaatgcaagattgtttaacatacaaaaatcaatcagtgtggccgggcacggaggctcaccctgtaatcccagcactttgggaggctgaagcaggtggatcacttgaggtcaggagtttgagaccagcctagaccacacggtgaaatccatctctactaaaaatacaaaacatattagctggctgtggtggtgcacacctgt

SEQ ID NO: 489420 - DNA, 918 bp, Homo sapiens
aatgtggtcccccgtatcgcccgatcttgtgggaccccggttcccccctgtacgcggtgaaaccccccgcccccggttagtcgtggtgtactcgccgcctcccccttatgtgggctgctatgtttgtccgccaattgcgtggaatggactctgggccccagctcgtaggctattggttgccgcgtggtaaatcgcggctccgccctataacgttcggtgttctgcgcagagccccttttatgccgaagtttctcctctcttccgcggtttcctcgcgcaaataattccccccgggggaattctcgcgccccctttcagcgcccccgggggagattactaaaaaatatcggggtccgctcaggagagccagccaccaccctgtgtaaaactaatgtgtgtgttggttgtcatacaaggcttgttctgagcgccccctcgagtcagttcacagacgagtaattaactctctcttgttgtgtaacacactactaatacttgcctgggtttgtcccgagacctcgtttgtcgttgttgtataaaatatattagttatccatacaaagaaaacaaacgttgtgtgcatctagccactcggcctgaaatttccccgcgggcattcaccggagcgctaccaggtggtagatactttggtaaaccacacggctgtcctcccggttgaagcatgctggttccttagaggtgtcccgataacacggggataagagacaacacactttggctcgcgactttcgagatcaccacaggaataataatgaccacactctcgacagtattgtctttcggttgctcaattttggtttctatttttatctctgcacatacagacccacccactacgttccccccattgtgaaaaaaaagatttctgcgcgaaaaaaaaaaatttttaaaccccca

SEQ ID NO: 489421 - DNA, 432 bp, Homo sapiens
  misc_feature (186)..(186): n is a, c, g, or t
tcagtcagtatagcagaactagagtcggagtgacattagaatggcacggcaccgctatatcccaagctgggtcctcggtaggttacaggagtcactactagtcactatccgtgaaatcttagaatatcctctttgtcatcacaatatcagatatctactagagccctgcttcagaattcttacatngttgttggtgatgcctagatcgaatgatttatcccatctagcactactcgcagcttctgtgaatttctaagttcagggtgaggctgtacttatacattctataataacacacagactcctactgtactagacgagagttaagagtaataggtccattaaaccacggaaagtccccgccttgtttgttgactgacagtcttgtcttcccctctaattccttcagctcttggacaccggttccgagct

SEQ ID NO: 489422 - DNA, 1133 bp, Homo sapiens
  misc_feature (173)..(173): n is a, c, g, or t
  misc_feature (257)..(257): n is a, c, g, or t
  misc_feature (381)..(381): n is a, c, g, or t
tttccaccctgggccccaatgccgtcctttcctccgcagagactggtcttggaaagcctcagcaaactcagcatccaggacaagaatgtggacctgattactagggccacactcccgccttcaggccgcctgtgtgagtaagttgtatagcactatggtggcgcttcctcagntgaaccgagggagaacgccggtgtgccgggagatgggctgtggatagctgcatggacacatagccatggtctcaggggggacangccctggcaggcgtcgctcgctcgattggccaagtgctataacgggctaggtatcggtgtacaccgtctcgtgcggcttcctctaagacgcgacgatgcgcgtcttgcccgtcgacacgaggtntcgcagcgaggagcgcagcggcaagacgctcgcatcgcgatcgatagcaagagacgcgcaacggccttgggaatggccgagagcatacgttgtagtgacgagtggagtgcctggtcggagtgcttcgccccgtcggcggctggcatgtgccccttgggcgcaaatggctggacggcatgcacgcacgtcaggacgtttatcatctggtgacgaagtcgacgggcgtgtggggacgatcgtcgcgtatcaccggtttgatggaactacacttggttgcacgaaagtcatttcgtggatgtactggttctcgggattcggccagtcagtgacaggccgtgggacagctccccaccctccgtgctgtgtgtgcgtgtgtggatgaacttagaaactgactgttgccctttatttatgcaaaaccaactcagaatccagtttaccctggtgctgtccagcttctcccttgggagcccaagtctctcctggtgctctcgcctgcgtaaactgcgccttcctgcattaggttggggccttctggtcccggtcctcgcttagtccgctagggaccttacccacctctttgttaagacaatggctgccgtaacgttaacacctttgtagtttaaccaaggttccggtggtccggacctgggggaaccacaactagaacgcgtcccaggctgtgtaacggtgcccttaacatgttcacggacgacacaaccgagaccaccgggttttgggggcaacaaaga

SEQ ID NO: 489423 - DNA, 303 bp, Homo sapiens
gttataggaagataaggcgttcaagcagaaacaaaaagaggagcacgaagaaactcgaggagctaaaagcgaaggccgcggtgacaggggcccttagccacaggtgggaattaaggaaatctggcaaaaagtaagctgttccttgtgccctgagtgagatggtgaccccgttatttcatctagtatttaaagcctctctattccctgccataacatcttttgccacgtattagcgtggaatttaagtagtcgtctttgggaattagcttgctggggtaaccgaggctcgaaattcggtaatcc

SEQ ID NO: 489424 - DNA, 244 bp, Homo sapiens
aattcaaaaggaacagaatgatgtcgcctggaaatgcgtgtcctgccccatcccaggactcagggtcctgcacctgaaacggccttgcagaagtcctgtcagtgagacaattagaacaccaacctaagctaacccagcccccatcctgcccttcccgttaattattcctgggctattgggccaagctaacttggaagacatttaggctacagtttaaatgattgataataggccttgccccaaa

SEQ ID NO: 489425 - DNA, 255 bp, Homo sapiens
actttgagaggccaaggtgggtggatcacgaggtcaagagatcaagaccatcctggccaacatggtgaaaccttgcctctactaaaaatacaaaaatcagctggcatggtgcacatgcctctagtcccaactcctcgggaggctgaggcagaagaatcacttgaccctgggaggaggagattgcagtgagctgcgatcatgatgctgactcccagtatgggctccaagactgagactctggctcaaaaaacacac

SEQ ID NO: 489426 - DNA, 1028 bp, Homo sapiens
gcccaggctggagtgcagtgggccagtgtcgcctcacggggacctccgcctcccaggttcaggtgcttctcctgcctcagacgtcctgagtatctgggacgtacaggtccatgcctaccacacccagtctgatttagtatttctagtagagacatggtttcgctattttgtccaggctgctctcgaactcctgacctcaggttatctgttcccacacggcatcccaaagtgctgggattacaggcgtgaactaccgtgcttggcctctgtgtacttctttcttgtctgttattcgttcttcgagatggagtttcactcttgtcatacaggctggagtgcagtggcgccatctcagctcactgcaacctctgtcctcctgggttcaagcgattctcatgcctcagacctcccaagtagctgggattacaggtgtgcaccaccacgcccagctaacttcacgcatccaagtaaaagacagggttacaccacatggtcgggcaggctaggtctcagaaactccttacccctcaggtgatctcacccactatcagtctacacatagcgctgcgaattaccgagctgtgagacaaccgacacctggcaccatcgtccctcttcacccagataaacagtcccgcgttatcaacgtacaactcttccaacaatgatcactccttcacccagataatatccaggctcatcacaaaaccacaactcggaccacacagcatcgacgcactgatccatagaacaacgtaccctgcccgacgagtcaacccccaacacagcacccccgccctcacacccacacccactacaaataagccagaaacacccgcactcattccccctcccacccgaaacgcataaaaataacttactgtttcacctagacaccttcacccactcaacaaccaccgcaatttctttcaccacccgaacacacaaccactcaacccaccctaccctatagcactctcccaccaccacaccacctacccaacaaccaacaatgcactcttcaccac

SEQ ID NO: 489427 - DNA, 280 bp, Homo sapiens
  misc_feature (120)..(120): n is a, c, g, or t
acccagcgggccttgcttttcacaaaggctgagtcttaactgcacccatattttcctggccaccggcagcctggggcgggtgttgccatgtcacagcatgcctctcgccttggaaggaancagtgcctgctctgctgtgagccgccaggaaccctcctcctgtcaatgggggtgtagtatttttgccaaaatatcatgttcaatttcagtagtttgatcagttgaaggctagaagtgtgaagtgcagatgagtgtgtgttcttctgcaaggaacccacgg

SEQ ID NO: 489428 - DNA, 915 bp, Homo sapiens
atggcacatgcaggcgcaagtcggtctacaagacgctacttcccctatcatagaagagtttaatcaccttgcatgatcacgccctcataatcatttcccttatctgcttcctagtcctgtatgcccttttcctaaacattcacaaaaaaactaaataataataacaatatctagacgctcaggcaaatagaaaccgactgatctatcgtgcccgacaatcatcctagtcgactttcgacctcccaatcccatacgaatcctttatatcaaccggaggcagggcccacggatccctccgcttaacatcaaatcaggggcgccactagtggtaacttgaacctacgagtagaccgactacggcggactattcttcaactcattacatatcttatccccatctattcctagacatccaggctgaactgagtactaccttgaagtagacaattacgaggtagatactcccgatttgaaggaccccattgcgtattatgaattatacttcaaaagacgtcttgcctccatgagctgattcgccacataacaggttaaaaactagatgacactccccggagtactaaatcagaacaattaacgctacacgaccgggagaaatataggtcaatgctctgcactccgggagacaaccaagatacatgcccagccgtccagaatacgtcccctagactcttgcataggccgaatttactatgaaccataagcgtagagcaaaaaaagcaggcaaaaagtggcgctacgcagcaaagatccaacactatgcggggccgggaggaagccacggcagagaccgaccaaggagtcacaacaccggacagtgaaacaaggggagggtaagacgcaacagcgacgcgaggaaccgagggagaacaggcgcagccaagggcaccaacggag

SEQ ID NO: 489429 - DNA, 406 bp, Homo sapiens
  misc_feature (338)..(338): n is a, c, g, or t
  misc_feature (360)..(360): n is a, c, g, or t
tggaacttccggggtttatatagctaaagcaatcctgagcaaaaagaaaaaaactgaggtatcatactatctgacttcaaaatatactacacaaagctatacttaccatatatagctttatgagactggtataaaaagacacatagaccaatggaatagaatagagaattcagaaacaaatccacgtatttacagccaactgattttcgacaatgatgacaagaacacgcattgggaaaaggatactctcttcagtaaatggtgcttggaaaactggagatccatatgcagtatgaaactagacccctacttctcaccctatacaaaaatcaactcanaatggattagacttaagtgtangacatgagaccacaaaacccctagaagaaacatagtgagagatgct

SEQ ID NO: 489430 - DNA, 848 bp, Homo sapiens
gcgcgagcctggagcgcggttcgaggtgggcagcgccgccttccgccgcacgccgccccgtcgctcactccggtcggcggccagagtgccgtgctcgcgcttgccacactctcgcagccaacggtgcgcccagcggccatgaccgccgaggagatgaaggcggcggagaacggggcgcagtcggcgcccctgcctctcgaaggagtggacatcagccccaaacaggacgagggcgtgctcaaggtcatcaagagagagggtacaggcacagagacacccatgatcggggaccgagtctttgtccactacactggctggctgctagatggcacaaagtttgactccagtctggaccgcaaggacaaattctcctttgacctgggaaaaggggaggtcatcaaggcttgggatattgctgtggcaaccatgaaagtgggggaagtgtgccacatcacctgcaagccagaatatgcctatggcgcagcaggcagccctccgaagatcccccccaacgccacacttgtatttgaggtggagctgtttgagttcaaaggagaagatcttacagaagaagaagatggcgggatcatccgcagaatacggactcggggtgaaggctatgccaggcccaatgatggtgctatggtggaagtggccctgggaagctaccacaaggaccgcctctttgaccagcgggagctctgctttgaagtcgggggaaggggcaagtctagatctggcctgtggggctgggaggaggccattagggcctggagacagaggagattccattggggtactaaaactagtatggcttagggaggttgggacaggaggtcccaatccac

SEQ ID NO: 489431 - DNA, 207 bp, Homo sapiens
tctcaggagactggggatgattgaattacctctgtacgaggttgtaagtcatctatagaatccaagtcattgtgcctatcatttttcaccctggtgggttgggaaactcatggtgaaatgatacctctgcccccaaccacccttttctctggattcttcttgcttagttacatatgcctttttcctgccctcttgctaacatgtgct

SEQ ID NO: 489432 - DNA, 306 bp, Homo sapiens
gagggtagccaggccgccattgccggtcgtgcctgggccgttgccgccggcgatgacggtgagcattccagaagcatccaccttctgcacgctgccggtgaacgcctctgcgatgtagacgctcccgtccggaccgatggcgagatcctgcagactgttgaacggattggccgccagcgcagagcccggcacgcccgcaccgtagccggcgaacggcgcgatgatcccgtctggtccgacgcgacggaccacgtacggtgacgctccacccgcgacgttcgctgcgatgtagacgtagcctgcggc

SEQ ID NO: 489433 - DNA, 299 bp, Homo sapiens
aatcatattgattaaatgatgtgtgagatgtatcacattttcaggcactgtgtaattctattgtaatacactggcaggtctctttgtacctataaatagtgcatgctcagccatgtacactgtaaatagccttataccaaacgtgttagacaaggaccataattaacatcacttcgtgcattgtgatacagaacaaacagccatgatttattcgatgtgattggcttgtttttatgtggcgccaagaacgaacctgtttaacagctgtaaccaatggtactgatctatccatccaatgt

SEQ ID NO: 489434 - DNA, 227 bp, Homo sapiens
gaatttaaatgagaaacagctacggagatcacataattttgttcggcctatgttaggtactccatgtttgaaaggtaaagtgctagtcagcaagcagtctcagaaaaacaaattatttacaatttcatttcgggaaattctacgagaaaactggacagtgactaagtaaagatggccacactggcaactggaccatattgcaactatttaaaacgggacggcactta

SEQ ID NO: 489435 - DNA, 396 bp, Homo sapiens
cgggtgagtgagtagaaaacaatgtttaaaacattcttcagagtgatgatttctaatacccccctttcctctggggcttttgaactgtattaaagggggatgagggataatgtttataagtcaaacataagatatggtacattgggaaaatatctcctctgggggtgctaaaaataaattaagaacaggtagcctgggcaaaccaggaagcaccaaaccccttttcagtgagaactcttctttgacaggtgtgagaaagtgtgcatctaacagacagcgcagaacacactgagacttgaatcaagacagcaacagagcaaaataaaggttagataagtccgggtgtagcaaatttcggagcataagaaataaaatctaataaattcttaggggatc

SEQ ID NO: 489436 - DNA, 264 bp, Homo sapiens
tgacccacaaccgctgctaactagtatagaggctgggtttgaattggacgaggctcctcgcctccgagcacagcgcgctctgagctgccccaggatcctcccccgccgccagcagcccatttggagggaggaagtaagggaagatggatgaggaaggggatgcctggaccgactacccagacagagccggtgaatgggtttgtggtgacccgacgtcttacccaaccccttgtttctttctactctctctttcttacgtaacta

SEQ ID NO: 489437 - DNA, 204 bp, Homo sapiens
gatcaccaaaatggcaatctttatataaggaccaatggtgaacctctgctctatctcagtcgtcacacggtgaagcctcgagacctctccacatttctattcggctccattcgaggtgcagcccccgatggctgtggacacccggggccgcagtgcgctcacatctctcagccggactcctgacccatctgatgcctgcgcttg

SEQ ID NO: 489438 - DNA, 843 bp, Homo sapiens
  misc_feature (322)..(322): n is a, c, g, or t
  misc_feature (834)..(835): n is a, c, g, or t
  misc_feature (842)..(842): n is a, c, g, or t
gagcgggggccagtcgggacagaggagacaagatggcgctgcgggcgatgcgggggattgtcaacggggccgcacccgagtctacccgtgcccaccggtgggccggcggtgggagctcggggagcaggcgctggactacgtcagtcggaactacctctcccaagcctcgcctcgacatacaagacagtatctgggagtcagatggtccactagtgatcttagatcatgttaagtttcccaggtatgcctgaaattgtccatttgaccttaccggattggcacaaagagaagtgggcaagttctggaagttagtggttccaanggcagtagttcaggtatttgaagggacttcaggtatagatgctaacgaaaacgtcctgtgagtttactggggatattctccgtaatcaccggtgtctgaggatatgcttggtcgggtattcaatggatcgggaaaacccattgacagaggtcctgttgtactggccgaagacttccttgatatcatgggtcagccaatcaagcctcaatgtcgaatctacccagaggaaatgattcagacttggcatttcggccatcgatgggatgaacagtattgctagggggcagaaaattcctatcttctctgctgctgggctaccacacaatgagattgcagctcagatctgtcgccaggctggtttggtaaagaaatccaaagatgtagtagactacagtgaggaaaattttgcaattgtatttgctgctatgggtgtaaacatggaaactggccggttcttcaaatctgactttgaagaaatggtcatggacaatgtctgctcttttgaacttggnnatgaccna

SEQ ID NO: 489439 - DNA, 210 bp, Homo sapiens
aagtggtggcggaggtcgctctacgacggctcccctagacgtccactctacaccaatcgtatactcgcatcgggagtatcaatcagcggagctcaccatagtctaatagaaaacaaccgaaaccaattaatgcaggcacggtttattacaagtggggggggtgtctcatattttaccctccctacaacgcctcagacgtacttgcgagtc

SEQ ID NO: 489440 - DNA, 870 bp, Homo sapiens
ggctcagaattggggacgctctcagctctcgggcacggcccagttccttcaaaatgtctatgtcacgaaatcctgtgcaagctcagctgtgagggtgatcactctaacccccaagtgcatatgggtctgtcaaagcctatacaaacttgtgattgctgagcgggattgctttgacccatggaaacagccatcaagaccaaagtgtgtgcatgaggtcaccatgtgtcaaccatttggaccaaccgcagcactgcaccagagacgaggtatatgggccttgcgcctacccagagaggcggccaaaaagggaactgtgcatcagacatgaagtcagccttatctgccaccttgacggacggtgatttgggcctatgtgacagacacctgctcaggtatgacgcttctgagctaaaagcttccatgaagggggcttggacccgagcgagactctctcattgagatcatctgttccagaaccaacaggagctgccgcacatacacagagtctacacgtgacttgtacacacgacttgatcgtgcaacggacattcattccgggaccccattcctggtggactttccgcgaagctgcttggtgggcccgccaacgggtagaacagcacgcgagtgaccgggcagtgacttatgacggtgaccaagcagcccggggactttatgacggcgggtgaggagacagggactgtggccacgggacagcacaggccgccgcgcgcgtccaccctcaaaagcttgtggcaaacaataccccctataaatggggcagtcgaaggggacgccacgacagccccgactggagtcacacccgatggcgcgcgacacgaacggcgagccctactccgcaaggcgcca

SEQ ID NO: 489441 - DNA, 357 bp, Homo sapiens
  misc_feature (165)..(165): n is a, c, g, or t
ccccgagttggagtctcactcctgtcactccaggctggcagtgctagtgggtgtgatctcaggcttattgcaacctctgcctcccgggttctagcatttctcctgcctctgccttcccttgtgctgggattgcaggcatattctaccatgctgggcctgaacatnatttcaagaggaggatttatgataccattttctgtcatctaatgattggtgtcattttcccatttgccaatgttgtctcacttcccagaaaattagggagcaagaactggataattccttctacggcgcttgctagggtttcatgtgttccttataccccttcttcatgcaactctcaaagtggggtccgta

SEQ ID NO: 489442 - DNA, 1433 bp, Homo sapiens
gactcacagagaagcacagatgcaatacctagacgtagaacttgataccagagtccacaacagcctaatggtgggctgccatcaattggatcctgcctgggaggaggacttgaggtggcccactttcattgctcaagtatagaactaaggcgatcaaataggacagggaaaaaacatgtgagttagagtaccccatgaaatgttgtctgctggagggccgttatcaagcgaagcaatcgaggcagcacagaagggcctgcccagagatttggatgggttgtgcctctgcatgcatattaggatcttgaatagcttgacatgagtataaggctaattacagttggcctagatcacggggccaaatatgaaagatagtaggcgatccttgtgattagatcacaaaaactagaggttgaggatatcactccgttgcgagatcgcatgggagcgtttaataatcccttcacagaaagagtaaccttagtagccacaataggaaatttactccttagaaaaagaatgattagcaatctctatgcttttgaccagagatgcactaagctggagtagagaagagtctcttccaaaaggaagacgagcaaatggcggagtacgtgaccgtggatacaaatttgaacacgacgggtgacttcccatgacgtaatatccacttgggtcaaaggcaaacctgggattttaccacaataaatagcgctggacaccgaacaaagagggtgcggaccacatgcatgaagcgtaatagaagaggcccactttttatttcccatgacaagcccgttcattgatacaccatacttaccactttggaactcggtcggggttaaacaggaacattggcgacattttcggacggccaacaaggcggacggttcgacatgcactgtggtttcaattccttcattgattggaacaacttcatcaagaaaaacttacgtccctggggaacggaactcgcgttcgcataaagtggacacgccaaaatctggaacatgtcactcaacgcgcccctttggacatgggggcaacggatctaaactcaacatgcggggtacacaagcagctctcccctgggttgacgccacaggaaacgcgcacattacaccaattatctggggtaggcatcccccaaccaaggtacaagggtgacctgttacacaggctacttccctagtggcgctaattacccttgggtgtggccaagggagctgtgacatgggcgaactcaccagaggagcattaggcgccaccaaagcgatatcttcccggatggcatatagaaggcgggctcaagaaggcacgctaatttagcggtaaaaaagaacaattgccgcgacagctcaacatgagggcacatgaactgaagagaacaccaacacaaaagtgatacaacgagaattggaatgaaccaaaca

SEQ ID NO: 489443 - DNA, 111 bp, Homo sapiens
ccatacagcacactcgcgcgtcgcgcgcgcacacacacacagtcaccttcctccaccctggtgagccagcccccaggaggagtcttttcctctaaccaccctgtgtggtcc

SEQ ID NO: 489444 - DNA, 3670 bp, Homo sapiens
  misc_feature (254)..(254): n is a, c, g, or t
  misc_feature (595)..(595): n is a, c, g, or t
  misc_feature (617)..(618): n is a, c, g, or t
gtaataagccatttatatcagaaaccttttttcctgccacagaagctttaaattttcccctaagagtacaaagccaagagagtgtggtttatctaaatgtcctgaaatccacttgtcattccttaatttctcctctatgcaattaaagagaaaggggaaatctataacatttcttttgcccaagtgacacaaaaatgattactgcatagaaatcaaatgtaagtttagcttctaaatgaaataatatatagganggatatcagaatgtctagatagagaaagtattttcaaattcttgaatatatggatgctattaaaagctgctttccattgcctggaaagagagcttttttccctcctctattcagtgtttcaaactttggtcatctcaaattattgtcacttttaaaatgttaatgtcattctgagcagaaatagatatattttcagatttttttacactgatgctactccgtaattgcttaggagtattgtccatcatagtattttagaactagaagtaaacacataaatccttataaattacccaatccaactttctcatattgcatgtagagaacctgagacacatatnaaagtctagaatccttaacttnnccccatttggtttttttccgcctcataacaccatgctgcctttccctcatatgatcaccaagccagtagctgagttcaaaaactacatatttcttgggcagtcctctactggtatgtgatgccaactttgatttctttcgaagataattgccttctttgcctagccaagcagccaattttatgggagaaaagcaagttatatgttcacaagaatggaaggctttctacctaaatttattctcatctgtggtcctcttattctcttccatggcttctgacatacagtggaaaaacttggccaacgatgtgctctacatatagtgcttgtgtcgggttaacttttccattaatttctcaacatcaattattcaggcccctacagttgtggtattgaggcccctaaaggcttctgcctttcaccaattagtgctgccagttactgaggcttctcccaaaaggtatcagtccagtcttaaagatatttcattgtgaaagaagaaactaaactatcaggcctcttttacaaaatgagagattgaatttaagcttgtcaagcacgtactggaaggtatgaattacactaccatgtgttttgtatcttccctttcaagtgatgatgttaaatgaaggtaagtttttcatccttttttaatttttgttttttataaatcatttcagctttttctggtttatagaggtgtcttatttctaatgcaacagacccccaactttaacagatttgatatggatgcatttattcacaagcaaccccaaaagtccaaaaatgtaataattttgacaaggcccaaagttgagatgctatgaagcttgtgtgtgtgaaaagtcagttatgattgtctggagagaagctgtggtgtgtatgctgtagagtttccacatttcacatgcagtgtactccaaaaagcgggtttgggtcaaccatttcccatctctttttaagaagtgactgctgttggggccaggggacatcatgggaggtggggctgtccagttagctgtgccctgcaccttcagcccaggaaagatttgaacagagcaaaggcttcaagagagggcagaatgtattcggcagaaaagggactcaggtaagcccagcctgggatgagagcagaaaagcattcaagatttgcaggccttgctatggatgcgcttaatcaccatggaggccagcaatacccatctcagcatggctttgatattctctacttcctggcctttaaaaatgacctataatttttcagtttgctttactatattttataaagaaaattctatcttatggttgattgagcattgagacttatgaaggcattaggatagatagctcaggaatgtaaaggttcagaaaaggtctgttttctcagattaacaaatatgatggattccatggctgaccttggtgcttaaaccaggaggtttcaatctagtcctagagttgtgtccctctgaaaggcccaatgccatgtaactaactttaaactggatatatactttgagccttacttaattcacagataagttgacttaactcagtatttttatttcaattaatgaaaacagtcctcttttcaaccccaggttgcttacattttgctggtctccccaagtgaccattggtggagaccaattaatgaaggaatgaaattcactttattgggactgtggtattcaacagagccacacttaaccactttttccaatgaagaatctccagaatgataatgcccaaatatggatggccaagaagaatttgtatctacggtgtgctttatgtgtttttgacactgctgtattctgtgtgatcaagtgatttgcagctggttccaatgtgactgagtgttctcaaagatttctagtaactaagtcaacttaattttcttaagcctggtattactatcagcctcacatttaccactttgattctagttttttaactgttcataacagggcataccgagggttgggatgagagcctacttcctacctcttaaggcactttcctcattattttgccatataatcttgaactgcatgataagctgtttaaatgtccatgacttctcccagagcaactagcaaagtatatgacattttgaatagagattagtggaaaggaaaatgtagagatttaagttcagaggtacaaacctcaataaaacctccttagagcacataccatgagtagagtatatgtaaacgtatatgagaagagagtcgctataatagtcctctctaagtagattagttcattgtctaatggaagtgaacatctttactcctgttatcaccatagtactgaatgaactgtataatgagtttttcaaacaagtatttaaaatagaactttcacgtacaaagcaagggcataaagattttggtttgtgtttctgtaagtgtagtttaccatctaaagctttggtttttaattttaaaaaaagcttcaaggtattgccattccttagcatccttattgattatgggtgatgagtttttaactcttaaaatcatatacgtgtattagtttatcttaactgttgccctaagcaaaagggaaggtatacacctaagggatgtacttattttgcatttttggtcatgggtgggaatggggtgggtgcctacttaaatagtttttaaaaaagaaaaaaatcacaaatatttttctactgttatatatgatcttcctttatactagtttctctctagtaaggcatgccagaagcccaagataccatatcatgaattcttacatattgtaccttttgttggtggttaaatcgcatcagatgcttggcattgctgccataattataaaatgcttgtaaaggatcaaatatcactaaatactttaaattgttttacttaagagtctaatctgggaagttttcaaatcatactattaatgtgtaatctaagctcttcagatgtatccatgaataatcctggaacaatattgcttgtattcctgtcatagaacaggttttgtaatctttaaaagaaatgaaaatttatataataaagtttcaaatca

SEQ ID NO: 489445 - DNA, 274 bp, Homo sapiens
  misc_feature (36)..(36): n is a, c, g, or t
agggcctgagccttaccttattagccttgttgctgncttgagacccagctttgcttacaagcattgaagctcatttgaacacatgtgactgggataataaatgccaaagtacagtttaatgaagacaagtgtcatgtctttcagttcttaataatttcctcaaccacagcccatgaaggctgcgttcagatgggcttttgtaattgaaagcaaagcctcttaacatccttaaatttcccgcctacttaaccctaaatgctataactggtggtgt

SEQ ID NO: 489446 - DNA, 3795 bp, Homo sapiens
  misc_feature (254)..(254): n is a, c, g, or t
  misc_feature (595)..(595): n is a, c, g, or t
  misc_feature (617)..(618): n is a, c, g, or t
  misc_feature (3689)..(3689): n is a, c, g, or t
  misc_feature (3746)..(3746): n is a, c, g, or t
  misc_feature (3753)..(3753): n is a, c, g, or t
  misc_feature (3760)..(3760): n is a, c, g, or t
  misc_feature (3789)..(3789): n is a, c, g, or t
gtaataagccatttatatcagaaaccttttttcctgccacagaagctttaaattttcccctaagagtacaaagccaagagagtgtggtttatctaaatgtcctgaaatccacttgtcattccttaatttctcctctatgcaattaaagagaaaggggaaatctataacatttcttttgcccaagtgacacaaaaatgattactgcatagaaatcaaatgtaagtttagcttctaaatgaaataatatatagganggatatcagaatgtctagatagagaaagtattttcaaattcttgaatatatggatgctattaaaagctgctttccattgcctggaaagagagcttttttccctcctctattcagtgtttcaaactttggtcatctcaaattattgtcacttttaaaatgttaatgtcattctgagcagaaatagatatattttcagatttttttacactgatgctactccgtaattgcttaggagtattgtccatcatagtattttagaactagaagtaaacacataaatccttataaattacccaatccaactttctcatattgcatgtagagaacctgagacacatatnaaagtctagaatccttaacttnnccccatttggtttttttccgcctcataacaccatgctgcctttccctcatatgatcaccaagccagtagctgagttcaaaaactacatatttcttgggcagtcctctactggtatgtgatgccaactttgatttctttcgaagataattgccttctttgcctagccaagcagccaattttatgggagaaaagcaagttatatgttcacaagaatggaaggctttctacctaaatttattctcatctgtggtcctcttattctcttccatggcttctgacatacagtggaaaaacttggccaacgatgtgctctacatatagtgcttgtgtcgggttaacttttccattaatttctcaacatcaattattcaggcccctacagttgtggtattgaggcccctaaaggcttctgcctttcaccaattagtgctgccagttactgaggcttctcccaaaaggtatcagtccagtcttaaagatatttcattgtgaaagaagaaactaaactatcaggcctcttttacaaaatgagagattgaatttaagcttgtcaagcacgtactggaaggtatgaattacactaccatgtgttttgtatcttccctttcaagtgatgatgttaaatgaaggtaagtttttcatccttttttaatttttgttttttataaatcatttcagctttttctggtttatagaggtgtcttatttctaatgcaacagacccccaactttaacagatttgatatggatgcatttattcacaagcaaccccaaaagtccaaaaatgtaataattttgacaaggcccaaagttgagatgctatgaagcttgtgtgtgtgaaaagtcagttatgattgtctggagagaagctgtggtgtgtatgctgtagagtttccacatttcacatgcagtgtactccaaaaagcgggtttgggtcaaccatttcccatctctttttaagaagtgactgctgttggggccaggggacatcatgggaggtggggctgtccagttagctgtgccctgcaccttcagcccaggaaagatttgaacagagcaaaggcttcaagagagggcagaatgtattcggcagaaaagggactcaggtaagcccagcctgggatgagagcagaaaagcattcaagatttgcaggccttgctatggatgcgcttaatcaccatggaggccagcaatacccatctcagcatggctttgatattctctacttcctggcctttaaaaatgacctataatttttcagtttgctttactatattttataaagaaaattctatcttatggttgattgagcattgagacttatgaaggcattaggatagatagctcaggaatgtaaaggttcagaaaaggtctgttttctcagattaacaaatatgatggattccatggctgaccttggtgcttaaaccaggaggtttcaatctagtcctagagttgtgtccctctgaaaggcccaatgccatgtaactaactttaaactggatatatactttgagccttacttaattcacagataagttgacttaactcagtatttttatttcaattaatgaaaacagtcctcttttcaaccccaggttgcttacattttgctggtctccccaagtgaccattggtggagaccaattaatgaaggaatgaaattcactttattgggactgtggtattcaacagagccacacttaaccactttttccaatgaagaatctccagaatgataatgcccaaatatggatggccaagaagaatttgtatctacggtgtgctttatgtgtttttgacactgctgtattctgtgtgatcaagtgatttgcagctggttccaatgtgactgagtgttctcaaagatttctagtaactaagtcaacttaattttcttaagcctggtattactatcagcctcacatttaccactttgattctagttttttaactgttcataacagggcataccgagggttgggatgagagcctacttcctacctcttaaggcactttcctcattattttgccatataatcttgaactgcatgataagctgtttaaatgtccatgacttctcccagagcaactagcaaagtatatgacattttgaatagagattagtggaaaggaaaatgtagagatttaagttcagaggtacaaacctcaataaaacctccttagagcacataccatgagtagagtatatgtaaacgtatatgagaagagagtcgctataatagtcctctctaagtagattagttcattgtctaatggaagtgaacatctttactcctgttatcaccatagtactgaatgaactgtataatgagtttttcaaacaagtatttaaaatagaactttcacgtacaaagcaagggcataaagattttggtttgtgtttctgtaagtgtagtttaccatctaaagctttggtttttaattttaaaaaaagcttcaaggtattgccattccttagcatccttattgattatgggtgatgagtttttaactcttaaaatcatatacgtgtattagtttatcttaactgttgccctaagcaaaagggaaggtatacacctaagggatgtacttattttgcatttttggtcatgggtgggaatggggtgggtgcctacttaaatagtttttaaaaaagaaaaaaatcacaaatatttttctactgttatatatgatcttcctttatactagtttctctctagtaaggcatgccagaagcccaagataccatatcatgaattcttacatattgtaccttttgttggtggttaaatcgcatcagatgcttggcattgctgccataattataaaatgcttgtaaaggatcaaatatcactaaatactttaaattgttttacttaagagtctaatctgggaagttttcaaatcatactattaatgtgtaatctaagctcttcagatgtatccatgaataatcctggaacaatattgcttgtattcctgtcatagaacaggttttgtaatctttaaaagaaatgaaaatttatataataaagtttcaaatcaaaaaaaaaaaaaaaaaaanctcgcccacctaccacacattcggggacccgtatacataaaatctagacaaaaaggnggatcgncccccangctggttcagccacccatggcctccatgncttttc

SEQ ID NO: 489447 - DNA, 2480 bp, Homo sapiens
  misc_feature (2374)..(2374): n is a, c, g, or t
  misc_feature (2431)..(2431): n is a, c, g, or t
  misc_feature (2438)..(2438): n is a, c, g, or t
  misc_feature (2445)..(2445): n is a, c, g, or t
  misc_feature (2474)..(2474): n is a, c, g, or t
cctagttttagaagtttcaatagcaccccaactttaacagatttgatatggatgcatttattcacaagcaaccccaaaagtccaaaaatgtaataattttgacaaggcccaaagttgagatgctatgaagcttgtgtgtgtgaaaagtcagttatgattgtctggagagaagctgtggtgtgtatgctgtagagtttccacatttcacatgcagtgtactccaaaaagcgggtttgggtcaaccatttcccatctctttttaagaagtgactgctgttggggccaggggacatcatgggaggtggggctgtccagttagctgtgccctgcaccttcagcccaggaaagatttgaacagagcaaaggcttcaagagagggcagaatgtattcggcagaaaagggactcaggtaagcccagcctgggatgagagcagaaaagcattcaagatttgcaggccttgctatggatgcgcttaatcaccatggaggccagcaatacccatctcagcatggctttgatattctctacttcctggcctttaaaaatgacctataatttttcagtttgctttactatattttataaagaaaattctatcttatggttgattgagcattgagacttatgaaggcattaggatagatagctcaggaatgtaaaggttcagaaaaggtctgttttctcagattaacaaatatgatggattccatggctgaccttggtgcttaaaccaggaggtttcaatctagtcctagagttgtgtccctctgaaaggcccaatgccatgtaactaactttaaactggatatatactttgagccttacttaattcacagataagttgacttaactcagtatttttatttcaattaatgaaaacagtcctcttttcaaccccaggttgcttacattttgctggtctccccaagtgaccattggtggagaccaattaatgaaggaatgaaattcactttattgggactgtggtattcaacagagccacacttaaccactttttccaatgaagaatctccagaatgataatgcccaaatatggatggccaagaagaatttgtatctacggtgtgctttatgtgtttttgacactgctgtattctgtgtgatcaagtgatttgcagctggttccaatgtgactgagtgttctcaaagatttctagtaactaagtcaacttaattttcttaagcctggtattactatcagcctcacatttaccactttgattctagttttttaactgttcataacagggcataccgagggttgggatgagagcctacttcctacctcttaaggcactttcctcattattttgccatataatcttgaactgcatgataagctgtttaaatgtccatgacttctcccagagcaactagcaaagtatatgacattttgaatagagattagtggaaaggaaaatgtagagatttaagttcagaggtacaaacctcaataaaacctccttagagcacataccatgagtagagtatatgtaaacgtatatgagaagagagtcgctataatagtcctctctaagtagattagttcattgtctaatggaagtgaacatctttactcctgttatcaccatagtactgaatgaactgtataatgagtttttcaaacaagtatttaaaatagaactttcacgtacaaagcaagggcataaagattttggtttgtgtttctgtaagtgtagtttaccatctaaagctttggtttttaattttaaaaaaagcttcaaggtattgccattccttagcatccttattgattatgggtgatgagtttttaactcttaaaatcatatacgtgtattagtttatcttaactgttgccctaagcaaaagggaaggtatacacctaagggatgtacttattttgcatttttggtcatgggtgggaatggggtgggtgcctacttaaatagtttttaaaaaagaaaaaaatcacaaatatttttctactgttatatatgatcttcctttatactagtttctctctagtaaggcatgccagaagcccaagataccatatcatgaattcttacatattgtaccttttgttggtggttaaatcgcatcagatgcttggcattgctgccataattataaaatgcttgtaaaggatcaaatatcactaaatactttaaattgttttacttaagagtctaatctgggaagttttcaaatcatactattaatgtgtaatctaagctcttcagatgtatccatgaataatcctggaacaatattgcttgtattcctgtcatagaacaggttttgtaatctttaaaagaaatgaaaatttatataataaagtttcaaatcaaaaaaaaaaaaaaaaaaanctcgcccacctaccacacattcggggacccgtatacataaaatctagacaaaaaggnggatcgncccccangctggttcagccacccatggcctccatgncttttc

SEQ ID NO: 489448 - DNA, 150 bp, Homo sapiens
agccacggcgaatcttgaaagcgagcacaaaccatataccggagctagccacaggtaagcggtgagggtgtattcaatatgggattaaaccggtgttattgctggagccagtaaatattctccagaggattctgagcaaataaaacagat

SEQ ID NO: 489449 - DNA, 638 bp, Homo sapiens
  misc_feature (536)..(536): n is a, c, g, or t
  misc_feature (553)..(553): n is a, c, g, or t
  misc_feature (561)..(561): n is a, c, g, or t
  misc_feature (565)..(565): n is a, c, g, or t
  misc_feature (590)..(590): n is a, c, g, or t
  misc_feature (595)..(595): n is a, c, g, or t
cccttccccttccggggggggccccttttttaaaggggctttttttcacacggggaacccccccccccccttggggggatttttttattaaaagggattttcccaattcgcccttgttttaaaaaaaacgtttttacaaaaatttttcccgctttttttcaaaaatttaggcgccaaaaattcccttcccccaaaggggggggcaaatttgtaaaagggcaatcgggggcccctttttttatttcccccttctggaaaaggggtttttcccacacgcatataatgtgggacccccggggtttcccccatccccgtgttttaaacccggccccgtaaattttaaaaccccccctataaagggaatgtgtggcccggccccccccctaaggttttttttttttttttaccctttccttaagaccaacccctgttgggtttccagtaagggaaaaaacgccctgtggttgatgttaaaaattgggctgttaattgcaggtccagggttttaatctggcccaggcctatgccggagaagnaatgttttcatggtacntatactanccantagtctttctataggggtgatagantggtnccaattgggtgtgaggagttcagtactatgtccgggatttttt

SEQ ID NO: 489450 - DNA, 726 bp, Homo sapiens
cgattgccaggagtagtagtcagcaacaggtgcaagtcaggtcaggcctcgtgttcgtgatagagtggcgaggtgcaaatctgccagttgaccattggagtggagctgatcacggatgaagtgtttgccgatcagattgagcttcccgcgcaacaaaggtggtgggtcgtctttggccccggtcgccgatttcgtggcaaggggttgaaacagaggtttcgcctccaataccagtggttcacaataattggaccttgaccctttccctggtcagtctgtcgctggtttggtcctgcagctccgagatcgtgtccagcgcccccaagcctttagaaaggcctgatttctccctgctgtctccttcggacacgggcttgcctcgtgtggttttttttacgggcgtcgacgtaatgtccgcccactctcctgctcttctccgactggtattttttggtacggtctatgggtcactcgctgggcccacccctgccctcggctactgtccacaatctccacatctcgagtgaacattcaatagtaaatacatacagaaatatataaaaccataaatacacaacaataagaaaacacaagaaaacacaagaaaagacaatacacaacacaataaataaaaataaaaataagaaatagagaaaaaagaataacaaagaagaaacaagggcaaacaaaaaataaaaaaaaaccaacaaacacaatcatatcgca

SEQ ID NO: 489451 - DNA, 197 bp, Homo sapiens
aaaaccatcggagctgtggtcgctactgtgatgtgtaggaggaagagctcattttgaaaaggagggagctactctcaggctgcgtccttctacagtgcccagggctctcacgtgtctctcacagcttgaaaagcctgagacagctgtcttgtgagggactgagatgcaggatttcttcacacttctccttcagactt

SEQ ID NO: 489452 - DNA, 676 bp, Homo sapiens
  misc_feature (283)..(283): n is a, c, g, or t
cgataatctcaatcctccaacagggagtccctcgatcagtcacaagctatcgctctaacggttggatgagtgttctgtctggcactactcggccagtggccatctgcaagttgctttcatctgcggacatagcatcgtgtcacgactcagagtctgagtaatcagtggatctatcttcaactcgctaagatagtctcagcagtccatgtaggcatgtgctgtatgctgttccagagagaccttcgctcatttaccgatgtccactagacgcgaggtagatacncagtatagggtcatagcgcatgtagcgtcttgaatgcgtctgcagtagtacgatccctttaggcatccatcaggacacaatagccgtgtgtctttcagtttctatgagcagtcatctacagaagtgatctggactgctcatggcgcatgtcagtctgtagcagcagccaatcggtcttcaagtaggtcaaacccgtcccaggtagatcctgcagtcacagtatcctaacattacatagcgcatgcttgggccgcatctagattttcaatataacatggtgcatctgataatcagagtatggcaactccgcatctcatcactcgacctggagcagtcatcctcagtttctcagcaccagatgaacttatttacagagggcgatcctgaatcacc

SEQ ID NO: 489453 - DNA, 3567 bp, Homo sapiens
ctctgagttagagtcggtaaaggaaaacaagccatacatattgcagcagagcggctttaacacaaggagctggctacccagctgtgggagggctagaaagcaaatgggaacgctgagtaacctaacagtagagattgcagggagcagttaccttgcctagggctgagaaactaaacgagaagattaggatttccagaagccacaagcattgaggagagatcctgtggaccactgtccaagtacggctgcagctctgaggggcccaaggagctggttatgggatcattgggaaaagttggagtctgcaatcaactgcccctaccgagaggaccctgatgagaacagcagcatgcagaaaggagcaagcctgctctgtcctcctaccttccagtcgccctcttggtcccccttttggctgtacctaacagttggaaaaaggagaacatggtttgcagggctctggcatcacttagtagaggatagaagagtgagtgtggagcagggacagtcgcttaataaagggcaaggggctgactcacaagacctgcccaactcagccagagctgttctgccaggggccagaaaggccatagggccctgacttgcactgccactgccagctgtgactctagaactttgcaaagcacctttccacttacttataataactggtagtaagtgacggccatgtcttccttagaatgtaaaatactaccaaggtatccgggctgccgtgagcagggtgaaggacagaggacagaaggccttggttctcgacattggcactggcacgggactcttgtcaatgatggcggtcacagcaggtgccgacttctgctatgccatcgaggaaaattgtgaggccgtgccccacagagccaccgtctatgcacagctggtggagtccgggaggatgtggtcgtggaacaagctatttcccatccacgtgcagaccagcctcggagagcaggtcatcgtccctcccgttgacgtggagagctgccctggcgcaccctctgtctgtgacattcagctgaaccaggtgtcaccagccgactttacagtcctcagcgatgtgctgcccatgttcagcatagacttcagcaagcaagtcagtagctcagcagcctgccatagcaggcggtttgaacctctgacatctggccgagctcaggtggttctctcgtggtgggacattgaaatggaccctgaggggaagatcaagtgcaccatggcccccttctgggcacactcagacccagaggagatgcagtggcgggaccactggatgcagtgtgtgtacttcctgccacaagaggagcctgtggtgcagggctcagcgctctatctggtagcccaccacgatgactactgcgtatggtacagcctgcagaggaccagccctgaaaagaatgagagagtccgccagatgcgccccgtgtgtgactgccaggctcacctgctctggaaccggcctcggtttggagagatcaatgaccaggacagaactgatcgatacgtccaggctctgaggaccgtctctctcctcctgggcgagccgttcttcactaccagcctgctgccgtggcacaacctctacttctggtacgtgcggaccgctgtggaccagcacctggggccaggtgccatggtgatgccccaggcagcctcgctgcacgctgtggttgtggagttcagggacctgtggcggatccggagcccctgtggtgactgcgaaggcttcgacgtgcacatcatggacgacatgattaagcgtgccctggacttcagggagagcagggaagctgagccccacccgctgtgggagtacccatgccgcagcctctccgagccctggcagatcctgacctttgacttccagcagccggtgcccctgcagcccctgtgtgccgagggcaccgtggagctcagaaggcccgggcagagccacgcagcggtgctatggatggagtaccacctgaccccggagtgcacgctcagcactggcctcctggagcctgcagaccctgaggggggctgctgctggaacccccactgcaagcaggccgtctacttcttcagccctgccccagatcccagagcactgctgggtggcccacggactgtcagctatgcagtggagtttcaccccgacacaggcgacatcatcatggagttcaggcatgcagataccccagactgaccactcttgagcaataaagtggcctgagggctggggttctgagtggctcatggctttctaggggggaaggctgaaggccctcctctcctctctgggagctgctcggcctcagggatgggaaagactgcgccgtgttgcatcttgttgcatctttgcactgctggcctctggctccagctgtggcaggaagcatgagagggtgactgaatttggagccctggaggggctgggaagacccccctgcttgtgcttctgaggtgctgagaatgctccaacacagagacatctctccccagctgggaagggagtggaagcacagggagcttgtggggctggccggtggggttgtccacgccgcccttggcgagcagtccccgtggcgggagcctgtcctgtctgtctcactctcgaggatctccgggtccctgctcttctggcttctgctaggagggtggagatttctggccctctagtgggtggagatgctgagttgtggctgggtctctggggcttgaagaccctggctgggcccgggctgagaggcctgggttctggccctttcacctgacaggtaacttcaagccacatccataggtgtctggcctcagtgctgcaccagctggtggcctgccaggacctgagactggacacaaggcagctgtcccagagcagttcctgagatgcaggcccaggaaagtggctgtcaggggagctgggaggcagccctgttccctgcacctccctcagattggaaagcccctcctgcaggtggggtatggcagggagcagcccctgcccagcgccgcttcaccaggaaggtcagtaggtgccgtggccttgcttctctcacacactaacccccctttggttatgtcccagctctcagaggtaacagcagacaccacgtgagagaacccagtggcctctggctcgcagcttagaaggtgaggcttgtgccaggccagccgagccgcctgtatgagcagagttccggtgtcctcggattcagggcagacttgggcagtgcctgtcctgcagttgggggcaggaactccctcccctgcccccaggcgtgcccctgaggcctggccccaacttgtcgctgaaataagtggagaacaccagccttgagcctcacagttttattttctcctcgttatccatccttcctttcagcaccagtaaggaaaaagaacacctctcttcgcaaaatattttatcaggtgtaaagacttgtttttcttctagggaagaaccgtctggatatatatttgataatgtttttaccaaaaccataggtgtgcttaccatagaaaacccctaatgtcccatgaagatacaatacagaaaaaaatacagaaatt

SEQ ID NO: 489454 - DNA, 155 bp, Homo sapiens
agaaaacagagagaagattgccctgtgtggaacctttgattcctccacaggaatttcccttttcttatttatttattttaaagggagatggagcctcgctctgtcacccaggctggagtgaaatggaacgatctcggttcactgaaaccggatcc

SEQ ID NO: 489455 - DNA, 193 bp, Homo sapiens
  misc_feature (15)..(15): n is a, c, g, or t
gcttgtgggactgangccctggctccttgttccaccctggtttccaactataacccaaaggtatttgaaatcctgattcagtattattccggaaaacaatgtggcttcaacatgagaaagctcctacagaagaagggaaaaaagagcctggtgttcctaagtaacgcgaacccctcgctgctggagcggaact

SEQ ID NO: 489456 - DNA, 368 bp, Homo sapiens
tctcgctatatagtagatcttgaactcagctgaacagattccgtcctcttcgaccctattcttttgcaaaatatatctgctataaattagtatatgaatttaagaataaccttgtctacatctacaaaacatcttctaggattcagataggaactgcatataacttgtatgttacttggaggagaacttgatatctttactgtatcctgtctagcaatccatgaacatggcatgtctatttaaatctttgataacatcacgattttataatcatcagcatacaagtccttgcatatttcgttagatttaaaccgaagtatttccctttttcagcaattgtaaacagtacatattattaacttttgtgt

SEQ ID NO: 489457 - DNA, 1015 bp, Homo sapiens
  misc_feature (262)..(262): n is a, c, g, or t
  misc_feature (377)..(377): n is a, c, g, or t
  misc_feature (637)..(637): n is a, c, g, or t
cgggattcgccgccagaacagcaggtgtcgtgaaaactagccctaaaagccaaagattgggaaaggaaagagactcatatcaacattgtcgtcatggacacgtaggattgcgggcaagtccaccagctactggccagctgatctatataagtgcggtggactatgacgagaaagaaccatttgaagaagagttgtgagaagggaggctgctgagtatgggaaagggctatcccttaatagtatgtccttggggatctgggantaaacttgaatagctgagtcgatgaactgtggtagtacagctaatatgaatatactccttgtggaacatttgagacttcatgcaagagtactattgatgactataatcagtagantgccgctctaaggaccccaggagtacttattatctaacaaacattgactatacacgggtacactcgtcaagggcttgacgtgatgcttgtccatgacttggtatgcatgcctggatgtttggttgcaattggaacgctgggtattcttcccaagaagtggtgcatgaacccgagtagcaatgtcccctggtcttggacttacatctatctggggttgctgtagaacacatctaaattgtctgggtggttaatcataaatntgggatttctcaacttgaatgactcaccacataacagacctagcaaacggaagaatagtgaagggaaacatgttagaggcgaaagctcacgtcacctataactgttaatgacacaggactgtgggcgtacacacccaccagtaagagccagcctagacttattaatggtcggcccaaaatttttcctggtctgggaacgtgggttgtaccaaacgatggactgtgcagtccgcagagatggcctgaaaacaatgtcccttccgggggttccacaccggggaatggggaaagagttcacccccgtttaagcgaatgtgggaatggcacctggtggaaccaacgcctggtttgaaggactgctgggactggattcgtaaa

SEQ ID NO: 489458 - DNA, 248 bp, Homo sapiens
aacctctcgcaatacctttacaattacttgcagaaagtctagtaccaatatgatatactctattctcatattagaaggcatacagtctgattactaaatataattctcatttgtcgtgacttgaaacctccctggcgaaattaaatttcattactcatttctggcattagttgtattcatttcacattgggttagcagtactttagaatggatattgctgaagtaagtggtgtgtcaataagatgtga

SEQ ID NO: 489459 - DNA, 338 bp, Homo sapiens
cggtctctctgaggatcccctcataaggggccagaggaggagacaactggagtttgagaccaacgtgggcacatggagagacctcatctttacaaaaaaaatttaagaatcagccaggcatggtggcacatacctgcaggcccagctacttagaaggccgagacagaaggatcacttgtgcccaggagttcaaggctgcagtgagctatgactgcaccactgcactccaacatgggtaacagagcaagaccatctcaaaaatgtgtttgtgtgtgtgtgtgtctgtatgtgtgtgtgtgcacgtgcgcgcacgcatgcgtgtgttggcccttatcgag

SEQ ID NO: 489460 - DNA, 214 bp, Homo sapiens
ttatttattacaagctctatttccaacacagattcccacacagccgtgagatctctgtggtctctccatcttaattacctcattccaggtcccatagctctatgcgtgaatttctagcaacactatctgtgctctcaccatcttttcatccttactattagccagggaaagcttttgatacaccagtgaactatccattagggcgtacggggca

SEQ ID NO: 489461 - DNA, 856 bp, Homo sapiens
atgaagaaattagaaaaaaaagaaaaagaaaataaaaaatagaatgaattaaatctctactttcaatttcgagtttcgaggaacattatataatgttttgaaaatgtctgtgtatctggatttgattttgcatgggtacaaggttcacactattcttgcaaaactggtgatggggggaatggtatcggaaaccattatgaatgagatagtggcacaaatagatgcacaaaatactctgtgaaaaatctgaggctggcttatccagaactccagcccgtgctgtatcagctgtaaagaatattaatgctgctgacatcccattacatattatcattgggtgacatcaatatataagtgctctaacctgccctcttttaaatcaaaatgtattaaagatattttaatgaatgtattcttgggatgatttatttatcattactttctactcttttttcccaattaaacgcccgatactctctttcttccgtctactttcttttaccccgcacttattttattcttattcgtaatttttttgtttatctatctttttattcctcattcatgtcatattccaacttatattctaatgtccccacaataataatactccccccatccttccccctctactcttggcttgtcctcactatttagtgctcaccccctcctttactcactgtacccccttcccccctctcactcctttttattattcctctccctcaccagatatctcttagtatacgaattaaggtaataaaaataattataccccctcctccacctttatatatcctcctcattcatcttctatctacaactgtccacactcttattcaagtttatcatccat

SEQ ID NO: 489462 - DNA, 573 bp, Homo sapiens
  misc_feature (58)..(58): n is a, c, g, or t
  misc_feature (79)..(80): n is a, c, g, or t
  misc_feature (151)..(151): n is a, c, g, or t
  misc_feature (325)..(325): n is a, c, g, or t
ttgcgggtatctagagatccagaccaggctgagcagaaggaggatctgtgttatcttnctggcccgagtctgcgccctnntagagcaaatgattatgcagctccaaggacgcatcaagaaaagctgacagggatcaagcatgaattgcaangcaactggctacgagaggtcagggacgctgcaccctggcagagaagctggggggcagtgccgtcatctccctggagggcaagcctttgtgagccccttctggccccctgcctggagcatctggcagccccacacctgcccttgggggttgcaggctggccccttcctgccagancggaggggctggggggatcccagcagggggagggcaatcccttcaccccagttgccaaacagaccccccaccccctggattttccttctccctccatcccttgacggttctggccttcccaaactgcttttgatcttttgattcctcttgggctgaagcagaccaagttccccccaggcaccccagttgtgggggagcctgtatttttttaacaacatccccattcctcagactgggtcgggtacgag

SEQ ID NO: 489463 - DNA, 177 bp, Homo sapiens
tacgaaatgaccgacataaacatcgactgatttttatgtttagtattttttttcggggccagagtttacatctcgttgcccaggctggagtgcaatgggcacaatctacagttcaccgacaacctccatttaccttggttcaagcaatactcctgcatcagcctcccatgtagctgg

SEQ ID NO: 489464 - DNA, 234 bp, Homo sapiens
aacgggtgatgcggttggagaaggaattaagaataaaggaacaaggccgagcatggtggctcatgcctgtaatcccagcactttgggaggccaaggcgggcggatcatttgaggtcagaagtttgagaccagtctggccaacatggtgaaactctgtctctactaaaaatacaaaaattagctgggtgtggtagcgcgtgcccatagtgtcccaaccgcatcacccgttcgggt

SEQ ID NO: 489465 - DNA, 440 bp, Homo sapiens
  misc_feature (97)..(97): n is a, c, g, or t
ctctctcacattggcgagaagcatataatgtaagaatgtggtaaggctatcacccggagagtcaagcctgaatgaacatcggcggagccatcactgnagagaaagcctatcaatgtaaggagtgtggaaaagccttcagtgccagtaatggcctcactcgacatagaagaatccagactggggaaaatccatctgaatgcaaagtgtgtggaaaggctttcctcctcagctcatgccttgtccaggcatcagagggatacacacgtggagagaagcgctatcagtgtcgtgagtgtggcaaagccttcattcagaatgcagggtttttcccagcatctccgagtccacactggttgaaaaaccctatcagtgcagtcagtgcagtaaactctttagtaagcggacacttcttaagacacatcagaaaaaccagtgtgaag

SEQ ID NO: 489466 - DNA, 297 bp, Homo sapiens
ccctgctaaagccaggcggaagtctccccctgcccggatgtggtgcttgcctctgtttcccacccctggaggcctctctcctccaatatccgagctctccttacccccgaccctgcacccagtcccttaggaagagagaagcctctccagctagatttcaacctccaggaggggcatccatatacccagcgccccccagcccaccacggtaacatccgatcagagtgcactcaactgagtttggccctggccctgatgactctgatggaagctggtctccttcgaccaagagctgcc

SEQ ID NO: 489467 - DNA, 1987 bp, Homo sapiens
  misc_feature (1715)..(1715): n is a, c, g, or t
ttgtgctgcgagttgcgcgcgctgtggctgcggagcgttgcctgtgctgagctgtctggctggtgcttgcgctgtgttgtggtggtggcttgttgctggctcgctttctgcgttgatgttgtatggtggctcgtgtttgctctttcgctttgtgctgttgtgcctgcggtgcgcgtgctgttgctgtgctgtgtgtgctggtgtggcttggtgtggctggtgtgagcgctgcgcgctgtgagccgggcgtatcggcgtgttcggttcgttttgtcgagtggtgtgtgatgtcgatcgggcttgcttgcgtgcgtgtgtggtgctgttgtgtgggttgcggtgtggtgcgtgtgctgtctgtctttgctgtgctgttgcgtccgtcgttctgccgtgcttctgtgtcgttgttttgttctcgtcttttcgttcgttgcgtttctctgttcttcgtcgtgtgtccgtctctcttcttgtctccgttgttgttgcgtgtgttttcgtgcttttggttgtgttgtttgtgtgtggtgttcgtgcgtggtcggttcttgttgtgtcgtgttggtggttgtgttcgttgttgtgtggtgtcttggtgttctcgtgtgtcgttcgtgttggttcgttgtgtcgagtctgtgctgccttttccgtacgtgttgatcgtgtgggtgttgtattgtttgtctgtcgaacgtgtgttgtattgtgtcacctggcgttccaccatttgttgtgttagcctagtttctgcgccgtcttgttgttgggtggtttgtgctcttttgcctctaacagtatcttgtctgttttgttttgtggttgggtcgccccgccccttttgttggtgtttcccttctctgttgggtgggtgtgtgcggctcccacacagggtgtgtgttgttgagcccacacaaatagatggcgccgcgggcggggtgggcgtgtgtgtatactttgtctggtggcccgcccagcggttggttctgtgaatgttatcgcgggggtgtcgtcgtgaatgtggtgtttttcttagtggcggctccctgttcggtgtgggggctgccgtatagtgtttgtgcgccggctgcacgtactgtgggtatgttttgttttgtctgtgtgttttccgtggggggggttgttctatgttgtaggggtcggcgctctcattgcttggtgttgctttgcggtggcggtggtgtgatagatgctccttccacatagaggagtgtgtgggtcgcccccttgctggtctcaccacactctctgcgggggggcccgctcttctgtcttgctctctttggcccgccaaagtgtgttgccccggttggtggtttccccgcggtgcctcacatggagtgtttcttttgtgtgtgggaacacacaaagttcgcgtcgctcttatctcccctacccatgtggtgcccctcttccccacgtggggtttgcacgacgtgctcgtcgctttgcgggtgtgttctgtttggtctgtgggtggtccgctcgctcttgttgtcgctggttcacaccccctcgcggggctctctcggggccttttgtgttcctcgcaccctcggtggcgctctatgatgatgctgtgtttctctgatgttgtgctgggtatgtttcagcttgttctgtgtaacacccctctcctcccgcgcgggctgtccactggccaccccctggggccaccttgtgcccacaanacaccacacacttggaatcaccacattttttagacaccttccatcttactcttgacaccccagacctcgtttgaaaagtaaacactgtattccccccaattgtgtccctatccaagaatgttcactggacaacaaccgttttctaaacacccacaccccgaatgtttcccggccacaccggactcccggcgtccccctccgggggtgaccaacaaataggggtttgttaacccaaaaaattaaatggatttagccggtgataaaaaatatta

SEQ ID NO: 489468 - DNA, 504 bp, Homo sapiens
aaggtaactaggaccatgctgtgttggcgcgcgagcccagataggaaagtgaacatggtcactactcgtgttgtccgctagtgatgatccttggtcactgactagggttactatggattactcacgcaataaaacaagcggccccggctggagacacctgtgccgttccttgacccaaattccatgacttgggcgttctgctgtgatcacttaccgctgtgaatcctaatcacgcacatgagtatgtccacatgcgaagcggtgagaagtattcagaaaaggtctaagagcgatcgactacgagaggtggagaggaggaggagaagtgagaggtgggtggaatggggaagtggagaggaataggaaaagcgagagaaaaaaataggaaaagagaatagcgataaaggggagagagggaaggatcaagatagaaaagaaggcaagagtggagagaggagaaggaaaagagagtgtaaagaggaaaggaaaaagagagaaatcaac

SEQ ID NO: 489469 - DNA, 825 bp, Homo sapiens
  misc_feature (552)..(552): n is a, c, g, or t
agcggaaatgtaggaatgcgggggcgatcgaggcggggataggtgggttctcggaaagtccgtgggactactgacccggcgtactgacaggctccattttatccggtgactcagttattaaccttcacctcaatggctcctctgagcgagagaggcggcttccgttagttaactcgctcgaggtgcaaatctgcagaatccaagagctcactggagttcccttctgtggtgtaggatctgcgcaggataaacttctgttgtcatgcagatgtttcgaggctctcaccggggcccgaagctaaggaggtaatgccgatgaaacgaaggatgttctggaaggagagttactgtggtaaaagtggccttgcaaaacaacgtagtgttccgcacgaagcacgcgcctgcgactgcatcgtgggacgaggtgtgcgtgtaagtccctcctgggttctgtccggggaaaaatgagtgtgtattcaaacctggcatgcgttaagttgaacgccatgcagtgcgcatgcatttgcgcccttcgaggatgcattgtacacntggtaagcaaccacaaataggggcagcattgtgagtgggtgggcctccggggagtctgctgtgtgagtgacaccattctcgaatggaacgggtgccatgggacgtcgtagttgaccacggcagtgaccctttgcgaagcggcttctcgtaggaggtctggcaccctggggcccgatgctatcggggtgggccgctcactatggggaggtcgtgggcttggccggggaggttgtggcaatgtttgatcggccgtccgtttacctccggatactc

SEQ ID NO: 489470 - DNA, 403 bp, Homo sapiens
gtttattctataggcatctgtatttggtgttggacctaggagatcccttgccaggtcccaaactcatcctatgcaaagtggcacttggaaggtaactatttcctagtggacagaggaatccctttaaaatacctgttcttccttcccagtgggagtaacacagagatgctatgaatcaccttgtgttaatgggacatcagggtcaaaaggaggagaaaaggaataagaaggtcagggaagaggcactagtacagtgatctgaccagaagcactgaggtgagtgacctagaggcgtggtctctcctctgagcctgtgttctgctagggattgagcatctaatcctaacacctgagaagcttcggagccccactctttgtttctataccctttctttttgcccac

SEQ ID NO: 489471 - DNA, 719 bp, Homo sapiens
  misc_feature (445)..(445): n is a, c, g, or t
ggagctcagtgccaccatgaacccaggtgaaataacacaagcatgtggctcatcacaaagcctgtttggtggtctcttcacatggacgcgcatgaaatttggtgccatgactcggatcgggggacctcccttgggagatcaagtcccctgtcctcctgttcttggcgtccgctgagaaagatccagccgtagcaagccgtcagggtcctcagagccgaggcaggcccaaggaaacaatcctgcagccagagtttgtaacatcagcgtaaggcgggtgcgtcttctgtactcctcgtgtcgtccagagcctcgtcgtccactggtcccgtcaaggccacgttatctccctttccagcgtcgtgtcaagtcgtctccccttctcttaagtttcaatctcctcttccattttctggcgagagacaacaggagacatgttttatccgtnggacccataaactccggtcgccgggtcacagactgggaaggcagctttccccttggcttgttctaactcatttgcagggacgccttctctgattattcagccaggtttcaaaggtgtcagaccacgcaggaacggcctgtctatggtccttcacccttagcggcaagtcccgcttttctggggaaggggcagtacccaagcccttctctccttgtctctaccccttctctgctttcctgggcaggggcagtacccagaaccttgctctcctgtc

SEQ ID NO: 489472 - DNA, 1209 bp, Homo sapiens
  misc_feature (1121)..(1121): n is a, c, g, or t
  misc_feature (1209)..(1209): n is a, c, g, or t
ggacgcgtgggtcgacccacgcgtccggaactgaacatttggcgtggacactagctacatagtagattaattatagttgagtagtaggacatggacaaatttggtgtttgggtcctttgtggacatttacttagtattatcgtcctcttaacaccaaattgaagtataatcaaactgctatatgaagaagggcctagaaaatgtggaggttttacactacttgccctgcctttctatatctagtttaagctgttaggactcaatggctctgattatgaccataattaaaagcattccgactttactatgaccctagcttatgcattactttagggggtgaggggaagctcctgtactggtatagtagtagcgcagattgcattagcggttattcaaggacacgaactctgtgcaagccctgtccacgtagctcgtggtaggctgttacagaacattgggtttccctgatgactccagtatacttgggtagtactcagacagtaaatcacttagtatagcatgtcgagacctataaggagtgcttatgactagctacaaagatggcatccactcctaaatcagtatctcaattcacgatgatgaattaaccattctcttacaagtacaaggtgttgcacaaccaacactggagacacacaaaatgtcttcacaacacagcacgtaatgcccatgccaccattcaaaagcacaaccctggccccaacacgaaagaccccaacaccacgcgcacggccagcaagaacacacgcgcaacagttgccaaagcagaccaacacagcaaacagccgacaaacacaccaccacactccacaagacacgagcacaactcaaagacaacataccaaagaacccgggcaatcagggaacggccaaggttaaacgccgcacccaacggcaaatgaacccacaacacggcgaacagacgatggcccagaacggaggaaaccaagacagaaacgggagcacaaccaccacaacaggcaagaaagtgccacgcgatacgccctagtcgcgactagacagacggaagcacaaagcagtaacaaacgacacacgaacgactaaaaaacacacacacggaaagcaacagacaactcacnacaacgggcacacgacctcagcacaatacgccacaccaactaacgcagcaagtaaacgccagcgctcacacatcgacgaagtcgtgtn

SEQ ID NO: 489473 - DNA, 103 bp, Homo sapiens
gagtccgaggaggttagttgtggcataaaatgcattaaggcatctcagtataagagcatcaggttcgtcctttagtgtttgtgtatggttatcatttgtatcc

SEQ ID NO: 489474 - DNA, 394 bp, Homo sapiens
ttggtgttttccagctggcagtggtttccaagccaccctggggacagagttcccagggggagggatggggctgtcatctttgaatgtttcacattcttagccattgttgcctttgggctctagggagtctgagttggttagggactggagtgatcccctggtacagagcagcagctctaaggagaagtggtcaggctgcttcctcatgtggctcctggatctcatttctcctcactgggtgggatctcccgactgaggtctacaaccataccccaaccagtgttttctggccagcagcagtttcaaacctccctggaatggctctcccagagagaggggcagggtgccagctttgctgttttgcagccttatctctttgcctttgggatttgga

SEQ ID NO: 489475 - DNA, 346 bp, Homo sapiens
cacagcaagaagcagcagtacccttagtaccaggtgcttgtcatgggagaagcttacaggagagctgccttttgaagctactaaactctcattcttgattattctgtacctcattatctatgccttcataactttacaacgatcaaaatctgtcatctaggctataccttactactgagacttcaatcactaggaccatcgtgtggctgcccatttagtattgatgtctgccttctgccaggcttgtcggacatacttctggtgggcacagtgcggaaacttgaggatgaaatcagtgcgctgcatgcacttaaaaggcatggcctgtctcctcacttgagtgcaa

SEQ ID NO: 489476 - DNA, 369 bp, Homo sapiens
ggagtagaatggattgcaagttggctagtggtcacggtgcccaccattcttggcctgttacttacctgagatgagctcttttaactcaagcgaaacttcaaggccagaagatcttgcctgttggtgatcatgctcctcatcaggacagagactgtataggctgaccagaagcatgctgctgaattatcaacgaggattcccacagcataacttttaaacactggttattatacaattttatatccgtatcattcttttctagtacaatggagatctagagacacacatgctttcttcccaccacaaacttgtgacaacattatgcgaatgttttattattttttaaaataaacatttgatataattatc

SEQ ID NO: 489477 - DNA, 337 bp, Homo sapiens
gtgttctcgaggatccccgggacagatacggactgttaggtccgcatctggcgtgtgccccattctcagcatgtgtgactcgtgggcaagttaaccttactgagtcttggcgtccttaatgtgccgttcacaggatcagatgccaccatagatgtgtacttgctgaatgggctctattaataatctctgtcactgagcgctggaatgacgtgtatgcatgtactgggctcgaggcctcttccctcaactccccaccactgtccctgcttcccaggtctgcacgcagacgtgcgcacgatcttccttctcagctacctaccctgaagactctccatcc

SEQ ID NO: 489478 - DNA, 409 bp, Homo sapiens
atagtggcaatatatatatagttcccgacggctctccatttggcatcgcttaatttatatgtcatggtctaagcacagctctcttgtcctattttcatcggtgccagcacactcatcatatttacaatggagtttgcgattgtagttaccttccgatctttgctccataagtatcaagcaagattgcacgttttgcggtaacccggagatctgtagattctgtatccgttgcgatttgtgggccagggcagccctcttcccatgctggttatcccgtcggagaccgcctcgttgggaacttcacaggatttgttgagcgctgacaagccctccgcccatctttgcaacgccctttatcattcttgaactatagttcggtcggtgggcaataaacagtattatcaaaaaa

SEQ ID NO: 489479 - DNA, 1725 bp, Homo sapiens
  misc_feature (974)..(974): n is a, c, g, or t
  misc_feature (1084)..(1084): n is a, c, g, or t
tgtgtcaaaaaaaaaaaaaagaaagaaagaaagaaaaaatgctttatggcccagtgcaggggctcacacctataattccttagcactttggggaaggctaaggcaggaggatggcttgaggccaagaagtttcaaaacaagccgtgggcaacatttgcaagaaccccaacttctacaaaaaacgaaaaattagccgggagcggtgatgttgttgccgtgttagttcccagcttacctcaaggaagaactgtgaggtgtgggagaaattcacttgtgaagcctgtgggaaggcttgaggctgccaggtgagcctggtgttttattaccaactgtgcacttccaagcccgtgcgtgggtatacacgagaagcaaaagaacttccaatctcttcaaaaaagagaaaacaggaaaaaaacagtgcttttgtgcttatacctctcacagtggaggggccagagcgccaaaaaacaacaacaagagagttcgcgtgtgtgggaacatctcctctatctgggacaccaaacgctatttgtgtgccacaaagtctgtggctataagttggggcccaatgtgtgcatcacccaaggtgtgtctctcacaccgtgtgtgtgtctccatataccgctgtgtggcacatctctttttattaagcgggtggaattctttctaatatgtgagaacggagagatttttctaacatatatcgtggtgggataaccccccaatattctcgagagaaaaaacctctcggtggttatacaagagttgtgcccataatggagggccatatctcccctttataaccagacctattagaggagattatgtaatatctcaatatatgttgcgccttccccccggggtggtgttataactcaaacacctttttgaggagcaagacacacctggtgaactaatgtgtggcgacaccaccaccaaggagaacgatatagtgggtggttcttaaacagacncacagacccccccaacacgagggggcgtggatccaaccttctcgtgtgggcgacattcataaagtgtggctgtttctcttccacacacaatcactatcatcacagacggngcagactttgctcagcatataaacacacgaggtgtttattcggggggggcgatatagtaatctcctcctctcacaaaccagcaacaatcaccacactactactaaccacacaactacgtcacataacaccacacaacatactaatccaatcaacaccatcaaccaacacacgcaccaccacgacgcacatgtagccaaccctacgtactagccaaaccacctacaccacctctgctaccactaaactaaatacagcacacagcaaccagcaacaactaccacacgcacaccgagtagagtgaagagaacgacgagagagcataacagaagacacaacagacggcgtgggtcgcagcggacgcgcgacgcagcaagagaaccacaaacagacatcgtcgcgcggcggccatgcgacagtccgagggatacatggtcacgacacacgaccgcttcgcgtgtcgatgagtgaaggacgccggacgagccaaatgaacagaggagcaatggatagactatcaacggaagcgtcgcgagcgcgccgccgcagtctcaacacacgcgccggtggagcgaacaaccgcacagcgatttaggatgggttgtcgatacagggcaagacaccccaccgatcggtgggagca

SEQ ID NO: 489480 - DNA, 360 bp, Homo sapiens
  misc_feature (34)..(34): n is a, c, g, or t
ggattcgtgtcatccccttcgtggagcctcatgncggctatcgggcttacagaactgggtgaagaagaacgggctgagcactcgctcccgacctggcctcaccaataaccagctcttcttcctgggctttgcacaggtctggtgctcagctcgcacacctgagagctcacacgatggcctcatcaccgatccccacagcccctctcgcttccgggtcatcggccttcctctccaattccagggagttctcagaacacttccgctgcccacctggctcacccatgaacccgcctcacaagtgcgaagtctgctaaggggacgaagcgggagaagagccatagacgaagtggggattggaca

SEQ ID NO: 489481 - DNA, 229 bp, Homo sapiens
cagctattgccttggtacgatctattttgacttttgggacaagctgagagttctggagagtaccagctctgatatcataggaaggtcaaggtgggcagtaacaaggtcacggaagggcaggagggcctctttatctggcggggactctccaagggccttggctggggcatcagatcccacaggcttcaagaacgttaacaagggctctgcactgagtcagcgacttggt

SEQ ID NO: 489482 - DNA, 217 bp, Homo sapiens
  misc_feature (22)..(22): n is a, c, g, or t
  misc_feature (175)..(175): n is a, c, g, or t
tgagcccctgttccgcatgagntgtttgattcggcttgccaatggggcgtgccgtgaaacgaggttaatcatgcggcgcgcttccacgtggctcttggcagccctgctctcgtgggtcagcatcgtcgcgtgctccggtggctcgggggacgcgggcgatgccgcagagcacgcngcggtctccgggaacgtcggcgccccgggggcgctcggtgac

SEQ ID NO: 489483 - DNA, 93 bp, Homo sapiens
tggagtgggggaatgggggaagaggtcatgttggggcacccaaatgacatccagtgctctcggcgaatggctgccgaggttctggctttgttt

SEQ ID NO: 489484 - DNA, 799 bp, Homo sapiens
ccagcttctggctactttttttgaaattaatttttagaaattaatgttttaataaaaaagttttgagacaggatctcactctgttccccaggctggaatgcagggtgcaatcatagcccactgcagcctcgaactcctgagctcaggcaatcctcccacctcagcttcctctgtagctgggactaaaggcgcgtgccaccatggctggctgatttttttaattttttgtggagatgaggtctcactatgttgcctgggctggtctcaaactcctgggctcatgtggtccttctacctcagcctcccaaagtgctgggattacaggtgtgagccaccacacctggccttcttctagtctacttttaaccatgagcataactgggtggaaaagttagtgatagaatcctagtatagttgtcccatggtatcggtggggattggttcagggactccttgcagataccaaaatctgtgatgctcaagttcctgataggaaatggtacagtatttgcatataacctaagcacatcctcctgtaaactttaaatcatctctaggttactcagaatagctattataataccacacatcagctcatttgtgtggatcccatgaaatacttggtggggggccaattcaagtttagctttctggaactttgtggaattttgccccctgaatatttcacctgtggtggttgaatcccaggactgcagaaggctgactgtactaaccccgctgcaagactgcaccgtacacaccattgagaaaaacggccatcgtttaagacccgatttgg

SEQ ID NO: 489485 - DNA, 694 bp, Homo sapiens
  misc_feature (272)..(272): n is a, c, g, or t
ttagaaatacaaccgtttcactcttaagaatttgcttaaattgggccgggggagtttaaaagcgggaaattaagggttaataaataacgcgggtggcccataggtttatacttttctagagggggtattgaagcagggtgtttcataaccttttctctcaccttttgttatgtttaaaatttatgagaggtgatgttttttgcacatgacacatgatgtttacagctcgcactaggacctctcacggcatggatgtcgtcagagagacagcntcagaaataatagctaatgtatgctgggctcaatacaagggtgatgaaatgatctgtgcagcaaagcccgatggaacatgtttacttatgtagcaaacctgcacatcctgctcatgtacactggaacttaataaaagttgtttttttttaaaaagaatgaataagacatggtatttgatagctcaacaggcagtctatagtcaacagcgatttatatgtatattttaactctgcctcaaagagtataatggattgtttgtatcacaaataaatgcttgagaggatggacaccccatattacatgatgtgattattacacgtcgcatgcttatatcaaaacatctcatgtcccccataaatatatacgcgtgatacccgccaaacttaaaatataaaatgtttaaataaaaataaagaaaaga

SEQ ID NO: 489486 - DNA, 895 bp, Homo sapiens
  misc_feature (14)..(14): n is a, c, g, or t
  misc_feature (131)..(131): n is a, c, g, or t
  misc_feature (206)..(206): n is a, c, g, or t
  misc_feature (304)..(304): n is a, c, g, or t
  misc_feature (425)..(425): n is a, c, g, or t
  misc_feature (470)..(470): n is a, c, g, or t
  misc_feature (584)..(584): n is a, c, g, or t
  misc_feature (623)..(623): n is a, c, g, or t
  misc_feature (658)..(658): n is a, c, g, or t
  misc_feature (670)..(670): n is a, c, g, or t
  misc_feature (685)..(685): n is a, c, g, or t
  misc_feature (715)..(715): n is a, c, g, or t
  misc_feature (717)..(717): n is a, c, g, or t
  misc_feature (741)..(741): n is a, c, g, or t
  misc_feature (751)..(751): n is a, c, g, or t
  misc_feature (759)..(759): n is a, c, g, or t
  misc_feature (762)..(762): n is a, c, g, or t
  misc_feature (765)..(765): n is a, c, g, or t
  misc_feature (769)..(769): n is a, c, g, or t
  misc_feature (774)..(774): n is a, c, g, or t
  misc_feature (777)..(777): n is a, c, g, or t
  misc_feature (797)..(797): n is a, c, g, or t
  misc_feature (866)..(866): n is a, c, g, or t
aagcgcgggacgancaaagtcatggaccgcaacccctcgccgccgccgccgggtcgcgacaaggaggaggaggaggaggtggccggtggagactgcatagggagcacggtctacagcaaacactggctctncggcgtcctcagcggactcatccagattgttagccctgaaaacaccaaatctagctcagatgatgaggagcagcngaaggagcttgaagaagaaatggagaatgaaatttgcagagtattgggataagtcaatggatgaggacgtggctttatttctccaagaatttaatgcncctgaaaaattcatgggagtactggccaagtccaagtgtccccgattaagagaaaactgtgtgggaattttaggtaaaaaggcctgttttccaggagaaatgtgttgttccaacagcagtnaaaaaaaacttgggcaggggttattgtgcactgttttgttatgantcagacccacccaccctgccggaaacaagcaggttgtggcttacttgcctttcccaggcagaaggggccagtgtttgggttgaaaggatccaggaacatccagccatttaaganagcattagcttcattatgtcaagtacaacaaatgtaganttgctggtgaaggtgggggaggttgtggacaagcnctttgatttggntgagaaactaatgtnagaatgggtcagaaatggggctgctcagcntntggaccaaccccaggaagattttnaagagcagcnagtttttnggnttntgcnctgtntanttgaagctgccaaacaagtncgttctgaaaatccagaatggcttgatgtttacatgcacattttacaactgcttactacagtggatganggaattcaagcaattttacattgttctga

SEQ ID NO: 489487 - DNA, 531 bp, Homo sapiens
  misc_feature (427)..(427): n is a, c, g, or t
  misc_feature (433)..(433): n is a, c, g, or t
aaaatagaatattagaatatggtgagctcaggtgattgatactcgtgatgagagtaatacgaatgtgtttagaagtggatcttatagggaattaagcggggtaatgcttgttggggcacagtgccctccaagttgggggatagggtataggttgaagtggtaaaaggctcagaaaaatcttgagaagaaaaaaacttgtgaggtaataaataggattatccggtatagaagcgcctttttgcacaggtggtgtgtggtgcccttggtatgtgcttttctggtgtaacatcgcgccatcattggtatatggatagtgtgttggttagtaggcatagtatgaggagcgatatgaagtgaaagtgaaatcacactcgtgctgaattcgtgcagcgcgtggtgatcaagtagtagaatatcgttggctctnttcaanggtttcacaaggtgggccaactctctgtgtaactgataaacagactactagtactacttactgtagacagtctgggttgctactgaaactgcctaacg

SEQ ID NO: 489488 - DNA, 502 bp, Homo sapiens
cgtaaatagagtccaagtgggcggagagccgtcccgcgccgcccgctcatgtctctacagatgccgactgtccggcctgcctggcacatgctgctgctgctgtgctggtggcagctgcctcgatcccccctgctgccccctgtgccccgtgacactttgtgctggtgtgccacgatgtgaccctgcatgcatgccaccgttgctgtgtcccccctgtgctggttcaccttgtgggccgttggtatcctgggccctgccctggttgctgctgtgaaccttctgcgctggtggcaaggtttggggcggtgctggtttggcagcggcgtgcctgcgcctggtgctgtggtttggagagagatggcctggggacccaagtggaccccgtgcgggggttttggctggcaaccattcttggtgggtggccgccccaacacaacattttggcggcacccactttggtggccctgggtgggctgggaataacagcgggctttggggaccg

SEQ ID NO: 489489 - DNA, 907 bp, Homo sapiens
tgctccgtggactttttcgctattttccaagttcatcgtataggccaaaagtggtgtccgcgggaaatcgtcgccattttggggggtaatacacccccccggtgggtcgcgccctggaattgtttcgcccccccaacatttttgcgggcgcgacattataacgaacagcccttttctcatttcacggaagcgttcttacttctaacgagggtttaccgccccacctcgtaacacagggtcgccctttatttgctgcccggaacgcccgttttcttctggaaccggcggctacttggcccttaaaaaggacccctgtttccggggagctccgccttttaatcaatttaatcctcggttggtcaggaaacccacaagtgatatttctcaatacaggggggcacgcaaaaaaaagagttgggatcaccctgggttccccaccctgagggctgctagatatcccccgtatcagctgccaaatgtccgtgtcgccataggagcagtctaatgagaataagggcaggtatctttctgttgaagaaagtgaccagtacaccaaaggaatctcgcttgcgccaccacatctatcaggagatccactcccgtactaggggacacaagaagccccgccgtcaagatgagggctgacatcttttataggtataaaaaaaggcaggtaccagcgccacaaggcgatggaaggaaggttgaaacgtggcagtcgacattccccatcatcaccacgtaaccaaaatgggggtgcacatggtgcgccaataaccgtctagatcacgcccaaccgtggggcaccgacagcacgggggagccgtcatcagcggccaccgagcttggtaagcggcccgggcccaaaaggcgagacccccttttacaaaaacaccccaacaaaaca

SEQ ID NO: 489490 - DNA, 307 bp, Homo sapiens
tttttttttcggttgcccaggctagagtacactggtgtgatcacagctcatttcagcctcaagctgctgggctccagcaatcttcccacctcagcctctcaagtagctgagactacaggcgtgtgccaccctgcccagttaattgtttattttttgtacaaacgcagggggcgtctcactatgttgcttaggttgctcttgaacttctgggctcaagtgatcctcctactttggcctcctgaagtgttgggactacagttgtgagccatcacacccagcatttagtgagggttaatcgaaaaaaaaa

SEQ ID NO: 489491 - DNA, 355 bp, Homo sapiens
atttttaaattatatgtgggtataccctaataccgttgttatttggctttcccttccatccccttatatagaaccttttaaaaatagatgtatgttcaatattgaaaaagatgaaggaaatagctccccttttaaattccagcaaggttaaaatccctgctcttctaagaaagttcagtgccatgctattcataaaaatgtgcccttagtagtctttgtaattataaatatatagtaatgtgggattttatgtgaactgtaaaacttttgtcctatctccctttttcatatctgtgaaaaatatacctatgtgtttgtcatgtctctcaaataataaattaagcttattaagtca

SEQ ID NO: 489492 - DNA, 570 bp, Homo sapiens
  misc_feature (1)..(1): n is a, c, g, or t
  misc_feature (187)..(187): n is a, c, g, or t
  misc_feature (191)..(191): n is a, c, g, or t
  misc_feature (198)..(198): n is a, c, g, or t
  misc_feature (247)..(247): n is a, c, g, or t
  misc_feature (256)..(256): n is a, c, g, or t
  misc_feature (337)..(337): n is a, c, g, or t
  misc_feature (349)..(349): n is a, c, g, or t
  misc_feature (367)..(367): n is a, c, g, or t
  misc_feature (370)..(370): n is a, c, g, or t
  misc_feature (376)..(376): n is a, c, g, or t
  misc_feature (379)..(379): n is a, c, g, or t
  misc_feature (459)..(459): n is a, c, g, or t
  misc_feature (463)..(465): n is a, c, g, or t
  misc_feature (471)..(471): n is a, c, g, or t
  misc_feature (478)..(478): n is a, c, g, or t
  misc_feature (480)..(480): n is a, c, g, or t
  misc_feature (483)..(483): n is a, c, g, or t
  misc_feature (485)..(485): n is a, c, g, or t
  misc_feature (487)..(487): n is a, c, g, or t
  misc_feature (493)..(494): n is a, c, g, or t
  misc_feature (546)..(546): n is a, c, g, or t
nacaagtagcttgagactccagctgaaatcatagaggtagtttctgtttaaatcctgggagaccttagataaggtatgtgaactgaaaaaagatcaaatcagcacacacagataaaggatacaacagataccaagatgggtaaatgcccaattattttcagtcctcataatctgtacatagctatgnggcnacccgtnggccatatctcactaggcagactttgaggtagatgtttccctatttganacacaaganattatgacaatatggagatgaagagggagtagttctgtgcttcttgctgtgttacctttattatattcctagtgtcactgncactagtttaanaacaagcctgccacaagnatnttctcntcncccgccaccttttcctcctttcttctttttctgttgctgtttcttttttgttgctggtgcccctgctggtttctggtgtnttgnnntttttntgttaantntanangnagaaanngttgcagcactgccaggtcttggggaggtgggtgggctgctcacagttttantggcatccagttcagatgaagctc

SEQ ID NO: 489493 - DNA, 429 bp, Homo sapiens
tattcaactccctaactctccattacatttgattccattcgggttgttccattccattccattccattccactgcattccattgcactcgggttgattccattccattccattccattccggaagattccattccattacattccattacattccattcccctgcactcgcgttgattccattccattccattccattccattccattccgttttgttccgttccattccattccattccattccattccattccattccgttccgttccattccattccattccattccactctattcgggttaattccattccattccattcgattgcaatcgagttgattccattccattccattccattccattccattcctttcccctgtactcgggttgattccattccattccattccaatccatgccattc

SEQ ID NO: 489494 - DNA, 840 bp, Homo sapiens
  misc_feature (13)..(13): n is a, c, g, or t
  misc_feature (89)..(89): n is a, c, g, or t
caaaaaaaccacnacaaaaacaaaaccacccccacccacccaaacaaaaaaaaaaacctaggcgtgaaaacatcctgctgtcactccanctgccgcaagccctgctgctgccagtccagctgctgtgttcccgtgtgctgccagtccagctgctgcaagccctgttgctgccagtccaactgttgtgtccctgtgtgctgccagcgtaagatctgaggctctggacccacaccttcacgcttctcctgtttggtgaacgcatctattatggatccctgaatcattttttcccacacatactacctgaggcacctaaacctgctatatgcttccctccctgctaacgacctacttacatggctcacattgcttccccgccctccctcctatcttctcactccacacaccaccccaccccctccgccctcccagcaccccccccccaccctacttccacccgcaaccccgactttccataaactccagagcgacccactatcacactctatctcagcgaatccgtcccatatgtaaatctccacctccagcaaatttaataaaattcttccagactcgcaatccacataatatctctcaaaaaagccccacacaacgtcaccacagagggcgatcacgaccgcgccccccacccccccgcacatcctccccccccacacccgctacccgtctccagccaccccacaagcacccaccaaaataaacccccacaacgcacctcaaccactacaataatatatccttaacctccaacgcatatacaatatcacaagatccagacaaaacggccacatacgccagatcatctcaacgccaaccacg

SEQ ID NO: 489495 - DNA, 259 bp, Homo sapiens
  misc_feature (250)..(250): n is a, c, g, or t
agtgtaaccacccatataataaatccacctcttccgctgttttagctgaagaattaaaaaaaaaacctggctaacacagtgaaaccccgtctctactaaaaatacaaaaaagtagtcgggtgtggtggcgggcgcctgtggtcccagccactcaggaggctgaggcaggagaatggcatgaacctgggaggcggagcttgcagtgagctgagatcgcgccactgcattccagcctgggcgacagagttanctccgtctc

SEQ ID NO: 489496 - DNA, 150 bp, Homo sapiens
atcaacattgtcgacattggacacgtagattcgggcaagtcaccactactggccatctgatctataaatgcggtgaatcgacaaaagaaccattgaaaattaagagaaggaggctgactgggatgggaagggctcatcaggtttacctgg

SEQ ID NO: 489497 - DNA, 337 bp, Homo sapiens
ccctctttcatcccctgccaattttagagggaaaaacatgtaattcttaaacccagaccatttccctttcaaagacaggaaagagatggacgctaaaatgcagatataaaaatgttccgagggctgggcacggtggctcacgcctgtaatcccagcactttgggaggccgaggcaggcggatcacctgaggtcaggagttcgagaccagcatggctaacatggtgaaaccctgtctctactaaaaatacaaaaattaggtgtgtgtggtggtgcgctcctgtagttccagctacttgggaggctgagacaggagaatcgcttgaacctgggaggcga

SEQ ID NO: 489498 - DNA, 300 bp, Homo sapiens
  misc_feature (11)..(11): n is a, c, g, or t
  misc_feature (42)..(42): n is a, c, g, or t
  misc_feature (130)..(130): n is a, c, g, or t
  misc_feature (138)..(138): n is a, c, g, or t
  misc_feature (161)..(161): n is a, c, g, or t
  misc_feature (173)..(173): n is a, c, g, or t
  misc_feature (262)..(262): n is a, c, g, or t
  misc_feature (265)..(265): n is a, c, g, or t
cggtgcattcngacacgggacaccaactttcgggacgaactncatctgccgcgtgcccaaaagcaagctggaagtgggccgcatcatcgagtgcacacactgtggctgtcgtggctgctctggctggagntggcgcgntccaccctggactctggacttcncaggttcctgcntgtcacgccacccccttcctgggagcagcgagcagtgccccaggcccgagttggagcacggtctctatggggaaggtcgctgtctatcngcntgtgatttgtaaaaataaaatctttaaatctctcg

SEQ ID NO: 489499 - DNA, 305 bp, Homo sapiens
ggccatcgggtgcccagacaaaacagtggtgtctgctggacaatgagaatccaggagtgggaggtggcgcctggtgagctctatcgacctgcctggaatttctaggtcacccagatgctctgcggcagtgatctgagccacgtggcacaccctctccctctctggtcctgccttggggacccatcctagacttgcagcttttcatggtaacctgcgtgtacacttaaatgctttgcgttccgtttctgcttgatgatgatgattgttggtatatattttacaatgacatggaaaacaagttccag

SEQ ID NO: 489500 - DNA, 156 bp, Homo sapiens
gacacgtgtgagtactgcatgttgggaagttggcgacagacatctgctcgctttgcgtctatcccatacacctgtgcttctgcctccttccccacccattcccactccctgggtagaggagaggtctacagagcccaacccagtactatactgtca

SEQ ID NO: 489501 - DNA, 307 bp, Homo sapiens
aagcagtagacagtgaagatctgctggaattgtccgaggagcataaggaacacctgttggcttcctgactcaagtgtgacagcgcggtggtcgccgagtttgggcggattgctgtgagaattcctgagacgcggcgcaaaaccgataaatctacgacggcgccgcctgaaaagtcaatgtgagtagtgacactgtcctggatggtgtgtgaggattaacgtagtctccgtcactgagagcacaaagttcatgagtttctgagctggatttccaagaactctgtttcttgtccatgggaattctcgtg

SEQ ID NO: 489502 - DNA, 939 bp, Homo sapiens
gagacatcatcagtggggtggagactgcatgtttgtgcaggaaaagctgagaagcggcaatttggcacctgcagagctggccattgtggctgcagacagaaaaaggactttcctcacgggatccctgagtgtgggacagctgccctgagattcacactcatgctcccatggagttcaggcgggcgacttgcaactgtcagtcatctgcggtccagacgctgcacgacattatcttgcaacaagatctggaatgctcttcgctttatcctcaatgctttcggggcgaccttttgtgccacagaactggctgaggcgctgatctccctcactcccacgagtggatgccttggatcctgacgccgacattgacctgatgctgcccaggagtgtgagcgggggcattcctcacccgagagatcatcgctcgatcactcatgccctgtaccacttcttggcattcaccaagctctgtgcacgtcataacttggacggctgtgacgacccgtgctgtggcactcgcacccgaacccactgaggggacccacataaaggatcctggtaatcccatgggcttgaacatcaggagcatccagactcctgggacccaattgactcgacccttccattgagttgaaggcatacgtcatcggacacacagcattgaaacaaacagggaaccaaagagaccaggcaacccaccagaccacacaagagaaacccacgagaagagcacaacaaaaaccaacccagcccacagcgacaaccaacaaccacacggacgcgcaggcaacaaccaggcaacgagcaagcacccaacaacccacccgacaccaagaccacaaacagcgcaacacaaaagcggcaacaaccacagacaaacaccacacacacgacaccaccaacagaccgcgcacacaaagaacactgccaccaaaaaac

SEQ ID NO: 489503 - DNA, 111 bp, Homo sapiens
gggtccagttcaactcggtacgtgggatggcgtgggaggttgcataatggccaagacaaaggccgccgggagggagcagttcgaaccaacacgtgacccgcgctgggtgca

SEQ ID NO: 489504 - DNA, 350 bp, Homo sapiens
  misc_feature (292)..(292): n is a, c, g, or t
ctccaacacagcccaaggcaggtttagacactagcatcctgcccatctgcaagggctccctgggctgtatgtacaacaagctggacatgaactatgacctcctgcttgacccttcagagatcaatgccatctacctggttaagtacgagccctggatcaagcctatgttcaactcgagtgacttctccaaggatggcacgctttctaacaatgagtggtgctactgcttccagaagcctggaggtctcccttgccagaatgaaatgaacagaattcagaagctgagtaaggngaaaagcctgttgggggccttcatacctcgatgtaatgaggagggctattacaaagcc

SEQ ID NO: 489505 - DNA, 130 bp, Homo sapiens
aatatctgacgcagaatacatgtgaaagagtctctaccctttctgtcgaagttcattttatcccttcctgtctgaacaaaactgttgggatcacaccaacgaggctctgtggggaaaaacgaaaacctgc

SEQ ID NO: 489506 - DNA, 440 bp, Homo sapiens
ctaaggattcctcctaagacatgtcccatctgttcgggacacactggaaatctggacgttcaactcaactggcagcactcccagagcccctggaactctggcccaagggtctctgactgactccttctcggcttagcggctgaagactgatgctagccgatcgcctcggaagccccgtagaccatcacggacaccgagctttgggtaactctcacagtggaaggtaagtccgtccccttcttaatccatatggaggctacccactccacattaacttcttttcaagggcccgtttccgttgcctccataactgttgtgggtattgacggccaggcttctaaacctctttaaactccccaactctagtgccaccttagacgatactcttttaagcactcctttttagttatccccacctgccccgttcccttattacgctg

SEQ ID NO: 489507 - DNA, 105 bp, Homo sapiens
  misc_feature (80)..(80): n is a, c, g, or t
cacttctcatgactgaccctcgccccaacccctattttagagaatacggctgagatttaatatgtgtctgtcacagcctntcctggtgtagaaagactaagccaa

SEQ ID NO: 489508 - DNA, 361 bp, Homo sapiens
cgtaatttatcccaacactaacgacagctgacgcgcttaaaaatagtcgcaaaaaaatctcataaagttggctgggcgtggtggctcatgctataatcccagcactttggtgggcaaggtgggtggatcatgatgtcaggagttcaagaccagcctggccaagatggtgaaaccccatctctactaaagaatacaaaaattagccgggcgcagtggcaggcgcctgtaatcgcagctacttgggaggctgaggcagaacaatcgcttgaacccgggtggcagagtctgcagtgagccgagatcacaccactgcacactagcctgggcaacagagcaagactctgtctcaaaaaaaaaaaat

SEQ ID NO: 489509 - DNA, 581 bp, Homo sapiens
cgactcagaggatccatagctgtgtcatacggaaactacaactgcacgcaagaactattaaggtatcagaaacgtgagcagcattgttcgcattcggcatttgaaaacaatttgcgtggaaactttaatttggtcctggaccggtcaagaaaaacattattgaggaaaattaatatcacagcataaccccaccctttacattttgtgcagtgattattttttaaagtcttctttcatgtaagtagcaaacagggctttactatcttttcatctcattaattcaattaaaaccattaccttaaaatttttttctttcgaagtgtggtgtcttttatatttgaattagtaactgtatgaagtcctagataatagtacatgtcaccttaggtagtaggaagaattaccatttctttaaatcatttatctggatttttatgttttattaggattttcaagaagacggattatctagagaataaccatatatatgcctacgtaaaaaatggcccccaggtggacttaattgtagttgttagttgccctgttacctagtttgttagtgcctttgagcccccatatta

SEQ ID NO: 489510 - DNA, 771 bp, Homo sapiens
agcggggggtcgcggggcggggaggcccctccgtgcggggcggccctgtggtggtccgcgcacaggcggaggccgctccgatgcctgtgcagcctctgggcgcctgctggatcgcgggcgatgatgggcggcgttggtgccgcctctgcgttggtggacccgcggggctcgcgacgcatggggacacttggctctccctcgccgtagtctgaagctgttgcataccgcggagttcacgggtccccgtgccaagagaccgactccgccgagagtggcctcgtggccgagcgatccccgacggggtggactgctgtgcatcccttttgccactcccaagcctggcgcgttgcgtatgcgctgtacacggtggtcgttgcagtcccaattgcctggtgttcaggccagccaatctgcggtgacacggctgcgttgtcccgatgccttgggtggccgtcgaaaccccggagtgagcgctaactcgtggcctcggctgctctctttaataatgccctcactcatgggcgcctggggaccctgggtgttcccggctctggactgtccacaccatggatgacccagactgtcggggttccatcccttcaccggcggaccgtgctccgggtccactatggggtagcatttggcttcgccggatttacccctaaggtacaccccaagttccaatggacttgccctataaggttccgtggaaggctccgcctgcgtagaccaagagtaaatacgtgccccagtttgcgcccagggttaccc

SEQ ID NO: 489511 - DNA, 642 bp, Homo sapiens
ggtaccaatgctgttctcaataaatgcattaagacaacaggtacctgtgtcttaatgctgttctcaataaatgcattaagacaacaggtaccagtggatcaatgcatttatatgatagatcagcatgggtaccttcggaggggatgaattcgagaatagtgtgtgctaaattgagtatagtagcaaaatcgtgttaagagtagagtataataatggataataagcaggaatgacggaagtaaagagagtaaagaagaggtcaaaaagaatatataggagagagacatgacgaagatacaacgcaaccaggagaccctgcacaacatagactgcacgaacacggaccgccagagacgacatcccacaaccttaatgcccgaaaactaacaggcgaaagcccaactgcggcctacatgaaggaactaagccacaaagtcgcaagcaagacgcccatcagaaaacagaccaagacagaacggacgcaggagcacccagacccacacatagccaccaccgagaaaggggagagaagccgcaacatccagcgcaaaccgacggaacccaccagcaatcgagcactgagtgacacacaataaacgagcagccacgcaaagaacaggatggcgaacagcacgaaacaac

SEQ ID NO: 489512 - DNA, 731 bp, Homo sapiens
  misc_feature (32)..(32): n is a, c, g, or t
  misc_feature (543)..(543): n is a, c, g, or t
ggtggtggctcacgcctacaatcccagcactntgggaggccaagtctgacagattgcttgagtccaggaattccaagaccagcctgggcaacatggtgaaaccccatctctactaaaaatacaaaaattagccaggtgcgatggcgggcgcctgtagtcccagctactcgggaagcagaggcaggagaatcgcccgaacccaggggcagaggctgcagtgagccgagatcctaccataagagctccaacctaggtgacagagcaagactgtctcaaaaaaaatcatcttcacaaataaaatttgcagcctttactccattgctggtcattactgttcgtgtacacagtgttcttgaaatatacaagacaacaatatgcctttcccataaatacattagcagctaatatgtgcccattaacacaccttacacaatttaggccaggtaccagtggctcatacctgtaatgccagcccttttgggaaggcccgatggcgggagcgatccacctggagggtcaaggagtcacgagaatcagccctgnggaacaaccattgcgtggaatcccggacccgaacacacggggcatacccaaccaggtggaaggggaattggcacaggcgcctcggaccacagaggaacccccgggctgaggactatcatactctcacaggcggcgggaccaaacccagacaggtgaaaaaacggagaaccatatggctaacaaataag

SEQ ID NO: 489513 - DNA, 303 bp, Homo sapiens
agggaattcgtgctgatgctatctcttccagtgaccatccaggcacgggtgagcacaggccaggctggtagactgcaatccagggtggaacagactgtcctccatgtcagttccttctggcttcaggcccgcaattctttcgctttgagcttttttagaccccagatctcctaggcccaggctctctcttgaccccagagaagccactgtcaggaaaggaagtgaaccctactgcaggctgacgagtcacccggtacaagcaggccctctgggtccagcccctcattccacaccacaccagca

SEQ ID NO: 489514 - DNA, 143 bp, Homo sapiens
cataattaaaacacatctgtgtagagtggctttgtaatgaaagtaccttgtacttcaagcttgccaaactacctgtaatctccccaataagaaataatagtacttgtagatagttgtcctgagaaatactcatctataatcac

SEQ ID NO: 489515 - DNA, 212 bp, Homo sapiens
cagagcgctggcgcgcatttctccgcctgctgcttcgggccggttgtatcggcgagcgagcgagttcccgcgagtttctcggtgggcgctcccccctttcctttacagtctccacggactggcccctcgtcctatctacttgaccgctcccgtcttccgccgccttctcgtgcttcccggtttgggcctgattcccggccccgtttcctcct

SEQ ID NO: 489516 - DNA, 264 bp, Homo sapiens
  misc_feature (65)..(65): n is a, c, g, or t
  misc_feature (72)..(72): n is a, c, g, or t
  misc_feature (79)..(79): n is a, c, g, or t
  misc_feature (84)..(84): n is a, c, g, or t
cggcacgaggtgtgaccttactcaactgattatcaccctccctgtcatacaatacttcctggctngatttcntgggggntggtntcagcccactccacctcccctcagccgagcctagagtagaggggccaggcatcctccccaggggaggggcgttgaagcaaggagcctctcctgggctgtcctagcctcacatttacttgaccacaataacctggcaggaggagctggtggaaaggatgaagagctgactgatggggaaga

SEQ ID NO: 489517 - DNA, 155 bp, Homo sapiens
ctcttgctcacagaggccccgccactgctggaatactgggacatcagctagctgggcactgcccacagcactagaggactttccctaatcacttcttcagaagagagttgtactctttgcgtctcctatgttccatctggccagcaccagctctt

SEQ ID NO: 489518 - DNA, 401 bp, Homo sapiens
  misc_feature (46)..(46): n is a, c, g, or t
  misc_feature (98)..(98): n is a, c, g, or t
  misc_feature (109)..(109): n is a, c, g, or t
  misc_feature (323)..(323): n is a, c, g, or t
cccgggaccccctgtagatagccaaaatttgcgggtgccccccagnccctttatataaaatggccttagtatttgccatataacctcacaatcctcanccctcttgcanactttaagctcctagattatttataataccctaatacaatgtaaatgcctatgtaaatagttacactgtattgtttagggaattatgacccccccccacaaaagtctggtgaaaccccctctctactaaaaatacaaaaaatatcagccgggtgtggtggcgagcacctgtaatcccagctactctggaggctgaggcaggagaattgcttgancctgggaggcaggggttgcagtgagccgagatcgcgccattgcactccagcctgggcaacaagaacgaaatccgtctc

SEQ ID NO: 489519 - DNA, 656 bp, Homo sapiens
cggacgcgtgggtgaccacctcaaccacactgtcctgggccctgctgctcatgatcctgcatccagatgtgcagcgccgtgtccaccaggaaatcgacgaggtcatagggcacgtgcggcatccagagatggcagaccaggcccgcatgccctacacaaacgcggtcattcatgaggtgcaacgctttgcagacatcgtcccaacaaatttaccacatatgacatcccgagacattaaattccaagacttcttcatccccaaggggacgacactcattcccaacctgtcctccgtgctgaaggatgagactgtctgggagaagcccctccgcttctatcctgaacacttcctggatgcccaggccactttgtgaagcacgaggccttcatgccattctcagcaggccgcagatcatgcctgggggagcccctggcccgcatggagctcttcctcttcttcacctgcctcctgcagcgctttagcttctcagtgcccgatggacagcccagacccagtgattatggcatctatacaatgccagttactccagagccctatcagctctgtgcagtggctcgatagcaggggcaatggtctaccttcccccaagtttggcctagatttggtgttcaataaacaagttctggtgtcttgc

SEQ ID NO: 489520 - DNA, 400 bp, Homo sapiens
  misc_feature (12)..(13): n is a, c, g, or t
  misc_feature (75)..(75): n is a, c, g, or t
tccttataatannagatagaccagataggttgagtgtgtcaagttgaacagagtcatataaagacgtgactcacntcaaggcgaaaacgctataggcatggcactacggacatacctaataagttttgggtcagtgcgaaaactatatgaccctaagagccccattaacttacgggaagcgcaacctcagaagaagataaaccaagacgccctaggcttgaaataacgaactgcgaacacaacgcggctaagccgtaaagggtagggctttgggaaggccgacccattattttaaacataaattctataaaaaccaaattaatttaagaaaagttaactcgggccaccttgtgcatcccttgtacaaactgaaaaataaataggccaggttcatttacag

SEQ ID NO: 489521 - DNA, 1075 bp, Homo sapiens
  misc_feature (38)..(38): n is a, c, g, or t
  misc_feature (41)..(43): n is a, c, g, or t
  misc_feature (964)..(964): n is a, c, g, or t
  misc_feature (985)..(985): n is a, c, g, or t
  misc_feature (999)..(999): n is a, c, g, or t
  misc_feature (1014)..(1014): n is a, c, g, or t
  misc_feature (1063)..(1063): n is a, c, g, or t
actcaccccggcaactacggctaggtacgaggctgggnggnnngtgggttgtgggcggcccggtctcggagaagaggggagagtggagggccgctgaataagcttccaaaatgatgcccacaccagttatcctattgaaagaggggactgatagctcccaaggcatcccccagcttgtgagtaacatcagtgcctgccaggtgattgctgaggctgtaagaactaccctgggtccccgtggcatggacaagcttattgtagatggcagaggcaaagcaacaatttctaatgatggggccacaattctgaaacttcttgatgttgtccatcctgcagcaaagactttggtagacattgccaaaatcccaagatgcttgaggtgggtgatggcaccacctccagtgaccttggcgtggctgcagagtttctgaagcaggtgaaaccctatgtggaggaaggtttacacccccagatcatcattcgagctttccgcacgagcgcaccctcagcggcagttaacaagatcaaaagagattgctgtgaccgtgaagaaggcagataaagtggagcagaggaagctgctggaaaagtgtgccatgaccgctctgagctccaaagctgatctcccagcagaaagctttctttgctaagatggtggtggatgcagtgatgatgctcgatgatttgctgcagcttaaaatgattggaatcaagaaggtacagggtggagccctcgaggattctcagctggtagctggtgttgcattcagaagactttctcttacgctgggtttgaaatgcaacccaaaaagtaccacaatcccaagattgcccttttgaatgtcgagctcgagttgaaagctgagaaagacaatgctgagataagagtccacacagttgaggattatcaggcaattgttgatgctgagtgggacattctctatgacaagttagagaagatccntcattctggagccaagttgtnttgtccaactcccnttggggatgtgggcncccagtactttgctgacaggacatgttctgtgctggcgagtacctgagnggatctgaagag

SEQ ID NO: 489522 - DNA, 133 bp, Homo sapiens
ttttttttttttgggggggcctcccaggggtacttccccccccctgtttttttggggggggggccctcccccccctttggttcctggggtttggttttcccccgtttgcccggttaaggccttttttcggcca

SEQ ID NO: 489523 - DNA, 1797 bp, Homo sapiens
aggaggagtggttcgctccgtctgttattcctatgtttttgtttatatcgcctgcgtcctctcctcgtcctgttgttggtgtggtgtctgtacgtggtgtttgcttgttttgtgtgtgctctctgtgtcttgggtgggtggtgcgcgctctctatatggtgtgtctttcgtcgcgtgcgtctggggggtggttgtgctgtggcgggtggggtgcggctccgactatctgcgctcgggtgtggttgctagtcgttcgtgctgtgtgttgtggttgcgtcacagctcggatgtttgttgccttctcctcctcgcagttagtggtgttggtgggttatttctccttccgccctctctctatgctacttgttggtggttgtggctttgattgtgtggcctcgctgatggtgtgggtgttcgcgcgactatcgccctccttcttatctacttgttgtggtgggtttgttcatacgtctctcgtctgtctgcttagtgttggttggttgtgggttctggttgcgtgggccgcggccggtctcttattgtgtattgtgcttgtctttgttgttttgtgtttgggcgtctgtgtgtgttttgcttcccccgctccttgcttgggtggttgtgtgtgtgcgtctgctcagtagatcgtctgctgttgtatcttcgttgttgtgtcgtctcccgcggctggtgactgcatcctccgcagtgtgttggtgggattaggttgttgtgggcctgttgtgttgtcgcgcgggttgtaggtgttttttgtgtgtcgtggggtcttgttttggttgtgtttttttgttggttgttgtcgtgtgcgggggtgttgttttttgtttgttttgttctgtgtagttgttcgttgttgtggggcgtcgtgtggtgtgtctctctcctctcgtctgtatattttggtaagtattagtaaacttttgtggtgggtcgactctcctgtgtgtggaataataggtggtggtatgtcaaccacgcctccttctttctctgtgttgtttgtgtgaagtattgtcagctagaggcctatgttcgcctcaccccgccgccacagagttgtttgtcaccccacaacattggtgtgtggtcgctctgcagtgggtgaggatcatgtttgttgggttgtggccacgccacatttgtgtgtgtgtgttttgtgtgtttgtaatataggggtgcgtctgtgtcgcccggattatttggaggatatgtgcgggtgtgtgtgtatcgcaccggggaggtgtgcgccctcgtagcggcacatgtcgcttgtaaagagcgcgcacacgcgcccgcttgttctctctctcgtaaagagagagaatttgggccccccgtggctctctctgtctctcacacgtgtcgcacacaccacagagggagaggtgtatatatccactctgtggctgtttgtatgtgtggtgaaggtgagaggttataagtgcgaccaattgtgtgttttatagttgttgcgccgctatagaactctgttgttagagtgtggtggtgttatatgttgtaatgtatgagaccgtctgtgtgtgcccaccccgtctgcccccgtcttgtttggttcccgcccacactgtgtagaaagtttatgtgaggctgtgttgtgttctgccctcgggagaggtgtggtggagaggcacacccacagggccttatccctggatcacctgagacttgtagagccaccgttgtaagtttaagggcaccccccttttaaaataaaaagataatatactcgagcaataaactcgggccgaaaggaga

SEQ ID NO: 489524 - DNA, 985 bp, Homo sapiens
gcctggactgccacaggtgtgcaggacacatgagtcttagtagctggagatgctgctcaaatcagaagaaacattttactgaagtcaaagtggtgccgcctacatctctgcagtgtggttcgaatatttacatcaggatgctctatcgatcactgggagatgtcctccgtgatgtggatgccaatgctttggtgcgctcatgacttccttctggtgttctggggatgtcgattctcaataccatcgatattattcatcgctagaagccctttgaggaatcacagggttgagacggaagctacagaagtagatgtttcgtgtgaatgaccgagagagacttcaaaggaagtcaatcccccgagctcatcccaacgtcgttgccacgaagacaaatgtggtagtggctgtggatagtaccacaaacagggttctccattttcagaagacccaggtctccggcgttttgcatttcctctgagcctgtttcagggcagtagtgatggagtggaggttcgactatgatttactggattgtcggtatcagcatctgttctcctcaggtggcacaatctttacagacgactttgaactagcaaacctcgagatgagctttgttgcgaggtctcttagtgaatgaggagatcctagggaaccagatccacatgcacgtaacgagcttatggaatatggtgcccgtgtatccaagctagcgacattgtctcagctgtctgtgctgacgtccatccgcgatggttctacctctcacgccagaggcgaacttcactgataggtcaccagaagtgatcattcccgctaacgtctacgggggctgaggtcagcctggctggcggtctgaggaatggtcctgggctgcctgcttggggctgtttttcccggttttgccgggccctggctactggggcccccccttgcgggtcgtggggggccccccttcttggagtgtggatagcctgcccgggggccc

SEQ ID NO: 489525 - DNA, 863 bp, Homo sapiens
  misc_feature (8)..(8): n is a, c, g, or t
  misc_feature (68)..(68): n is a, c, g, or t
  misc_feature (75)..(77): n is a, c, g, or t
  misc_feature (81)..(81): n is a, c, g, or t
  misc_feature (103)..(103): n is a, c, g, or t
  misc_feature (106)..(107): n is a, c, g, or t
  misc_feature (112)..(112): n is a, c, g, or t
  misc_feature (114)..(114): n is a, c, g, or t
  misc_feature (125)..(125): n is a, c, g, or t
  misc_feature (131)..(131): n is a, c, g, or t
  misc_feature (143)..(143): n is a, c, g, or t
  misc_feature (149)..(149): n is a, c, g, or t
  misc_feature (154)..(154): n is a, c, g, or t
  misc_feature (156)..(156): n is a, c, g, or t
  misc_feature (158)..(158): n is a, c, g, or t
  misc_feature (172)..(172): n is a, c, g, or t
  misc_feature (205)..(205): n is a, c, g, or t
  misc_feature (208)..(208): n is a, c, g, or t
  misc_feature (210)..(210): n is a, c, g, or t
  misc_feature (214)..(214): n is a, c, g, or t
  misc_feature (224)..(224): n is a, c, g, or t
  misc_feature (233)..(235): n is a, c, g, or t
  misc_feature (240)..(241): n is a, c, g, or t
  misc_feature (243)..(244): n is a, c, g, or t
  misc_feature (255)..(255): n is a, c, g, or t
  misc_feature (267)..(267): n is a, c, g, or t
  misc_feature (269)..(269): n is a, c, g, or t
  misc_feature (273)..(273): n is a, c, g, or t
  misc_feature (275)..(275): n is a, c, g, or t
  misc_feature (277)..(278): n is a, c, g, or t
  misc_feature (292)..(292): n is a, c, g, or t
  misc_feature (310)..(310): n is a, c, g, or t
  misc_feature (355)..(355): n is a, c, g, or t
  misc_feature (357)..(358): n is a, c, g, or t
  misc_feature (364)..(365): n is a, c, g, or t
  misc_feature (369)..(369): n is a, c, g, or t
  misc_feature (372)..(372): n is a, c, g, or t
  misc_feature (414)..(416): n is a, c, g, or t
  misc_feature (419)..(419): n is a, c, g, or t
  misc_feature (423)..(423): n is a, c, g, or t
  misc_feature (428)..(429): n is a, c, g, or t
  misc_feature (431)..(431): n is a, c, g, or t
  misc_feature (440)..(440): n is a, c, g, or t
  misc_feature (445)..(445): n is a, c, g, or t
  misc_feature (452)..(452): n is a, c, g, or t
  misc_feature (455)..(455): n is a, c, g, or t
  misc_feature (498)..(498): n is a, c, g, or t
  misc_feature (510)..(510): n is a, c, g, or t
  misc_feature (563)..(563): n is a, c, g, or t
  misc_feature (637)..(637): n is a, c, g, or t
  misc_feature (850)..(850): n is a, c, g, or t
tgaagtgnaatttttcaaaaacagtaaaagcgggtttctcctaaactattttccttgtggtagtaganatcagtnnntcanaaacaactcctgaccacttggnttnnttttnanccgcgtcattnggaggnaatctgtaaaantagcanaggtntncngctgttccactggntcacccacatgattagcagagtgcacgaaaaantanantttntattaaagantcatgctgnnnacccnntnnggggggttgtnacattgcaaacncnctancngnngggggcctggccgnctggcgttctccaaaggnctcccaacaccatctctcctctgatttctgtgacaaatgtgggangnnacttgnntggnggngcgggggggactggggggggggctttcatcctgttagggggnnngcnttcnattcnngngtctctgtnttgcnccctggngangggtgggtggggggggggggcacagtcagctggggcagcaggnactccctacggnactagtctacagggggaaggacgctctgtgctggcagcggtggctcacatggnctgtctgcactgtaaccacaggctgggatgtagccaggacttggtctccttggaagacaggtctgatgtttggncaatccagtccttcagaccctgcctgaaacttgtatcttacgtgaacttaaagaataaaatgcatttctaccccgatctcgcccccaggactggcacgacaggcccacggcagattagatcttttcccagtactgatcggtgcgtggaattccagccaccacttctgattcgattccacagtgatcctgtcctctgagtattttaaagaagcnattgtcacccagt

SEQ ID NO: 489526 - DNA, 412 bp, Homo sapiens
aacgacggcttcatacgacggcttcagcagtctctgataaaataggcatagtcccaaaacaggaaacgacatctacacaagataaaggtattatactcaacttcacacacacgggctccatgcactgctgaccaacatgtcaccaggcgaggacactcaatcatgtatgaagccaacatgcttgctgtcccctttgaaggcatccttcgagctgggacccctggttcgcaatgtcgtttccctcttcccgtgttccgagtgtcgtagcgtgtgccactcttctagcgactgggcgtgtgtgagtcagctcatggcttcaattaatacacacagaagtccctgcctgcccgcctgcttggaaatctttggtactgctggttaatttccaacttcaactgggacaaagaaggca

SEQ ID NO: 489527 - DNA, 400 bp, Homo sapiens
gcaataaaagcaggggttgtcccctgtgcgagatttttggccccccccccaggccccccgagaacttgtcccgcttctggcggtccccactccgggcctcctttgggggactggggggcttccgttagggggacattcgggaaagcctcccaatgctctggcaatgcccacaaaaagcgttccccacactgccggtgggttgcccagcccccgggattcccccctgtagccttttcccctgtccctggtgcataaggaggcgcccatcaccgttcccccatttgttccaggcccggagcgcaactcgttgtcccatgaatttttttccgccccgcccttggcaccccccaatgttggggggccaaaaaacccatctttttttttttttttttaataagga

SEQ ID NO: 489528 - DNA, 225 bp, Homo sapiens
ggtagagctgcaaccggtatattttccttctgttaaacacccattctggacacaatctggcgccatcgaccttcttgtgaggccaagcctgaaaatgcgaagcagagaggcaggagcaaaattgaggcgaattcaggaacctgccaatgtggctctccggagctgcggtctctgaaactggcggactatcgcgcacggacaggtttctccgatgcggcagctaac

SEQ ID NO: 489529 - DNA, 298 bp, Homo sapiens
tcatgaacttcctggtccagatagtaccgtgtcattcatcgtggtgatcctgtgacaaaatatgttccatggctgaaaaatgttcaacaatgattgacgctcatgttgatgtcaagactacgatggttacttctttcatcttgtttagtgttggttttactaaaaaacgcaacaatcagatacggaagacctcttatgctcaggaccaacagtctgccaaatccagaagaaaatgatggaaatcatgacctgagaggtgcagacaaatgacttgaaagaagtggtcaataaactgatt

SEQ ID NO: 489530 - DNA, 710 bp, Homo sapiens
tggaagggaaaattggttttatttcaattatttttatgtacagaaaactcaaccagggtacttttaccccagtttagtgggcaagttctttagcccttggccttttcgagctgggcgatacgagccacagacttaggacccaggactattggccaccccagtgacgggggatctcatcgtatctggtcattggtaatgggccctgatagcttccaccagcttagccaaagcgccttggtctcccgagttcacctggtgtgaaggcgacagtgggtgcaggtcttccctggtgggactagactgtcccagttctggccttccccttgataatggcagtaaggggacccccattttacgacacagggcaggcaagaagacaaccagtctcgatggggatccacgtcgtggtgcaatcaccaccagctgagctttctggttctccaccaggggtggtgacggtgttaactccggctcgaaggacagggtggtctcttcgtggggacgtcccctttgccagcagccttcttctcggcccgggccaacagtctcgtgttcttctctggctatgctctggtctgtacttgtggggcccagttaagcaggtgagttagctgttggcgggccaggccctgggttgaactggttaccgcgggaggacttcaagcggtataaaggagggctctgcgggggactgtatgcgggccttccag

SEQ ID NO: 489531 - DNA, 415 bp, Homo sapiens
atgtatcgccacactctgcggctgtgtcccacaatcagccgtctcagacactgagagggtatatatcttttcaggctgagagaaggtccagcattaccaggagttcttgggattccacaggttaactggcttgttcccaatttcaagtgaccatcacattccatttctggacagtattcaacacatttgataggggcattatgggttccaacaaagattttctttgatcagtgttccaatccatgcattttccatttggattgatctagtcctccactccaggcatgggttggatcgtagaagggcgcagtccaggacggcgccggtgtgctggtacttgagccgcatggagttggccggcacatcgtagagacgcacggacgtgtcccaggaggagacaagcaggaactgggag

SEQ ID NO: 489532 - DNA, 514 bp, Homo sapiens
  misc_feature (503)..(503): n is a, c, g, or t
gatccacagtcgtggttatagcttgaaccggagccaaaaaaaacggcaacacagtcatcagtcaggccaaggccagctctgggagcagaaaaggccatctctttctctgttctcttcaccttcttaggggaaaggactctaaacaaggttgtgggaaagcccaccagtatgtttcccccagtgctgacctctgccttcacagtcaaaaagctttctgctttgccacaaatatctaaggagcatagaaatatctgtgacatttcaaatattgttccaaccaggggtaaatattaaagagtctgtcagagttgtcttctagagattacctaggtatagcctaatgtagcaagctgggttattagaaataatctgtagtacaattttctgtgtgtagcctcaatttccttatttactaaataaggcgacttggttggttgatctttgaggcttcaagtccagacgtctaaaacttcatggggctatttatgtatgtaatatttggncacctaaatcg

SEQ ID NO: 489533 - DNA, 359 bp, Homo sapiens
atgtggagagagaacgggacattgacttcccggagttcctgtaccatgatggccagatagatgaaggacacagactgtgaggaggagatccgagaggcgttccgtgtctttgacaacggatgggaatggctacatcagcgccgcatagctgcgttcacgtaatgacgaacctgggggagaagctgaccgatgacgaggtggatgagatgatcagggagggtgacatcgatggagatggccaggtcaattattgaggagtttgtacagatgatgacggagaagtgaagggctcacccgggcagatggcgatgcccgtgctcttgatctctctcttctcgcgcgcgcattctctctccact

SEQ ID NO: 489534 - DNA, 164 bp, Homo sapiens
tctagacgatcccgtttagcctcgccagtgtggtgaagccatgtttatactaaaaatacaaaattaggtcggacattgtggtgcacgtctgtcatcccagcaaggcaggcgaatcgcttgaacccgggaagcggaggttgcggtgagccaggatcgtgccattg

SEQ ID NO: 489535 - DNA, 772 bp, Homo sapiens
  misc_feature (258)..(258): n is a, c, g, or t
ggtgggcccccccggggcagtcccatccttgccaaggccaaaaattagtgcccgaagtttggcccgtttgtggttaagacaaacaaaaggttttttataaccgcaagtggctccccgcatgaaatttacacctggcccgtttgttagttcaagaatggtttttttgaaaattttgatgactagtacttcaaattggtccaaaaggttactttcaatggctggtgttacatggccccagatgggtcaaaaaaccccggngcaatgggtctcctcagggtggatccagtgacaagaaccattacaaagatgctaaaggggcggtcattgtcctctaacctgtttggggcatcgggctccttgtagtcccttcctcggtctcggagatgctatggacattcatcatggatacatacacctgcgagcatgcattcgtgcgcccatttagcaatagtgttcctcaacagtcgtgtatgtaatcatagaagcatacgaactatggagcttaaatgtcatatcaaaacaagaaaaaataggccattcatcataatgagcctctcgcaattgttcatttcaatgtcaggaatcacttattatttggttaacctgttgctccgtaatcagtctgggcacaaattatttccagcccgcatgctgctctagttcatgtctggtacggctgcggtggaccatactcaattgttagctttcactactgtgtgccggtgtgtcttaacaaaagcaaagcagtgtgtgtcataaaaatcttgtcagc

SEQ ID NO: 489536 - DNA, 519 bp, Homo sapiens
aagctaggtagggctggttgaatcggccgaggtggggcggaggctggcggttaggcgcagaggtctgtgggcctgagcccacgctggactctgtccgttctgcgatgactgctgctctggccgtcgtcacgacgtcgggttggaagatggggtgcctaggtcccgtggcgaagggaccggggaagtggtcttggagcgggggcccggcgcggctaccacatgttcgtggtgatggaggacttggtggagaagctgagctgctccgctacgaggaggagttcctccggaagagcaactgaaggcccgtccagacactattttgcactgctaccaaccctggcgaacagttctacatgttttgtactctttgctgcttggttggatttaataaagggggacggtcccttttggaagcaagccttcaggaatattgatgaaccttaatggcaaaaaataattcttaacattactattccgagctttcgggtccattgggaaagaactgagattttccttcct

SEQ ID NO: 489537 - DNA, 222 bp, Homo sapiens
acctggctccggcttactgacttctgcctcagcatcaatgcgcttcactcccagtgtggctgctcgggctgctaattgcccccaggtcaccctgcccatggtgttgtgggattggtgcatgactacagggggatagagcaacagggtgacggagggtcctagcaacatgacagctgtgacttaggttgtccggggggagcccttggggcagtaggctgacga

SEQ ID NO: 489538 - DNA, 1061 bp, Homo sapiens
  misc_feature (308)..(308): n is a, c, g, or t
  misc_feature (390)..(390): n is a, c, g, or t
  misc_feature (394)..(394): n is a, c, g, or t
  misc_feature (397)..(398): n is a, c, g, or t
  misc_feature (403)..(403): n is a, c, g, or t
  misc_feature (416)..(416): n is a, c, g, or t
  misc_feature (418)..(419): n is a, c, g, or t
  misc_feature (606)..(607): n is a, c, g, or t
  misc_feature (659)..(659): n is a, c, g, or t
  misc_feature (690)..(690): n is a, c, g, or t
  misc_feature (797)..(797): n is a, c, g, or t
tgcctgttttatttatgttttgttgtcttggttgtctggtggtgttgttgttttttggtgtgtttgggtgtgtcgtgtttgttgtttttgtgtgtgcggagtttggcgtgtcgtcgttgtggaggtagaagtggtagagaagagacgaggacaggggaggaggggacgatatatagaatagtagtgatactcttcggggtctaactcgtatgtactctctctcgcccccccttctacgcgccgttggtgtcccccccccgaggcccgctgttggcctttcggggtaacgggcccccccccccctcgcncgacacaagaacggtggggttccccccccccaagtcggcttttaacccaccaaaaatccatatctgggcctggtcacaggtngctnganntaccnggcatgcaccacncnnggaggagaagaggaagaagaaccacgatcccttccgggagaagaacacctcatgaggctacggaaacaggccgagaagaacgtggagaagaaaattgaccaatacaccagaggtcctccagacccccggactcctggtctgagccccataaagactggtaattcctcaagcgttgcctgcccctccnnccattgttgccctggaaagtacgggacccacggggcagctagcagtcccagngtcccacaggcagccctgggacataggaaanctgggagcacaggaaagggttttagtcactgcctcccgaagttgcttgaaagcactcggagaattgtgcaggtgtcatttatctatgacccataggaagagcaaccngttactatgagtgaaaagggagccacgaagactgattgtgagggccctatcttgtgagtggggcatctgttggactttccacctggtcatatactctgcagctgttagaatgtgcaagcacttggggacagcatgagcttgctgttgtacacagggtatttctagaagcagaaatagactgggaagatgcacaaccaaggggttacaggcatcgcccatgctcctcacctgtattttgtaatcagaaataaattgcttttaaag

SEQ ID NO: 489539 - DNA, 119 bp, Homo sapiens
ccggttttgcacaaaggtaggagaacaagtagaccagtgaggcagaatatgtatcggggatatagaccacgaattcccagtaagtgcgggtcataagcttgcgttgattaagtccctgc

SEQ ID NO: 489540 - DNA, 113 bp, Homo sapiens
acccgcttcatatactacccttcatcatacctacccatctcaaaaaaagaaaaagaaagcagaagaaaagaaagaagagaagaaagaagaagaggtaggtatgatgaaggacg

SEQ ID NO: 489541 - DNA, 1109 bp, Homo sapiens
  misc_feature (308)..(308): n is a, c, g, or t
  misc_feature (390)..(390): n is a, c, g, or t
  misc_feature (394)..(394): n is a, c, g, or t
  misc_feature (397)..(398): n is a, c, g, or t
  misc_feature (403)..(403): n is a, c, g, or t
  misc_feature (416)..(416): n is a, c, g, or t
  misc_feature (418)..(419): n is a, c, g, or t
  misc_feature (606)..(607): n is a, c, g, or t
  misc_feature (659)..(659): n is a, c, g, or t
  misc_feature (690)..(690): n is a, c, g, or t
  misc_feature (797)..(797): n is a, c, g, or t
  misc_feature (1062)..(1062): n is a, c, g, or t
tgcctgttttatttatgttttgttgtcttggttgtctggtggtgttgttgttttttggtgtgtttgggtgtgtcgtgtttgttgtttttgtgtgtgcggagtttggcgtgtcgtcgttgtggaggtagaagtggtagagaagagacgaggacaggggaggaggggacgatatatagaatagtagtgatactcttcggggtctaactcgtatgtactctctctcgcccccccttctacgcgccgttggtgtcccccccccgaggcccgctgttggcctttcggggtaacgggcccccccccccctcgcncgacacaagaacggtggggttccccccccccaagtcggcttttaacccaccaaaaatccatatctgggcctggtcacaggtngctnganntaccnggcatgcaccacncnnggaggagaagaggaagaagaaccacgatcccttccgggagaagaacacctcatgaggctacggaaacaggccgagaagaacgtggagaagaaaattgaccaatacaccagaggtcctccagacccccggactcctggtctgagccccataaagactggtaattcctcaagcgttgcctgcccctccnnccattgttgccctggaaagtacgggacccacggggcagctagcagtcccagngtcccacaggcagccctgggacataggaaanctgggagcacaggaaagggttttagtcactgcctcccgaagttgcttgaaagcactcggagaattgtgcaggtgtcatttatctatgacccataggaagagcaaccngttactatgagtgaaaagggagccacgaagactgattgtgagggccctatcttgtgagtggggcatctgttggactttccacctggtcatatactctgcagctgttagaatgtgcaagcacttggggacagcatgagcttgctgttgtacacagggtatttctagaagcagaaatagactgggaagatgcacaaccaaggggttacaggcatcgcccatgctcctcacctgtattttgtaatcagaaataaattgcttttaaagnaatataagaaaaactccgagactagttctctctctctctctctctcc

SEQ ID NO: 489542 - DNA, 162 bp, Homo sapiens
gctggtcttgaacctcctgacctcaggtaatctgtcaccttggcgtgccaaaatgctgggattataggcgtgaactaccacgcccagccattacccgtttatttttcatatacctatgtgctatattgcaaatgatctccaaaagtatggcttagagaggct

SEQ ID NO: 489543 - DNA, 679 bp, Homo sapiens
  misc_feature (104)..(104): n is a, c, g, or t
  misc_feature (455)..(455): n is a, c, g, or t
  misc_feature (535)..(535): n is a, c, g, or t
agaattcgtcgagtgtaatttgtatctttactaaattcatttcatacatgtagatgggttttatttaatacaggggcctcaatagaatatgttttttcatatanataaaacaaagtttaagactaatttttaaaaaatatcccaaagtttattttgaataatctaaacatatgatattatagggaaattgctattacttttctagagaagtaacatccataaaaactaaaaccaaagtttctaatatgtgtataattaaagttaatttctagtgagtcccctttctggacatgatcacataaaaacactattcttaattagattctaataaggaattatattagagagagagagagagagggagagacagaaatgtatgtcttataacaagttatcttacaaacattggaacataagtattaatatgtataatacaaatttggaacatgcggctnttaacttactgaaatattcattatcagtaactaagcaagaatctgcatgcagtccttaaaatctcctgataaatttaatntactggtgatataacgatctattacattccaacccattaagaaattgtaaaagagtttaacaactgtgcagttattacaattgttcgtaatatctaatttatttaagagaagtttactggagtggcaagccaactcacacgctt

SEQ ID NO: 489544 - DNA, 230 bp, Homo sapiens
  misc_feature (12)..(12): n is a, c, g, or t
  misc_feature (16)..(16): n is a, c, g, or t
  misc_feature (44)..(44): n is a, c, g, or t
  misc_feature (130)..(131): n is a, c, g, or t
tataggtacgtntttnttgtagcaatactgcacccacataaaanttgcatttttaatacgagataaaaaggtatatcacaaaaagtgtaaggtttgctggtatagatgcagtaatggcttcataaatttnnttaatttttttttaacagtggtccttatgctggattcatttatcttgaaggatgggcaactacagctgcagaccagtacacatcaagcaatttaacttt

SEQ ID NO: 489545 - DNA, 707 bp, Homo sapiens
ggtgcttcttagcagccttctggaagagatctcgcaggtctgctttctgcggggcacaagtaaaggggtgaagagtagccctggtcctccaggcagacaggaggcagtagggggcacctcacccgacgactgtgactcccgcacatgggcagaggacacttactgtgtgggacccctccatcatggcctgcacaaaggcctgtggtagctcgctggatacaggatacgcttacagtctcagtccgtccctcccggaacattctggtcattgaggcctcataggtcaggcagaacttacccctgtcctgggatatagcagaggggtgaactctggcaggtggaccctggtaccaccctgccctctctagcagcggcgcaggcggggctcctacccggaagtgagccagctgcatgacgcgatcgtgcagcaagaggtcactcacgggctggtccggcacttcttgatgaggcctttgccatagagggcaggaacatggtagagctagtacaaggtccacgttcgtctgccataatcgccttggccaccgtggtaggaactcttgatgaccgcctgggactgccaagacatgggaagggtcacgctgagggtagggctctccaagtcaggactctgggtcatgtctaggaggcatgacggtttagctggtggagaaagggccagcggcgaagaatcttcacgaggaggg

SEQ ID NO: 489546 - DNA, 620 bp, Homo sapiens
  misc_feature (29)..(29): n is a, c, g, or t
cagtaggttttcaaattcttgggtatatnttaagagttttaggtaaacaagaataggaattagaaataattcttattttttaatataattgttatttagtcatataaatcattatgcttcagtgattttgacgtgggcccaaactgattgccaagaattgttctgcactgaatgaaaagttcagagatgaattatttggttggattggagaagacagtttacaggagaccacacacccctaatttgagagaatactagcagttaggtttgaatatagtaaacgcttatcactaggtgggaaacagctagctgaaatacacattcttcttgtacttaacacttgctgtacacacaaatgccaacttgaaagacaatgaatcatgttttcactaataatgaatattcttctgctaattttataatgtaaatgagatattggtaaatatccatttaatgctacaatgttgtctaaagatttttctgtaattgtctatgcaccagaaaaattgcaagaagaaagttaatattcctgttagtttttctagaaatcagaaagttttattcctttctaaatagaagacaattccttttaaagatttctagtgcgccacccccaacca

SEQ ID NO: 489547 - DNA, 267 bp, Homo sapiens
ttaaagcacacccaatttagagttagaatgacattatatctttttaaaacatgcaaaatcaagctggaagagtgccagtcaatgaatttcagaagtatgatgatgtaaacaaaaccatgccatacacaaaaacattctttatgaacacagtcagaaaaaaccccaaactaagtattccaacaggcttcgaaacacaccttgatgtcctaaccacccatgtcaaagtcatctttgatgactgcattcagagaacaaaacgagtacaag

SEQ ID NO: 489548 - DNA, 356 bp, Homo sapiens
tggcccgaggaggtttgaaacccaattttttttcaaaggagtcaggtaagctgggtttacttatgggccaacatttaaaaggggggaaggatttgaaatttgccaatgggaaatttccccttagctaggtagcattgtcagacttcaatttcctcaagggtttggccgtcctgttttaagcatgaaaaatgttggccccatttcccaaagttttcattgaggggggtcataaaaaaacaggggttttttttttttttaaaaagcagcccagcccaaaggggggctttgttgacattttatgggactttgtcaaatgttcctaaccccccaaaaaagcaatgttgcatccactggga

SEQ ID NO: 489549 - DNA, 196 bp, Homo sapiens
ttatagaagatgctgacgaaaagttgttcgaagatgatgattcaatgagaagttgttgatgaggaggaagattcagtgagaagttgtttgacgattctgatgagagggggactattgggtggtatcagagctataccaccttggaatgtcaccccctaacttaggcaggcacatggaccacttcgaccacttcctg

SEQ ID NO: 489550 - DNA, 192 bp, Homo sapiens
ggagctcaggggggggctgttgcactgaacgaagaattcttaataaattatttcactgataaagcggcctcttacactgaggaagatgaatatcacacagccaaagattgccttctggtttattctcacgaagaaaccgaatcgctgaatgcttctattggatgccgcacctttattgaaggagagctagat

SEQ ID NO: 489551 - DNA, 373 bp, Homo sapiens
  misc_feature (119)..(119): n is a, c, g, or t
  misc_feature (192)..(192): n is a, c, g, or t
  misc_feature (198)..(198): n is a, c, g, or t
  misc_feature (200)..(200): n is a, c, g, or t
  misc_feature (204)..(204): n is a, c, g, or t
  misc_feature (209)..(209): n is a, c, g, or t
  misc_feature (234)..(234): n is a, c, g, or t
  misc_feature (237)..(237): n is a, c, g, or t
  misc_feature (275)..(275): n is a, c, g, or t
  misc_feature (319)..(319): n is a, c, g, or t
  misc_feature (330)..(330): n is a, c, g, or t
ggaaccagaggtttgagaagccctgagtggtagagtaaggcctccagcgctgcctctgggtgcagggcagagtggcagaggagagggggagaggcactgggcaccatgggggccagttncccacttcggggatctctctcgcagaaccgagggtccccttcatgggggttagatgcccagggctagctgttnccatananctgnaaagnaacctgagttctgggacatgcccgngtnactcaggagtggctgcttgggcgggctctgtcaccctngagatgttatacattctgggaactgggacaggagtggctgcttnggcgggctctngcaccctggggatgttattacattcttggggaactggacagga

SEQ ID NO: 489552 - DNA, 184 bp, Homo sapiens
gtgatcactcatgtcccatacactgaactctgttttttctggacaatctcaggttctcagattgaacattcagttttgtctactgacaaaatgcaactaaaatgttttaattcaacctcttacctttacacttatttaccttttcccagggctgggccttccctgagatccttaaggggtgatt

SEQ ID NO: 489553 - DNA, 288 bp, Homo sapiens
aggatggtgagtgtatagctagaggataaggagcttctgaggtctggaatgttctacatctttatctgagcggagtctcttggtggtacacttaacattgtgctttctgtgtgtagaagctatacctcaataaagaagaagaagaaaaaaaataggcttaagataggcagtgacttccctaaccatgaatgcaacattttctatgtatagcattactcttggataaaggtcctcagctttcatcagattgtcttttaaaatatcaactacctgatgacagatattttt

SEQ ID NO: 489554 - DNA, 150 bp, Homo sapiens
actgtgcttgactgaggtaatgggggctgtctgtgaagcttgcggcaggacagcccaggtaatttgctgagcctgatgggtgtcagggtgaaagtgaagagaggctgggacgaggggtgcaggggaatagtgaaaaaagcatctttaaga

SEQ ID NO: 489555 - DNA, 429 bp, Homo sapiens
  misc_feature (120)..(120): n is a, c, g, or t
  misc_feature (157)..(157): n is a, c, g, or t
  misc_feature (169)..(169): n is a, c, g, or t
agattgatagacctaagtgaatgaagctaggtgtgtatgccttaattaagaaaggctctgtggctcagtcctgggatcagcccaggttgtaaatcttaatgcacctaaagatttacagancggtctccaaagtaacttcagagccaggcacagtggnctcacgctgtanatcccagcacttttggaggctgaggcagatgaatcacttcaggtcaggagttccagactagcctgaccaacatggcgaaaccccatctctactaaaaatacaaaattagccgggtgtggtggcgggcgcttgtaatccgagctacttggaaggctgaggcaggagaattgcttaaatttgggagacggaggttggagtaagtcaaaatctcgccattgtgcttcagcctgggcaacaagagcgaaagccgtctcaaaaaa

SEQ ID NO: 489556 - DNA, 161 bp, Homo sapiens
tatacagaggctacattaatttattgagaacacagataaagagcagaggaggaacgggagagagcaggaagagcagttgccgtgtagcacaggttctggtcctggcccttcctgctcctgaggccccttcctatggtgcggggtaccagagactcgaaatt

SEQ ID NO: 489557 - DNA, 271 bp, Homo sapiens
acctgtctcaggctcctatatggttcctgggccttatagccaggtttgtgtggcgctcccccattttgtgacaaacgggggttcttcccatttggactggggcctggccagagccccttgcatatcccccctgtcaggggcagcccgggctgttcccctccccctggaatgggggacccttccttatcccctgcccccctcccccctcccataaagcccctgggcccccccccatggcctcccctgtgctgttgctgggatgtttgtttta

SEQ ID NO: 489558 - DNA, 527 bp, Homo sapiens
gcggagagtctcgtcaggaacggtgggtcatctgtggagagtgagtcattccttgttttaatttcactccattgtgtttctatataactaaatcttgtaattctctaaatcttttttcatgatataaaaaaaagaaaatcccaaaccacaatttaagatagcttttttttttaaaaaaaaaggttctccgtgttgccacctgctccgggaaggccaggccgatgggcggccaggtttgggagcagcggcttcggctccgattgcttcctgacggtcagttcctagcacaggctctgagaaacgcctcgaacccttggtatctggtgaccgtctccgcaggcttccgtgagtctccgataggtgtttggggctttgggaatactttcagaatactttcccattttttcataaggcaaaacggagtggacggcctttttttgagagaaacagcattctaagagtgtgcttggaaaacacactttttgggagtcacgtgcggagtggcactcaggaaggaagcggtggcc

SEQ ID NO: 489559 - DNA, 1255 bp, Homo sapiens
  misc_feature (1255)..(1255): n is a, c, g, or t
gtcgagacgcaggcgccgtctgccgagcgctcgtgtagatagcgagcccaagacggaccctccggacttccgtccgtcacccgacactcgacggagtgtcggcgtgcgtgccggcgtcgcgtccactagactgcctctccatcgctgtctctgtgggtgtgtcctagcattcgttgtaggcctcgcaagccgtctgcagttggctccagtggcttcacgtcgcaggttcgcgccagacggggtgtcgccgctacgtacctcggtgctcgcggtcggtgtagtccctgtgttcacaagcaagagacacgacctcgtttgggcgatcttggtttttggtagcatcttgatccctgatggtggtacccatcggtagctgggaaatagcgctaatcggttgcaattcgtgtcccagtggccccacatgagagacctatctgaattggaaactaatcgacacccaaaggtcatccctgtgtacaccagactgacctatagtcacagagtcctacagggaggaaatcgcgagaggcaactcaataggtttctcagtggacacacgagcgtatctggataatgggcgactgtgcggaaggctcagcagttaccccgtcttaacgatgtgaccttgggacctatgtccgacaggtgtccccgcagttggaggtcctttgagccctcgtggggaaggccagtgcaacaccatcggcaaagagtcggccaagcgggaagcgtcttgagagtaaccgtcgattggagcttggtcttggggatccaataggcgaaccgctattagcttgtacaaaaagcgctatagtggaaagtcgaaaccgtccaaaggcagcgtctccgttgggcgaaaacgccgttcggattctccgagagggtgcgcacattggcgcttccactcccgacggaagagcgtacacccctttatctggtggcggcccagaagaaatgccctattactaggagaacgatatcagcgcccaagagagctgagagcaggaggtccataaggttcagaaacaccccattggcttcaccccacatatccgaacgaccacgcctttggaacacagtttcggtgcgcccaacggggggccgagaagagcgggaaaccagacaccgcgcttggtgacgcgcttatccatttgagtaggggagcgccgaaccaaaccaggtgggttcgcaattttcccccattgatacctattgttggccaggaattcctctggggtacaagggggtcccgcan

SEQ ID NO: 489560 - DNA, 210 bp, Homo sapiens
aatgaggacccattaggcgcgtctgcgtgtgtgtgtgtgcaggagagtgctgtgtgtctgtgtgtgagtgagtgtgtgtgtgtgcaggagagtgcccagcacccagtaggacctcatgggcctcatgtataaaacttcttttttttttgagagggagtctcgctctgtcacccagactggagtgcagtggcgcaatctcggctcacggca

SEQ ID NO: 489561 - DNA, 160 bp, Homo sapiens
ctgatcaactatgagcgtctctgtgattaccattcagaccattctttcagctatagatatgttaatcagacttccgtgtgtgtaccagatgttctttcagggatgatcactgaagtcagttttccagctgtgctttggcaggcagccagctacctacctg

SEQ ID NO: 489562 - DNA, 136 bp, Homo sapiens
agacagctcagccgtggcatctgaatgggaggaagaatggacagtgtgggaaggcgaagggcagcagtgacttaggaccagatggggcctgtagctctggggacggcacaggtgcacgcaagatccggctgtctca

SEQ ID NO: 489563 - DNA, 235 bp, Homo sapiens
aattttgagcactaactgtcagggcttgtggtaggcagaaaaatggtccttcaaaggtgtctgcatatttatccctgaaacctgtgcatatgttactttacatggcaaaaaaagacttcgaaaatgtgattaagtgaaatatcttgagataggaagattatcctggattatccaatgggcccattgtggtcacaagggtccctctcttaaggagacaggagaatcaaagaagatt

SEQ ID NO: 489564 - DNA, 139 bp, Homo sapiens
tatatttaaacctttctaacacagtaacacatagcgtgcccagccatgtctgggggaaggtgcccactgtcatgcctaggccagaagttggtaaataagagagtaaacaatggcaatgcccccaatctgtcaatcataa

SEQ ID NO: 489565 - DNA, 873 bp, Homo sapiens
agcgggccaggcccaggaaatccatgaagggctacatgcacagcgggtcctgcatgcacgccgaccaaaaggacgactatggcgtgctgcatgctcgtcgcgtccacgctcgggcatcgactacacgcctgttaccggtccgaggggacgcgacgagaaccccagtcagtccccacggagagacccacgagccgggaaagacggagcccggaagccaagacggagagtctgggcagacagcaggcatgaggaggaagaagcagcgtgcgagggggctacagcctgcgatgagagattgatttggcacgagcgatgatggggacgagtggtcacccagtaacgagtcgcacaagcaagccttgtactgagtgacacgtaaacgatcgagggcccctctcaagggcagtcacagagtctggtacgaacgttgggggaacaaggtcccgattgggtgcaaagacatattgccttgagagcattaggaggaaagccccctcaggtagcagacccaggctcttacgagacgttcgagaatgcacctcaagggaccgtgaacgaaggacgaacttcagcctgcaagctgcgcgatcgtacttccctggaggagcgcaatgcgacagaagtacgaggccaggcggggaggacgtcgtacgagcggaacactgagcctgaaggttgaaggtggatgaaggttgaaaggagaactccagtggcatagaaacaggcatctgggatcaaaacatggggcttgatgtggcaggacatcgtcacccgagttcaggaattgacagctgaggctcccgatgccaggtttgaacgaagcgaccgccacgagactggagcccttgtgtattgaagcttcttggagcaata

SEQ ID NO: 489566 - DNA, 265 bp, Homo sapiens
gcatctgaggcacaccatattctaatagaaatacaaactcgacactccaataatacatgcacgactccgcttattacaatttcactggatctctattctaccttcctacggatcccctagaatttcgcttctcgcttgaccatttgcgacgggatgtacggctcaacagtcgtggtagccacaggcttccagggacttcacgtcattattggctcaactttcctcactatctgcttcatccgccaactaatatttcactttacat

SEQ ID NO: 489567 - DNA, 526 bp, Homo sapiens
gtgatcctctaacaggaggtgtgggaaacttatctccaaggcaacagggtggggaggtagggcctaaaagaaggaggtgaggtcatgaaggctctaccattataaacagattaaggcctataatgaaagggctggaggccactagtttactctttggctctccctcaccctcttggcccttcggccaggagaagatgcaggaagaaaaccctcaccagatgcgggcgcatgggacttaccagcttccagaatcatgagccaataaattggggtccattataaattacccagtctcaggtatttggttatagcagcacagaagggaccaagacaatctcttggttaagggggtatcggccagaacgctgaacggtaaagttacggttggtccttttctatgccagtatcacatggtctggactactactatttggtacaggtggagcatccctaatccaaaaattggaaattcaaaatgctccaaaatccaaagctttgggagtaccgagatccaaaatggtccaaa

SEQ ID NO: 489568 - DNA, 136 bp, Homo sapiens
agcgcagagcttcatcctctgagtctgagcattcactctcttctaccatcctcgtcctcctcatctatcctcctcctcttcctcagaggagctctcacagctactttcctcactggaggactctgaagacgatttg

SEQ ID NO: 489569 - DNA, 889 bp, Homo sapiens
ctgttcgacagtcagtccggcatcttcttatgcgtcgccagccgaggccacatcgctgagacaccagggggaaggtgaaggtcggagtcaacggattaggtcgattagtggggcgcctgcgtcaccgagggtctgcttgttaactgctggtacaagctggatatgtgtgtgccatacaatgacgcccattcatatgaccgtcaatctacatggctttgacatagtggccaataatgagttgccagcctcatgggccaaatttccactggtcaccgatgcagaggcatgagtagacgtggtaagcttagtgccgatcgaagtggcaagatcgccccgaatcaccgatgcttctcaggcaggccgagatcctctcgccaaaaatctaagtgggtgcgatgctggcgtctgatgtacgctcggtggagtcctactggtcgtgcttcaaccagccatgtgagagaaggctggggctacagtttgcagggtgggagctcataagggtctatcatattcatgaccccctctgctgactgcccccatgttcgtcatgggtgtgaaccatgagaagtatgacaattagccttcggagatcatcagcagatgcctgctgctacgaatctaagtgtttagcgaccccgtggtctaggtcgtccatgacagaggctttggtatcgtggaaaggactcatggaccatcgagtccatgccatccacttgctaccaagaagactgtggatggccctccggggaaactgggcgtgaggccgcgggggctcaccagaaaaatatccttggctctaaaggcgccgccagggttgtgggccaggcgaccctgagtgaagggaagctcgtggctggccgcctgtccccttggcacgtgtcctgggggc

SEQ ID NO: 489570 - DNA, 121 bp, Homo sapiens
tctgaggatcctactctgggccttgagagatgggcactgccgtccttcggaacggcgctcgcccatctctcagtgaccgactgacccatgtacagggcccgagagtcaggacccgagagta

SEQ ID NO: 489571 - DNA, 101 bp, Homo sapiens
gtcaggcatcttagctagattgtggagtcgttcctactctcgcagaagggagaacatcaatgtgctggtgagttgggagcaggaaggatggctgagaccgg

SEQ ID NO: 489572 - DNA, 228 bp, Homo sapiens
cataccccactccccgaaacaaaacacaaaaccttccaggtcccgtagtcagctggatgtgagaaatggtgcctcatagagtgtactcggcttacctttctgtctggagggtgtctactcaattcaagcgtacaacgtttttgagagaagacccaattttcctattttgccattcagtggtttttggcaagccaggacacccgttcatcctttacggaaactgatcta

SEQ ID NO: 489573 - DNA, 91 bp, Homo sapiens
ggatttgctggtgcagtacaactaggcttaatagggaatatgtggaatatcttcagaccaatcaatatcatacacgatattaacaggaaaa

SEQ ID NO: 489574 - DNA, 266 bp, Homo sapiens
  misc_feature (169)..(169): n is a, c, g, or t
cggtacccaggaaaattgagccgacgggtcgggtccgatgtggctaggcttggagagcttgaccgaatccgcggagtccttcggtctgtctcttttgccgagcgaggggcagccgtctcgacccggacgccttcctcggtgcaggctgagatgctttcttggggttttngttgtcatggctctttctggactgtcgccgactcgaagggcatcctttgcaggttcgccccagagtgcgtcgctaatttataagcatccgctaggca

SEQ ID NO: 489575 - DNA, 170 bp, Homo sapiens
ttactaaacttaaatgatgtcgataatacttatataccagcacctatagaggcagctcccttccaatatcaatatcaattcttcttttctttttggagatggagtcttactccgtcacccaggctggagtgcaagggtacgatcttagctcaccgcaacctcggcctccg

SEQ ID NO: 489576 - DNA, 295 bp, Homo sapiens
  misc_feature (100)..(101): n is a, c, g, or t
gccctcgcccagcaccagctttccgcggggcgtgcaaggggctcctcctagccccacagccctgtctttccacgggggacaccaaggcccttggaacggnncccgcggccagtcgtctcgcccgtcgtttaacgacgaacttcaatccaccgtgcccagttacctccccgcgaagtcccagggactaggtcgactaggccaccgatagcaaggagtcgcatgtcggaccgactcgggccgtgggatgggcagcgcactagcaacctcggcggcttccacagcctcacgcggtcgc

SEQ ID NO: 489577 - DNA, 975 bp, Homo sapiens
  misc_feature (131)..(131): n is a, c, g, or t
  misc_feature (133)..(133): n is a, c, g, or t
  misc_feature (275)..(275): n is a, c, g, or t
agcggagtcgcgatcctgaggtaacggataactttataccatggatagcacaagaggatgaagtgtgacaggttacaacagcatgatcttctgcgtgtcaggaataggcgacttcaaatgatgacactagnangactagcgaactggacaggattcaggataacatggagaataattcaacaaaagttataatggacatgccacgaaggcggctccacgattttatggaagatgatgctcaaggaaagaatgagcaagtctaaccaatcgcaatntgcacaaaactatgattgacaacaaaatagtctctaattcaccagtccaacagtctatacgaaatagtccacaagtgtactggattgactggactttgcaaatgggaattaagaacaaagccgtaacacctttgtaggcaataccagtaggtgccactcttgacagtgcgatgtcttactatgcagctgtagacatgagggacaatccatgaattgcacaggataagacgccagttgctgtaggatcatatgagtatgcgtgtctacttcatcattacctatgccaggagacttcggtgtgcgtcgcagccatgccacgcgattgattggctaagaggctgtgcccgctatttaataagtagtgcaccccaatctttgacgaaatacgcgagctgtgcacgtaagacgcaggttgaaggaaatacttgctgcatgtatgatcccaattcttatggacatgagtcttgatgaaggcctacgttgtaatttgagcaaagcacttagaaatgacagaccaataattgggcctgaggacttacacgaagggtaatttcatcccacaatggggaaagctctgtaggaaaaatgattaatcccggggaacggggacttcaataaactgggttgtagcctttaaccgaatcccattctcttccactagatttttggaagagaagtcccttcttgatgttgcagccca

SEQ ID NO: 489578 - DNA, 304 bp, Homo sapiens
ggctgaggcaggagaagggcctgaacccaggaggcggagcttgccgtcagcagagatcgtgccactgcactccagcctgggtgacaaagccagactccgtctccaaaaaaaaaaaaaaaaaaagaaaaaaaaagaaaaataactttattagaaagtcaattttagatcataagtgatctagcttatatacctaaaatctaaaaaagttgaacgcatagaagcagaaagtacaatgctggtttccagggtgtgacagggaggaggtggggagatgttggtcagaggatacaaaatttaagttgaa

SEQ ID NO: 489579 - DNA, 282 bp, Homo sapiens
  misc_feature (184)..(184): n is a, c, g, or t
tggtgagatctagaggatcccgtccagcgtcgtaagtgctaaaacatcgaaaacgaggaaagaggccaggcgccgtggctcacgcctgtgatcccagcactttgggaggccgaggcaggcagatcacccaaggtcagcgtgttctgagaccatgccgtggagaaaccaacatgagagaaacccncgatctctacataaaaatacaaaaaaattagccatgcgatggtggcgcagtgcgctgtaactcccactgccactgtgctgagtgctaggacggtgtac

SEQ ID NO: 489580 - DNA, 531 bp, Homo sapiens
  misc_feature (31)..(31): n is a, c, g, or t
acgacgagtgagtacctgtggtaccccacgntttgtggtgggaggacggtgtgtacagctgcatacgggtacgatgagtttccgtatgtgcaggaatagcattaggctgaggcataggttgacctttaacagccaaaggtgctcttgctggccttatctccataggacttggctccataggggctgcagcaataggctcctgatgcatatctgcacttgttataggagcaggctcaataggtgcatgatgctcctccacttcagggtgttgaactctgtgcacatgcctgctgaaatgagggtatggccggacagggctgctgcctctgcctcagtagactcttctgaaagctctgccaccgggtgcatccttatagtatggaatctaggggctgtcagccatccttatcccaccaccaccacccccaccaccaccaactcgatttagtttcctcacttgaggatgagtcacctgctgtcaattaatctaaaattggttctcagacaaaccaaaaaaaaaaccacaacgcc

SEQ ID NO: 489581 - DNA, 4358 bp, Homo sapiens
gcgcagttagagccgatctcccgcgccccgaggttgctcctctccgaggtctcccgcggcccaagttctccgcgccccgaggtctccgcgccccgaggtctccgcggcccgaggtctccgcccgcaccatgcggctgggcagtcctggactgctcttcctgctcttcagcagccttcgagctgatactcaggagaaggaagtcagagcgatggtaggcagcgacgtggagctcagctgcgcttgccctgaaggaagccgttttgatttaaatgatgtttacgtatattggcaaaccagtgagtcgaaaaccgtggtgacctaccacatcccacagaacagctccttggaaaacgtggacagccgctaccggaaccgagccctgatgtcaccggccggcatgctgcggggcgacttctccctgcgcttgttcaacgtcaccccccaggacgagcagaagtttcactgcctggtgttgagccaatccctgggattccaggaggttttgagcgttgaggttacactgcatgtggcagcaaacttcagcgtgcccgtcgtcagcgccccccacagcccctcccaggatgagctcaccttcacgtgtacatccataaacggctaccccaggcccaacgtgtactggatcaataagacggacaacagcctgctggaccaggctctgcagaatgacaccgtcttcttgaacatgcggggcttgtatgacgtggtcagcgtgctgaggatcgcacggacccccagcgtgaacattggctgctgcatagagaacgtgcttctgcagcagaacctgactgtcggcagccagacaggaaatgacatcggagagagagacaagatcacagagaatccagtcagtaccggcgagaaaaacgcggccacgtggagcatcctggctgtcctgtgcctgcttgtggtcgtggcggtggccataggctgggtgtgcagggaccgatgcctccaacacagctatgcaggtgcctgggctgtgagtccggagacagagctcactggtgagtttgccgtgggaagcagcaggttctggggggcccaggggaggcttggctgccagctgtctttcagagtttcaaaaaactttcagaaggcaaaagtcccttgccttgaacaactgttgttcctggagacgcagcgaagccctcgatggtgcgcacggcatttcctgcagcctccccttggcatgggatggcatcctggtgtgcactttgtcacactgcgatgggattttcccaacatgcacagaagcagagagacgagtgctagacccccgcgctccccagtgcccagccccgaccagggtgtccagggcgggtccaggcaccggcgcccagcccccatggggtgtccggagtgggtccaggcaccggcgcccagcccccgtggggtgtccagggcgggtccaggcaccggcgcccagcccccgtggggtgtccagggcgggtccaggcaccggcgcccagcccccatggggtgtccggagtgggtccaggcaccggcgcccagcccccgtggggtgtccagggcgggtccaggcaccggcgcccagcccctgtggggtgtctggagcgggtccgggcaccgccagcttctctctgtggcagccactcctgcagctctcgtttgcccctcagttccaggagcaacatagatgtggattcctgtccaatttgggaaaaatgtccacacacggtcacccacctggcaggtgcctctggctgcaaggggcgctgggcttcgcaggcaggccagccgggctccccgccatgggccaggatcccctccgagccctgtttgccgcccaggagaaggggttccccggggacagtgggctcagggtgtgcgcagccaccacgctgtggtgtcacctgtggacccaggcgagctgatggccgaccgcagaaacgcacttccaaggccaggtcggcccatccagatgatgcaggaacacagcttgctaaaaacacggccggcctgttcccgtcggagccagtcgaagttccctgaacaggccgctgtttccgaagctttaaaccctgtgtttccaccaagctgagtcctgagaaaaccggcgtctgcctgcagaagggaaaggggtgcttcatgttcctctctctccttcatctcccttccaaggccacgtttgaccggagctcaccgcccagagcgtggacagggcttccgtgagacgccaccgtgagaggccaggtggcagcttgagcatggactcccagactgcaggggagcacttggggcagcccccagaaggaccactgctggatcccagggagaacctgctggcgttggctgtgatcctggaatgaggccctttcaaaagcgtcatccacaccaaaggcaaatgtccccaagtgagtgggctccccgctgtcactgccagtcacccacaggaagggactggtgatgggctgtctctacccggagcgtgcgggattcagcaccaggctcttcccagtaccccagacccactgtgggtcttcccgtgggatgcgggatcctgagaccgaagggtgtttggtttaaaaagaagactgggcgtccgctcttccaggacggcgtctgtgctgctggggtcacgcgaggctgtttgcaggggacacggtcacaggagctcttctgccctgaacgctcccaacctgcctcccgcccggaagccacaggacccactcatgtgtgtgcccacaagtgtagttagccgtccacaccgaggagcccccggaagtccccactgggcttcagtgtcctctgccacattccctgggaggaacaatgtccctcggctgttccggtgaaaagttgagccacctttggaagacgcacgggtggagtttgccagaagaaaggctgtgccagggccgtgtttggctacaggggctgccggggctcttggctctgcagcgagaaagacacagcccagcagggctggagacgcccatgtccagcaggcgcaggcctggcaacacggtccccagagtcctgagcagcagttaggtgcatggagagggtatcacctggtggccacagtcccccttctcacctcagcaatgatccccaaagtgagaggtggctcccccggcccccaccaccctcagcagccccaccccactcaaccctgagggtccccagggtcctgatgaagacctccgaccccagcgccaggctcctcggagcccaacagtcccaagggggcagtgttgaggggtacagccctgggccctgaccagccccggcacctgccatgctggttcccggaatgaatcagctgctgactgtctccagaagggctggaaaggatgctgccaggtgacccgaggtgcactcgccccagggagatggagtagacagcctggcctggccctcgggacacattgtctgccccgggactatgggcaaatgcccctccttcttacttcccagaatcccctgacattcccagggtcagccaggacctgttacagccctggtcacttggaactgacagctgtgtgaggcctgcacttctcagacccagacttagaacaaaaggaggagtgaggactcaaggctacaatgaggttccagtacttgttacaagaaattggttttctgcaaaaaaagtccctacctgggcctttaggtgaatgtgggatccactcccgcttttaacatgaaagcattagaagatgtgtggtgtttataaaagaacagttgtcatcaccgggcattgattggcagggacaaggagctgcttgggtgtggaaagttggggcgttggaaagtgggctgtggtgcccatttgcagtgactgtgaagtgactccaggacggacctgcgggggcacccagaggtcctaagccccaggactgagggtcgtgcatcaccactcgggtgtcccgggaggtgccctgggcccggggacctcacaggcaggacggcgacactaatgcagggagagggagtctggccccagcttttcctatcagaggcgattttccttcaccaggggatgggcaggaaagaggcaggggccccagaagcttctgtccctcatgcctgagggcacgggggacacttggaggctgctgtcaccactgtgcgtccaaggccatgctctctgcgggtcagtgcctgagtctcgcctccctgctggtccctgaagccccctcagaagccctgcctgtcacgtcggcatttgtgagacctaccctgtaacgcctgcccctctcagcccaacatcagcttcctctttctcccttgctgtagacaggctggattccagtgttgggacagccatctccagaaacctgacttaagagagtaagatgcaaatcgt

SEQ ID NO: 489582 - DNA, 1010 bp, Homo sapiens
cggaagcgtcacacacactcttccccccagacctgttcggcgagctgctggcttcttcggagctggaggccacagcggagagggtggagcactgtgagccgactgctgtggcggatgcccgcgccggtgctggtggttctgcgctacctcttcaccttcctcaaccacctcggcccagtacagcgatgagaacatgatggaccccatacaacctggactgtgtgcttcgtggcccactgctgcatacctggtgccccgcatgtgtgcagtgaacctggtgtgcgctgcagaggagcgggtgaaccagctgggtgcagacgactcatacgtgcagcccgatcgggtcttcccgcacccatgacctctgctgcactgagaccacgtctacgcagacagtgcagtggcacccggactatcctgccatgctgcacttggagggagacgccccaggctggacgatgcctggagaggcggacaactgacgccggagcgtggacagccgaagatgccacgcaccaggaggactgacctgagagggggtcgtcggacggcatgtggcactgcgcaagccctacacaggagccgcagaagaaacacgcgacaccgcaagacaccccggcaggaggaggaccagtaaccggacagcatgccaagacgacgggacccatcgaaggcgacctgcgcgagacagcaagcgcgaaggcaacacacggtagaatagccaggggcacctcaaagcacaccaaagagcgaagatatccccagacctagaacacagaccgggtgacacgggaccacaaacacagatgcgacgagacacccaacggacaaagcacacgccaccgccacacgcgcaaacccggggaacacaggacacccgaacggagagacaaccacaggagaacacaggagaacagacgaggccaaacaaaacgaagtaagagccacccaacccggcagccggcgaaagacaagaggagaaaccgacaggcgaagccaaccacgacgac

SEQ ID NO: 489583 - DNA, 863 bp, Homo sapiens
gagactccagcgcgtgagaagcacggggcagaaaccgacctccaagaccttcgccatgggacaggaacgggcacacagcttctgagatccatacaggagaagaaagatcggtagtcctctcctgcgggccttcctgtctcctgggctggggactccagggtgtgcccagggagactgggcagcacaccgagcgagaacagaccctgtggcgccccgtgccctggctcaccccagcccatttgctgctcccgtagagacctcttgtacaggaagttgcccaccaggtggatggggcccctccattgcctaggctggttggtaaaagagaggaggtcaacactccagctctagccacctctgcctcttgggtcagcacctcctggactgtgtcccagccagcagcaggccagcatgcctcatcccgtgccattcagggctgttccagagattcgatcctcttaaggcattatcagtgagcaaatgtgaaggaaatggtgtctggaagaaagttctggttcacatgccgagtagctaagtctttctgcaaacaacctcccttccccccgtcgagtcatttggtgactttgatggggggagttctggttatgtcgaggctctggagacaggaagggcctttggccgcattggagtagttgacctgccttttgctgactccgggacgagccagtcccaggctgctctccagggagcatcttgaggtatcccgcaggccatgaggaccacactgggcagctctataggacagcctcttggctccagcccgaacccgaaagtggacacgtggctcagctctggcgacctggggactggcactgtggtgataacgcccaggtgccaacgaa

SEQ ID NO: 489584 - DNA, 1112 bp, Homo sapiens
tatacaccaaggacaattttaatcctggcattttcctggagtaacatccactgctaggctatctatggatgtgtaacgtgcattgtgctaagaaacgtggtgaaccacaaagaaaactttacagtgaagtccacagtgtttgatcacaggccaccacagacatcttttcagcagcaacagactacactacataacgcatcaccagaataggtctcgaagtggataaatcgtgctctcaccagataatctctattttagtaaaatccacagattaagtggcagaaattccatttttataatttatacattcttttactacacatttcctctaacatatctttattgttgttaagacaaaacaccctccattctcaagcagtgtgataaattgtgcatgtgggcgaataagacagaggggtgttaccagtgggtgtctcataagtgttctcttctaaagagtgtgttctcacgcagccacacctttaacagacgcacccaacagagagtcgattctattttacccacaaatttgtggcagggcaccccgtgtaccctctacagaggtttataaaaattttacatctcagaacataccatctccactctacaacagcgtggtccacatttgtcatcactcgtgtggtggaggaaacgacacatgtggtgttttccaaaattgtgggctttaaattatcccaccaagggggaaccataaaatcatttcatttctgagcgcccaagtggggcgggtgtttcccagggataaccctttatatagagcctggggatttagccgcgccacaatgagttatacctccccccaaataaacatttagacataagccccccgacacattaaggaagacgcgtctataagacgctacgttcgctgaacagcgggggcaccttactcaccaacattcgaagcaagcaaagaaagtggaactgggccgaatttaacaagtttgtcgctcacaaagagtggtatctcctgagggaagataaactccccaagcctttgagacccatgttatgcgcccaaaaagcacttggtattacccaagaagataaaattctttagacaacacatatttgaatactattttaacacc

SEQ ID NO: 489585 - DNA, 925 bp, Homo sapiens
  misc_feature (9)..(9): n is a, c, g, or t
  misc_feature (242)..(242): n is a, c, g, or t
  misc_feature (374)..(374): n is a, c, g, or t
  misc_feature (393)..(393): n is a, c, g, or t
  misc_feature (395)..(395): n is a, c, g, or t
  misc_feature (432)..(432): n is a, c, g, or t
  misc_feature (521)..(521): n is a, c, g, or t
  misc_feature (524)..(524): n is a, c, g, or t
  misc_feature (659)..(659): n is a, c, g, or t
  misc_feature (849)..(849): n is a, c, g, or t
  misc_feature (922)..(922): n is a, c, g, or t
agattggantaagcttcctgggctttgtatgaaaaaggtgttgtacgtgggggtttttgggagtaataatgaataaaataaccataataaaaatgaaagggtttgttttgaccattttttaggttttttgttgaaacggaaaagtgcaaagaaattgaagtacatatgcagtttgttttaacctcaaatagtggaagtgccacttcgtttcgtttgatagtttgtttagtttaggagatggngaggggttgggttgtttttgttttgattttgtccagaaggtttttttttgggaaatgcacttttttcttgctcgttattgaatggagtttgatgaccccatttttgagtttttggtgggggatgataggaanaagtgggatgggtgggttntnatagtattgtaattggtttagtagttttgggttgttnttgtagagggggtgagggttgatgggaggatggcaaagttttgagaaaagttttagtgtttggtgtagcaggttgttgtgtgcagatgnganaagaacttgtgtttgagtggtgggtatcttctcctccaaagcctctagtctctgttccacgatggagaaaatccgctccaccccaatgctgagccccacacatggcaccttgcgccctttggggtcgaacatgcncactagcccatcatagcgtcctccagcagccacactgcccacacccaggggctcttcccctgcctgggctggggtctgtagcagcactgcctcatagatcaccccagtgtagtaatccagccctcgagcaaggctcaggtcaaaggagattttgtcatcaatgccaaatagggtcaggtactcaaagagnaacttcaggtctcccaggccctccaaggcctggcttgttttgggatagtttaggatcctggagagctgttcancag

SEQ ID NO: 489586 - DNA, 109 bp, Homo sapiens
atttgttctctttcatctgtctatgtacaaccatttacgattgacacctataagtgtatctctgtgtcacacgagagactgcggttatatgtctctttcctcctttttt

SEQ ID NO: 489587 - DNA, 1246 bp, Homo sapiens
tccttaatgacattaacactattctcaccagacctccctaggcgacccagacaagttatacccatagaccaaccccttaaagcaccccgtcccgcacatcaagcccgaagtgatatttcctattcgccatacacaaatacatccgatccgtccctaacaaacctaggaggacgtccattgcaccatagttacctagtccaatccgtcatcactaggcacataagtcacccagtacctccagtacatatcacaagagcaagcaacagcagtaatagtgttcagccccacgctaaggcacgaaagtcaacgtagttagtgtgcaccatacacataggcccgacaacgcacacgttcgcagtcaacattcataacccgtgcaacatcaggcacgagacaccacaacgcaacgctacatggcataaacacaccatgtcaattaacacacatcacaagattaggaagcaagaaggtcacgaccgataccagtgtcaacactgacatacacagaatgcaagcacaaaccgcacaacgtccgccctgcacaagtgctcacctcagaaattaacgcacacaagacagtacagtgcgattcccagcatcaaacgtctcggaacaggcaacccaagacagaacttaagcactgccagaacacatcgtcgcgaccacacaagacagagacagcgaacacaagcagacagaagagacgcagagcgaaagatagcaaacgacacgcagaacgtgagtacagaagacgaccgaagagacctaagcgaggaacgagaccggtgagcgacagacaagcccaagacgatgataacacaacccgatacacaacggagcacagcaagaccagcacccacgaggccagctacagccaagacaatacgagatataaccaactaagtacacacctcacgtctgacaccctatcacaagctagcagtacaccaccccagaaacaagcaaaaacacaagagggaaagacacacaaaacaaaaggcagagagatgaagccacagcaccaccacacaaccgagcaaaaccgcaagacacccaatacagagaggaacacaccaaagcgagcgacacctacaccacaaacacacacaccatcaacacagaaaggaaacatcacccacatcagcgcagcacgaccacgaatctcggaggaacactcacaacaaaaagaaggcaagaacagcacacagagcaccagaacggagaacaacacagaaaattccacgcc

SEQ ID NO: 489588 - DNA, 683 bp, Homo sapiens
tttgtgtccaccagctgtgatcgtagctgaacttcagcctataatctggaatttgaagcaggtttgatgctgcagaatgattatgcttgacttgcaacatggctcatagtgttcttccagactttcacgcacatggttaaccgtacatgtcctaaggaaaagccaattttgtgtcgtcctaaccacggcctgatatcttgtcagtctatcatccatgtcccaccctgccaggaatgcgcctacatgggccctgctgctggccaggccgccttcctcagcgtgcacacgcgtcactgccggccccggcgaagccaggaagccaccgcagcctgcggcgttccagccacagaccgcaccagctgcattccgtccagggacttggccagctggcatgaaggcataaaggagggagcagaagctcgcagggtcagatcaccaagcgccgaccacgcgcggctagcgccgcatcgccccagccgcgctcctcagtctgtctcgccgcgccttccctgggtgaactggagtcggagggagcctacttctggcaatatgttttctccatggattcagcagcagtgttaaaggcaaaaatttcatcaaccaatcatttatatttatttaatataagatatacactgcgaaccagtgaactggatagaaactcttcatgtacagaaccgtgc

SEQ ID NO: 489589 - DNA, 346 bp, Homo sapiens
tactaaattcgcggccgcgtcgacctccggtcctgagctgatgctagtcctcatactagccatgtggccttgggcaaagcgtgcccccacctccgtttccgcttccataaaatgaggggtttggactggaataactaattctcctccccctgagaagtgcccccccacattgtgttcgctgtcacgatggcaagaatggcccaggatgaatcagatccaaagttatcgaggacacactgaggtcaagcaagtgaccacgcgtgaccggggggataaataacgaaggccacataattccattccgcccttcccctgcttttttcgtcgacgcggccgcgaatttagt

SEQ ID NO: 489590 - DNA, 201 bp, Homo sapiens
aactgagagacgtgttgcatgctaccagtgtgtaagccagagtgtgggaggcatctagccaacttccggatgccaggtcaacatggagaagcctgtcccactgacatccctagctctagctccttctcgaatcaccagaaacgtctggatgtctgactcaggaactgaaattaagagcaaccattgcaacacggtctctca

SEQ ID NO: 489591 - DNA, 228 bp, Homo sapiens
aattgaatgatgattcagatccaggcgagtatgtttacttcattgaatttgtggctctacacatcataatcaaaagtgaaacaaaggaaaaatttccctgggtcatgtgtctaggcttcaaggactaggagtcagcggccctacaaaataggaaaaacagattctacttatttagtgctcttctttctcttgatcttagaaatatatttttgaggggaaaagaccctg

SEQ ID NO: 489592 - DNA, 939 bp, Homo sapiens
  misc_feature (611)..(611): n is a, c, g, or t
ggcggcggcggcggtaagaggccggaggtgccggcatcgatgtccctcttgccaccgtgcggaccccctttgccaggcgaatcggctcccgatcagggtcctgaagatgctgagcgctcacgaccggtcaccttcctgcacccggagtaccgtgcagccggtgtcctccactcccgtcagccccattgatgctggacggccaagaagagccccttggcgctgttggctcagaccgtgctacgcaagatctggctaagcctggaccacgtccgccctacctacctaaactgcgaactcgtgttggacggcgagcgtgccaaacggggttgctaggagctggcagaatgcgaccaccggccagctacagccccggaggcgcctggctccggcgagaccagcggtgcgcctcgaaggcaggctagaggggactcgaccgtggcgcggagagacgaacgtccatgcgttcaaggcccataagcgtccaaaggtggcttccgggctggccgtgcgagctcccagcagaagaccaagcgtgcctccgtccttcgggttcggtcttaccagccatccctccgtacgttccctcccttcgtgcccctcgggatgaccanaggtcgggggctttccatggggttcccccccagggcgcccgttccttgcgccggccccttttcaccctcggcataggagcgcgccgggtactcgcgacactacctccggtcctccgctccgtacggccccgggccggaggcttcccgcggcgtgccgggcgtcccctcgtgaacgcaagcttcttgtaacttggccaaccgaagcggtgcgagaccgaggggttcggccgtggcgggggcacgcgtggcatcgaaaggaaacatcacccatggggacggcccccaaaggcccccatgaccccgggaggcccgggccacccaccggtga

SEQ ID NO: 489593 - DNA, 87 bp, Homo sapiens
gcctacgccgaaaaccccttcctttttttcatccagaaaagcaagagaaaaaggattctcttctgcggccgccaacgcgtcggagat

SEQ ID NO: 489594 - DNA, 977 bp, Homo sapiens
tggggaaatacaatatgaatcttttttcataaaagcaaaaatgtcccgggccctcttggggtacccgaaaattagtgtcactgtggagtttttaagtttatagcgtgacacccccgaggtgaaaaaataagaagactcactaacccaagaaaaagcaagctatttatgacacaaagttattcatcaccaccaggtgaagaggtattaaagtagagggcgcctcgtgcaacacgtgtgggtctcaacacacagcgggtgtggtcttatttgtggggttctcacaacaataagttttctcttaatatctcgcgtgtgtgaaagaggtgccttggcgagtagtgtggggaaacatgtgccgagccgaaacaccagaggagactcctctcctccacagaggtttattagaggcctgtgtgcccacgtgtgggaatagtggctcaggtgtgaagaaatttcaccccggggtgaaacaccttgagggcaaagtgatatttggtgcgcccgggggccaacaaaccctttggggggcttttatctcaaatatgtgacaccttttctcgttttatactcacaaaagcggtggcgcttatctccctcttaacaatgtgtggcgctcctttcaaaattgcaccggaaaaatcctccaaatcgtggccttgaaggtatagggggggggaaatatttctcccacgcgtgggagcgttttttatatccccccaatcacaggcatattcaccattttgtataacagtctccgtttaccactctataggaagattgcgctgtgtcccaatatttcttgtgtgtggatatccaccacggagagggcggcggcgagaccaactttaacgggtggacacccacattttatttctcgcgccggtcagtggattattaccccactccactcatggggagggggataagggagattcaaccagaactgaggtttaccccactcatctagtcacaacctc

SEQ ID NO: 489595 - DNA, 109 bp, Homo sapiens
  misc_feature (81)..(81): n is a, c, g, or t
acggtatggccgagctcaggcatcattcaggctagttgatcggcagtgagtgtacacactcttagcgtatcgactacatgncacgtctgctgtctatatcaccaacact

SEQ ID NO: 489596 - DNA, 356 bp, Homo sapiens
tgctccttgcgcagggtttggtattgggtagcttaagtcgtccgaaggctttttgcccccgggaatttagacgggaagcgggcgaggcagcgcgatgcgtcttgctcacttcttgcccgcgtgtaacgggctacgtcagttgccaataggcgtggcgcgccggcagattggcacccgatgccaaaatttggatgatgctttagaagcgcgatgcgtgatccgcggtgcggatcggccatacacctgggaaattgcagcgttcttcctcgacggagccgagatgcttcgctagcgttgaactgctctggcacaattgcggttgtgggcgtctgaaagtgtgcgctatcagccacgct

SEQ ID NO: 489597 - DNA, 471 bp, Homo sapiens
  misc_feature (45)..(45): n is a, c, g, or t
  misc_feature (53)..(53): n is a, c, g, or t
  misc_feature (66)..(66): n is a, c, g, or t
  misc_feature (77)..(77): n is a, c, g, or t
  misc_feature (80)..(81): n is a, c, g, or t
tttatttaaaaggcccaaagtggccaaagggcctataatccaacnggtacgtnccccccctttttnattacaaaatnccnnggttaaatgcaaaaccaaaatagtacataacaaaaacataatcgtgcccattagccgaacactctcagatataataatttattgtatatctgtttggatttttttctatgcatatagtaatttttttaaagtccagcatattacaagtacagttttacaacatttttgtttgtttgttttgttttctgcctaatatatcttgggcctctgtatcaagacatactgatctacctcataaagatatatgtttaacaaggtggatttttaaaattgcctcaccctactagatgtttatctatttttctatatttgacaaaaattttcaaaattcttccttgtactcacaaaagcttaaatattacaagaaataaagattccggaattgtttta

SEQ ID NO: 489598 - DNA, 915 bp, Homo sapiens
cctgttgtttgactccgccatttctttgtacatatatttgtcgtgccgtccctaaattcggcggtttttccttttccggagagcttttttttggcagcgggcctttaactaattgtggccgccccgtgggatcaccggttacagcgacccttggcgtggccaccgtggttgtgatgcccggccaccacggggtgtccaaccacacgcttgggaaactgcggcaattctcgtgtctgctcccggggataccacacatggtgccccgcccctaggttgccggtcctcccttgtggtaccacacaatccttgtggggcctctggccctcccagcaattctttgtaccccgggtggctcctttcttccccttggcgcgggtttcatctccccgcgcccctctcccctctccgtggtgccaaataaggcgttgtcccctcctttctgctctcccaaatcaataagttgtttatttttttcgcctcccttgaagaattttttcgcagtacttgtgatacagtcgagctccttatttcccccaggcgcctagagccgcattggtttcttgcatctcggggtccaccgccccgctatcggactcctcccccggggtgtttcgcccggactcccctctgtggcctcagcctccgcgagtatctgtggtgccacccgcggttctcgcgtccctccccctgtcgcaacacattggggtaccccccctgttgtttcccttatttcatcctttcaaggcgtggttttggaccccccttgctgctgcgatgggtgatccatatctgggggggcatatctggaggggcttgcccttgaccgcccgtgaagttcttccaatgcccggggcagccgtggtgatatttgtcatagccttttcctcgggccccgcgccccccggcccacatgac

SEQ ID NO: 489599 - DNA, 136 bp, Homo sapiens
cacctcccatactatgtgctcgtaaatatattatatctcaggaaagtaatcctgaactatgtgacatctaaattggaatgtatacttttaaacattcaatgtgaccatcctgaaagaaattctcctttcttgatag

SEQ ID NO: 489600 - DNA, 171 bp, Homo sapiens
gaagggtatgatccacgtgtcctcctcaaggacgtcatgatttctagcaggacttacctgagtggtcgatcacatgcagttggttggttgatgcactcagttttccctatatgtgcagcattcaagttacaggctcatttccaggtcaagcccaaggtcatctgccagcag

SEQ ID NO: 489601 - DNA, 177 bp, Homo sapiens
ggaccgccatcagtcatgagagtatcaagacttgagatattgagggtaatgtacttgtcttaagtacagaacattgtcccacatatactaataacaaatatacagtaaatgctttaatctatttaactgtcatctggaaaaccaaaggaaacgaaacggaacaaatatcaaaacttt

SEQ ID NO: 489602 - DNA, 143 bp, Homo sapiens
atcttagcaacctttaccaataaggatagcgatagaatgaacctggcgcaatagatatagtacgcagggaaagatgaaaatcatagccagcatatatagcaaggctaaccacatacctctgcatatgattactagaatacttt

SEQ ID NO: 489603 - DNA, 164 bp, Homo sapiens
gcgtacatcttcgatacccctggagccccaaaccctggagccctaccctggagcaccaaaccctggagccgcctatccctggagaccctagccttggagccctcaaagtcggtcttgctctgattctagggcccctctcgagtcttcttagctctgatttctgg

SEQ ID NO: 489604 - DNA, 1070 bp, Homo sapiens
ggtgaagcccgctggccgcgaactggactggtggatctctcagacctggggccccggactccgatctccgccgtctccgccaccatcagggcgggatcctggctctggtgtttctgagcgagggggtgtggtgtagggaaacggaatccctgtccctctccaccttctctcgccttcggggcttcagcactcacggaactcgctcatggctctcctttgatgaagacagaacgaaattcaaattccaaactactttcaccctggaggagctgactgcggttcccttcgtgaacggggtcctcttctgcaatggccctggccgctccgaacccctccgagcccaggcaccactgtgaactattctcctctgaaccactagagggcaggccaggcaggccacggcgggcccgtgcagcttgtgggcaagcaaggagctggcaaggacccggcgctgcctggagactgacccatgcctctggctgaggacatgcagcagctcctaaatgtacgacgatgcctgtggctgactggtggcctctctacctgtgtccccactcactccaggagcactggcttctgcgtcacgtcttcacgccgccagggccttgcctccgttgttcccttgtcctggtggtggcgcgcggccatgaccgcctccggaatcctgccacctgtgactgctctgactgcttaagctgcctctcagctgtcccttaccttgtgtactgggggaacctgctgggggcctcatccctgtgcagcccatgccgaaaacgcttggcctccaccccggcaaactgtcctccccgctggccttgcatccccctggtacgcatctagcactttggaaagcaccccatagcgcatatggcccgtcacttgggccccattcactagtccccgtttccacttgcgcctccctttcacccatgggagccataggtgaaccttggcctctgctggctgcgccatacggccgtgtggctctacggaaccactcgccgcacactgcacgtggctttatctcccacgaaacgcccgaccatctttaaaacctgctgacaacctgt

SEQ ID NO: 489605 - DNA, 138 bp, Homo sapiens
catcgagatctgctccctcagcgaacacagatcccctccagtagactcaactgtgaccttggagacgtactaagctgaaccccgaggagacagcagatgtagacattctaacactaaacttgatttacaaccttgaca

SEQ ID NO: 489606 - DNA, 129 bp, Homo sapiens
gatttacagcttcttaatagaaaataggttcttattatatttctgactggagaaggatttgtaaggctaaaagcaatggaagggatcgcaaaagaaaatattgacaggctttggctccttcatttgtct

SEQ ID NO: 489607 - DNA, 4823 bp, Homo sapiens
agcggggaggagagagagaggggagggcggcaccgcccctagccccgcgctccggaagtgaagcggccagaccaccagctaatggatgcggagcggagggcccgctgaccgctctccgcgcctggagcagcttggcttggctggagctaagagccagacacaccactgtgtggaggtgggtgatgtcttcctgtgctaaaaggtgaataaataagctcctcacctctcgcggaacactcgggaacacatcaacaggggtccaagccgccctgctgggaggcttctcttcaagagttctgggtcccagagtggaaggcattttcccatcaactggagagagacgaaacatcagagaccaggaggctgtggagaaagcagctgtcccaggtgcctcaactatcagagaagggtcagcgtcacgtggctgccagcatctttgagaaaatcactggcaatcggacttcagagctgcgggcacaggtgtggttagaactgagatacgacctgcccacctgggtcaggcctaaagacaagaagtcctgagttcttgccactgagtaggccagggtcatttgtccagaaaactttgtgactgtctttgagtgacctagtctgggacccattcattggtgggttctaaggttagaagctcatccaggatattttcaatattaagtcagtgcatagctgcaccactaacaaattggtgcctgtagagtcagagtgggtcaattcttaggacaatggccctggcactgttagaggactggtgcaggataatgagtgtggatgagcagaagtcactgatggttacggggataccggcggactttgaggaggctgagattcaggaggtccttcaggagactttaaagtctctgggcaggtatagactgcttggcaagatattccggaagcaggagaatgccaatgctgtcttactagagcttctggaagatactgatgtctcggccattcccagtgaggtccagggaaaggggggtgtctggaaggtgatctttaagacccctaatcaggacactgagtttcttgaaagattgaacctgtttctagaaaaagaggggcagacggtctcgggtatgtttcgagccctggggcaggagggcgtgtctccagccacagtgccctgcatctcaccagaattactggcccatttgttgggacaggcaatggcacatgcgcctcagcccctgctacccatgagataccggaaactgcgagtattctcagggagtgctgtcccagccccagaggaagagtcctttgaggtctggttggaacaggccacggagatagtcaaagagtggccagtaacagaggcagaaaagaaaaggtggctggcggaaagcctgcggggccctgccctggacctcatgcacatagtgcaggcagacaacccgtccatcagtgtagaagagtgtttggaggcctttaagcaagtgtttgggagcctagagagccgcaggacagcccaggtgaggtatctgaagacctatcaggaggaaggagagaaggtctcagcctatgtgttacggctagaaaccctgctccggagagcggtggagaaacgcgccatccctcggcgtattgcggaccaggtccgcctggagcaggtcatggctggggccactcttaaccagatgctgtggtgccggcttagggagctgaaggatcagggcccgccccccagcttccttgagctaatgaaggtaatacgggaagaagaggaggaagaggcctcctttgagaatgagagtatcgaagagccagaggaacgagatggctatggccgctggaatcatgagggagacgactgaaaaccacctgggggcaggacccacagccagtgggctaagacctttaaaaaatttttttctttaatgtatgggactgaaatcaaaccatgaaagccaattattgaccttccttccttccttccttccctcccttcctccttctctccttctctcctcctctctcctctcctctcctctctttccttccttccttccttttttctttttctctttcttctttatttcttgggtctcactctcatcacccaggctagagtgcagtggcacaaaaatctcggctcactgcagccttgacttcccaggctcaggctcaggtgatcctcacaccttagcctcccaagtacctgggactacaggcacgcaccaccatgcctagctattcttttgtatttttggtagagacagggttttgctgtgttgctcaggctggtctggaacccctaggctcaaatgatgtgcccaactcggcctcccaaagtgctgggattacaggcatgaaccgccatgcctggcccttgatttttctttttaagaaaaaaatatctaggagtttcttagaccctatgtagattattaatgaacaaaagattaaactccaaatattaaatagtaagcctgaaggaatctgaaacacttgtacttccaattttctttaaataatcccaaatagaccagaattggcccataccatagaagaaagaattggcagtcaaaaaaaaaaataccttttgtaatgtttgaaaaataaagctgtttgacttgtcaggtgttttcctttctcaaatcagcaaattctctctgagtgcctggctttgtgagacactgtacaaggagttacaagactacagctataacctgcagttgagcagttataaacctacaaaatgggccctgccctcagagaggttccagtctagatgaggagctgatctagacaggtaaaaggctaactaaccctttgtgtaaataagttcatcaccccagtaaaagtgtcatcacccagtgaataggaccacctctgcctgcagatttttgttgttgttgttgtcattgttgttgttgttttaacctgggaagtgttcttcctgcctttctgctaggtgtcagatagatggtcccagagctaggtgctgtgtcaggccctgaagacacagatgactcaacctaagctttactttccagaggtccacagcctgagaggtgtccccaaagaaagggggacatgaggggactgcatgcttgagagcagggttgtttagggcaggtttggatttagtgagcaggctggtttgcttagagaaggcttttagtggcaacaaaggatgaagaggagagaaaaggaactcacatttattgaaggcctactgtgtgcaaagtgtttcatgtatatctcattgaatgtatacagccaccctgttgtggtataattttgctctttataaagagaaagaccgaagctcagatgagttaagtggtctcctcaacaccaaaatgccaagaagtgatggagcctagacagaagcccagaactttctgactcacactagtccatcctctaccatcacgatgactttcaaattgtgctctgcagttctgcagattttctagcagtgccatctccaaaatgtgttttaaactctttatttttttaattattattagtattattttgagactgagtcttgctctatcacccaggctggagtgcagtggtgcaatctcagctcactgcaacctccgcctcccaggttcaagcgatttcgtgcctcagcctcccgagtagctgggattacaggcacccaccaccacgcccagctaatttttgtatttttagtagaaatggggtttcaccatgttggccaggctggtctcgaactcctgacctcaagtgatccactcacctcggcctcccaaagtgctgggattacaggtgtgagccaccatgcctgggctaaactctttaagtctctagtaaatgcagctagattcaaatgggctgataaccaaattttaacacatcagcattcaccaccaggtttacttttattttcagattggctcattttgtgcagaccttagagcaaagtttcctttatggtatctgtgtacgtatccaaacttcttttaattgttcacagattttaaaagcggtagcaccacatggttgtgtagatcagacctgtgtatttagatcagacctgtgtatcacgtaagtgtgtgagtgcagtgcagatgagcaccatttagttatatgtgctaggcaaatctccaacacagttgatgtgtagtcttgtggtagatttgtgcatactgtaagcaaattgcttagcttctctagacatcagtttccacatctgaaaaataagaagatgagagtacacggttgttatgaacaaatgacttaatgctttttaagcacgttgcatgacatctggaacacagaaagccctcaatacattgaagctcttaggattttcacgatgttcctgtctgctcaatgcatgctttctttattgttctgacagttgtgtggtaacaagctaatatgcttccagttgacttccagtctaccctggtgttagaaaccgtttcatctcttattgtaaatttgagtgcttgttgttttttatatttgtgatgactcttccagcagttgttgacaattgttagaggtttgacttttaaataattacttattttttctgattgtggttcagtttaactgaagaatatcctgagattgtaagaaaagcattttttaaaaggtatcacttgtgatcatttatctttctaaattctatttttaatactgttccaccaaagtgatgcagtggttaccatgacaccctaatttcatgtgtttttgtatttatgaaaatagtttcattgtcatttattggcggtatacaaagtaaaatgttataaatgtgaagttataaaataaatatatgctaataaaatcctgagtttttctgaaaaaaaaaa

SEQ ID NO: 489608 - DNA, 1411 bp, Homo sapiens
gcattagactgagatctctgagatgaaccggatcatcagccggttcctggctgacattgacgggcctcgagaggtccatgaagggcttcctctggaggccgctctaattgccgaagactgccggatgcagccgtggcagaggctaggctctattaaagtgatgccacacgctcataagttagttcctgatgcttgcgacggcccgcccgtgctatgcgtgagactcaatgctatgcgtacattggctgcgtgacacgcttgcattagatgttacgcagggatgctggactgaacggtcaaaggctcggctcatggaatactcgaggaatccgcccaatccttggccagtgtaagctcgctgtgaagagcgcagcaaggaaggagtccccgtggcatcgttcatgttactcgtgcgcacttgctacgtacacctatcgtacgcttagttccattacctcataggcatcataccgagcgggggcgtcatggcaaggcgtttggatcctagaggtcttcagagccacgttcatgagggggtcctcctatcaagacgacgcgcgccagggttcaattcctacgccctaacaacggtcgcgtaaggcgcccttccccgatggacgtattctccgtgacatccctaagtgcctggtccgtgcgccttttcaccaaagcccttcaccgttttaccaagtcggcttgactaaccctacgttcattcccttttccacagggggggcccccagtttggaggatttttgttcggaatacggaacacagaacttccagactggaattccaaccaggttagtaatagggggaacaccggcccttggggttcgatttcttagcaactgttacactttccttcggaacaggtgcccttcgtcttccgtaatacggtttgcataaggcactggccctgggtccgcgttcaaagtgtccgacacattgtgcgcacagatgcccctttaaactctatccgttccgcttagtttgtctcttggcgccccacaattcaccgttccacttgttgtggtatcatggggccaagtggcaccggtatttaatcgtttaacggtgagttacagggcagactgggcgaaaaaacctaggtgtatggaaaccccaaaagccttttgctatgtggagaatatcccagcgcggacgatgaggacagcgctatgtgagatgaaaacacaccccaatgtggtgcgtgaaagtattctcacaagcattaaacccccgttaggttgtggaatagccacctcaactcatttgtgggcgctcccaaatagtggccctggtcacacaagagctgtttaacatcagttatccttataaatttccaataatatcaggagggtgctattacagggggcaaagatatggggtccctctcacaagttatatg

SEQ ID NO: 489609 - DNA, 553 bp, Homo sapiens
  misc_feature (399)..(399): n is a, c, g, or t
aatgaaagacagagggtagctggtgatttgcataaggctcaccagtccctggagccttacccagtccaaaatagtaaaagctgctggaggcctactgttattgaaaatagtgatgtttccccagaaacggagtcttctgagaaggagacaatgtctgtaagtttaaatcagactgtaacccagttcacgcagttgcttcaggcggttaaccccacgctcccaaaggagaaagagcccttcccggggttagagtgaagtaattggggaactgttcctttgaggataaaaaaggccttgtattatattttgcccaattaaagccctatttatggtttccccccttctaccttggcagaaacccggacaagaggtttgtcttttttaatccctggtaggccnctggtttaaagaaggaaaaaaaaaagccccctctgtagaccccctcagaggttagttttataataaaaactgtttgaataattaggccctttccttcctgaagataaacatgtaatcttttttctttttttggcccataaaattgttccgaaga

SEQ ID NO: 489610 - DNA, 4769 bp, Homo sapiens
agcggggaggagagagagaggggagggcggcaccgcccctagccccgcgctccggaagtgaagcggccagaccaccagctaatggatgcggagcggagggcccgctgaccgctctccgcgcctggagcagcttggcttggctggagctaagagccagacacaccactgtgtggaggtgggtgatgtcttcctgtgctaaaaggtgaataaataagctcctcacctctcgcggaacactcgggaacacatcaacaggggtccaagccgccctgctgggaggcttctcttcaagagttctgggtcccagagtggaaggcattttcccatcaactggagagagacgaaacatcagagaccaggaggctgtggagaaagcagctgtcccaggtgcctcaactatcagagaagggtcagcgtcacgtggctgccagcatctttgagaaaatcactggcaatcggacttcagagctgcgggcacaggtgtggttagaactgagatacgacctgcccacctgggtcaggcctaaagacaagaagtcctgagttcttgccactgagtaggccagggtcatttgtccagaaaactttgtgactgtctttgagtgacctagtctgggacccattcattggtgggttctaaggttagaagctcatccaggatattttcaatattaagtcagtgcatagctgcaccactaacaaattggtgcctgtagagtcagagtgggtcaattcttaggacaatggccctggcactgttagaggactggtgcaggataatgagtgtggatgagcagaagtcactgatggttacggggataccggcggactttgaggaggctgagattcaggaggtccttcaggagactttaaagtctctgggcaggtatagactgcttggcaagatattccggaagcaggagaatgccaatgctgtcttactagagcttctggaagatactgatgtctcggccattcccagtgaggtccagggaaaggggggtgtctggaaggtgatctttaagacccctaatcaggacactgagtttcttgaaagattgaacctgtttctagaaaaagaggggcagacggtctcgggtatgtttcgagccctggggcaggagggcgtgtctccagccacagtgccctgcatctcaccagaattactggcccatttgttgggacaggcaatggcacatgcgcctcagcccctgctacccatgagataccggaaactgcgagtattctcagggagtgctgtcccagccccagaggaagagtcctttgaggtctggttggaacaggccacggagatagtcaaagagtggccagtaacagaggcagaaaagaaaaggtggctggcggaaagcctgcggggccctgccctggacctcatgcacatagtgcaggcagacaacccgtccatcagtgtagaagagtgtttggaggcctttaagcaagtgtttgggagcctagagagccgcaggacagcccaggtgaggtatctgaagacctatcaggaggaaggagagaaggtctcagcctatgtgttacggctagaaaccctgctccggagagcggtggagaaacgcgccatccctcggcgtattgcggaccaggtccgcctggagcaggtcatggctggggccactcttaaccagatgctgtggtgccggcttagggagctgaaggatcagggcccgccccccagcttccttgagctaatgaaggtaatacgggaagaagaggaggaagaggcctcctttgagaatgagagtatcgaagagccagaggaacgagatggctatggccgctggaatcatgagggagacgactgaaaaccacctgggggcaggacccacagccagtgggctaagacctttaaaaaatttttttctttaatgtatgggactgaaatcaaaccatgaaagccaattattgaccttccttccttccttccttccctcccttcctccttctctccttctctcctcctctctcctctcctctcctctctttccttccttccttccttttttctttttctctttcttctttatttcttgggtctcactctcatcacccaggctagagtgcagtggcacaaaaatctcggctcactgcagccttgacttcccaggctcaggctcaggtgatcctcacaccttagcctcccaagtacctgggactacaggcacgcaccaccatgcctagctattcttttgtatttttggtagagacagggttttgctgtgttgctcaggctggtctggaacccctaggctcaaatgatgtgcccaactcggcctcccaaagtgctgggattacaggcatgaaccgccatgcctggcccttgatttttctttttaagaaaaaaatatctaggagtttcttagaccctatgtagattattaatgaacaaaagattaaactccaaatattaaatagtaagcctgaaggaatctgaaacacttgtacttccaattttctttaaataatcccaaatagaccagaattggcccataccatagaagaaagaattggcagtcaaaaaaaaaaataccttttgtaatgtttgaaaaataaagctgtttgacttgtcaggtgttttcctttctcaaatcagcaaattctctctgagtgcctggctttgtgagacactgtacaaggagttacaagactacagctataacctgcagttgagcagttataaacctacaaaatgggccctgccctcagagaggttccagtctagatgaggagctgatctagacaggtaaaaggctaactaaccctttgtgtaaataagttcatcaccccagtaaaagtgtcatcacccagtgaataggaccacctctgcctgcagatttttgttgttgttgttgtcattgttgttgttgttttaacctgggaagtgttcttcctgcctttctgctaggtgtcagatagatggtcccagagctaggtgctgtgtcaggccctgaagacacagatgactcaacctaagctttactttccagaggtccacagcctgagaggtgtccccaaagaaagggggacatgaggggactgcatgcttgagagcagggttgtttagggcaggtttggatttagtgagcaggctggtttgcttagagaaggcttttagtggcaacaaaggatgaagaggagagaaaaggaactcacatttattgaaggcctactgtgtgcaaagtgtttcatgtatatctcattgaatgtatacagccaccctgttgtggtataattttgctctttataaagagaaagaccgaagctcagatgagttaagtggtctcctcaacaccaaaatgccaagaagtgatggagcctagacagaagcccagaactttctgactcacactagtccatcctctaccatcacgatgactttcaaattgtgctctgcagttctgcagattttctagcagtgccatctccctgagtcttgctctatcacccaggctggagtgcagtggtgcaatctcagctcactgcaacctccgcctcccaggttcaagcgatttcgtgcctcagcctcccgagtagctgggattacaggcacccaccaccacgcccagctaatttttgtatttttagtagaaatggggtttcaccatgttggccaggctggtctcgaactcctgacctcaagtgatccactcacctcggcctcccaaagtgctgggattacaggtgtgagccaccatgcctgggctaaactctttaagtctctagtaaatgcagctagattcaaatgggctgataaccaaattttaacacatcagcattcaccaccaggtttacttttattttcagattggctcattttgtgcagaccttagagcaaagtttcctttatggtatctgtgtacgtatccaaacttcttttaattgttcacagattttaaaagcggtagcaccacatggttgtgtagatcagacctgtgtatttagatcagacctgtgtatcacgtaagtgtgtgagtgcagtgcagatgagcaccatttagttatatgtgctaggcaaatctccaacacagttgatgtgtagtcttgtggtagatttgtgcatactgtaagcaaattgcttagcttctctagacatcagtttccacatctgaaaaataagaagatgagagtacacggttgttatgaacaaatgacttaatgctttttaagcacgttgcatgacatctggaacacagaaagccctcaatacattgaagctcttaggattttcacgatgttcctgtctgctcaatgcatgctttctttattgttctgacagttgtgtggtaacaagctaatatgcttccagttgacttccagtctaccctggtgttagaaaccgtttcatctcttattgtaaatttgagtgcttgttgttttttatatttgtgatgactcttccagcagttgttgacaattgttagaggtttgacttttaaataattacttattttttctgattgtggttcagtttaactgaagaatatcctgagattgtaagaaaagcattttttaaaaggtatcacttgtgatcatttatctttctaaattctatttttaatactgttccaccaaagtgatgcagtggttaccatgacaccctaatttcatgtgtttttgtatttatgaaaatagtttcattgtcatttattggcggtatacaaagtaaaatgttataaatgtgaagttataaaataaatatatgctaataaaatcctgagtttttctgaaaaaaaaaa

SEQ ID NO: 489611 - DNA, 236 bp, Homo sapiens
tcatccttattctattgcagtaatatacctatttacccctgtatttgtgtcataattatttcttgccttaaacagttatgtgttaatgtacttctaaaagcacatgactttttttttatttaaacagggtatcctataaatttaagtattataggttggtcctttgctgcaccatgggctttaaaaaagagtaaggaaaaatacacggatggtttaaccagtggtgttcatgagga

SEQ ID NO: 489612 - DNA, 4769 bp, Homo sapiens
agcggggaggagagagagaggggagggcggcaccgcccctagccccgcgctccggaagtgaagcggccagaccaccagctaatggatgcggagcggagggcccgctgaccgctctccgcgcctggagcagcttggcttggctggagctaagagccagacacaccactgtgtggaggtgggtgatgtcttcctgtgctaaaaggtgaataaataagctcctcacctctcgcggaacactcgggaacacatcaacaggggtccaagccgccctgctgggaggcttctcttcaagagttctgggtcccagagtggaaggcattttcccatcaactggagagagacgaaacatcagagaccaggaggctgtggagaaagcagctgtcccaggtgcctcaactatcagagaagggtcagcgtcacgtggctgccagcatctttgagaaaatcactggcaatcggacttcagagctgcgggcacaggtgtggttagaactgagatacgacctgcccacctgggtcaggcctaaagacaagaagtcctgagttcttgccactgagtaggccagggtcatttgtccagaaaactttgtgactgtctttgagtgacctagtctgggacccattcattggtgggttctaaggttagaagctcatccaggatattttcaatattaagtcagtgcatagctgcaccactaacaaattggtgcctgtagagtcagagtgggtcaattcttaggacaatggccctggcactgttagaggactggtgcaggataatgagtgtggatgagcagaagtcactgatggttacggggataccggcggactttgaggaggctgagattcaggaggtccttcaggagactttaaagtctctgggcaggtatagactgcttggcaagatattccggaagcaggagaatgccaatgctgtcttactagagcttctggaagatactgatgtctcggccattcccagtgaggtccagggaaaggggggtgtctggaaggtgatctttaagacccctaatcaggacactgagtttcttgaaagattgaacctgtttctagaaaaagaggggcagacggtctcgggtatgtttcgagccctggggcaggagggcgtgtctccagccacagtgccctgcatctcaccagaattactggcccatttgttgggacaggcaatggcacatgcgcctcagcccctgctacccatgagataccggaaactgcgagtattctcagggagtgctgtcccagccccagaggaagagtcctttgaggtctggttggaacaggccacggagatagtcaaagagtggccagtaacagaggcagaaaagaaaaggtggctggcggaaagcctgcggggccctgccctggacctcatgcacatagtgcaggcagacaacccgtccatcagtgtagaagagtgtttggaggcctttaagcaagtgtttgggagcctagagagccgcaggacagcccaggtgaggtatctgaagacctatcaggaggaaggagagaaggtctcagcctatgtgttacggctagaaaccctgctccggagagcggtggagaaacgcgccatccctcggcgtattgcggaccaggtccgcctggagcaggtcatggctggggccactcttaaccagatgctgtggtgccggcttagggagctgaaggatcagggcccgccccccagcttccttgagctaatgaaggtaatacgggaagaagaggaggaagaggcctcctttgagaatgagagtatcgaagagccagaggaacgagatggctatggccgctggaatcatgagggagacgactgaaaaccacctgggggcaggacccacagccagtgggctaagacctttaaaaaatttttttctttaatgtatgggactgaaatcaaaccatgaaagccaattattgaccttccttccttccttccttccctcccttcctccttctctccttctctcctcctctctcctctcctctcctctctttccttccttccttccttttttctttttctctttcttctttatttcttgggtctcactctcatcacccaggctagagtgcagtggcacaaaaatctcggctcactgcagccttgacttcccaggctcaggctcaggtgatcctcacaccttagcctcccaagtacctgggactacaggcacgcaccaccatgcctagctattcttttgtatttttggtagagacagggttttgctgtgttgctcaggctggtctggaacccctaggctcaaatgatgtgcccaactcggcctcccaaagtgctgggattacaggcatgaaccgccatgcctggcccttgatttttctttttaagaaaaaaatatctaggagtttcttagaccctatgtagattattaatgaacaaaagattaaactccaaatattaaatagtaagcctgaaggaatctgaaacacttgtacttccaattttctttaaataatcccaaatagaccagaattggcccataccatagaagaaagaattggcagtcaaaaaaaaaaataccttttgtaatgtttgaaaaataaagctgtttgacttgtcaggtgttttcctttctcaaatcagcaaattctctctgagtgcctggctttgtgagacactgtacaaggagttacaagactacagctataacctgcagttgagcagttataaacctacaaaatgggccctgccctcagagaggttccagtctagatgaggagctgatctagacaggtaaaaggctaactaaccctttgtgtaaataagttcatcaccccagtaaaagtgtcatcacccagtgaataggaccacctctgcctgcagatttttgttgttgttgttgtcattgttgttgttgttttaacctgggaagtgttcttcctgcctttctgctaggtgtcagatagatggtcccagagctaggtgctgtgtcaggccctgaagacacagatgactcaacctaagctttactttccagaggtccacagcctgagaggtgtccccaaagaaagggggacatgaggggactgcatgcttgagagcagggttgtttagggcaggtttggatttagtgagcaggctggtttgcttagagaaggcttttagtggcaacaaaggatgaagaggagagaaaaggaactcacatttattgaaggcctactgtgtgcaaagtgtttcatgtatatctcattgaatgtatacagccaccctgttgtggtataattttgctctttataaagagaaagaccgaagctcagatgagttaagtggtctcctcaacaccaaaatgccaagaagtgatggagcctagacagaagcccagaactttctgactcacactagtccatcctctaccatcacgatgactttcaaattgtgctctgcagttctgcagattttctagcagtgccatctccaaaatgtgttttaaactctttatttttttaattattattagtattattttgagactgagtcttgctctatcacccaggctggagtgcagtggtgcaatctcagctcactgcaacctccgcctcccaggttcaagcgatttcgtgcctcagcctcccgagtagctgggattacaggcacccaccaccacgcccagctaatttttgtatttttagtagaaatggggtttcaccatgttggccaggctggtctcgaactcctgacctcaagtgatccactcacctcggcctcccaaagtgctgggattacaggtgtgagccaccatgcctgggctaaactctttaagtctctagtaaatgcagctagattcaaatgggctgataaccaaattttaacacatcagcattcaccaccaggtttacttttattttcagattggctcattttgtgcagaccttagagcaaagtttcctttatggtatctgtgtacgtatccaaacttcttttaattgttcacagattttaaaagcggtagcaccacatggttgtgtagatcagacctgtgtatttagatcagacctgtgtatcacgtaagtgtgtgagtgcagtgcagatgagcaccatttagttatatgtgctaggcaaatctccaacacagttgatgtgtagtcttgtggtagatttgtgcatactgtaagcaaattgcttagcttctctagacatcagtttccacatctgataagcacgttgcatgacatctggaacacagaaagccctcaatacattgaagctcttaggattttcacgatgttcctgtctgctcaatgcatgctttctttattgttctgacagttgtgtggtaacaagctaatatgcttccagttgacttccagtctaccctggtgttagaaaccgtttcatctcttattgtaaatttgagtgcttgttgttttttatatttgtgatgactcttccagcagttgttgacaattgttagaggtttgacttttaaataattacttattttttctgattgtggttcagtttaactgaagaatatcctgagattgtaagaaaagcattttttaaaaggtatcacttgtgatcatttatctttctaaattctatttttaatactgttccaccaaagtgatgcagtggttaccatgacaccctaatttcatgtgtttttgtatttatgaaaatagtttcattgtcatttattggcggtatacaaagtaaaatgttataaatgtgaagttataaaataaatatatgctaataaaatcctgagtttttctgaaaaaaaaaa

SEQ ID NO: 489613 - DNA, 4121 bp, Homo sapiens
gaggaggtcccaaacgctggtgggacctcgacctcagctggtgtccaggctcttgatactgccacgggaaggaattcaaggatgagtcagaaaatagtgaaaatatggttacggggataccggcggactttgaggaggctgagattcaggaggtccttcaggagactttaaagtctctgggcaggtatagactgcttggcaagatattccggaagcaggagaatgccaatgctgtcttactagagcttctggaagatactgatgtctcggccattcccagtgaggtccagggaaaggggggtgtctggaaggtgatctttaagacccctaatcaggacactgagtttcttgaaagattgaacctgtttctagaaaaagaggggcagacggtctcgggtatgtttcgagccctggggcaggagggcgtgtctccagccacagtgccctgcatctcaccagaattactggcccatttgttgggacaggcaatggcacatgcgcctcagcccctgctacccatgagataccggaaactgcgagtattctcagggagtgctgtcccagccccagaggaagagtcctttgaggtctggttggaacaggccacggagatagtcaaagagtggccagtaacagaggcagaaaagaaaaggtggctggcggaaagcctgcggggccctgccctggacctcatgcacatagtgcaggcagacaacccgtccatcagtgtagaagagtgtttggaggcctttaagcaagtgtttgggagcctagagagccgcaggacagcccaggtgaggtatctgaagacctatcaggaggaaggagagaaggtctcagcctatgtgttacggctagaaaccctgctccggagagcggtggagaaacgcgccatccctcggcgtattgcggaccaggtccgcctggagcaggtcatggctggggccactcttaaccagatgctgtggtgccggcttagggagctgaaggatcagggcccgccccccagcttccttgagctaatgaaggtaatacgggaagaagaggaggaagaggcctcctttgagaatgagagtatcgaagagccagaggaacgagatggctatggccgctggaatcatgagggagacgactgaaaaccacctgggggcaggacccacagccagtgggctaagacctttaaaaaatttttttctttaatgtatgggactgaaatcaaaccatgaaagccaattattgaccttccttccttccttccttccctcccttcctccttctctccttctctcctcctctctcctctcctctcctctctttccttccttccttccttttttctttttctctttcttctttatttcttgggtctcactctcatcacccaggctagagtgcagtggcacaaaaatctcggctcactgcagccttgacttcccaggctcaggctcaggtgatcctcacaccttagcctcccaagtacctgggactacaggcacgcaccaccatgcctagctattcttttgtatttttggtagagacagggttttgctgtgttgctcaggctggtctggaacccctaggctcaaatgatgtgcccaactcggcctcccaaagtgctgggattacaggcatgaaccgccatgcctggcccttgatttttctttttaagaaaaaaatatctaggagtttcttagaccctatgtagattattaatgaacaaaagattaaactccaaatattaaatagtaagcctgaaggaatctgaaacacttgtacttccaattttctttaaataatcccaaatagaccagaattggcccataccatagaagaaagaattggcagtcaaaaaaaaaaataccttttgtaatgtttgaaaaataaagctgtttgacttgtcaggtgttttcctttctcaaatcagcaaattctctctgagtgcctggctttgtgagacactgtacaaggagttacaagactacagctataacctgcagttgagcagttataaacctacaaaatgggccctgccctcagagaggttccagtctagatgaggagctgatctagacaggtaaaaggctaactaaccctttgtgtaaataagttcatcaccccagtaaaagtgtcatcacccagtgaataggaccacctctgcctgcagatttttgttgttgttgttgtcattgttgttgttgttttaacctgggaagtgttcttcctgcctttctgctaggtgtcagatagatggtcccagagctaggtgctgtgtcaggccctgaagacacagatgactcaacctaagctttactttccagaggtccacagcctgagaggtgtccccaaagaaagggggacatgaggggactgcatgcttgagagcagggttgtttagggcaggtttggatttagtgagcaggctggtttgcttagagaaggcttttagtggcaacaaaggatgaagaggagagaaaaggaactcacatttattgaaggcctactgtgtgcaaagtgtttcatgtatatctcattgaatgtatacagccaccctgttgtggtataattttgctctttataaagagaaagaccgaagctcagatgagttaagtggtctcctcaacaccaaaatgccaagaagtgatggagcctagacagaagcccagaactttctgactcacactagtccatcctctaccatcacgatgactttcaaattgtgctctgcagttctgcagattttctagcagtgccatctccaaaatgtgttttaaactctttatttttttaattattattagtattattttgagactgagtcttgctctatcacccaggctggagtgcagtggtgcaatctcagctcactgcaacctccgcctcccaggttcaagcgatttcgtgcctcagcctcccgagtagctgggattacaggcacccaccaccacgcccagctaatttttgtatttttagtagaaatggggtttcaccatgttggccaggctggtctcgaactcctgacctcaagtgatccactcacctcggcctcccaaagtgctgggattacaggtgtgagccaccatgcctgggctaaactctttaagtctctagtaaatgcagctagattcaaatgggctgataaccaaattttaacacatcagcattcaccaccaggtttacttttattttcagattggctcattttgtgcagaccttagagcaaagtttcctttatggtatctgtgtacgtatccaaacttcttttaattgttcacagattttaaaagcggtagcaccacatggttgtgtagatcagacctgtgtatttagatcagacctgtgtatcacgtaagtgtgtgagtgcagtgcagatgagcaccatttagttatatgtgctaggcaaatctccaacacagttgatgtgtagtcttgtggtagatttgtgcatactgtaagcaaattgcttagcttctctagacatcagtttccacatctgaaaaataagaagatgagagtacacggttgttatgaacaaatgacttaatgctttttaagcacgttgcatgacatctggaacacagaaagccctcaatacattgaagctcttaggattttcacgatgttcctgtctgctcaatgcatgctttctttattgttctgacagttgtgtggtaacaagctaatatgcttccagttgacttccagtctaccctggtgttagaaaccgtttcatctcttattgtaaatttgagtgcttgttgttttttatatttgtgatgactcttccagcagttgttgacaattgttagaggtttgacttttaaataattacttattttttctgattgtggttcagtttaactgaagaatatcctgagattgtaagaaaagcattttttaaaaggtatcacttgtgatcatttatctttctaaattctatttttaatactgttccaccaaagtgatgcagtggttaccatgacaccctaatttcatgtgtttttgtatttatgaaaatagtttcattgtcatttattggcggtatacaaagtaaaatgttataaatgtgaagttataaaataaatatatgctaataaaatcctgagtttttctgaaaaaaaaaa

SEQ ID NO: 489614 - DNA, 81 bp, Homo sapiens
gctgaggacacggccgtgtatgactgtatgagagccccatattacgatgatagtagtgtccgccccgcccgcggccaggga

SEQ ID NO: 489615 - DNA, 1198 bp, Homo sapiens
atttcgtgtctcgtgctgatgtttcctagagtctcgactgttcctacctcttctgccccctttcccgaccaacccatattgtcctcatggaatgccacggagacaatcatgcggctgacgactatatgctacatcagatgattcgtgcatcggaacatgtcacggtacctgcatgtatcaagctgcatttgatatggccctggcaccacaaaacataacgatcccaaaaggataattgtatggcgcacataaccagtgtgcatcttgtcagccaagcaacgcatacagccagtctgttctgaaacttgagtggcagcacttcacaaggcagactatcagcagcaggcccaagcaccagctggaacccggcaaccactaccgcacaacacaagcactagaacaaggcaatcaatccaacggggccatgcacaagtcgcacatcccacgcccccagccaccactgacacgaaaccaaccagataggaagccccgcataacagcaaggacccatgcgatgacacacaagcattcggcgacaagcataaccaccctatggggccagcggcatctgcaacggcagcctaccacggaaagatagtggcatcccaaaccgaacagaacgaaccttgacgagcccccgctggaagtcccgtggcagaatcggggcagggccaaagacatggccaaccctagacacggcagggcgccaaggaatgtgcattcgacacccagtaaccggacaacagccaaacacaaatccaacacggtcacgaagacaggccgtgacagcccaagggatgcccaggcagcaccgtcacgggaacggccgccacacggggccaaccaaccagtacactgccaaaacgagcacccccaaccatccagctgccacattaagcgccatcaagtcgccagagcatcccgcacaccgcacgcgcgcagcgccctgcgcaaacgcagcacgaaaggcctaggcacaacacaccacgacactgcggcagctcacggacgggggaaacgcaacaccaccacaccacccgggaccagcgcaacacgaccgaacactaccacacacgggcaacccacataaccacggcaacagaaaaacacacaacggacgtacagtaccacacaacaacacccccgacgaccgacaccaacccacacgaccggcaaagacacagccagcacgcgacac

SEQ ID NO: 489616 - DNA, 499 bp, Homo sapiens
tgagcagacagtgttgaatcgtataccttaatgactatctgcctagttattctagcagctgttggagttgggggctggagtcgtcaactgcaacagaaggtttgtctcttcctcctttcagctctatcagtttctgctttatacatgttgaaggtctgtggtttgctgtacacacatttggaattgctgttatcttcccagtggattcttttatcattatgtaatgtccctctttttcccaaggaatttcaacagccactcccgctttttaaaatttatgtttacatgatactcttttgccgtccttttactttcaatgtgcctatgttattatgtttgaagtgagcttcagcatatagtagacatcatacagttgggtcatgtttggtatccacgtggcgaacctctgtcttctaattggtgtgattaggccatttacatttaaattagtgatatattagggcttacgcttgccattgcaacacggggggtaccgagc

SEQ ID NO: 489617 - DNA, 126 bp, Homo sapiens
ggtctgaccgggaggcgaggtgggcgatcacctgagtccaggaggtcaagactgcaatgagccatgatggcgctactgcactccagcctggactccagcctgggtggcagagtaagatccagtctc

SEQ ID NO: 489618 - DNA, 161 bp, Homo sapiens
ttgcgaggaatgctgagacaaatgtcatgtcctttctcccaaggtacagaatacgattattctcaatgatgtggtggttctggagactcaggattcttggatccatgcgtgggcctcatacatctcttccacgttgaatcccatcagattgatggcaggag

SEQ ID NO: 489619 - DNA, 110 bp, Homo sapiens
gcacaacgaaatgtatcctggaatccgagaagcccaagggttggggccaaaacacggatgggcccagtactggcatctcaggtccaggtgacttcctggctcacaccagg

SEQ ID NO: 489620 - DNA, 361 bp, Homo sapiens
caatttactcaataacatgttcttggtgctttgtatatttactcattcctcacaagggtctgatgtatgtttaatatatatttcatttacatatgtgaaccctaggcacagaaattcgatgtacttgcctaaggtcaagcgtgtagaatttgtagcaaagccctgattcttgctatgccagaagttcctagtttttatgcttggtcattagcttttcctattttaaaaatgatttttaaagcccacttttctttaaaccttaaatatacttaaaaattcactgaaaaatttagttgggtgttaatattaaaaatgcctatttgcttgttttttgactgatgctcaagcgcttttacatttg

SEQ ID NO: 489621 - DNA, 105 bp, Homo sapiens
  misc_feature (66)..(66): n is a, c, g, or t
  misc_feature (76)..(76): n is a, c, g, or t
ggcaagataagctaggagccgcgcgagtcgtagtgtcgctgtttagcggggctccccgcggccccntgcgcgcgangcgggatcgcttgagagcggagagatctt

SEQ ID NO: 489622 - DNA, 590 bp, Homo sapiens
tacaaaataatttttttttagagacacagtctccctctgttgcccaggctacagtgcagtggcacaatcacgagctcactgcaacctcagcctcctgggctcatgcaagcttccaggcctgacgctcctgagtacctggcactactatgcctggctaattttttttggtattgttttgtagagacagggttttgccatgttgcccaggctggtctcaaactcctaagctcaaacaatccacccaccttggcctcccaagtagctgggattaaaggcgtgcaccaccatgcctggctaatttttgtatttttagtagagatggggttccaccatgatggccaggctggtctggaacccctgacctcatgtgatctgtctgccttggcctcccaaactgctgggattacaggcatgagccaccacgcccgagcgctttattctttgttgtagtagtttgtttttaagagacagggccttgccttgttgcccaggctgaagtgcagcagtgcgatcgtagcttgctgtagccttgaactccttgcctcaggtgatctcctaacttggttcccaaagtgtgggatatagggtga

SEQ ID NO: 489623 - DNA, 204 bp, Homo sapiens
tagccgacgacactttacctcttttctttgttagtcctgaaaaacaaaaacaagggcatgcccctttggttttaattccctcacccatacaattgcgcaggtttatgacgatttgggttagttttcttcattggcttcagggcactattcacctttaaagatataacttcttagagtccccgtcgtgcctccgtgggttatttt

SEQ ID NO: 489624 - DNA, 167 bp, Homo sapiens
acatacgagatggtagcaaaacagaagctgaaggccaccgatatacccgactgatcgaccgaatcctccaggacccatgattagcagatctccaaagtgttcctaatggagacggaccaggtggaggaagtcacctacgacgtggcccagtatataaagttcgcgat

SEQ ID NO: 489625 - DNA, 909 bp, Homo sapiens
agatggccaagacagaaaatcgtggctagggttgactgagaactgtcgtcttccatgtattacaacgcaattaagcttttgcatattccactctctgtgctgaccctggctgaggcatttgggagacaagggactctgaatcttctgctgtccagttaacagaaacgaactgtgactattcaacattaggacttgtctgagaagtaaaagattacggatgattccttgtagaactttgagcttacttgtatgacaatgtccagctaggttaggttttgccatttcctatatactcttgggtaaagctacatttgatgagcaatgtgaatgtctctgacaatgttcattcctgtgtttctcttaagagaatgtgctgtgtactagcatgcaggccgcatagtgtctgcctgttgaagatctggaatctgcctccccagatctgttttgtattggtcgcgtaggggggtcagtttcttcttgctcagttgtgtgtgttaatctacacgccactctgtggaaccagggtgttgctttggggaactcctcctgtgtactaggaggatggtaccttagggagaccagagaggagagaagcatttcctttgatgatgtcacattctgtctagtgatgcccactaatgctgtgacatgggggcttgaaacagaagtgtcttgtaaaagccttgctcaggtgtggctatagcatcgtggttggttcacgcacttagattgtttggggaccgtagaaggggtaacccccgaattctgcccgggactgggaatggcgcaaaagtaaccgtctagtgggtggaatgggtagccgactggctttgcgagtcgcttcggaaattgggggacccaaatggaacgggcgacacattataagcgggggggaaaagggaacaaaaa

SEQ ID NO: 489626 - DNA, 949 bp, Homo sapiens
tcactgcacaatttcttttcatggttcatgcgaatatctggcagccttccaggtcccctgaatgtagtagacacttcagcagccgtctcctaccccttttgccactaaatgcttcaaaatgcctttgacctcgccgcgggcaggcggaacgcttaagataccgggtcagtatcgtcctgtcggactggggctggccgccggtcgcatcgtgaggacacgtgtagttatccgacagggtttatgggaccgcgttaaagtcatgagatgcacgcacttatgaggttgttgaatgaatgtggaacgcttcatcatgtcacgcgtctcggttcactggaacactggacaactgtaagagggcaatccagcaggcattccaggcctcatggacccccagggacatgacgggttgacgacgggtggaccatcccccggcatcggttcgtctacataaggacgaacgaagtacaacctgcgtctgggcctaacaaagtaagccccacaaaaagcacgaaccctggatcgggtctgggggccacggtccgagccagtgcgacaaaagcatagaggtctattccaggctggagtcaccagacacgaacactgcatcggtttacgggaagcatacactgagggatgcgacacactgggagggaccggaaaagacaagaccaacgacctcggagtaagagcattggaccactcaataacaccgaccctaccacgaggtgacactgcagggcccaggtgacacacgcccaaacgacggaacaaacacatgagtgcgccccacagccaggactggcgggctgcagcgcaacagtgaagagcgcccagagaaggcgaagcagcgaacagcccgagcgaccagagaaacacgcccatacgcaccagccccagcgaaaccggacaccaccgcacggcacggagccagagaaaagacaggacacaa

SEQ ID NO: 489627 - DNA, 115 bp, Homo sapiens
cgagatagctacaaaatgagactaattatcacatgctactacgggtccatgtcaagggtgctaaaagcactctagttcccaatgtatatgtttagttccctctcccccacaccac

SEQ ID NO: 489628 - DNA, 129 bp, Homo sapiens
taacgacgccactgaaaacttgagaatcatgttgaagctaaacccatatgcaaagaccatgcgccgttaggaaggcgctcgttacggagggcgctcgttacggagggcgctcgttacggaaggggctcg

SEQ ID NO: 489629 - DNA, 285 bp, Homo sapiens
  misc_feature (17)..(17): n is a, c, g, or t
  misc_feature (19)..(19): n is a, c, g, or t
  misc_feature (31)..(31): n is a, c, g, or t
  misc_feature (260)..(260): n is a, c, g, or t
aacaatttctgtttaantnagggtcttttgntgcacaacaaaaacagactctggctttactaaccagaaaagaactacactggaagaatataggttggctcagacagtccataggaaggctaaataaccacgctcaggaaatgggccttagagagtgggaagagaaaatgtatctaaacttatatctcagtaacagcttgataggacattgtcactagcagtgccaccactaggtccttaccattgctgcttggcatgancagttaccacttcttatgacttctt

SEQ ID NO: 489630 - DNA, 123 bp, Homo sapiens
ccccccctttccccccaggggttttaaaatttttgggcccccggttttttttcgggggggcccccgggtttttccccgggggttttttgtttcaatttaaaaccccccgtgcccccctgggga

SEQ ID NO: 489631 - DNA, 306 bp, Homo sapiens
  misc_feature (21)..(21): n is a, c, g, or t
agttgcacatgtcctccaaangttcgtgtgttagagacttaatccccaatgcaactattgggaggtgggtcctaacaggaagtgtctgagtcatgagggcccttccctcctgaatggattaatgccagtgataaaaagccacgatattaggctgcaagtttgatctcttgttctctcatgctctcttgcccttccaccttttgccagggaggatgtagcacaaaggtcctcaccagatgccagcccctcaatcttggactttccagcctccagaactgtaagaaataaatctcttctttataaatt

SEQ ID NO: 489632 - DNA, 663 bp, Homo sapiens
cgaactctgaacccctctccggctggatggttcgtgcaggcagcacccggatgctggagctcatgagcatgcttcctgggaacggttcggccgcaactggctgcagtacaggagtcacctggagccctccggaaaccctctgcctggccacccccactacttctgcacccagtgcacctccagccagctcccagggcccctgacactgcacccagaccttcaccccctgcaggaggaaggccagaggcccccaggagtcaccacagaaaatgtcagaggaggtcatgggcggacgccatcaggatggaggaagacggacgaacggaggggaccggacggcagaaggaggagggcgagatggtggaaaccgggagaacgaggaggcaggagagcgaggaacgaagaggtagcaggaccacaaggaagtggaacgcggaactttgtcggccccttgttggtgtgtcccctggatggggcctgagggcgtacgggcgcacgggaatgctttctcatgggtcacttcttgcccacctgtttgaggtggacactccaagcagctcgcaccttggagcgactggagctccagagtctggaggcagctgagatagagccggaggtccaggccagaggtcgccaggccccgggctcagatctgtcctggaa

SEQ ID NO: 489633 - DNA, 279 bp, Homo sapiens
gacatctgaagcagctactccaaccacgaagcagacgccccaaaccttgtaacatgcctcaagtgctgctctcatgacctacacattaaacaaaacattcaaaggaatagtccactcctccatcggtcatctcaatgagcacttcctggatgggtaatataaactcctgagggttaatacattcagtggctccacactctaatggcccttgcaacttcatcttaattgatgtccacaccaatgatccgggaagcaccagccactttacagcccatgcta

SEQ ID NO: 489634 - DNA, 631 bp, Homo sapiens
ctatccactttgtttatattattccccttttttttttgggagacggagtcttgctctgttgcccagcctggagtacagtggtgcgatctcagttcactgcaaaactccacctcccgggctcatgccattctcctgcctcagcctcagcctcccgagcagctgggattacaggcaccagccaccacacctggctaatttttggtatggttttagtagagacagggtttcaccgttttagccaggatggtcctcaatctcctgacttcgtgatccgcccgccttggcctcccaaaaatgctgggattacaggcgtgagccaccgcgcctggccattttttttttttttttcccgagaagacgggagtctggctctgtgtcccccagggttgggctgtggcatggggctgtgagactcccgggctcggttggaaacctcttgcctcccgggtgcccagggcagttctcctggcctcaagcctcccggattagctggggtttccggggcgcccagcattggcccctgggtaaatcggggttctcaaggaggggatggggtttcccccgttgtggtgcaggctggtcgggactctcgacctcggggtctgcccactttggcccccaatgtgtgggc

SEQ ID NO: 489635 - DNA, 391 bp, Homo sapiens
gattctatgaggatcccgtaaccactcgaggacacgcccctgtgttcggtctcattatcatcattgtgtgagcgggagaggtctacttccctagaacgacccacagtcagtagtacgtgctagactctggaatatccatgcccggtccatccaaagcttacagccatatgtctcttctctggacctctctggaaatgcttctcaactttgatgatggctccagtgacaggcagcagccaccaggactgtgatctccctgggatttaaagtgggaggttaaaccaggctccacgccactgcggaattgtgcaattgtaagtcaagtctcaattgtgagccaagcttctcccagggtcagaggtggagttagaaaggccccatgtgaccctga

SEQ ID NO: 489636 - DNA, 1030 bp, Homo sapiens
agcggcttctgtacaaggatggcgccgaaagcgaagaaggaagctcctgcccctcctaaagctgacagccaaagcgactggctttagagaggccaacgcaaggcatgatgttgaaaaggctgtccacagccacaaaaagaagaagatccgcaacgtcacccacacttcctgagtcggccgacagacactgcagacgtccggcatgacagcgccacgagtatccctcggcaagagcgtctcccaaggagaatacaaagcttgtaccagctatgcttatcatcacagtttccggctgaccactgatgtctgccagtgaaggaagataggaagacaatcagagcagcacttgtgttcacttgtggatgttagaagcctaacaaagcacgcagattgaaacaggctcgtgaagaagctgtactgacacttcgactgtggccaaggctcaatcaccctgagttcggcctgaatggagagaagaacggcatatgttcgacatgagctcctggacttcacgagtgctttgcgaatgtttgccgaactagatagattggcgactcgatcgtagaacgtgtagtcccagcgtgcgctaaacttctgcacatttatactactagtagtcacttatcatcctttgtccacctaagaacataacaacaaacaaacgaacgtctatcacagagcgccgtgtgcacctgcgcgtgcacacgatatgcgcgtgccctttgcacactcctgtgtcagtagcggggtgggtgtgcccccaccggatctacgccaggggcatagtggcgttgtctgcccctcttatctagcttgggagagcggggtggataacggttcatctcctgtgagccttttgggtgcccgtttgacctttacttgagtcgcgccaaccatttatgccgcgtggagtttccccccctgtgtgctgtgttgaccaaccttgtgtggttccttagtgccccggacttcccacccaagtttcccctcgagacccccgaatttttgtgtgctctggggcgccccacac

SEQ ID NO: 489637 - DNA, 215 bp, Homo sapiens
  misc_feature (33)..(33): n is a, c, g, or t
  misc_feature (66)..(66): n is a, c, g, or t
tctttgatagggtgctgcatctagcatagatgnggtctggcttccttaataagagagattagcttnatttcattatatatcagctgttgccacattttggttggaaaaaggtctatttttttaaaagggttaaatcttttgattttaaatgtttaaaaatgctttattatgggaatgataacaagtagagaaaatagtatagtgagatcataggt

SEQ ID NO: 489638 - DNA, 181 bp, Homo sapiens
ggaccctgccaatttcctctcaggtcaaatacctctaataaatccatctgcgtcctcataggtctctccctatccctgcccttttcctccaatccatctttaactgctcttgagcagtctaactgagagtatgattcaaagcaaaataaatcttaaggtggcatgactctgaaaaaaaaaa

SEQ ID NO: 489639 - DNA, 487 bp, Homo sapiens
gtgcagccgctattaaaggttcgttgtaaaagaaaaaaaaaaaaaaaaaaaaaaaaaaaaaaacatggttggggcgggcctacgggccacctaggaagaaggttttctaaagacccactcccggtgggggggcgggggggccaaggacaggcgtacaggtgtagaaccatggggtccaaataggcgtgagttccaatagggagagaactcggcgggggcccagagaaccaagagcggggccgtgggaacttctcctacacacaatataaaaaaaagggccggcggggggaagacacgcgggagcgcgtttctctgagaaaacccacaaacctcgcgagcagagtgggacagctttctcgagaggagagccaaccaaattaacgcggggagaactcttaatcacaacacgaggcggagagctccacaaaagcgacggaaggcctgcgcgaatacatctacaaattaacgcgccccgcgccgcggagac

SEQ ID NO: 489640 - DNA, 208 bp, Homo sapiens
accacatatttcaacacacacacacatgggtctctgtcaatcagtcttttcaggccgctttcccctcttgtcatcaccagcatgtcatttcatcacagtccacacagcacattcatgcaacattgaggttccatcttcccatacttatttcacacacaggtcagtccacacaacatcacatgagtccagcatcgccaatagcagcatc

SEQ ID NO: 489641 - DNA, 312 bp, Homo sapiens
acgctctctctgtggggacaagagagtgaggctatataataagataaagcctttgttatagtgatttctgggcaagttcttcaacggttgttgctgttagtaaaatatacacaatagtacctgtgttctgaagtttttataaagagtaaatatggaaaagtgggaaacaaggggtgtacatagctatgattcagattaaaccaataggtagtagacttatggtaactggaataacagaaggcaacaattacgtagaaactactaagaatttacctgaaaacttatacaaacggagaaaaggtgtgcttggta

SEQ ID NO: 489642 - DNA, 178 bp, Homo sapiens
atccgggaagcgggatcgcagtgagccgagatcacgccacagcacgccagtctgagcaacagtgagactctgcataaagagcataacccatgtgtgtacctatctatctatctatctatctatctatctatctatctatctatctatctatctgtatatagatatataaacatgtaaa

SEQ ID NO: 489643 - DNA, 217 bp, Homo sapiens
gtccatgatggtgattctgcagccctctggtgtgtctgggtgtgggatggctgctggtgaggacaggactctgccaggtggagcactggcctgtggccacactcagggatgggtctgtgcatgctgctgggccagctcagagctctgcggcccgtccctgtccatccctgcccgtccctgttcatccctgtccgtccttgtccatctgacccatctt

SEQ ID NO: 489644 - DNA, 836 bp, Homo sapiens
ggcggcgcgggtcctccatatgctgagcgccggtcccctgggcccacttttctttctctatacttgtctctgtgtctttcttttctcaagtctctcgttccacctgaggaggaatgcccacagctgtggaggcgcaggccactccatctggtgcccaacgtggatgcttttctctagggtgaagggactctcgagtgtggtcattgaggacaagtcaacgagagattcccgagtacgtctacagtgagccttgtgggtgaaggtactctacagtgtggtcattgaggacaagttgacgagagagtcccaagtacgtccacggtcagccttgcggtaagcttgtgtgcttagaggaacccaggtaacgatggggcaaactgaaagtaaatatgcctcttatctcagctttattaacaattcttttaagaagagggggagttagagcttctacagaaaatctaattacgctatttcaaacaatagaacaattctgccccatggttttccagaacagggaactttagatctaaaaagatgggcaacaacttcggcacagaatttaaaaccaagccaaatacgggaaggttaaaaatcatcccacttacagtatggaatgatgggcgccattatttaaagccactttagaacccatttcaaacaggagcacgatatggttcaggttcctgatgacactaaagctgtgtaccgcactgtgcgacagaggccgcgcagattccagacaggaacggcagtccttgttctttgtcgacttgtaggtccgacaccaaaagtgacacggcatcacgggaatataccgacgcaatgggggggcaact

SEQ ID NO: 489645 - DNA, 395 bp, Homo sapiens
tgtgaaaaccttgcgagaacagtgtgaggagcgaatagaaaggtcacaataaatgggaatgaactgtagcttccagatacctgaatgaatataatgatcagagagatcaggtccaagcgccccagtgagcctcagaccaggctgcatgcaggatgcctgccaaacacagaggtgccacatagggcaagtggaaacgtgtcttggtaacagcgagtgccagatcccagcatccagttccgaagtggttatgtgttcaaagagacatgttgacaattaggactgcaattagatccaggtggtgagtgaggagtcgtccaggagatgggttgtcgtaggaggctttgccggtgagctcgttgctggattacagagctgtaagtggaagatgcttcgtg

SEQ ID NO: 489646 - DNA, 427 bp, Homo sapiens
  misc_feature (4)..(4): n is a, c, g, or t
  misc_feature (27)..(27): n is a, c, g, or t
  misc_feature (292)..(292): n is a, c, g, or t
  misc_feature (417)..(417): n is a, c, g, or t
  misc_feature (419)..(419): n is a, c, g, or t
gggnccctctattcccacacacagganaggtggtgcctagggacagggcttatccatttatagtcttgtttcccattttctgaagacaaatattcccagtttcaaaatgtttgtggggatgataaagacagcccaggtccatggccgggcgcagtggctcatgcctgtaatcccagcacttcgggaggccaaggtgggtggatcacctgaggtaaggagttcgagaccagcctggccaacataatgaaaccccatctctactaaaaatacaaaaattagccgggcatggtantcacgcctgtagtcccaggtacttgggaggctgatgcatgagaattgcttgaacccgggaggcggcagttgcaatgagcagagatcacgccactgcactctaccttgggcaacagagtgaactananttctcggg

SEQ ID NO: 489647 - DNA, 338 bp, Homo sapiens
acggctacacttactcggcgcacccggtggcgtgtgctgcgggcctggcggcactggacctgctgcagaaggaaaacctggtgcagagcgtggccgaagttgccccgcatttcgagaatgcactgcacggcatcaagggtacgaagaacgtgatcgacatccgtaacttcggcctggctggcgcgatccagattgccccccgtgatggcgatgccatcgtgcgtccgttcgaggccggcatggcgttgtggaaggccggcttctatgtgcgcttcggcggcgacaccttgcagttcggcccaaccttcaacagcaagccgcaggacctcgatcgactg

SEQ ID NO: 489648 - DNA, 312 bp, Homo sapiens
gcggccgggctggctcagcgtcgcgccgtgtctgcagtccttcacggtggacagcagcacagctggctggctccgctggaagtgaggttctgagcccacgaggcttggtggacgccgtgaacatggtggacaatggagatggcacacacacagtaacctacaccccatctcaggagggaccttacatggtctcagttaaatatgctgatgaagagattcctcgcagtaccttcaaggtcaaggtccttcccacatatgatgcccgcaacagtgactgccagtggccccggactaagttcctatggtgtgcct

SEQ ID NO: 489649 - DNA, 143 bp, Homo sapiens
tttcacaagtttatctctcagccataaagacaaacctgaagtcacaatataacaagtaaatacatttttgttattttcctatgtcaaaattacaattaatttagtgtttgaacagtaccttagatataggtcgtcacacgcgc

SEQ ID NO: 489650 - DNA, 854 bp, Homo sapiens
gaataatttacaattacatgtatcccttctcaataagtttaatcagactaaccctaagctagaggtcaaaatctacttcctctaatatcaaaacgaaaatttaaagttttcccaaatattaattcaactattaattgaatattcaatgaattcatttaatgttagattaattcattgaatattaattcgatgaatgactaattaatagtattttaacaagattctggtatatttaacaacattttggtaataaagacaataatttgagagtgtgtggaagtccccctaatagaagccatctatctaatcaatgtcccaaacagtgtgaactacctagtagagcaaaggaagcagtgaacaaagaatgcaactttttcttcaccattcacaagtacagagatcacatgcataacaatgaactcatacagatcaagaacatcgaaactacccagcaacctgataagcacagagtgttcaaagcctccaccgtgtggagaaactaaattagaggtaactagctattgagtactattgagtacccttcaagagcacgtcaactgacaggtctttacagacgtggaaatctatcaatacttatgacatttctaccttggtatataaccaataatctaccatacgaatgtagtcatttttaaagctcattaacaagcaatatattaacatactaatgtattatatcgtgactctagaacccattcctatgtacaactaattgcctaggtgagccctctcacttcagaagtgtcactgaaccctatgggagggtcacaatagaaagaggatacgtagtaaccacaggtcaccagacatgataaaaaggatggtcccaagaa

SEQ ID NO: 489651 - DNA, 396 bp, Homo sapiens
tctgactgccagatgcaggatcccggagaacaagataaggctgcgctcgaaatgattggtcgctcacgtgctcaccagcattcgagctgcaatgactccgaatgatgctgctgctcacctacctactgaaggcggtcgcgagttacagcttttcgacgatgagttcaaataggctttcggtctgcaatgccgcccgaaatggccaccgtgacctttcgcactcatacaactggaaaaagggatcaagtgtgggacgacgaaagcctcccatttgatgtagttcagcatcaagaatggcttgaacccctcgccgacgttgcaaaagtcgagtgcgacggtatgacccgcgtggttgaccatttgatgcgcaagaatgggatagaacatgttgtagcc

SEQ ID NO: 489652 - DNA, 199 bp, Homo sapiens
tatgggttaggtttggtatattcacaatcctatgctttcttgtccggatagcaattcattgcttggttgaacggacctgacacttctctgttctgtcctacaaaatatagcatagttgcgaggacagattggagtgttaattgagtagtgtcaaacgaataggtgatatgggtagggctgtcctcatgtacagtggcat

SEQ ID NO: 489653 - DNA, 413 bp, Homo sapiens
ggctagtgtcggctgcagaaccgaggaaggcatggtaggttgcgcaaggctgtgtcctgtgtgcatgtgcgacacacaatgctcatgggagcaggatcactgatgctctgcccttgatgatcaaggctgtggctgaagtggatgagggaggcaagttctggggtaattgcctttgcagagtatgaggacaagctctgtatccctcctatttgtagttgatctcataactagaagcatttgtcaattgctgtgactcccaactgacagcacaggttcattgtcgaacccttctaacatcttatacctttcttctgctagaactagattacagtttgattttattctatcatgagctgtgcactagccatgtcctacttggttatcttgattactgctaccgcttcttgccttcc

SEQ ID NO: 489654 - DNA, 438 bp, Homo sapiens
gtcggggcagcagaatttatgctgcattgaaaagcaggtaccagtgccccttttcagacagtttttgattcgctctagactttttttttttaaatagggagggaaaaaattggataattttcttttttctacatgcacttaagattaaaacacaggttgggattaatttaattggcttcctttttccgcttttcttcccgcagagcctgatgggagaatgtccagggcagggaaaccacatttttggtcggtgataactcactgaacatgggggctaatcttttacacttctctctggtggacctctgggtggggcaatcggtttaaaggtctccttgaaggcgcacgggggtccctggccatgcctcgttctcccggctttctttatccggtaatggcctccacagtcggtggccagggactctacgatcaatgcag

SEQ ID NO: 489655 - DNA, 867 bp, Homo sapiens
aatgaactctttctgggaagagattcttcttttatgactatattactcatattatgacaattcattgaatagtaaaagacattgatgatgtgtttgggtgaggtagaactcttgtcttcaaaggacaggagaaatttatctatccacatttattgcaaggtgttttcaaataactcttctgatagcgtatgacatatccattagccctggacctaagaggagtaagttatgggtatttagaatggttctaagctgagacacccagtcccttccacccaaccacattggcatccatttagataggtacaattttgaaaatctcttcccaggaaagagccagattgtcacagtatgcaagaaagtgttgtgcatagcaaaagaaacttaggtaaaggatatttaagaagattcaaacatcagtataagggcgatctgtgcagaaattttattaagcaaggggatgagcaacaggagactgttgtcacataaaatgttcagggcagagaatgaatgttcatctttcaggatattgaatactaagggtgatagatctgattaatcatccaagttttctccaaactctgatatttagaaaaggttcttagggttggaggcattaatttggttgactggtaattcaagtaagttcggtgtatagaagcgatcagatataggatgggggggggattatggaaggggtccaaaagcggatggaaaggttaacaggagggtacagggtggttcggggttggaccggccggggggggcaaggggagaggcccgggaagggttttacgggttgggagttaggaagggggtggggggtcaaaaaaacaggggtggggtatagtggacagtgagtgtatg

SEQ ID NO: 489656 - DNA, 885 bp, Homo sapiens
gtagaagggtgttggcgtcgttccctggctgctttccgacacgcatgtgtttcactacaggggtattcttcacagcattgcttatatagcttgtgaacttgtgtgcccacctgggggccgcgagtgcccacgtggacgctgggtcttctctcccagtgtgtcttgctgtccacccgtgcatagtgggcgccgtgttgccctcttggggtcccccccgtacaaacaaaggcaacttcctcctgtcttaagaaaattatgtgtctccctctgtggttaaacctggacggccgccccaattttctttcaggctcgtgcgaaccccccactctatgtgaggctgtctgccagcacaacgggggcagagccctccccgatttggcacacgtatgctccaagtatccgtcccgtgaaacaggaaccccaactgccgcggcaaggggtcggatcaaacccggggccacacaggcatccgggcacgggcgaaggatccccgacagacacacaacatcgacaataggaagcccacgagagtcttcacccagagcgtcaccccccgctgtcaatagagcgcatgtggaacagaccgttcttcacagctgtttcgttgaacatgggcgccacatgatggattatgtatatccgagatcggggtatcagacagatcacacccagatcggttcaacccgtcccagtgccaatagacccaatcaattttttggaagaccactcctttggatgatgtcaatgctgcgacgggcccgtcatataagaatcgattattgttgtaagaccgcagtccgttgttgacctgcgaagcaacgcgtggcccccacataggcattgccaactttcgggcccccttcaaaaatccagccaacattgaca

SEQ ID NO: 489657 - DNA, 116 bp, Homo sapiens
tactcaattttcccttccataaaatattttctacttctatataacttctttttttatttttttgagatggagccttgctctgtggcccaggttggagtgcagtggcgcgatctcag

SEQ ID NO: 489658 - DNA, 148 bp, Homo sapiens
tgcaggttgactttatcctgagagtacgggtgagttctggcaggatatccaagcgagatgtacacatgatcagttctgcttattagaaagacattggctcgagcatggtggctcacacctgtaatcactgttactcggtaataggagg

SEQ ID NO: 489659 - DNA, 437 bp, Homo sapiens
cacgtcagggcccatctccggctgagcctcctccatcctggtcaccctgatgtccgggctggctgactgcaccactgatgcggggcacgggtctggtgtgcgaggggagacggccgcttgcccctcttctcatcgcggacgggaaagacgagacttgacggagctttggcattctgcggcacgaaggactttgaccaggattcacagtacgcgctgctgcaagggttactgacgtcctggactctggacgaatggcttattatccggggcacgaaacagcagagggcggcgggccaggacgctatctcctctggaaactgtggctccgggcatacatccttgctgactttcccaccggccctctgtgctgccatagcaccgtatgcactggaatgacgatcctgtcggcttccagaccaatctgttcacatctcggc

SEQ ID NO: 489660 - DNA, 156 bp, Homo sapiens
cactgtctgtgctggtggcacgaggaactggtacaaacatgctagagagaggagctagtatagagcaccgagacaagaaaggttttactccactcatcttggctgccacagctggtcatgttggtgttgtggaaatattgctggacaatggtgcag

SEQ ID NO: 489661 - DNA, 182 bp, Homo sapiens
cctagaggatctcaagcttctcaacggggtcaggcacttgaccaaagtcacacaatggggggcagggacatccctgatgatatcttgccccagtggcaatgctttccaccactatactatatcagttctggtgatacagcagttaacagtatagatgaaataaactacattgcagcgttgag

SEQ ID NO: 489662 - DNA, 1157 bp, Homo sapiens
actgacacgaagaacaagagaaagccagactgatctgcgtctagaagaaacacgagagactgcacaggttgaaaaaggatcaacgtagaagagatcatcaacttagacttctggtaagcccaaaaaagaaaccaagaagtggttctacgctcgcaaaactgaagaggttacggctcttcgtacggcaagtaagacccatgtcagatacacagtggctgggaaagttcaatcggaacgctgagtacatctagatgacacctgctcaggacacaggttccagtgcagctgactgtcgaaacagatgacatcaagagacacggagcccagcagcacaaatgacgaattcctgtggcgagcagatccacgccttaccaacgccggacaactcacatggacacacaggacaaccaatatcagcaggcaaagtgctcgcctggccgcgtgtcaataaccaagacagatcgcatgcagtggcaagctcctatgagccgcagggtcacaagcacatcatcatgcacgaacgatgaccatatcccaaacatggaaggccagatatgaatagactccctcaaaggcacacgcggaaggaactcacaccaacacagaacgaaaagcaccatctcccaacaaaagacacggcacgcaaagacacgtccaaggcccaactgggccagcgacagcatcacaacatgcagcctcactaatcagatctactcacgccactgcgcaagactaacttgcaactgacacaataatcacattcaccattccaactgacactgacactacctggacatggtccagcgcccaagcataactgtgcaaattggaaaacactcaccaagatacacagcagcataaaaatcgcctaaacacatgacactattaaagatcgacaccactaaaaaaagcgcgacgatagcggtcagaaaaaactacagtgataaaaggcgcatcacgcaaaggcaatcaaaagtggtgacgtaaaagaggacccaaaacgaaagtgcatcgggagttgatgttatcaatgaccgtcaataatcgagacaaaatacagaaggacgacgacaaccgagagacacaaacggtgaacaaagcagaaaaccacgaaagacagaagtatgattaaacaagaagatgcatgagatgggtga

SEQ ID NO: 489663 - DNA, 236 bp, Homo sapiens
  misc_feature (33)..(33): n is a, c, g, or t
aggatcaggtactgctactagtgaccaggatancataggcagtcagacagagtagcagatcagaggcagttctgcacacatatttatacccacttgtaactatatacaaattaaggaggaggttatttagaaatttctagaaaaggggtggtaactttcaggtcattgccatggaaaggggcagtaatttccagctgttaccatgagaacggcaaactcacttggcaccagtgggt

SEQ ID NO: 489664 - DNA, 240 bp, Homo sapiens
  misc_feature (144)..(144): n is a, c, g, or t
ggacacttccagggccgaggtgacatctcaggaggccagaacaacactcttgctgtgagaggtctacccgggtactctgcactactcactgcctggggccgtggcaagttgccagggtgggggtgcctagccaggtgcagtccncgcccgcctagtcctcggcgtcacgcaatgctcacctcgcctcttccccactaacatcccagactttaaaattcagtaaatcagatgtacaccgag

SEQ ID NO: 489665 - DNA, 570 bp, Homo sapiens
  misc_feature (12)..(13): n is a, c, g, or t
  misc_feature (24)..(24): n is a, c, g, or t
  misc_feature (52)..(52): n is a, c, g, or t
  misc_feature (202)..(202): n is a, c, g, or t
aaacaaaacctnntattcactctntttttatattaacaaaattaatccattnaaggaaaaaagcataatattacccaagtccttgatctctgtggtaaaaagtgctactttagatacaaaacctgaatcaaaatatgtatcactggggacgtcataccatccattttccttaaaaaagaaggtggtctgtgaaaaacccttntctccatcaacacttccaggcatgcataccaaaaacaatccatgaaaagtggaacatacagaacaactttctattataacagaagtcgtaactactgaagaaaatattcctgacgtggtcccgggcagccatctgactccaatagagagagagagttcttcacctttaagtagtaaccagtctaaacctggcagcatcgctttaaactcgtatcactccagaaattgttctgaaagtgatcactccagaaatggttttaatactaattccaactggctggaatcacatagctccttatctgactcagaatttcccccatataataaaggtgaaataaaaacagagggacatgagctcataaccgtaat

SEQ ID NO: 489666 - DNA, 775 bp, Homo sapiens
cccacgcgtcgcgcacgagatgtgtggtgtgtcagaagacggttcacttcgccgatcaggttcagtgccaaggcagcagtttccataaatcctgctgcctgtgcatggtctgcaacatgcactctggacagtaccatctgtggacgtgcatggtgaggagatttactgcaagatcctgctacggccagaagtatgggcccaaatggctatgggctacggtcagggcgcaggcatgctcagcactgacaagggggagtccgctgggtatcaagtcacgaggaagccgcctggccacaggctccaccagcaaccccaatgcatccaatatttgcccagaagattggtggctccgaacgctgcccccgatgctgccaggcagtctatgctgcgtaagaaagtgcattgtgtgctggtggaaatcctgtgccataatggcctgcttttcgatgtgccaacgtgtggcaaaggccttgagtcaaacaccctggcagacaaggatggcgagattcactgcaaaggatgttatgctaaaaacttcgggcccaagggctttggttttgggcaccggtagcttgcggccttgggtccacctctgagtgaggccacctatcatccgccgacatcgctgtccacatcctgcgcttatcattcgccaatacatgcccagcagctttggagacctcccggattttttctctgtcgacctgttacgttcctatggcttgacttggcatttggtcccttgggtggggctgctaagcccccctaaggtccc

SEQ ID NO: 489667 - DNA, 340 bp, Homo sapiens
ggccacgcaggacaggcacggtggctcatgctgtaatcctagcactctgggaggcccaggcaggtagatgacaaggtcaggagttcgagaccagcctggccaacatagtgaaaacctgtcgctactaaaaatacaaaaaattagctgggcgtggtggcgggtgcctgtagtcccacctactggggaggctgagacaggagaatcacttgaacccaggaggcagatgttgcagtgaaccgagatcacaccgttgtactccagcccaggcaacagtacgagattccctctcaaaaaaataagaaatgccacgcggggcttgagaaaagcggttatccaggaa

SEQ ID NO: 489668 - DNA, 1092 bp, Homo sapiens
  misc_feature (1)..(1): n is a, c, g, or t
ngggcttataattaattaaaccaacacagagcctgttctcctttttttatgatttgtcatccacccgatctactatgatagtctccctcgtccgtggcgatacgactccactattcatctcacactacccttggtgtgtgttgtcacccccccacccattttttgatagtatactccctcgcgggtgagcccgacatgattcttacaccagctccccccgcgcgactattttttatgccatctaattggcgccccgcgcgcgcggctcgcgttaatatactcacatacatgttttctatcacacacgacgtgaggacataacactgctcgatttgttgatgtaccaatcttcatattgcggcgcatactcatattatatatgggttgacgacacatcctatatatgatacaaaaaacaagctttgtgtgtacactaaaacaaaaacattactacaccacggcgcttcgttgtgatctactcgcccttcgctggtcgagatattttttccgacggaagataattattatgcttcttctacactaactctacatcgcggccacaccccactctagggggaatcactctatctacgcttttgtattcacccactcactcatacgtgcacactcaccgcgctatctctcactcttctcgcgagtgacattctccacgcaatccaccgcaccacaccctaatcgcttttgttctgtatgacatctctttgtgtgttttttcctcctctcttttcccaggcaaatctctgtttgtagatggtccacctcaccgagcggatgtttattaggaggggtgccatctggcacagcgctgttgtttcgtgtaataagaggagggaatgggtttcatgaggtgtacttgagtggtttttagaaacaatccggcacctctctcctctttgatattcttttttgtgtttttcttctttcgcctccctgcgggcgccaagcaaaattgctcatcctttttccccttgcgctctcttcttccgcggatatgtaattttttggggggcccccccccaaagttttttttcccccccccacaaggggggggaaaaaaatctttttttttta

SEQ ID NO: 489669 - DNA, 641 bp, Homo sapiens
  misc_feature (641)..(641): n is a, c, g, or t
ggcttcctctcgccgtgttgtgagggcaaaggagagaagggagaaaaaaaaaaaaaaaaaccaaaacccataatttaccagaaaaagaaagaagggtgggagagcgaacatttggcctaatttgggtaataaaacacgttgtctttcggggatggctcgcagggatgggagaaacttttcttaaccaaaattcaaaaaaaaaaaaaaaaaaaaaaaacaaaaactgttgttggggggcgctgaacggcgccgagaaaagtctttaaaacaaccaactgcgtgtgtgtgggcgcgcgcggcggccccacaacgttagtgagatagacaagacgaccaacagcggtgctcgccaaaagaggtgtggctcccatcaaagaagaacgactccggcgggaacaagaacagaaagagggcggcggggagactgtccaccaccaacatagaaaaaaaacgacgcgcggcgggggagacaacaaaacgaacggcttgtttgagagaaaaaataccacaagaaggcgggagtcaacagaaggggcaccagtagaaggaggagatatatctaaccagagaggggacgctcaccaagaagcgagcgcccgcaaaatataaaattataaccgccgcggcagggggggagacgn

SEQ ID NO: 489670 - DNA, 226 bp, Homo sapiens
cggaagtgcgcggatcgctcgacgccaccgggttagtgaggctctcgacatcgacgccgcgctggcacaagctgatcttgtcgtcacctgccgtgggtcgggggttcctgcgttgtcggctgaggctgctcggcgcgcggtcgacgctcgaaggggccgagatctcatggtgctcgatttagcaatcagcggggacgttgaggagcctgtccctgctggggtagag

SEQ ID NO: 489671 - DNA, 145 bp, Homo sapiens
gtgcagcactatgcaagctggaggaggagacgcgcacatcaaacgctgccctacgtgcaaggtctacatcgagcgggacgaagggtgtgcccagatgatgtgtaagaactgcaagcacgccttctgctggtactgcctcgagtcc

SEQ ID NO: 489672 - DNA, 130 bp, Homo sapiens
  misc_feature (5)..(5): n is a, c, g, or t
  misc_feature (26)..(26): n is a, c, g, or t
  misc_feature (101)..(101): n is a, c, g, or t
  misc_feature (130)..(130): n is a, c, g, or t
cgggnattaaatgtgctgactcacgnaccattccataaagaatatcagtgggggtacaggaaagggtctcactggaagtgctggggtctttaaccagaggngcctttgccactttactatgccactccan

SEQ ID NO: 489673 - DNA, 320 bp, Homo sapiens
atattcatgagacagggagagatcattaaggaaattagagagtatttagaatcaactggcgcagttgctcacgtcttttaatcccagcactttgggaggctcaggcagaaggatgcttgagcccaggagttccagaccagcctgggcaagacattgagactgtgtctgtacaaaaataaaataaaattagccaggtgtggccaggcatggtggctcatgcctgtgatcccagcattttgggagggcaaggtaggaagactgcctgagctcaggagtttaagaccagcctgcgcaacatggcgggacttcatctcatttaa

SEQ ID NO: 489674 - DNA, 639 bp, Homo sapiens
  misc_feature (1)..(1): n is a, c, g, or t
  misc_feature (221)..(221): n is a, c, g, or t
  misc_feature (354)..(354): n is a, c, g, or t
naaatcttggctggacgtgtggttcacgcctgtcatccaagcacttggtgaggctgaggcagtggtatcacgaggtcaggagatcaagacaagcctagccaacatagtgaaccccgtctctactaaaaatgcaaaaaattagcctggcatggtggcaggcacctataatcccagctactcgggaggccaggaggcggaggttgcagtgagccgagatcgcnacattgcactccagcccgggcaacagtgcgagactctgtctcaaaaaatatagatatagatatagatagatagatagattcttaccatgcaatctagcagttttgctcctgaatatttatccaactgaattgnaaacttatgtccacataaaaacctgcatgcaggccaggcatggtggctcacgcttataatcccagcagtttgggaggctgaggcaggaggatcgcttgagcccaggagttcaagaccagcctgggcaacatactgagaccccatctctaccaaactaaaaaacttagccgagtgtcacagcacacacacatggtcccacctgtcaagaggctgagtgggatctcaagcccggaaggcagaggttgcagcgagctgtgattgagccactgcactgcagcctccaga

SEQ ID NO: 489675 - DNA, 779 bp, Homo sapiens
  misc_feature (46)..(46): n is a, c, g, or t
  misc_feature (81)..(81): n is a, c, g, or t
  misc_feature (83)..(85): n is a, c, g, or t
  misc_feature (87)..(87): n is a, c, g, or t
  misc_feature (94)..(94): n is a, c, g, or t
  misc_feature (122)..(122): n is a, c, g, or t
  misc_feature (124)..(126): n is a, c, g, or t
  misc_feature (128)..(128): n is a, c, g, or t
  misc_feature (130)..(130): n is a, c, g, or t
  misc_feature (132)..(132): n is a, c, g, or t
  misc_feature (135)..(135): n is a, c, g, or t
  misc_feature (137)..(137): n is a, c, g, or t
  misc_feature (140)..(140): n is a, c, g, or t
  misc_feature (144)..(144): n is a, c, g, or t
  misc_feature (146)..(147): n is a, c, g, or t
  misc_feature (155)..(155): n is a, c, g, or t
  misc_feature (159)..(159): n is a, c, g, or t
  misc_feature (176)..(176): n is a, c, g, or t
  misc_feature (183)..(183): n is a, c, g, or t
  misc_feature (190)..(190): n is a, c, g, or t
  misc_feature (208)..(209): n is a, c, g, or t
  misc_feature (224)..(224): n is a, c, g, or t
  misc_feature (228)..(228): n is a, c, g, or t
  misc_feature (232)..(232): n is a, c, g, or t
  misc_feature (234)..(234): n is a, c, g, or t
  misc_feature (237)..(237): n is a, c, g, or t
  misc_feature (308)..(308): n is a, c, g, or t
  misc_feature (312)..(312): n is a, c, g, or t
  misc_feature (317)..(317): n is a, c, g, or t
  misc_feature (386)..(389): n is a, c, g, or t
  misc_feature (392)..(393): n is a, c, g, or t
  misc_feature (407)..(407): n is a, c, g, or t
  misc_feature (409)..(409): n is a, c, g, or t
  misc_feature (415)..(415): n is a, c, g, or t
  misc_feature (417)..(417): n is a, c, g, or t
  misc_feature (428)..(428): n is a, c, g, or t
  misc_feature (431)..(431): n is a, c, g, or t
  misc_feature (435)..(435): n is a, c, g, or t
  misc_feature (559)..(559): n is a, c, g, or t
  misc_feature (589)..(589): n is a, c, g, or t
  misc_feature (593)..(594): n is a, c, g, or t
  misc_feature (597)..(597): n is a, c, g, or t
  misc_feature (636)..(636): n is a, c, g, or t
  misc_feature (702)..(702): n is a, c, g, or t
  misc_feature (740)..(740): n is a, c, g, or t
aatattttttttattatacaaaacacggagatattgcttcacttgnaaagaggttccagaccagatggggagacgagacanannntngggacanggagggccgagagggggcgttgcgtgcngnnnangngnggngngangggngnnggggggangggnttctccctgcatcaatnggcaggnatatttnggaggccttttctatctnntttttgcggaggagngggngggngntgngagcccggggggtccgcctgccccggcccccgctgcctggttcttcgggctttggcccaaagcacggttcngggnggggncgagcgggctggctgggccacccggtcacagatggagggaggcaatcgctccctagagtcggccaatgnnnnttnnataaggcggctccntntgctcntnctcctctcctnttnccanccccgtccatcctgccgccctccccaccccgccaagacgctgtggggacccgagtttcatgggtgcagcaaaccggggcttctagcttttccccgggcaggacggggtagcactggctcctgtncttcctgggccccggcccggccgtgcaganctcnnctnggagggctggaacgagccggccacagagggacagctggnaggggccagaggataccgtggcgggggcgggcggaggacgtgcacgcacgctgggtggaggcgcanggggtcacaggttctggcacactgcagcttgtttgggntctgtgcgtccgtggtgggcggcactgcatttccacacg

SEQ ID NO: 489676 - DNA, 544 bp, Homo sapiens
  misc_feature (12)..(12): n is a, c, g, or t
cacaaccatgcngtagaatgagaaaatttgcatattggttttccttccactatgtggtttccaggaatcaaactcagagattgttgggcttggcagcaccttgaccactgaaaaatgtcacgggcccccaacattttgagatggtgttaaacagatccatctgcccatgtcagctggatgccattatataggcaaagtctaattgctttgttttctattttacagggtccactactcaatttcactttggcatgaggagataatccgttgaaacattaattgaatattaaatagattcccttttgtaaatcaatggctcttttgtgcttttgtattgtgaatattcgatgggaccaatacatgcacagcttatgattgtatacaaatccttagcagcagcacatgaagacaaactggagtttgtgtatataagcaatgtgtgtgtgttcatgcacagtaatcattaaattacatgtatatttgtggaatgctaatttaagtgattaaattataaactttgtgtatttatcaggtgggtgaaaag

SEQ ID NO: 489677 - DNA, 436 bp, Homo sapiens
aagcttaacgaggagcgaagtcgatgtgatgatcagatacgagagcagttagtgatcagtcgatcttagtgtatctgttggggtagctgtgtcgagtataggctagcgcatgctgacctagagtctagagtgggctagtggctgatttttaggtccagtgctagatagtaggctgtgagttaagtggcgtcagtagctaggctgtagcggttaggctgcgtcagtctgagagtgtgagcagctagatcttagcagtctgagagtgtgagcagctagatcttagagcctaggataggcaggtgactagagtcagggctgaagccagtagagctaggtccagagctagctagatcgaagtctgcatatcaggtgtcagatcggcactaggaacctgactaggaccatgactagtccgtaccagccggaaaaaaaaaaa

SEQ ID NO: 489678 - DNA, 457 bp, Homo sapiens
tgcatttaggttactgtgagtactctatctgtagtagtccagagcgaccccgatgtgcatctcttctgctcaaagcaggtggtcttggaaccattcagcaccccaccctctctcagcacacctagttccgtgccattgaagtcctcagtcttgccctcaccatcaggacgatctgctcagggcagttcaagcccagtgccctcaatggtacagaaatcacccaggataacccctccagcggcaaaagccaggctctccccaggcaaagtcacttcagcctgctgttgcagaaaagcagggacatcagtggaaagattcagatcctgtaatggctggaataggggaggagattgcacactttcagaaggagttggaagagttaaaagcccgaacttccaaagcctgtttccaagtgggcacttctgaggagatgaagatgctgcgaacagaatcagat

SEQ ID NO: 489679 - DNA, 150 bp, Homo sapiens
gacttgcgccatacagtgctgtacactacagtaatgatgtactgggtaaactagaaacaaagaatgcatgcaggatctgtcgtagcttattaaagatgaaactgaattggaaaaatagctccattttttggtgcttggaaagtcagtgcg

SEQ ID NO: 489680 - DNA, 1637 bp, Homo sapiens
tccacgcttaatccatttttatttttctggtttaaaacccctatgtgtttgtagccacagcttggagccgtgagttccctgtgcacggagactcggggtgtgggctctggacgacggtggctcaggtgaactccgtgataagggagactggggtgaactacagctctcctttccagaggctcgggggttcacggtacctgataggctcttaaaaatgtggctctcacacggggtggccttgggcagaagttgtgcccagggtgtggcagtgtgcatgcccgcgggcttgaggtgtgtagcagctcattcgaataccaggccattcagtgagacagtctctttataggcaccagggtgcggtgagaccacagagtgccccgagtgtgcccctgtgtggtgtgcgagggggcatggaggcggttaccaagcacggaagagctcgccagtggcgcctgtgttccaccttgtgtctagagggcaccaggtgtgtggcggcttgtgccgaactcttgggtctcccccaagtataagccttctgtgtggcacggggtggacctcgatagcgacgcacgtcttcggtgccactgtgtatagtatttgggccccctactgtgatgtgcgctgtgggcgcccaccctcctcttggggaagcatcttaatcgaccctcatgaccggacctgtgtggcccattgggtgagtgtccccccggaataagcaaccaatatcgctttggaacgcttgggtgtgcggcttggccgggaccggagcgtaccgagcttcctcggccccgggcgcattaaatctctcacaagaaagcctctcatctcttatggagaaaagaaggcccccctaggggaaagacacatccacaaggggagcttcacgagaatacccactaaaggggcgcgagggcgacaacaggcaaagacttccctcccaccagggacatctggtacgtcaaactgttcactctggacccacatcggcgcccacaccttcgaggtaacagggcatccaaccagttaaccactgggctgtgcaccatgaaaaactcaatggtaaatgctgcaagctccgtaatagtcgggtaacccagcgcacagtcatagctgaaacccgaggagacagcgagctccacacagtgcatcataagtcgttcccacactactggaatcctactcggacgaagcgtgccagcagctacatcctggcagtcaaacagagatacaccaccacacactctacgtacagactgctctcacttctcgattacagcatcacctctactacttcgacctcgtagcagtcgatgaacatattgcactgaccctgtcatcagtagcaagacactgccagtgtcgactgactcagcgcgaagccatctcataaaagatcaatcagcactcaacacaaactaaccaacaaacacaacaccacatacagcacagaagacaaccgccattaaccaaaagagccacaccccacacccacccgaccacacacccaacaacccaccacgactcgcgttgtcaggcgcatcatcgcacctactcccgtcgtctcgttcccgtccgttggcgtcgtgcgcgcatgtcggctcggctgctgcgatgtgtggtctagctgtgttgcgtcg

SEQ ID NO: 489681 - DNA, 144 bp, Homo sapiens
cgctctggcgatctgtgtgtccgcactaagttcggcatcatatgtgacctcccgtgagtcgggggatcaccaggtagcctaaggaggggtgaaccggcccaggtcggaaacggagcatgtcaaaactccagcgtgctgatacaa

SEQ ID NO: 489682 - DNA, 183 bp, Homo sapiens
atggtgattatgggaggcactttatttggaagtaatgagggattccaaaaatagtcttagtgatgcttaacaaattggaaagacaaaaggaactgaggccaaagaagattgagataggtgaaatgtttcattgtatacattttcattaacttggttaataataatggatgtggcatttatatg

SEQ ID NO: 489683 - DNA, 219 bp, Homo sapiens
gacacagtggagtccataggactgatgctcgctcagtcccatggattcagctttcttcctaggagtgtttagagaggtccacatccttgcattttctgagtagcttccagctttgccagagatctcggagcctgagtatctagcggctcctgagattctgtttgtgcctgagtagttgctctgtccaataccatgcagttcggtgggtcagaacataag

SEQ ID NO: 489684 - DNA, 387 bp, Homo sapiens
cgaccaaggccaaagggccagatagattaccaggatgtgtagccagagcatgctcttcactaacattttcaacctctccctgtttgagtctgtaataccaacatgtttcaatcagaccaccatagtccctgtgcccaagaacactaaggtaacctgcctaaatgactaccgacccgtagcattcacatctgtagccatgaagtgctttgaaaggccttaatggtgtacatcaacaccattatcccggaaaccctagacccactccaatttgcttaccgccccaacagatccacagataatgccatctctattgcactccacacttcccttccacacctggagaaaaggaacacctatgtgagaatgcgtagacgcgcccgcgaattt

SEQ ID NO: 489685 - DNA, 471 bp, Homo sapiens
tcctattatcagtctccatgcttcggaatctgctgctggtgggtaaacacaaatccagccagaaagagaaatactggtctcccatacttgcaaacatcttgaatctctagttacttcctcaggccttcctcctgcggttttgtttttttgagatagggtctcactgtcacccaggctggagtgcagtggagcaaccatggctcactgcagcctactcttcccgggcttgggtgatcctcctgcctcaccctccttggtggctggaactacaggtgcgccaccacagctggctagctttgtggtattttttgtagagtcagggtttcaccatgttgcccagactggtctcaaattcctggagccaagtgatccaccctccttagccccggaaagtgctgggattactagccatgagccactgcacctggccctcttttaacacacactatctgtgggtctttggcctgaagt

SEQ ID NO: 489686 - DNA, 642 bp, Homo sapiens
cagcaacgttgttgagcgcagatgcttcttggcagccaaccatcagctcccagagtcgagagagttattgcaccgacttgctggcatccggctacagccagcctaaatcgtacctgcaggcctcatacacgtacctctctctgggctagtatttcgaccgccatgatgaggctatggatggcgtgtgccactactaacgcgaagtggccctagagaagcgctagggctacgagcgcctactgaagatgcgtagccagcatggcagacatgctatgttacaggacatgatgatgccacctgatgatgagagacgtccctatacgcgatgaatgctgccatgatcctgaagaacccccatctgtgtgactaactggagactgagctgctagatgaggaagagactgctgatacgaagatggctgacgacctgaccgaccggcacaggctgattaggacataagctgtgctgtacagtatctgtatgaatgctgactatcacgcacgtcatagagcacattgagggcagcgacttctgaagctaccttgcagagtagggctgctgctgaggcagttcccttagccaagtagccgattgcttaactactcctacagcccattggctcaatgataataggcttgttg

SEQ ID NO: 489687 - DNA, 440 bp, Homo sapiens
tccttgagtatccccctaagcaggctttggagcggcgctgggctcggtgggtcacaggcccgggatgatgaggtacaccacctcggccacattgaggattatgcgatccagaggcacgcgtagcatgaagacggtgaagacggttttctcggtggggcgggacacgatgcagtccactgtgttggggcaggggtagacgtcgcagattgagcagacgcatcatggcatagccagggtagagcagataaaagacatacatgaagacggcctcaaacaacagccggaacaccacgctgatgacataggtccaccacagtgtccctgagatgtggaccttgtgcctcttcacctcctccaggtgtagggggtccccatggccctcaagccgtagcattttcttctctatgtgttgctggtgagccacgtgcatggccacgagg

SEQ ID NO: 489688 - DNA, 180 bp, Homo sapiens
cccccctctaggcgagctttacttcccacactcaatgtggtcgcatttaggcaatcaggtgtggtgtggtgctgacaaacacaatgtatattctgttgatttggggtggagagttctgtagctgtctattaggtctgcttggtgcagagctgagttcacttcctgagctctgccacgggg

SEQ ID NO: 489689 - DNA, 256 bp, Homo sapiens
cagagcacgcaccacgtcctgagtgtctcatactcgtatgtggtggttaaaaagactggagaccagaatgctgccaatgcctctgcatccaagtcggtcaagaccgtcactgcaggagcaggaactatcaggacgatcaagtcatctgctgtgcccccaggtctccctgtgtatttggacctgtgctacattccatatccacagcaatatgtaagaatgttgatgtgtgaatttttcatgatagtgcgtgtcttcc

SEQ ID NO: 489690 - DNA, 920 bp, Homo sapiens
  misc_feature (655)..(655): n is a, c, g, or t
ttagaggctgacttttactctgtcaattacagtggtattttaaatgcatgaatataattcattgaatgtctgtatctttctgcctccatgactttttcaaaaaaaaaaaaaaaaaaaaaaaaaaaaaaaaaaaaaaaaaaaaaaaaaaaaaaaaaaagaggggcgcgcgcgcacgacaagaagacccccgcggggccgcccgcgagatgagcagctgccccaattttttgttgtagacgagggggcgcgccccatcatgagggcggcgctgatgacaataaaagcgacaagcggcgagcgcgcggggttataaaacaacggcgggctggagggcgggaaacacctggcgtcaacgcggggcgatccttggtgtgagagaagacgcacactaacacctgcgggcgggggcgggcgaacaatatggtaggtggggcacaacaactctcatcatagaggaggatattatatagaagcgctcctacgagggagcataatataattaatcatttttcgatgcaggtgcgtatccaggtggtgggttctacccacagcagcgcgagatcatatctgccctgcgggcgggaggaaaaatatgttgtggcgccatcagggggattattgtattatcagtggcgaacaacatcttttatcaccncgcggggcgcgtgttattagattataataaaaaacggccaacccacgcacttagccaacaccgaccgtccccagcaccacaccgacaccgcacagaccatctgacgccctctgaccgctgaccgagccagcctgccagccgcaccaccgacacacccccacgcaacacgctgctccggccgccccacgatgcaacccggcaccgccgccctgcacctcacgcgtctccacactacacgccaccacacgatacaacggaccaacca

SEQ ID NO: 489691 - DNA, 642 bp, Homo sapiens
cgggctggcccgcccaagaaaagaaggccacggttcccctgaaagaagcttggctgtgtgcaacggaccccctccagctctgatgccttatgggggatcggtcaaggtcaacttgagtgttccaggaagactcatacctgattcgctaggccccgagccacagctctggcacgggcggtgaggtatgtggaccaagccgtctagattggtctcgcaaggcagggaaaactcggcttgcaacttactttactcacctttcaggtagcacgcgcgacagccctcgtccttgagtttcttggtcaacagcctgagctacgactcgccgaccgtaatctcgttccagtcgatgctgctctcgtcgtagagctccactgtgtcggtgccacagctccgggtgaatcggtctcggtcctctccgcgtgtgaagagcgcgcgcaccggcaggttacccttatgcaggcgcctcagcataatgcccgggatggccacgttgatggccgactcgatgtgcgcgcactcgaatagctcctgcggccggcagtccatcagcagcagccgctcgttgcccagctccagctgctcgttgagccacgcccccgtcttgctgatcgccatatccgacgagaagggcgcgggtttgag

SEQ ID NO: 489692 - DNA, 756 bp, Homo sapiens
  misc_feature (58)..(58): n is a, c, g, or t
  misc_feature (413)..(413): n is a, c, g, or t
  misc_feature (507)..(507): n is a, c, g, or t
acttttaaaatatatttctaaacagaaggggccgactcagtcacagtaactgtggatnctccagtagtagagcaacccacaaagacagaactgattttttccccataatcaggggtgaaaaatatacaactgtgttctctgaaccaaaaaccacaattctctgcagtcttaataagtgctttcacgtgctaattattggcccgtggttagcaaatttagtgtacgttttctttctctctcttttaaaaacaaaacattctaaacaaaatttctccttaagaaccacttaaatctccctcaatctcgtggaaatgtgttagattctctagagccacaagagccacctctcagtctatacccttaaacaaaataacagaaaaaaattcatcccattcaacctgtgtgtcctcagntgagggccgtgaaagaggagcaagaagttagtgtggtggggaaaccccctgtggcttgggatagtggaagagtctcagcggcccctttgtaccncagaaccgaagaccgtgaagttaagccattaagcgtgggtgcttcctctcaggattaaacctcgagattgtcaggagagttttcacccttcttgagacgcggaattgggggtccccccagtttatacgcaggcgcatttcccattgtcttcttttctgagatactcgaccatccccattccatccttctgcacttcagcttaccagacttccccagcttctcgcttgtgactccttcaggtcctgccag

SEQ ID NO: 489693 - DNA, 166 bp, Homo sapiens
cccccacccccaccccatcattgtttttaaaaaattaaggcctggcgcagcagctcatgcctataatcccagcactttgggaggctgaggcgggcggatcacttgaggccaggagtttgagaccagcccaggcaacatagcaaaaccccattctgctttaaaaaaa

SEQ ID NO: 489694 - DNA, 960 bp, Homo sapiens
ttatggagatcattaactcctagaatttgagattatatttccatacaacattttataaagttatgttgaacttactacctgttatgtgaatagttacataataacctgcacataacaggtagtaagttcaacataactttataaaatgttgtacgagctactgtatgtgcaggtgattgatgtatacttaatacacagatgcttgtcatatatttgctttatcttcctcatctaacatgcataagaagttaaaatccgggacgcacaatgtagaataatcgtaaaccgagacattctgggacatggtaactactcgccacataaaaccccaggagactataacagagatgcaatgttacctaaatgtacatgttactggcagcccactcttccagatatataaatgttgcattaaaatctggcagatcatgaactgagcataattatatccaaaacgatcttgcagtgatgcgcctcctaacatatattcctgtgattacgtaaatcaggcagatcatctgtaggagctagattgtcgctacagatcccgttatctaagacgaaaggcttactcactagttatggcctgattagcgattgacgcacgccgggaactcaccagggcatttgaggatgccccttgacgcatggctcaccgagaaactcggcgtacagagatacagcccggggacggggatcaaagtctggtaactcaccatgcacattgcgaatgacagacaccggggatgcagaaggcagcggacagagcaacatcctgggaagcgcggagaaagcccatcctgtacgcaaccgtgcagggcacggctcgaggctgggccagaccgccggaatgcacaccaccgagagacagaaaggagacacctcacccaggaagagaaagaaaacaggagccgaccgaggaagcccaagcagggcacggaaactctataacacagcaaa

SEQ ID NO: 489695 - DNA, 615 bp, Homo sapiens
gttgcgtggctgtcccaacaaaaaatcccgatggcacgatgaacctcatgaactggaggagtgcgccattccaggaaagacagggactccgtgggaaggaggcttgtgttaaagctacggatgctttgcaacgatgattatgcagcttcgccaccacaaatgtaaatgcgaagcatcatgatttcacccggactgtgtacccttcggggacagtgtgcctgtccatctttagaggaggacaaggactggaggccagccatcacaatcacacgagatcctattaggaataaaaggacagttctaaatgcaaccaacacaatatgccaagaaccagttccacgcagcggacctgcacgattatactggcaataatccagagtggacgtacgaagacaaacgggtccgagcaaaagccaccgacggttcgacgcccctcataagacgagtggatcttgtggacatcgttccgacacggcaggtgattggttaggcaacgaactcgttctaccaaatgacgggaactactacacgttgctgcatagccaatgacttagacacctggaggggatggacgggccgccatcttcataggcgcagcgcatgtgggctcccaat

SEQ ID NO: 489696 - DNA, 1856 bp, Homo sapiens
  misc_feature (398)..(398): n is a, c, g, or t
  misc_feature (450)..(450): n is a, c, g, or t
  misc_feature (482)..(482): n is a, c, g, or t
  misc_feature (493)..(493): n is a, c, g, or t
  misc_feature (879)..(879): n is a, c, g, or t
gattcgcgaagaagcgctgagaggtacctttgacttgctgctgtaatcttgtcaccaagtgcacttgtagtacagagagatatgtcatggcgaagcatgtattctcaaagcctgagaattggagcatcaatcaaatgagacatgaaacgcagttcagcgtgcgtccttgtagcgggacagctgggccgtgattggcttgcttgactctcgcacagacgcgtagctctgcgaccctgcgtcactatagttcgctccatcatagactatcggctgtacgcgacgtcctcgcaaggtgtagcgacgcgctgtcgccgcggacccctcgccacttccagggtcggtcctctcgctggcacacacactgaggtcgcaaacacctctcgagcaatctcctattntcttcacctcgcgaacataacgaagcaatgcaaactcttctcaagggactcntgttgtgcaatatctgacagtctcaatcatcntgggtaatggntcaaatatacacacaaaacaaggccatgcagaggggcgagagagacagagaacactataaaaaagagataacacacacacagacagagagaacaccacacacaaaatatataaacagaagtataacacacaaagacaatttgacgcgtggtggtgagcgacacacgcgcttgtgtggtacccccattaattaccgctgagaagcgttgcggcgtcactcacatcctaaacgcaggccatagcgtcgacacacctggcgacgcaccctgtaccctgtattcttatgtaaccacaactcgatgtgtcccggttcagcaccttttgtgggagaaaaacaacgcgtgacgcagtaatagactattgaggcggaggacatcacctcattgnaggcgtacgcaaacgcgggtaaaacgctgctttttaaaccaatctacagtcgagtcgaagaataggtttgcaaccgctctcaacaaattagtggggcaccccacaggcacccttgagccgcgcttaacctactagaaacgaaattttatcaaacaagaagagcccctccataaaacgggggttacacacaggtactttagacagcaccactccctctaccaacacgggcggcgctgcaataaccacgcggcttcggcttcaacacaaacccagttaccacctcatgccacacatatagttgccccctatggagcagtaggcccattagtcaacacaaacacacatactgccgaggcataatagcagtggaaagaaataaggtggcaccgtctccaaactgcgacacccacagctaccttacatattaccaacacaggggagagctaacccgcatgcaagaaaaaaaactgagcgaccaacaaccagcgcaaaccacagacaacagatcgacaaagcagcgaacgaccaacactacgcatcacaccacggagcacacgacaatcaaccgaggcgcccaaacaaaacacaggcccgcgagacaagcgagcagaaacaccaaagaacacagcgaccaaccgaagcagcgccgtagggacgacgacgaggaggaccaacagcagcaagagaaccagcaacaaaagacacaaacaaaaccaaacacaaaaacacaacacaccgccagacaagagagaacaaaccaccacacacaacacgaacaaggaaaacaagcacaacaggcaaaagcgaaaacacaacaaaaagacaaagaaaagcaaagcacgcagacaagtgaagagaaaagaagaaacccacagcgcaacgcacgctagcaggagcacgaagcaggcaacgaagaaaacaccacgcacgacacaccgctagcaacggaaaaccgaggaccaacagcacaacacgga

SEQ ID NO: 489697 - DNA, 917 bp, Homo sapiens
  misc_feature (15)..(15): n is a, c, g, or t
  misc_feature (116)..(116): n is a, c, g, or t
  misc_feature (132)..(132): n is a, c, g, or t
  misc_feature (161)..(161): n is a, c, g, or t
  misc_feature (163)..(164): n is a, c, g, or t
  misc_feature (166)..(166): n is a, c, g, or t
  misc_feature (197)..(198): n is a, c, g, or t
  misc_feature (207)..(207): n is a, c, g, or t
  misc_feature (210)..(211): n is a, c, g, or t
  misc_feature (214)..(214): n is a, c, g, or t
  misc_feature (230)..(230): n is a, c, g, or t
  misc_feature (232)..(233): n is a, c, g, or t
  misc_feature (236)..(236): n is a, c, g, or t
  misc_feature (238)..(238): n is a, c, g, or t
  misc_feature (245)..(245): n is a, c, g, or t
  misc_feature (255)..(255): n is a, c, g, or t
  misc_feature (270)..(270): n is a, c, g, or t
  misc_feature (273)..(273): n is a, c, g, or t
  misc_feature (283)..(283): n is a, c, g, or t
  misc_feature (285)..(285): n is a, c, g, or t
  misc_feature (313)..(313): n is a, c, g, or t
  misc_feature (347)..(347): n is a, c, g, or t
  misc_feature (355)..(355): n is a, c, g, or t
  misc_feature (357)..(357): n is a, c, g, or t
  misc_feature (360)..(360): n is a, c, g, or t
  misc_feature (376)..(376): n is a, c, g, or t
  misc_feature (384)..(385): n is a, c, g, or t
  misc_feature (391)..(391): n is a, c, g, or t
  misc_feature (406)..(407): n is a, c, g, or t
  misc_feature (409)..(409): n is a, c, g, or t
  misc_feature (440)..(440): n is a, c, g, or t
  misc_feature (471)..(471): n is a, c, g, or t
  misc_feature (473)..(473): n is a, c, g, or t
  misc_feature (479)..(479): n is a, c, g, or t
  misc_feature (481)..(481): n is a, c, g, or t
  misc_feature (498)..(498): n is a, c, g, or t
  misc_feature (516)..(516): n is a, c, g, or t
  misc_feature (628)..(628): n is a, c, g, or t
  misc_feature (780)..(780): n is a, c, g, or t
  misc_feature (782)..(782): n is a, c, g, or t
  misc_feature (784)..(784): n is a, c, g, or t
  misc_feature (811)..(811): n is a, c, g, or t
  misc_feature (913)..(913): n is a, c, g, or t
gacgatgcgtgcgcnccgcgaccgagccgggctcctcctctgcgtgctgctgctggcggcgctgctggaggcggcgctagggctccccgtgaagaagccgcggctccgcggaccanggcctgggagcctcangaggctcgcagaggtctcagcctccccananncnaggcctctgaaggaagaggaggaggcaccanngctccccanaanncanctgcaggcagagccanannaananggatgcnggactgtcantgagccagcagccangancccaggcaanancacccctcccaggaccccagaggttacnccgttgcggctggagctgcagaagctgccgggantggccaananaancttgagtacccctaancctgaaanncaggcntcagcctccccaganncnaggcctctgagggaagaggaggaggcacgantgctccccagaacccacctgcaggcagagcnanaccaananggatgttggactgtcantgagccagcagccctgancccagggaatgccacgcctcccaggacccaggaggttactcccttgctgctggagctgcagaagctgccagaattggtccacgcaaccttgagtacccctaaccctgataancaggtgaccatcaaggtggtggaggacccccaggccgaggtgtcgatagacctgttggctgagcccagcaatcccccgccccaggatacccttagctggctgcccgcactctggtccttcctctgggggagactacaaaggagaggaaaaanananggccccaggggagaagggggaggaaangaggaagacgaggactatccttcagaggatatcgagggtgaggatcaagaggacaaaagaggaagatgaggaagagcagcgctctggttcaatggaatacanacaa

SEQ ID NO: 489698 - DNA, 577 bp, Homo sapiens
tgctgtccacttttgagcagaaacgcaacgaggagggctcggaggtagagaggggcccgaggtgcgttcgtcctgggcgaaggtggcgagtgagctccagcgcgtgtgcgacaccgtgctgtgtctgctgtccagccatcctcatcgaggagtgccgtggtcgccgagagccgggtcttctacctcacagatgaagggtgattaatatccgctagctggccgaggtggtcaccggtgacgacaagaagcgcatcattgactcagcccggtcagtctaccaggaggccatggacatcagcaagaaggagatgccgcccaccaaccccatccgcctgggcctggccctgaacttttccgtcttccactacgagatcgccaacagccccgaggaggccatctctctggccaagaccactttcgacgaggccatggctgatctgcacaccctcagcgaggactcctacaaagacagcaccctcatcatgcagctgctgcgagacaacctgacactgtggacgggcgacaacgccggggaagaggggggcgaggctccccaagagacccaaaagtttttttg

SEQ ID NO: 489699 - DNA, 276 bp, Homo sapiens
aatatccttcagaacccacccagaggccccaccacgttctcctcctcctctccaaccccagaccactttctcttttttccactcgaggacctgtttctcactctagacccctgagcctgacagtaagaccctctcggacggggccagcacaggctgccctaggtctcctcccagggtccagcacagcctgctgtggccaggacatatggtctgcaggatcccctgaggctacccggccagtcgtctcctcaccgtgccagacctgagcaagccagg

SEQ ID NO: 489700 - DNA, 237 bp, Homo sapiens
cgttgggtggggtcccacctggttggaggcttgtggggccgggaacccaagcccaagaagttggggcggccccaatggcaaggctaaaactccctgccctaaagatgaactttcccaaaccttttaccttttttaaccggaattggagttttgtctgaactacaagcgaattggcaccccaagaaggcaagcaggggattcccaaggaggaggagtataaagctgatgtacgggatg

SEQ ID NO: 489701 - DNA, 1342 bp, Homo sapiens
tatactccagcctaagcaacaagagcgaaactgtcttaaagaaaaaaaaaaaaaaaaaaagggcctagtgttgcaggggatcatgcctgtaataccagccacttggggaggctgagggtgggtggatccacctgagactcaggagttttgagaacacagccttggccaaccagggtgaaacccgcatcttctacttaaaacttacacaaaagaattacccggacaggtggttgggtgggcacccgcgtgttaatgcccacttatctcgggaagattctgaagagccagtgaaaaattggctgtggaacccgcggagaggtagaaggttgtgaggagtggagccacaaaaatcccgcccatgttggaccctccccaagacctgcgggggcaaaggagaagaggaagagacctctgtgggcctcagagaaacacaaaaaaaccaacacacaaaaagcagaacaacaaaagaccaaaacaacaaaacacaacaccgacagagagaaccaagagggtgtcacccagagagatcctctccccaagaaaagagctgtttcaccaacaagatggacacattgcgagtgggcttgaaagaaaaggggcaacagggggctcaacaatgaactcaaaggaccgacctgcacggtctgtttcccctgtgcgcaacgacgtgggggaaatacctacgtggcgcacacccataggggtcaacatagaacgagagataacacacaaacccagagagacccgccaccactcacaaacggcgggaatcccacaaccgtcaacaaaacccccgcggggggagcacacccagccacatgcgcaaaaacggggaacacacctcccacacaacaaaacaaagaaacagtgatctaaacgcacatgggccccaaccaccctagagtgtcccgggcaccaaacagtagaatgcccttattggaccccccatttatagtgaaaaacccaggggctcttgccatattgatgcagatatatcctctgcaacccccaacatatgtatgaaacccaaaccttcaacacatgaaaaacaatctaaaagggaacacagcgtccgcacataaagttgcccctgaaaaaagagacgaaactataatttaatgcggacatcccaggtgcaaattctatctaaaacgcagtacgggcctctcgagaaaccctaaacagcaagtgccatgatggtacccaagtagttaacactatacatagagacatatctcaaatattaagacggaaatggcgcacgtgatatggaacaaaaagtgctcttgatacatgagacaaaaacaactagtgcaacctatacaccaacaaataacagcag

SEQ ID NO: 489702 - DNA, 768 bp, Homo sapiens
ggtctgtctcttgacttcatcagtggtgtggaacaggacacatgatccaggggactctcttccatgcctcctgacctgccctcctgatttcctctcctgcttgccaatctcctgggaccatcttctcgagcatctcctgcttcttggcgacctgccagcaccgttttttgtggttcggctccttcttgcccaaccaactcatgagctcccagattctgtcaggaattattccacctgactgtgtgagtgcagccgtcaacatgcctgtgtcaaatttgtacctgcaagtgcctcctacaactacctctctctgggcttctatttcgaccgcgatgatgtgcgttctggaaggcgtgatgccacttcttccgcgaattgtgccgagctgagaacgcgcgagcggctacgagcgtctcctgaagatgcaaacccagcggtgtcggccgcgctcgtctttccagtgacatctaagaagcccaggctgaaagatgaggtgggcgtcaaaccccagacgccatgaacagcttgtcatgtgcccttggtgatcaacaaagctgacaccaggccctttttggatcttcatgccagtggtgtctgcccgcaaggaccccccatctctgtgacctcctggcgagacctcaccttcctagataaggagttggaccttctcacgaagatgggtgaccgcttgccaacttcacaaggcttgatgcctggggttgggctgcgcgagttccttcgaaaggcccgtccagacgactcaagagc

SEQ ID NO: 489703 - DNA, 803 bp, Homo sapiens
gatgtcgtcatcaggatgagatctccaggcagcttaccagggcccttgataacgcttacctccgatctatcacttcacgatcctcttcttcacgatgaagcgaatcatcgtaaggaaaatggaagttgcaacccagcttcaggtgacttgcagctcgcaagtcctgtgtaccagatttcagaactcatagtttccacctcttccaatgtggcaccctttgcccagctttaagccaggaatgtatacgagcgaatggccatcagaatctactatcctcctcctgttccatttggcttatccaaattcagggaagatcatatttaccatatcgcccaattccagtgacatgggtacctcctcctggaatgcattgtgaccggaatcactggattaatcctcacatgttagcacctcactaacttcgtttttgattgtgttggtgtcatgttgagcaaaaggtagaagtaaaccgttatctacacagttaaaagttgaaagttcgtgtgacgtaatagtagtgaagttagatgggccaaacctatcagaactggtatttattatagaagttattgagaataatgtttccgtggaaaatagtatgcactgttagatagttgatatagtttgagaaatgttgtattaaagttagtcaagtgcctaagtttttaatattggacttgagtatttatatattgtgcatcaactctgttggataccgagaacatctgtagaagtggacgatttgttctagacctttgagaatctactttatggaacgtatgtaagttatttatatacaagga

SEQ ID NO: 489704 - DNA, 643 bp, Homo sapiens
aaagaaagtataaaatagtttatggcccttaaggcaggccttgttgaatttgaactatacttaccccaatgatagttctgtggtagtttgtttgaatatgtaatatgagaagcacgatggcaaacgataatcttcactgagctgatttacgagcgaccatcatctccacggtgcgaattaataagctgtggcgatgtgctgtagttgccctatcgcccctgcggagcttgcgtcaactagctctcccctttccccattgaagttagcgtattaccatcagttaatgattgataggctcatacgaagaagaaaaaaagccgggataagaaaccccgcctccacttttttggctcatccgaaaatttatccgcggagacatccacggagcacccgcaaaactgaagtaataactctaaattatatgccgctgagaaaaatctcgtacgaggatacggtaaataatccgtgcgagaaagtttttccgaaaatcattcccggtcaaaagcgtttctggtatataagcgattgggaaacccgtctataatacgtagtaacttacgatctgcctgtcaaattgtgtgcttgtccttgtactattaccattgtgtagcttatcttaaatctcaattaagttttaactcac

SEQ ID NO: 489705 - DNA, 942 bp, Homo sapiens
gaactccgcgcgcccgctgagactgtgtgcgtggagaggtctccccggtgcttcccatcaccaggtatccgacaccagttgggtcctctccggcatgccaaaaaagagtgccaaagaagtgcgcggcacctgggacaccaaggccgcccgggacaccggggtcccccgccggtgttttcccggcccccggcccattgcccgcggttggcccctattggggctccaaccccgggccacatgcagcaaatgtgcggcctgtaaggaaacgttgggtgcccccgccctgggaataaccgtgggaaaatggcccctaaatattctgcaaagatgttggggggaaaacccccccactgattgataaagggtccgaggcaaaccaaacgtgtgggttggagacgcgttctccaagcacaccacccgtgggggccgcccttgcccggttccagtaagtatgaaggaccaagacaaactcccggggggggtcatcaaaagcaagtgggccaacaaaaaggcggggtgggagagcgtggcgcaagggccaacaccaagtcgcggccccggaaacgtccagagaaggcgttaatgtgattatttaattccgccgaagtacgccgcgccacgccgccacttccgtagaacacttggtgggagaaaacgcgtgctcacaagactgtgttgttttgccaatggcacacttaaagttaaataacttataaaagactggggttaagagtgaacacaggcaggttcgtgtaaaccctgtcacagaaggaaaaggaggacaaatttttgtggagaccaccgcttggggttttctctttttgcgggtggccacatttaaaggtaattaagtgttaaaacaacaaacttttttatgggaaaaaatggccccaaaaattgtcccaaaaatttgggacccccttaaaaaagttaaccgaaaaa

SEQ ID NO: 489706 - DNA, 863 bp, Homo sapiens
gagtctcgccaactcctgggctcaatgtgattctcctgcttccacctccccacagtgctgggattacaggcatgagccaccacgcctggctctctgttcttttcagtgtctccgtgccatcagctcagcagtgcttacatgtatcagcatacttgtcatgcacgttcactcttctgttcccacgagactatctctggacaaaaaaattgaccacacagtacatgtgtctttccccacctatcccttacgaaacaccctaactgtgtactgctacttttaaaaccaaaaacgagaccgcgtgacgactgcgtaacgcactttgtcttagccttaccttatgtcttgatctgttaactgagaccaacatacctgcccacgacctcacccctacctctactacttgctgctgaccagacaactacaactttacgacttgcaccaacattctgaccaactactacactcagcctggtcttcttaccacgagctcggctgccgccactcttaacacaagcaccacgtttcacgccacgtccttacgacgcatccaagacgcccaccacgtctcttaccgcagccttacgtatggtgccgctgggctcaaacacctactcgcacccatttactttcaacatactcaagcatttgccagggggtatatacccagctggccgccagcacaacagcgcgggaacacagaagtgtgcaatggttgcccttccgtccaaggaacgacttaacatcgacccgttagacttcacaaacttggacgacataacgtacatactccggcattcctggcatctcacggacaatatgctaaaaagtgagtccagaacacacgtgctgtcccacacaccatc

SEQ ID NO: 489707 - DNA, 150 bp, Homo sapiens
ggctcggtacctgaacattcgtgtcctttgaaggatacttgaggagggacgggcggtgtgtacgcgcttcagggccctgttcaactaatgcgctctactctcagtttgagctgcgtaaactccacgcttcgacgccttgaatgtttcata

SEQ ID NO: 489708 - DNA, 1277 bp, Homo sapiens
atccttattgacacttatttcctgttctagttaatctgtcttatatcctatagatacgtccatcctaatggatgtgatgtgtaacttcattctttaatgtttctcttgttctctagagaaatactgaaactattacagatttttgagtttctcggaaggaacctaatgggctactgtcatttgtgccatgggtcatgcccgattgtgaactagtagatagttacctatgtgcatgtggtctagtgtttaatgtacacggtgttttgacgtaaatatattaagtcttgatatatccgtcatcatatgcatgattttctcatatgattgcattatccttatgtatcatattcttatctaggaaagcgcgcacgagatatgagtgatgttgtgcaagtggttcgtggggagacaaattcgttgtagccaataaagatgggctgttgtatctcaatctctatgtaaggtccttatctacaggcattatttccttatctcccttatgagtatactgcaagtagcatcgggcgtcctattatggcaccctcctataaacgattcggacaatcatatctatcaaccgttgttagagcgctgtccagtgccgagtcgcgctgtttatagatctgcggctaggaaaggagggcgtatcccacgtctggacggggcatgctacggtgaaggtaacaacttccccatgggagggtgtttctcaccaattctaccagctatttttttgaaacaaaagaggcttcaaccgcggagatctacttacacaacacaccccagccaacggtcgttgggaccgccacatatctcgcacatcactctgcggcgaacatttcgcacgaatgtacccaccaaccgacttacttaacgaatccctccggctgtagttaaaacatagtgcgcacccaacgtcaagtcagtacaaattgtctggcaccaacgcgcatctctcacatagttcgctcccttattgcgacacacacggcatatccgttttgtggcccttcccttaaggaaaaccttttcccaatttttgtaacaccgctaggagtataatttccccgccaacattcttcataagggaggtgaatacatgcgacagccaacttcctgcatttgagggagacacaaatcttgtgtcacagagttttctgtcgagcaacggttgcggccatatcccggaaacacaagttgtgtcttctctcaacaggacaaaatcttccccacgtgaaataacatttggctttctaccagctgagcgcgggcagaca

SEQ ID NO: 489709 - DNA, 275 bp, Homo sapiens
  misc_feature (6)..(6): n is a, c, g, or t
ggacgngcacgaaaggcctttaaactacctgtcctggaagtcctacctgatgtggctgggacaatctgcggaatgtggacagggggacgtgttatggagtttagttactccaactgctgtacaacagaggatggacatgctatcatccctgatgaaagcttcaccattccccagaaacagagcaacctgtagatgaactcagatatcctggaatcctgggcaaattaccatagtagcacctactactccatcaacacagaactctctcttttttc

SEQ ID NO: 489710 - DNA, 105 bp, Homo sapiens
ccggtacccatctgcgtccatcagtatgacagttgttcaagactagtaggttttgtttgtgtatctttttataacttattaaatggctgatgggagaagactgcg

SEQ ID NO: 489711 - DNA, 533 bp, Homo sapiens
attcgcggccgcgtcgactgaaacagcccaagggaatatcacccatgccgatctctttaccggagaggtaaggttgcgtcgccaaggcctgatccaccgtctgcaatacgtcgatgcaagcctggcgaccagcgttgatggtgtcccagttctgcttttcggcaggggtgcgaagtacgccccagaacacagtcctgaaagggtcggcgagggtcgaggtggtccagtccatccacttttcggcgttggcgcgggcttgcaggtcgctcgggtaccagttcgaatccggcgcatcttggcggccagatagcgcacgatggtgttggactcccagagcacaaagtcgccatcttcaatcatcggcacgcggccattggggttcagcgcgcggtattgcggcgtgtcgaccacaccaaaagccccgcccgcatcaattgcctcatagtccaggccgagctcctcggcgcaccacagtgctttcctgacgtttgacgaatttttacgaccccagattttcagcatgggccggcccg

SEQ ID NO: 489712 - DNA, 1307 bp, Homo sapiens
tgtgaggaattaacagtctttatggggctcaaaccaggagtccgggggtctggaggacctcggtgttatttggtcaattttcttctccaacgttcttctcggcctgtttccggtagcctcatgagctggtttcttcttccgggtaaggggatctatggctatatctctattcctctatctcctccagggtgggctggacactggcctgggaactatcacaggcacaacctcctggagacgccagggcggccccaagatagggcaaatcttatcctgtggtaggagcttacaagacggcaagagaccttggaggggcacgcagagaaccacacatacgcggctatattacctagggtccgcaagagggccggggggtatacgccgtacaacaagactctgtgagagaagagggtcccagaaaggagtgcctggggccctacgccctgggatctatggcgagggggccaggacatacacctgacggcaacgggttcccgggacaagaaaaagaagtagcgggctggggggggggccccctggagaacggggcgctatggggggccctccgggggagacagggggttgggcgcgtgtaaccacaccggaggtttgagcgaaggaacgagaaagggcccacgtgtgaacatgatcgacagctagggatgaacctggggaaacaaaacatgcgccacacagaaaacatgagcctacgacgcgccgtcaaacaacagagaggtgataaaagaaaccaccaaacaacactaatcccggaggcaccccacacgagagacaaccgatggtagcaaaaagccacacaatgcgggcccggcccaagggcggggccaccaagggaaagaatgggcccttaaaaaaaccaagcaaaagagcaacccagggacaccggtgagacaccatcgcgcgcaaaatcacaccctccgggggaccaggagcattcgggccgacgacaggaaggaacagcaacatcgcgtccggaaggagtatagtagagcaagacaaacagaaaacgaagaaatactaaggcagagaatacaataagagacacatatatatatgcacaagcacaagacagaggcagacaaagagaggagaccgacacagacagggaagcggagggagacagacagacgaaggaagcggaacagagaccaagagcacaatcacgagccgaaagggagcgacgaacatacgggaggaggccccgcgaagaaaacaaaacgaggaatggaaaagggagacggaccacggagggacaacccacgccggcgagaaagggagacgagggaaga

SEQ ID NO: 489713 - DNA, 252 bp, Homo sapiens
cgtgatgtatcccaacaccatccaggttcagcaccaaatgtaagaagtaaagaaagagaaaagaaacatgaaaagtggctcaacagtcaaagacaagtttattttggagaataaacctgagaggggcttctggacaatttttttttttttgggttaggagtgcttgcccctatggactaagagtttttatgggtttaagggtgagagagtttatcacaggcttggaatgtttctgtgtggggcgataacata

SEQ ID NO: 489714 - DNA, 380 bp, Homo sapiens
  misc_feature (31)..(31): n is a, c, g, or t
  misc_feature (34)..(34): n is a, c, g, or t
  misc_feature (244)..(244): n is a, c, g, or t
  misc_feature (281)..(281): n is a, c, g, or t
  misc_feature (323)..(323): n is a, c, g, or t
  misc_feature (327)..(327): n is a, c, g, or t
  misc_feature (358)..(358): n is a, c, g, or t
  misc_feature (360)..(360): n is a, c, g, or t
tcgtgccgaattcggcacgaggtttttttgnggnagtttctttctgtgtagcccgctgtcctggaacttgctatgcacctttagctcagtacgcctgcctctgcttccccagtgctgggattaaaggtgtgtgcttccaagcctgcctaagatactggtttaagcttttggatgcttattgtctgctgcattataaatccataggtgtaaattggaagagcttgttacattataaacacactgnccacattggaagcttctcaggtggtcatgcttgtgtngacaaaggcttagccttggaacttggagtggatcttccctgnccgntcttccgagtgcttaaattgtgggtgttgtncntttcatattactgggaaaaa

SEQ ID NO: 489715 - DNA, 880 bp, Homo sapiens
gagggagggagggaggccacgtcccgggcacgccagccagccagccccgcccccagattcgtctcgccccagtgggccgcctcggagtcgggtgggtcttccatcccggaggacccgatgtgctgatggggcaaccgccaacggttgtggcgttaaaacccaagccgcagccgtgtgctcgccgagctcccggagcttgggtgggggtgcccacgctgaaaggagagtgatggagtgcccagtgatggaaaacttgctcacttttttacctcagggaattagagaacttttgaaccagacaaaaggaatttcaaagactactaagtgtgaatgtttctcttggcttcacaaataaaaaaaaaatataaataattcttctattttcaaaatttcttttaaagcacaacaccaggcattagctcaggctcttagtagagaaaagagaattctcgaggaattacaagtgaaaagatgctatggcaaaaagaagtcgagacctggaatttggagaaccacatttttcgcctaaaggctaaatttacttggataaggaagcttatagacatagaaagctctcatgaacaataactttgataactgccactggcaatgggcagtctttcttgagtccatcagagtcctttctactgtcagtagccaagaagaacgaattcgtacaccgggccacgtggatgcgtctcccattgccgggtccctcacttccatgtgtgcacgctacgatacggcaaatggcggtggccctttatcaagattctgatttcccttgatacaaaaacttttaatagggatgccagggtttcagaacacccagtgtgtgtgatcacactttttggggtcccaacgcccaccatgacttcgg

SEQ ID NO: 489716 - DNA, 349 bp, Homo sapiens
tgagatggagtctcgctctgtcagccaggctggagtgcagtggcgtgatctcggctcactgcaacttccgcctcccaagtttaagcaattctcgtgcctcagcctcccaagtagctgggattacaggtgtgtgccaccacgcccagctagttgttgttttaagactgagtctcactccagcccgggctgagtgcaggtggtgtgatcttggctcactgtaacctccaccttctgggttcaagcaattctcctgtctcagcttcccgagtaactgggattacaggcacccgccaccacacccggctaatttttgtatttttggtagagacggggtttcgtcgacgcggcc

SEQ ID NO: 489717 - DNA, 165 bp, Homo sapiens
aatacattattagaaaatcattatttctgggtaacattttgatgcttaccattcgtgttatattttgtttgtctgcatgtctatatcaccagacagatgcttatcttctattacttcttaaacactaaaaattgtttgatgaatgaataaatgaacaagtaaatg

SEQ ID NO: 489718 - DNA, 381 bp, Homo sapiens
cactcctgacctcgtccaccctccttctcctcccaaagtgctgggattacatgcgtgagccaccgcgcctggccctggtgcccttttaaaaacaggaagagggagagagtgatcttgctctagcaacacatgagaagaggcaacgaaccaattggtgctgaaatggatagaggtagcacgagtgaaaactgaagcagaggcatcaggaagacgcatcctcagaagctgtaagacagcatggcgtgggagacggcccctctgtttcgtctcctcaagttccgtggcagactagtaagactgagtttgacaccttgggagagacacgtctgccaagtttgtcatccattaaattcacattaaatgataagagttgaccacaaa

SEQ ID NO: 489719 - DNA, 214 bp, Homo sapiens
ccgcgcatactctggcctctcgctctctgctagcggcgtgcactgcccacgtcaggcgtgagctctcgagatggccagagaagtgtggggctgggttgtgctgcagcaggggtggggtctcggcgttgggactcctggccagtggactttgccaaacagcctacaggggagtaggcacccggaatgtttgttctacgatctcggtgcagcaagg

SEQ ID NO: 489720 - DNA, 1740 bp, Homo sapiens
  misc_feature (887)..(887): n is a, c, g, or t
cggcaccagtgttgctctcctgggacgtcattctctgtttatgccaccttgtggggtcggcgatgtctatgtggttggctccaccctcatcatgtggggcactaccggctgctctttcttcaatctcgttttgttgcgggcgttttctcttttttctggtggggggtgggcggcggtgtggtatcacaggcatgtttgtctttccaccgtcagtgatttcctccctcgttggtggggatcacacccctccccacacgtggtggttgtcctctctctctgtactttatttgaccctcctctgtgcttcttgacttacaccccacctgatgtggggttccccccgctgattggtgtctccttgttctgcctcactcctcacatagtgtaggaccttggtgttggtgtatctaatgactggctctccacaccactgagcgctccctctctgctgtagggtgaagttgattctctcatcgtggggcgcccgttgtctcactcaccatggctatgaaggtggcattgtcttgagatgattccacctgcgtgtatataccacaccgatcgttggtgtgcgtacaccaatcctgtttgggtgcccacacgacacaccacctgctgggagccacccacgttcgtcttgtgttggtgcgtctcccacacaaccagaagggcttgtctatcctaacggggtcctcttccccccgcatctttgtgtggagtacctccccaccggcgtgtggggggtcggcgcccccccttgtggactacttcgttctgtgtgtttgtttttgtcggtctgtcggccccccctctttttccaccggcggggagtagatctgggctcccctcccccccctcggtgatatgggagggcacaacatcgtgtntcgccccctcgttttttctacccctcctcgttttcatcagccctcttctgtgagagggcccttcggttctttgcgagcactctctctctcccctcataggagtggttctccctctgcggtgggccgctctctctcagcgcgctgagattgttgtggcgccgcgcgggggtggtgtttgtggcgtcctcgggactacttctcttgtgtgtgttacagcacctcttttaccaccctctgttctcgccctcacagcacaggtccacgagagagagaggagagcgcccacagcgtggtcacagagggctctgagagatgtggtgcccactggccggtctcttagtagcacactctgtggccgcgatgcgcacatggtgcacaacattttattctgtgccccctctcgtgataaggggcgcacacagagagagagagagagaggagagagcgcacaacacccacacgtctggggtttcccctggagaccacatatgtgggtggtcgccacaccaccctcaccgcacatgatacgtctcttccacaagcactctcccacgacgccaccacacaatgtcacgcgagatatttgtggctgagaggagaccacgccctttatagtggatattggagttggatggagcttaaagttcacaagctactcttcctcgagagctcttcttctgcacagagattcccacagagcccaccagagagttgagatttgtgcgtgacacttctctggcccccactcttttacaggatttcctttttcctcccccccctcccagtgatttttagaggtagatttttttgaaactaaaattaaaaccccagttccccccccttgttttaaata

SEQ ID NO: 489721 - DNA, 629 bp, Homo sapiens
  misc_feature (367)..(368): n is a, c, g, or t
  misc_feature (377)..(377): n is a, c, g, or t
  misc_feature (412)..(412): n is a, c, g, or t
  misc_feature (425)..(425): n is a, c, g, or t
  misc_feature (437)..(437): n is a, c, g, or t
gctgatcaagaggatccccttcagcacattagtcaaactatcctgaatatgggaagggatgcacagactcgagttttccccaaacccaattgaatttactctggtaaatttggcaaagaaggtgccttataggtactttcagccattgggcttggggccccggggctgtgcaggaaagtacatcgccagggtgatgatgaaagccatcctcgtaacacttctgagacgattccacgtgaagacatggcagggacagggtgtggagagcatacagaagatacacgactggtcctggcacccagatgagactaaaaacatgcggggaatgatctttaccccaagaaactcagacaggtgtcgggaacannagagaaggngggtcagtacccactcgggagcatttctcatcagnagtcacatacaantcatccatcctngccaatagtgtcatcctcacagtgaacactcaggggcccagggcatttaataggcatacctcctatgggtggtcaccaagctaggtgctatgggtcatctgctcctggtcacaccagagaaccaggctacaagagaaaaagcggggccaagagtttgagggagaatagtcggtgaagaaccgtatccataag

SEQ ID NO: 489722 - DNA, 351 bp, Homo sapiens
  misc_feature (112)..(112): n is a, c, g, or t
ttgttttataaatagaataaataagttgtgatatggtcacgaatgatttgttgaagctacatcttattgtgaaatgtttttaatcagagtactacaactgatcagcttttgntgttttgtcttggctatatacttgtgactcataaagattatgttgcaaacaggataaatcccacatgcatttattttccagtgagttgtataaccttattttttgttaaaggttgtatgttaaatcaatgtaccattcttatatcacttcttagaaagaaagttcgattttgaaattgtatcatttcctcaaaatgaagggcagtgcttagttaaataaaagattgatgatatctttta

SEQ ID NO: 489723 - DNA, 735 bp, Homo sapiens
ggacgcgtgggtcgacgcatagtcgtgccgagattgcgtaggtcgtcaccacgcgtccggcttcctgagaattcccatattaataaagaagaaaattatctgccattttttcctacaataataatgctgaatcttaatttagagaggtacaagggtatggtaatgcttgtagaatctttattatctcaacaatctaaaacatgatgtatatttccatagattatgactagtgccacttaaatgccaatgaaacaagaatataacatttcaatagaaatttgtatttcattttcaattacttggtaaattcgtgtgtatttagtacactgattagtatagtaacatttctgctttgaatgcagatgcaatataatataatagattattaaaagtgaagttaactcttaacatagtaatctatagctatatatatacaaaatatattaaatataggagtatatgtgagtactataaacaacagatacataaatataccacatatacacctgatagtcaaaataaggtacagaaatgaaatatatgtcaattatgccgaaataatactctataatgtgacactcaaacatgtactacactaaggataaataacaataatgatgcaaaataaagtagaacacaacaaaaattacaaaataatagatatataaaacactaaaaaataaatcaaaaaaaaaacatatacatataaaaataatcacaaaaatcccagataac

SEQ ID NO: 489724 - DNA, 122 bp, Homo sapiens
agacgactccccctactgttctcgactcgtacgcccctactgacccgaccttacacgtacctttactaccacacactgtactaacacacgtgcgcacacctaccacgtatcctatcaccact

SEQ ID NO: 489725 - DNA, 1250 bp, Homo sapiens
tggtgtgttcttgggctttttatttcaaaattggcgagcaaaagacagagaagaaaaaaaaatcaagggaagcaccagggggtctgggcctggaagaacgggaagaagatccggagaatcgggggccaagggtggttatccttggaccggcacagacaagggatgtactgggcggggacctgagacacccgggagaacagaggggcgtctggggggcacaaagatagcctgggtgtcgggccctatacgggtctctaggggagatgtgtgtgccgaaacacaacattgggggggcgcacaagaagaccacaagacgccgcccgtgtgggcctctttatattatgcgcgtatatctgcgcgctctctcagaggtgagagtgtcacactggggagagggagagggcgacgatgtgcgctggcgctgtgcgacacagacagatggctcaccagggtgtacagggggagaggattctgggggaacgcaccacacgctctgggccggttttatacacacagcgcggggagaaaactaattgcacaacatgcggtgggggcactcccgggaaatttcacccgaacagcgggggaacttcttccccttatcaaaaacatcctcctatctctgggaaaaagcgcgcgagagaggtattcagctctccaaggggcccccaattttcacacagaggttgggggaatctcggtgggaaaacgacgtcaccacaggggaacatatcggggaacccagcgagacatcacggaggatcgcaaacttggggaggcaaaagaacactatggagccaaaaagccgagaggtctgccacggggaattcccacaaaaagaatttatcacccgagacaccagacgggcgaccacccttccctttaccacagggggggcagccccacaaccaccaaaaaactgggagcgcacacaacgagggagagaatccatgcaggcaggagcaaccacaaccatacacccgcgagggaaacatttacaacgccccacaagaggagtctctgtaggagacagtcacaaatagcgatcacaccgagtgccacacaaacctaccgtggagtcatggaacaccacacacacatcccaagaggagacaagggagaataaccaacccgaagcaagtcgcacgacgaggggggaaggaacacaaccaaagagagtatccagaggacacgccccaaccattctacggggagggtacccacgatagaacaaacaagacgagtgctgc

SEQ ID NO: 489726 - DNA, 787 bp, Homo sapiens
ggggcgctgggggcgctgcgtgccgctgcagcgccagttgtccacctggtcgtgtgcacctgtggaggaggaggtggatttcaggcttcccgtagactggaagaatctggctcaaaacctggcttgcctcgcagggtgctgatgctggatggcagctgaggccgcccgacgcatggcttcctggctgagacatggcatgggccaatggattggcacgccctgttgctgtgcatgtggccctgtgctgatggatgctgctgaaccctgcggcctgcagttcccatgtgctgtctgctgtggctgctgatgcactgcctgggaccgctgcggttgctgccgggtggcgggtggtgtggctgtgggccctcggccttttgcacaaaagtaggggacgcagggggctggggcgggcacaatttcgcgccaaatttgaccggcgcgttctgcttgtaacgatgctgggctcgagaggtcctcccgctgctgtcatggttggttcgctagaactgcatcgtcgctgtgtcccagaacatgggcatcggcaatgaacgggggacctgccctggcaccgtcaggaatgaattcacgatatttccagaggaattgaccacggactcttcagtagaagggtaaacagaatctggtgattatgggtaagaagacctggttcctccattcctgagaaaatcgacctttaaagggtagaattaattaagttctcagcggagaactccagaactccaaaaggagctcattttctttccagaagtctagatgatgccttaga

SEQ ID NO: 489727 - DNA, 263 bp, Homo sapiens
  misc_feature (192)..(193): n is a, c, g, or t
taagagaaaaaaagggaattttcaaggggggttggttgggaaaaaaaagtttttgaaaaggcaatttttgggggggggggggggcccaaaaaaccccacaacccaaaaggggccctatcttattttggggggggggaaggggttttttaaaaccccctaaaaaattaaccccggggtgaggaaaaaaaactnnaaaagaaaggaaaaaacctcccccccctattcccttggaaaacctttaaaaaaaaattttaaaatttttt

SEQ ID NO: 489728 - DNA, 980 bp, Homo sapiens
ttgctatcgaacaatgctcattattggtaaggctatcatagaattgtgtgtgttctgttcatgtttcactgatagtgaagctgaggtcaagacaatctagttgtgctgcatgaagagtctgtggtctttgcttgatcacgctataattcgatttcttgtcgcgaaagtcatagaatgtctccatgatcgatactggtgataatacgtagtacctctcattacgttcctgtctgactagttagatgagtcactgtcggatcatcagctcgaacttcaagtagcttggatcttcgaatttgctctccttgcgccttttactggaatctattgctgtcgagaattcattgcatgtgcatccaaggtagctgccagtatgtttgccgttactgtctttgcagatagcatgtttcactacatggcacggagtcatatgattatagccactgaggtctgtgtagcaatctacattgaaccgcggtagtcctgagagtaacactgcagacacagtcagctaaatagatacgaaagtgtctgggcattaatttcaccctatggtacctcggacactaagtcagactactgtcgctcagacaagtccaagttgatgacacagtgtctagtcatctcgatacgctgagtgcgttgtagacaccgacaggcaatgggatatcggccaggtgcatacgatgaatattgtcgctacactccggcagtcgtcgtatatctctacgcatctggtagacgtcggcatgtgtacatggtatgttatttcacagaagtggtatgtgcgcacatctgggagtttgttatatcctctcgtcgagcagtcattagcaggtctgcccgattcatctgcgcgttgtggcgcttacggaaatttccccgataatgttcgaatgtgctttaaggcatccatgttcaccttactgacgcagacataagaaccttaagattgcatgctgtaagttttaagttccggc

SEQ ID NO: 489729 - DNA, 196 bp, Homo sapiens
ataaagtcggttcattcaatggaatcatcagaggtctagattattgcatcattcatttgaacaccaatttgtcaaacatgatgtgtgtgagtgccagatggatcatcttttcatccaaatcgttcacattggggaaataatcatgaggagtttcccaaattaaatcatggggggggatgggattggcaaagggggg

SEQ ID NO: 489730 - DNA, 95 bp, Homo sapiens
ggagaccatcagctcatccaggaggcccttgtctttgacaacaagcacacgaactacacgatggagcacattcgtcttggatgggacctccttct

SEQ ID NO: 489731 - DNA, 330 bp, Homo sapiens
atgaaagcgacattacactaattccacagcaagtacaaccgaacatgaattcactattacaaacaacgatacactaacatactggcacacttgcgaggaactggatgcattcctagacatagacatatacaatctaccaagatcgaatcaggaagaaatacgaaacctgaacagactgatactgagtaaagacctttaatcagtactaaagtctcccaacaaatttttagtccgggacatggctggcttcactggcaaatactaccaaacactcatcagaagaactaacatcaatatctccccaactcattctacaaggccaaaattacc

SEQ ID NO: 489732 - DNA, 503 bp, Homo sapiens
  misc_feature (499)..(499): n is a, c, g, or t
aaatagtttctgggctatgcacccgatttttcctgtgatgcaggaagtcatgcctttactgtaaaacacgaaaaccaaatggaaggaaaaaatgggggacgaaaggagggtgactgaaaagatgaacaagaacgtccaacaactgccaccacgcaggtgtttctaaaatcactttataggtaactacaaacccgatcccaacgtttaccctaacacttcccctcccaggtcctcctcggtggtccgcccgcttggcacctcctccagctccccaggcccgggggttcgggcgggggcgggggagaggcggggcccgggacgttcccggcgtctgggctctctcctccggcgccaagcccagcacgccggcgcccagccgtcccgaccccgctagctgggcaaggccgagtcccaggtgccagctgtgggcccgggaactcgacagccgacttggcggcagtctcaagggaggcggcggcaggcgcctggcggaggcggncgca

SEQ ID NO: 489733 - DNA, 130 bp, Homo sapiens
gacgctctctctgttggggggttgactctctctggtggggtgtggttgcactaagcagctgtggggaagggggaggttgttgcgctcaggtgggagccatgggtcgtgtggcttgccagtcccacaagaa

SEQ ID NO: 489734 - DNA, 155 bp, Homo sapiens
gtatccccgggaatcttggtcatcactcgtaccatttctatccgtgaagttggcccttggtccgctcacaatcgagacagtgggcggctgacggccttctaacggtcttcttcttcatcgccggcctcgagctcaagcgagagttcgttgaggga

SEQ ID NO: 489735 - DNA, 549 bp, Homo sapiens
gggattggagtcatgtgagctggtggagctggcctgaatcccttggagggagtgtcgaggcgcacagcctctcgagaggctgagcatcaacaggactactacagtgactgggatcactacagctcgttttcaatatttaacaaagttgctcagagtctgtctggcaatggatgctggaagttggctgagtcactggggctgtctgccgcaccaactgcacagaacatgctatgtatcggcttggcttctcccagcatactgaatggacataagtcagaacgtttcaagagacaagagaacgcctcacattccttaaactgtggaccaggaagtggggagagggtcacttcaatcatactctattgcagccacaatgactttcaacaaatcggcgtagagggcatgtttaaaagctaccacaatattggacccaatgtttaagcattttatttcaaatcatttatatgcattggctcttcataattagtagctccacgacatttattaaatggaataaatgcaatctgctaggattaaagaaaaaaaaaa

SEQ ID NO: 489736 - DNA, 241 bp, Homo sapiens
tgctgcagagcagctcggtgttatgcttacaccttgcacagggctgaaacaggagaatggcccagccagccagtccctcctcctctgtctgcaatggttgtttgtttttgaggcagagtctcactctgtcacccaggctggagtgcagtggcacaatcagctcactgcaacttctgcctcccggattcaagcaattctcctgcctcagcctcctgagtagctgggattacaggtgcctgca

SEQ ID NO: 489737 - DNA, 129 bp, Homo sapiens
ccacaactccccaatctaactcaagcatttctttattctgacttcaactcaacaagcagagcttaactccttcagccggggacaatcaaaaatctgaagcaggacaatcggggagagagagatcactct

SEQ ID NO: 489738 - DNA, 347 bp, Homo sapiens
  misc_feature (1)..(1): n is a, c, g, or t
  misc_feature (12)..(13): n is a, c, g, or t
  misc_feature (49)..(49): n is a, c, g, or t
  misc_feature (206)..(206): n is a, c, g, or t
ngggggggttgnntgtggctgggaatcgagagaagactggagagagtanttgttgtgtattctgtaaacactgtctgcctagtgtgatgtgatatagtctaggcctcgcatgctgctgggacagaaaagacccgacattgcttcagaacccgttcagaacagactggctttttttacatggaactgaattaccacatgaacactgncatcttatctcatgaaagtaaagagaaccaagaccatttcacactctgatctgatatttcttgtctcgtctgttgagctgctctaacacatcttggcttgggaatggagtcaagctccaggggaaaggttaacaagtcatc

SEQ ID NO: 489739 - DNA, 841 bp, Homo sapiens
  misc_feature (59)..(59): n is a, c, g, or t
  misc_feature (98)..(99): n is a, c, g, or t
  misc_feature (122)..(122): n is a, c, g, or t
  misc_feature (130)..(130): n is a, c, g, or t
  misc_feature (153)..(153): n is a, c, g, or t
  misc_feature (158)..(158): n is a, c, g, or t
  misc_feature (170)..(170): n is a, c, g, or t
  misc_feature (172)..(172): n is a, c, g, or t
  misc_feature (174)..(174): n is a, c, g, or t
  misc_feature (177)..(178): n is a, c, g, or t
  misc_feature (188)..(188): n is a, c, g, or t
  misc_feature (201)..(202): n is a, c, g, or t
  misc_feature (206)..(206): n is a, c, g, or t
  misc_feature (211)..(211): n is a, c, g, or t
  misc_feature (215)..(215): n is a, c, g, or t
  misc_feature (217)..(217): n is a, c, g, or t
  misc_feature (224)..(224): n is a, c, g, or t
  misc_feature (235)..(235): n is a, c, g, or t
  misc_feature (258)..(259): n is a, c, g, or t
  misc_feature (263)..(265): n is a, c, g, or t
  misc_feature (281)..(281): n is a, c, g, or t
  misc_feature (283)..(283): n is a, c, g, or t
  misc_feature (295)..(295): n is a, c, g, or t
  misc_feature (305)..(305): n is a, c, g, or t
  misc_feature (318)..(318): n is a, c, g, or t
  misc_feature (324)..(324): n is a, c, g, or t
  misc_feature (331)..(331): n is a, c, g, or t
  misc_feature (352)..(352): n is a, c, g, or t
  misc_feature (370)..(370): n is a, c, g, or t
  misc_feature (372)..(372): n is a, c, g, or t
  misc_feature (454)..(454): n is a, c, g, or t
  misc_feature (465)..(465): n is a, c, g, or t
  misc_feature (496)..(496): n is a, c, g, or t
  misc_feature (697)..(697): n is a, c, g, or t
  misc_feature (720)..(720): n is a, c, g, or t
  misc_feature (724)..(724): n is a, c, g, or t
  misc_feature (766)..(766): n is a, c, g, or t
  misc_feature (772)..(772): n is a, c, g, or t
  misc_feature (830)..(830): n is a, c, g, or t
aagtttatttgttacctaagtagttttacagcataattctataatttgtcactaatggnagatttatctaagccatacaaaagtcgtttaatggaaanntcccagttatttaaacgttttcntataaggnacatgatgcacactatgggatcnatgcntcatcttcaaantntnggnnggtgtattantttctcatatttnntgtnttatntaantnttttttncaacctatcancttctgagattctgaagagttannattnnngtctaatgatgacaancngcctcacctatntctccccccngccaggccacccncctacnccccgcngactgagcccccctgactcangggcaggcctcgaccccncnacactggcctcatgcattactctaaatcaaagccttcgatatacatgactcaggatcaggaataacagagaagttctcagcnggctccatgtnctctctactgtacctgacaacagtataagcnacaactcaagtgaattaccggaccaaaattatgataacagaaaaactcattaaaagctctttaaagcaaaaatctcaacttaagtgaaaaatgtttaatattcttctttggaactgtaaatgacctttcatttaattttctaagattttaacctgaacttggacaagaaagaaagggaaaaggaaaaataatttgtattanatttgccttttcatatttcagtnagcncctagatgtttcagtaaataattcttactgccttttctccantgtgtncaaacatcacaaaatgcttaattatctacacgtatcaaactgtaaagcagccccagtnccaccatccgt

SEQ ID NO: 489740 - DNA, 407 bp, Homo sapiens
  misc_feature (39)..(39): n is a, c, g, or t
cctgggtcgtaaagaataggggcaagcacaggcacattnggggtcaattttgttaattttctctacttatctatcttatctatctatctatctatgtatctatctatctatcatctatctatctaaaaggagacaggatctcactctgttgcccaggctggagtgcagtggcatgatcacagctcacggcagcctcaaactcctgggcttaagcaatcctcctgccccagcctctggagtagctgggattgcaggtgtgcgccaccatgcccaggtaattgttgtatttttagtggagacagggtttcaccatgttggtcaggctggtttcaaactcctgacctcaaatgatctgcccacctcgacctcccaaagtgctgggattacaggtgcgagccaccgcacct

SEQ ID NO: 489741 - DNA, 1700 bp, Homo sapiens
tcaggctcctggaaaggaccgtccacccctccgcgctggcggatgtggacgcggaactcagcggagtaaacgcgattgagagcagtgtgtggattacactatcactggaaaaactacgaacttgacgcaacgaacggaaacagactggaacgactgcagacccttgcgttcctgattagatggaacacactgtacaggtcccagacaactggaacacacgaaaactgaaataaactcagcacgttatgacggcagagcactaagagaactatggacaacaatcaggtgactgatcccacgaaagtgaactcgacagggaagcaagagcactgcatgagatgcaagacgcaggcgggctctcctgcacggcaggcgacgctaccagccgcgagagacgataacagatggccactcgcaggcactcaccgcctgaccacccgcagtgacgacccccagacatacaaggacacacggacgaagacgagacaaacaacaacaacattccatgagcaccacacccaccctgccgcactcgcgctggactgcaaggcataacgcacgactgccgcgagcctagccatggcggaagataccatacgccgacgacaacaaaccacataatgagcgcgacacgacaccgcatgccactagaagcattacacaaccccagcacgcgcaccaacgcgagagccaccagaggactgaaaacgcaagataccatgtccagcgaacagacctacaccgggcaccacactaccgcggaaaacagcgaaacaccgaacacaacggagcaaaaaaaagcgaacagagaacaatgaaaccccaaggacacccgaccgaacaacacaaacacatcacagaactacacaccccaaacacgccagggatacgcaccacccaggccacggccaaatagacacgcgaacagcacccacctggcaacacagcgacactaacacaagagaacaccaccaacagcgacaaaccacaagccgcaacgcagccgcaaacctcggcgagcacaacccgagcccggcggcaccacaaactcacggaggaacacagaccaacacaacacgcacgcgagaccacgaaaaaccgcgcacaagacacccagcgaaccagccacggccccccgcccaccaccaccgacgaaacacaccacacacacgagccgaacgagacatcatgtccgccagacgagccacaacagcggacaatcgccaactgcacgccagcagacacatacaacacgacgcaccccaacgacgaaaagcggcgaaaacacaagcccaagcccaccatccacgacaaagacacaagaccaagatacacacgaaagaacgcgacggatgggacgggcaggccgcacgacggcgcccgtagaagggacgcgtgcaagcagtgcgcacagaccggagggcgacgacagcgggagggagagcagaaggcagacgagacggccacggagcggaagcagcacaagagagggacggcgtgaagaggcaaacagaccggagccagggaaggaaagcagccgcagatgacgcgagaaccgcgggggcggcgcagacgcgcggacgaccggacgcgcgagcgcgcagggagcgggcgcgaaggcgagacggagaggagacagacgaggcccagagccatcaccagccaacgaaaagggagagagacagcgagggagagagcga

SEQ ID NO: 489742 - DNA, 113 bp, Homo sapiens
tgtggatagacatgggccttcggcaggaagaaggagacatactttgcagttctgataaaacagctatgaatctggcaccactactccctctattgtccacgggtagcgggctg

SEQ ID NO: 489743 - DNA, 1196 bp, Homo sapiens
  misc_feature (43)..(44): n is a, c, g, or t
  misc_feature (48)..(48): n is a, c, g, or t
  misc_feature (50)..(52): n is a, c, g, or t
  misc_feature (57)..(58): n is a, c, g, or t
acaaaaaaaaacaacaaacacagaaggcaaaactagctaggtnnagcntnnnttttnntcggcggccgggaagatggcggacattcagactgagcgtgcctaccaaaagcagccgaccatctttcaaaacaagaagagggtcctgctgggagaaactggcaaggagaagctcccgcggtactacaagaacatcggtctgggcttcaagacacccaaggaggctattgagggcacctacattgacaagaaatgccccttcactggtaatgtgtccattcgagggcggatcctctctggcgtggtgaccaagatgaagatgcagaggaccattgtcatccgccgagactatctgcactacatccgcaagtacaaccgcttcgagaagcgccacaagaacatgtctgtacacctgtccccctgcttcagggacgtccagatcggtgacatcgtcacagtgggcgagtgccggcctctgagcaagacagtgcgcttcaacgtgctcaaggtcaccaaggctgccggcaccaagaagcagttccagaagttctgaggctggacatcggcccgctccccacaatgaaataaagttattttctcattcccagaaaaaaaaaaaaaaaaaaaaaaaaaacaaaaaaaaaaaaaaaaaaaaaaacaaaaagaaaaaaaaagagagcgagggaaacaaaacagaagagagacagggaacaacggcgcaacagagagacacgacaacaacaagaaagagacaacgagagggaacaataacgaggccacacataaagagcgaaacacaaaaccaaaaaacaacagatcaacagcgaaaaaataaagcggcgacaaagaacgagtacaagacaaaagacgaaagcgagagagaaaagagaaagaagtaaaaacaggcgagaaataaaatccagagcgaaagtggacgataaaacacaaaaaccaaaagagcagggaagaagagcgaaagagcacacaacaagacaagaggaggaaagcaggaaaacagaagaagaaggagacacagccggcgacacatacaacagccgacaacaacaccgcaaactcccgcgcgacacagacacaagacaaggaaaacaacagagaggcaggcgcagagaaagaaaaaagaagcagaaggagagaagagagaagaaggcaagcgggcccggcagacgagacaagagaaa

SEQ ID NO: 489744 - DNA, 246 bp, Homo sapiens
ctgtgtgtggaggttgcagactgctgtttatgaattgtggaggcgtcccacaataaggagtcttaagaaggagtattgtgctgcttgctcaagcgtgtgcttgactcctggaaactgcctgctccctctcccagaacagctagtttggggctggggagctcacgcgaaagaggtttccaggatgcagattaagtcatgcaggcctttaccggcgttgatgtggctcatgtttcaggcagacttggg

SEQ ID NO: 489745 - DNA, 1271 bp, Homo sapiens
tcgagatagagtctgtgctctgtcgcccaggctggagtgcagcggcacaatctgtggctcacgtgtgtgacctttggcctcccgggttcaaggggattctccgtgcctcagccgcccaagtagctgggacttacaggtatgcgtcaccacgccgtggcatacttctggagactttcaactagacgacagggctttcaccagtgttgggccagggctagctcatattaactcttattatttggagacgggagcctggactcggatcattccaggccggaagtgcagttggacacgactctggggcctcgataacaacccatcggacttccacaggggttcaagttgattactcccttggccttacagccgtcacttggagatacgcttggggttaaacagggggcgccgcgccaaccattgggcccagcttagaattctacggtcactcttacaaaggtacagacacacccggggcgttctcacccattggtgggcgacaaaggcctggggatcactcagaaggcatcctcatagaacgccttccagagtagaacatctggccaccggcactatcgcgggaccctattcgccccagatgcgaatacctgggggagactttacaaccattgtggccatattagagcgccccaacatcattttcggagcgggacataacttcaaaacctggcatcggggtgcaccccccaagaagatctatttgtgggccattacttataccaagaacgctcacaacttgttggcaacaatagacaaaacggtagggcccctatattaacaccagtatcgattcgacatgtatcacccacatctctatatacgatatccgtatggcacagaaaagcgggcatagcgtcatccctcaccaagaccagttccgcttgggtgtacccccccccccccgaagggtggcctctgcgcgacacgtagttcgcacacatgatatagtcacaggcggcccggaaacacttccaccagtgggccatcgaacagcggggacaaacgagcactagcccagcgacgccatcaccccaaaggaggctatttacacacagcgcaacaaatcttgcgtgtgccacactacaacaggacacttcacccccggaacagatacaacgccgcgtggggcgaacccctacaaacaggacgggacaagcccctacaacccaaaaaaacgaagagagcaccgtgtgcgacacaaaacattatactagcagggggacgagctgagctgacgaggatacagcacacca

SEQ ID NO: 489746 - DNA, 604 bp, Homo sapiens
  misc_feature (43)..(44): n is a, c, g, or t
  misc_feature (48)..(48): n is a, c, g, or t
  misc_feature (50)..(52): n is a, c, g, or t
  misc_feature (57)..(58): n is a, c, g, or t
acaaaaaaaaacaacaaacacagaaggcaaaactagctaggtnnagcntnnnttttnntcggcggccgggaagatggcggacattcagactgagcgtgcctaccaaaagcagccgaccatctttcaaaacaagaagagggtcctgctgggagaaactggcaaggagaagctcccgcggtactacaagaacatcggtctgggcttcaagacacccaaggaggctattgagggcacctacattgacaagaaatgccccttcactggtaatgtgtccattcgagggcggatcctctctggcgtggtgaccaagatgaagatgcagaggaccattgtcatccgccgagactatctgcactacatccgcaagtacaaccgcttcgagaagcgccacaagaacatgtctgtacacctgtccccctgcttcagggacgtccagatcggtgacatcgtcacagtgggcgagtgccggcctctgagcaagacagtgcgcttcaacgtgctcaaggtcaccaaggctgccggcaccaagaagcagttccagaagttctgaggctggacatcggcccgctccccacaatgaaataaagttattttctcattccca

SEQ ID NO: 489747 - DNA, 1232 bp, Homo sapiens
  misc_feature (43)..(44): n is a, c, g, or t
  misc_feature (48)..(48): n is a, c, g, or t
  misc_feature (50)..(52): n is a, c, g, or t
  misc_feature (57)..(58): n is a, c, g, or t
  misc_feature (506)..(506): n is a, c, g, or t
  misc_feature (514)..(514): n is a, c, g, or t
  misc_feature (517)..(517): n is a, c, g, or t
  misc_feature (521)..(521): n is a, c, g, or t
  misc_feature (529)..(529): n is a, c, g, or t
acaaaaaaaaacaacaaacacagaaggcaaaactagctaggtnnagcntnnnttttnntcggcggccgggaagatggcggacattcagactgagcgtgcctaccaaaagcagccgaccatctttcaaaacaagaagagggtcctgctgggagaaactggcaaggagaagctcccgcggtactacaagaacatcggtctgggcttcaagacacccaaggaggctattgagggcacctacattgacaagaaatgccccttcactggtaatgtgtccattcgagggcggatcctctctggcgtggtgaccaagatgaagatgcagaggaccattgtcatccgccgagactatctgcactacatccgcaagtacaaccgcttcgagaagcgccacaagaacatgtctgtacacctgtccccctgcttcagggacgtccagatcggtgacatcgtcacagtgggcgagtgccggcctctgagcaagacagtgcgcttcaacgtgctcaagntcaccaangcngccngcaccaanaagcagttccaggtcaccaaggctgccggcaccaagaagcagttccagaagttctgaggctggacatcggcccgctccccacaatgaaataaagttattttctcattcccagaaaaaaaaaaaaaaaaaaaaaaaaaacaaaaaaaaaaaaaaaaaaaaaaacaaaaagaaaaaaaaagagagcgagggaaacaaaacagaagagagacagggaacaacggcgcaacagagagacacgacaacaacaagaaagagacaacgagagggaacaataacgaggccacacataaagagcgaaacacaaaaccaaaaaacaacagatcaacagcgaaaaaataaagcggcgacaaagaacgagtacaagacaaaagacgaaagcgagagagaaaagagaaagaagtaaaaacaggcgagaaataaaatccagagcgaaagtggacgataaaacacaaaaaccaaaagagcagggaagaagagcgaaagagcacacaacaagacaagaggaggaaagcaggaaaacagaagaagaaggagacacagccggcgacacatacaacagccgacaacaacaccgcaaactcccgcgcgacacagacacaagacaaggaaaacaacagagaggcaggcgcagagaaagaaaaaagaagcagaaggagagaagagagaagaaggcaagcgggcccggcagacgagacaagagaaa

SEQ ID NO: 489748 - DNA, 971 bp, Homo sapiens
  misc_feature (43)..(44): n is a, c, g, or t
  misc_feature (48)..(48): n is a, c, g, or t
  misc_feature (50)..(52): n is a, c, g, or t
  misc_feature (57)..(58): n is a, c, g, or t
acaaaaaaaaacaacaaacacagaaggcaaaactagctaggtnnagcntnnnttttnntcggcggccgggaagatggcggacattcagactgagcgtgcctaccaaaagcagccgaccatctttcaaaacaagaagagggtcctgctgggagaaactggcaaggagaagctcccgcggtactacaagaacatcggtctgggcttcaagacacccaaggaggctattgagggcacctacattgacaagaaatgccccttcactggtaatgtgtccattcgagggcggatcctctctggcgtggtgaccaagatgaagatgcagaggaccattgtcatccgccgagactatctgcactacatccgcaagtacaaccgcttcgagaagcgccacaagaacatgtctgtacacctgtccccctgcttcagggacgtccagatcggtgacatcgtcacagtgggcgagtgccggcctctgagcaagacagtgcgcttcaacgtgctcaaggtcaccaatggactggcccggcaacacaaagacaagcaatgttaccatgaaagtaacatagagagatggacacatcggtgcccgaaataccacaacaaatgagaataaaagtttaatagtacctcaatacccccacaagcaaagcagaaaaacaaaacagaaaaacagggcaaatcaaatagataagggcaatggaagcagaaaacagagtggatactatgaaaagagcaatctggtgtagacacagcgaccacccagaccgaacgcagtgaccagcagaccaacaggtggcccaaatgcaggcgccgcccccaatatgagaggacgccgcgaacaaaaacgagaaaaactgcacagaggcaaaaacgggcaatacggatcagcgccaaaaggaaacagaccaaaccaacagcaccaaccaatcaagagcgctaaagaagaagcgcagcataacccgagaaaacca

SEQ ID NO: 489749 - DNA, 290 bp, Homo sapiens
tagtcaggctcggtacctgtcagacgctgaactatgtgcactacatccgcaagtacaaccgcttcgagaagcgccacaagaacatgtctgtacacctgtccccctgcttcagggacgtccagatcggtgacatcgtcacagtgggcgagtgccggcctctgagcaagacagtgcgcttcaacgtgctcaaggtcaccaaggctgccggcaccaagaagcagttccagaagttctgaggctggacatcggcccgctccccacaatgaaataaagttattttctcattccca

SEQ ID NO: 489750 - DNA, 270 bp, Homo sapiens
ggtttctaaggcacaagtagggtgggggacagtcaaatggtagcctggcctccctctctctttgatagaactgggtgctcctggctgggcttagcttgaaacacaagcgaaaaagaaagaagccattcttccccaaactccaagtggagacaccacagggagttcagcccccctcctaaagccaccatgcctccctccctgagcacagtgctcagtgaaaaggctagccagcctttccagaccctctccataggcagtgacgttcctcat

SEQ ID NO: 489751 - DNA, 1388 bp, Homo sapiens
taagaaaaatcttatatatctctcagaaaaaaaaaaacccccaaaaaccaaagagttttcccacccaaacgagggggagggcaaaggggaagagggggcgaggggttggtggaccactccagcgccgcgggccccagagcccgagggggtttggggccagccaccaaagaggggtatagtggggcatagagggcccccacaaaacaataaagcagggtagtggggagcgtgtgtatatgtggggagagcgaaagaggggcggtggcacaagccgggcggcgaagacgcggaagaacaggggaagagtgacaaaaacagcgaaggtccaccagcagggagaaaacagcccgagagagagcgaggcggcggacccatattcatcaaaaacaattctactctagggggagacacacaaaaacccccacggtggagaacccaactctctctctttggcgcacacaatactaaccagcgaaaaaagagagagaacgttggagcacgcaagctcatgcgcgggagaacagcgtaggacaaatttgagacaggcgtggtgagcgcgcccccacacgcagggagaggaacactgtgtgagaacaaaaaagaatctcccaggtgcaaaaaaatctcccacacatcctgtgaaccccatacaaggaatcccccggagaaatcacccgacaaaaatcttttatatgggcccccccaaaagagtgtggcatccaccccacaattataaaggtaacacacaagtgtgtaacgcgcgagtatatagtggccacacccgcagtgcaccccacgacatacaaccgtgagatgtaaaatggattggaaacaaacacggattccccccgggggacacagcggcgaccccaaagcaacgagacgggacaaaaacccccgaagaaagtacaaaaaaacaaggaggaccgaaaaccggggagtccctcggagacaggataggccaaaatacagagggcccccaaacacacatgatggtcgtgccgcgaaacgtccccacaaaaaactaaaaaaaagcggacggaatagcacgaggactcgacaccagacaccgctgcgaccgcagagggcacccacagcggagaccaagcggggaacagaaagcccccgaacgcgcggactttacaagagggcccgagaaaacaccctccggggccaggagcctacaaaaggactctctggtaacaatctgccaacaaagtttacaaaagcgggtagaacctcgcaaatcctatctcccgatatctcggaatcccaatacgacgatctatagcagcatatgctagcgcccctctgactaagcgacatgattgcattgtgtattgctgcagttttcttactttgtctacacctcaaagcaaccacgagca

SEQ ID NO: 489752 - DNA, 174 bp, Homo sapiens
tatactactggagaactctctgtgctagtaaccacgtactcctgatcaaatatcactctcctaggtgcaggactcaacatactagtcacagccctatactaccctctacatatttaccacaacgcaataggagctcactcacccaccacattaacaacataaaaccctcattca

SEQ ID NO: 489753 - DNA, 158 bp, Homo sapiens
  misc_feature (145)..(145): n is a, c, g, or t
tcggcgtaccatataggtgggacgatctcagaacttccccttggatgctgtgatctccagagactcgattagcttttatatttatgtagttgcaaatctggtaactcatggatacttccttggcttggtggcttggaagggcagntatcaaatatatg

SEQ ID NO: 489754 - DNA, 109 bp, Homo sapiens
gctcatgtctgcgcttctggcttctgcttcctgtctgcccagtgggggtgagggggatcctcttttcagactcacaaccctgtagtttatacactttccgcttcctgct

SEQ ID NO: 489755 - DNA, 605 bp, Homo sapiens
  misc_feature (1)..(1): n is a, c, g, or t
ntgagatagacggatatgcatctgtgctcgcaccatagctctagatacttgttcagtgctcattggcaggaagcacaatcctagcgttgacgtcacagtcaagttctccatgagtcgcatatgcctaggaagccatggataaaggctaagtgtacacacgtgtggccttgatgtctataggatctcagtattactgcctgtacgaccctagtacctacagtctgtgttcggaaagacctttatataggcatccaataggcactctgccagcacatttccgctaccttccatctgttatcagtttaagctctcgcttggactctttaagttggagcacattccccttcactgtgtcacctgccctacgagagggtagtgcagggcatgtagccagacataccgttgtagttggtagcattcagcatggagtggaggtgcgggctggtgcagtcctgagtcagaactctctcgctgtccagtcagccgtgctgctaggcaaggtgcatcgtggtatttcctcgaaagtcctgtagctcaggatcacagtctgctctcagaagtgcagcagcaattcctgcatggtcggcgatcacatcccagtgtag

SEQ ID NO: 489756 - DNA, 285 bp, Homo sapiens
gctataatccacatcagatcagaataccttaccagttacaaaacattataataaatcttgtcatatctatgtctgtaaacccattctttgttgatagcctccacatttatatgttttagtcattgtagctgtgtgtcttacctatgacattatttttatatcccttcatttgtggatcttaagatgttgcagaaggttcattcctgtaccccaatacagattcacttcctttagctgccttttctagcaccaatatgctttaaaaaaaaatgcgcaaacaacaag

SEQ ID NO: 489757 - DNA, 123 bp, Homo sapiens
aagggcaggattcagaaagacacgtacatagagaatagagaagctcatactccaggaaagcgccaggagctaggtcaccaagatacgagcacatacctaggaatagccctgtaagccacctgc

SEQ ID NO: 489758 - DNA, 900 bp, Homo sapiens
taaatcatgaggttatccgcggatatagcggtcgcatgctgtggtctagtattaaatattacacctagatgcggtcgatgcaaaactgtcgctctgttaatcatcgagtttcacacttgtggccgactatgcctttgatgtgggtgttgaagtctaggaggtgtaagttagctgttgtttcctttatgatcactgcaagattgctgatgcctgacatgcgaggatagagtgaaagggtgggaagtcattggaatgcgattgtaacacatcattactcctggtggttcatgcaattctcctgtggtaaatactccgtgagatcgctgggactatagggatatgcgataggagagcctaatttattgtatattataagttaggagagggtgtttgcaacatgtttgaccgggtgagtgggcctcgatctactatcacatcgtgaccacgaccgtgagttggtctcccaaatgtgcacggcggttcctggcgtgagacattggggcctgagatgatagggtcctttgcaaatcgatgaaagacactgagatagcccaaatttcaggcctaggtaacgcctaagaaatcggggaaccggaagattggcgcccgaagccaggcggagccaattcggtgcaacgtctgcccggcacggaagcggagcacgaactcgggcagcgcaccaaccgacttggagactcggaggttccgactgcccgtctacaccaccccccaaattgcgccgtccggcgccaaaaaacacgggatacacgggggcccgccgcccgaatgtggagaccacaacatacacaccaccgcgcagcggcaacacgagagggaacacaccgacaacagcccccccaacgaccccaccggcacacagccgcaacgccaggacgcaaa

SEQ ID NO: 489759 - DNA, 159 bp, Homo sapiens
cgaatgtccccttgaggctctgaaaatctgtccgaatagaaaagcttcgttgctgagcctctcgagaaaaagctggttgttgggaatcgcagtacgtgttttttttcgaattccttggcgttttccaccagtttttgaattactggagagattttttca

SEQ ID NO: 489760 - DNA, 103 bp, Homo sapiens
aagcagacaccaggcaagacgcgcgaaagcgggaagagactgttacctattggccatcggtgagcgaacgacgagcgcagcgaagctaggagcgaggaagcgg

SEQ ID NO: 489761 - DNA, 128 bp, Homo sapiens
  misc_feature (91)..(91): n is a, c, g, or t
tcgagctcgtaccgagatgggagactcccaggtttctgacttaagcaacttgtggctggtggtgccattcacagtggtggcgattcaaggnaaaggacttggtgtcgttggggagaaaagctttggtt

SEQ ID NO: 489762 - DNA, 423 bp, Homo sapiens
ctatgcctgcctcaaagggactgcgttatgcggaacacaaacgaggtcctggtacctcgaggctcttgcccaagtgtttctgagcgggcttgtgatatgcacgtggccgacatgctggttaaggtgaacgcacttatcaaggatcgggaaggttatgctcctgggacagaattccaccggtgcaacgagatgtctgaatactggaggactctgtggccgcaactttacctgtttccaggacaccctcccacatgatgtcacctccccatgatccacgccaagtggaagccactggaccacaggagagtgagagtttggaaggtgtccaaatttaatgtagacattatcttttggctctgaagaagcaaacatgactagagacgcacctgcgtgcagtgtccagaagcgggctgtgcgttcccc

SEQ ID NO: 489763 - DNA, 107 bp, Homo sapiens
gcgtcccatcaggggattttatacattgacctcttgtggttataaaatagcagtgaacgacgtgtcacaaatgacgctggtttgatgggactgatgggagaagactg

SEQ ID NO: 489764 - DNA, 192 bp, Homo sapiens
ggtcatccaaggattagtgttcctttgtttagagggggtatactggtggctccccggcatgacccctcaaaaacgaaggggagatgttgcaatgagccatgggagcgccagactggcaaggcttctttggcagtctgagaacctcaggtcccccagtgcctggcggtgctggccgggcaggagcgggctgac

SEQ ID NO: 489765 - DNA, 161 bp, Homo sapiens
gtttcaccgtgttagccaggatgtctcgatctcctgacctcgtgatctgcccgccttggctcccaaattgctgggattacaggtgtgagccaccgtgcccagccgcttctttaagtcaagtaaacatgctgagattcaagcccttttcttcctccagtctc

SEQ ID NO: 489766 - DNA, 100 bp, Homo sapiens
gatccaggcgagtcttacacacaggaaacaagtgtctgcaaagcccaggggtgtgtttccctctgcgtacagtgttatctgagtaactatctagaaaata

SEQ ID NO: 489767 - DNA, 136 bp, Homo sapiens
gtgaggagctgtacagcatacctaacaggcagatccctaacaggacgctcctaaccagacaggaaacttttgacgctgggctgcaggccttccagcaggaaggcattgccaacatcactggcctccaaagatcagc

SEQ ID NO: 489768 - DNA, 526 bp, Homo sapiens
ccatgtgggccaggcgtggtcctgaactcctgacctcaggtgatccacccacctcggctcccaaaaggctgggattacaggtgtgatccaccgcgcccaggcgggttgcccatttttatagttatttctggatagtatgctaaccaaggggtggattattcatgcctcccctttttagacaatatagggtaactttctgacgttgccatggcattggtaaactgtcatagtgctggtgggagtgtagcagtgaggacaaccagaggttactctcgtggccatcttgattggggtgggttttagccggcttctttactgtaacccgtttggtcagcaaggtctttatgacctgtaccttgtgctgacctcctgtctcatcctgtgacttagaatgccttaaccatctgggaatgcagcccactaggtttcagccttattttacccagctcctattcaagatggaatggctctggttcatacgcctctgacgcttggaaggggtgtgggtgtcagctcgcccatggga

SEQ ID NO: 489769 - DNA, 322 bp, Homo sapiens
ttaatccctttggccctccccctatcctttttttttcaaacctgggtgaggggacccacccttttcccctgaaagtggccgatgccaagggtgagagtgaccccgaccggccccctgtggggggtgaaacctggggggttcctttagtgatgggggtgggtagaattgctgaatccgcccatcaaggcctttttcctggggtccccttccccggggatgggcagagcccgatgggatggcccgcttttaaaataatcgggaaacccccatgccctgggctggcttttttaattttttaataaaatggccttttttccaatta

SEQ ID NO: 489770 - DNA, 351 bp, Homo sapiens
  misc_feature (216)..(216): n is a, c, g, or t
  misc_feature (240)..(240): n is a, c, g, or t
agaaatgataggaataagagtgagctgttttaaaaagcttattaaaatgaatttaaggctaggtgtagtgggttatatttataattttaatactttgggaggttaaggaaggaggattgtttgaggtcaggagtttgagactggcttaggtagcaaagtgagaccctgtctttgaaaaaatagacaaaattagctgggggtggtggagtcactacntgtagtcctagttacttggtaggntgaggtgggagcatcacttgagcccaggaggtcgaggatgcagtgagcgaagttcgcaccactgaactccagcctgggtgacagagccagaacctgtctcaaaaaaaaaaa

SEQ ID NO: 489771 - DNA, 133 bp, Homo sapiens
agatggccgtttctagaggctccacctcatgggcgagctgtgcgaggagaaaaaagatgaaggttctcctaaattttacgacacataagagaaatatcaattaaatataacttgtgggcttagaatcataatt

SEQ ID NO: 489772 - DNA, 416 bp, Homo sapiens
aaccccacgatcactggggacaggagaaactttgcccaagatgacccctgtgtggggcagctgagcagccgtggagcctcagggagcagcacggtctgaggtggcacagctggtgaaagaatgatgctcgagttgctgcaactgaagctctgccccaggggtgcttggagatttcgaagggatgcattctgagccgagaatgtccactttgctgccgtgggggaaggacacattgtactccaccgccctgtagctcaggtagactaccttctgctgccggtcctgcattcctcctccgctgcggtgtccataggggaatgagagacgcaggtggggatgggcaccctcactgcttccctggaccttggtttcgttggggttccgtgcagagatgcccctggcctctcctcctccct

SEQ ID NO: 489773 - DNA, 466 bp, Homo sapiens
  misc_feature (173)..(173): n is a, c, g, or t
  misc_feature (181)..(181): n is a, c, g, or t
  misc_feature (209)..(209): n is a, c, g, or t
  misc_feature (212)..(212): n is a, c, g, or t
  misc_feature (221)..(221): n is a, c, g, or t
  misc_feature (252)..(252): n is a, c, g, or t
gtgtctagaatcctttggggcctttccccgatcatcctctggcaatatgcctgtatctctgtgaaagctacatgaacagttctgtagcagagatcacaatgttgttgagcagcaacagatggtgaaatgtgacctcgccatgtaaatacatggttgctgctgttgtaccgtgntgacgtgnttcccaaagatgtcaatgctgccattgncancatcaagancaagcgtaccatccagtttgtggattggtgncccactggcttcaaggttggcatcaactaccagcctcccactgtggtgcctggtggagacctggccaaggtacagagagctgtgtgcatgctgagcaacaccacagccattgctgaggcctgggctcgcctggagcacaagtttgacctgatgtatgccaaacgtggctttgtgcactgggacgttggggaggggatggaggaaggtgagtttt

SEQ ID NO: 489774 - DNA, 550 bp, Homo sapiens
gaactcctgaagttgtacttgtgtataattgcccgcgtcgtgcatagcgcaaagaacggattaggctgttttcttcttgtaaagctactgtatgcctcagctactgagtgtaaggtgtgtcaggctctagttgtacgaacgcaatacttgtccgagttttgcttgcatcgcttttctccggtgtttgtactacacacctcgtgcattgtggaactccgatgacagaaaacggtgccatccctgaaccacggcttggccactggcgtatacttgctggacaaccgcaacgaagcgaattataacgactaagatccttgggctactggtgtttagatcgttatcgttcccttcttctaacgttgcccttttttcctggttgtgggttaacttggcgttttcatcttgttgttgtcacgagtttaaaccggaactcgcaagctttcttgtcatttacttttgccggttgcggtctgtcaaattggccccttgccctgcgttttaaagtactataagcttgccttgggttgcgtcccctatcttgcgacttatg

SEQ ID NO: 489775 - DNA, 1477 bp, Homo sapiens
gtgctagtgatgaccaatatctgctgcgacggtgtcagagaccgattttaccactcggcgtgttctagaccaccttagaggctaggaatattccgcggcggccccacctattacaggagctactctgttggggcaccaagcggcgccccccaaagtgggtacaagggtccttttgattctccggaacacacgtggtggtgtccccacggggcataatagactcttcacccaccacagggggttgcttgctatgggcattccaaagcacttgtaggaagtcgtttgccccccgaccaagcccccccctggggggggctcctaacacatagttcccatccgaggccgttgtgtccatgggaacctactcaaaccctgcgggtttaacaaatcctccacggggcatataggtttcctgtaaagcaccttgttggggcctttttcccccctcgggagacaacgtgttcccccacttgatggggccaaatagaactctggagaggaaggccttttcttacacagttgtgaagaaaggtcaacacacgggggggaccccacacccatgttacgtggcttctccccccccgtaccccacagtgttccccgcgaaattggaaggggaaggaatcccgaagaagggggctttttcccgccctatatttctcggctgtgccacaggggaatattccaccacatttgcgcgcttccaacagttgacctttaaataccccaccagcgcccccaattttcgcggggaaaggcccacaacggagtttgatacaggagagattttcaccaagggagatgaaagcttctttttggcaccttttcctgagagacagcgctctataggacacactaactcttgttgaaaagacacaaaccccccttagggggagcctctccacgcccttgttctgtgcgcgccacttgagccccccacccctctgtgacacaccccccccacatctggggtgagaagccccccaccctcggggcccatagtgttcctcgaactaccctgggtgttcctctcctggctgtctcccctggggccttgggtagccgcctcttcacccaagataggccggaaagagaagctctgttctttcctttcttttaagggaagggctccaagagaggccacaagtcccacgagaaccccactggcgcacagctttcaaagcacccaaaggaaaagagaaattcacagagacccaccacgccacaagaccctccctcgagagggtttgttgggccttcttctggagagctgagagcaccacttgtggagcaccacggcttacacccctcttcgtggaacacggcgaggcttctggtgcttaactgcaccacgcctgagacacgaacacgtttctcggggccggcacgtgctgggcccttttaagctcccttggcacactttcccagctggcattttgccccttgaccaccagaataaaaattttagctgccccca

SEQ ID NO: 489776 - DNA, 262 bp, Homo sapiens
ccgtctgatagtcagacgagaagaccatgtcgtctctaaaaactctcaggctgggacagtgactcacgctatatactcccagcacttagggaggctgaggcaggcgtatcacttgaggccaggagttcaaaaccaggctgattaacatggcaaaaccccatctctaccagaaatacaaaaaattagcttggcgtgctagttgggcgcctgtagtcccagcagcttggtaggctgaggctggagaatggtgtgaaccctggag

SEQ ID NO: 489777 - DNA, 104 bp, Homo sapiens
  misc_feature (35)..(35): n is a, c, g, or t
  misc_feature (73)..(73): n is a, c, g, or t
  misc_feature (82)..(82): n is a, c, g, or t
tggtctcaatctgctcgacgttacccgaccacttnatcaacaacatcggcatcgttggggttgccctgctcgnatgcctcgngattttctgtgcgctgcggaag

SEQ ID NO: 489778 - DNA, 618 bp, Homo sapiens
  misc_feature (598)..(598): n is a, c, g, or t
ctagaggatccgccaggtagatttaattaaacgtaaaaagcttctgcacagcagagtaaacagaaaacctacagaatgggtgaaaatattgcaaactgtgcatctgacaaaggactaacatccagaatctacaaggaactcaaacaattcaaaaagaaaaaaagaacccctttaaaaagagggcaaaggacatgaacagacatttctctaaagacatacaaatggccaacaagcatatgtaaaaatgttccacatccctaatcatcagagaaaggcaaattaaaaccatgagacaccatcttatacccactggaatggcaattattaaaaagtcaaaaagcaaaagatgttggcaagaacgtagaaaaacgggaatgcttacatacactggtgggaatgtaaattaggatgtcctctatggaaaacagtatagagatctatcaaggaactaaaaatagaactaccattccatccagcaatcccactactgaatatatacttgaaggaaaaaaatcatcagaaagacacctgcactcatatgtttatcacagcactatccataatggcaaagatatggaataaacctaagtgtcatcantggatgatggataacaaaaa

SEQ ID NO: 489779 - DNA, 150 bp, Homo sapiens
gcactctgcctgataaagcatatgtgtatgttctaatactttacactttaagtggggtaggagggaggcttacaaaggaagtggctgctggtcccggcagggagcgatgagcgtccaagaaattgtgcgaagggcttataattgtgagca

SEQ ID NO: 489780 - DNA, 417 bp, Homo sapiens
  misc_feature (95)..(95): n is a, c, g, or t
  misc_feature (118)..(118): n is a, c, g, or t
  misc_feature (211)..(211): n is a, c, g, or t
  misc_feature (227)..(227): n is a, c, g, or t
  misc_feature (238)..(238): n is a, c, g, or t
  misc_feature (241)..(241): n is a, c, g, or t
  misc_feature (254)..(254): n is a, c, g, or t
  misc_feature (293)..(293): n is a, c, g, or t
  misc_feature (319)..(320): n is a, c, g, or t
  misc_feature (369)..(369): n is a, c, g, or t
  misc_feature (392)..(392): n is a, c, g, or t
  misc_feature (401)..(401): n is a, c, g, or t
tggagcccccccatggcttttttccaaggccggcccccaaacaggagccctttttttgaggtgcttttctggcgctatcctggcagcctcatccntaaggccctcggtttgttggggntggggccccccagagttcccccctaccctgcaaccccaggtggggacataatggagctttgagtggtggtggacagtgcccctccccccttcntttttccccccaacanaaaagaccagngantcccgcaaagggncaaggttcctccctttcctgcaaagtagggatttgggcnccaagaccttccctcaacaaaggacnntgagcccaacggagttttgggatgggaggggtgggagcatgggaagggnggcatcccccccccaaaaagaantgaataaanattgttgagcaaagga

SEQ ID NO: 489781 - DNA, 263 bp, Homo sapiens
aagggaaggggttgcctcaaaagtcacagcttagttgggcacagtggctcatgccgataatcccagcaattcagaaagctgaggcaggaggattacttgaggccagactgggcaatatagcaagaccccatctctaaaaaataggcatggtggtgcatgcctgtattcccagctactcaggaggttgaggtgggaggatcacttgagcccagaagttcaaggctgcaatgagccatgattacaccacggcactacaaccttgg

SEQ ID NO: 489782 - DNA, 308 bp, Homo sapiens
accaggcgagcgtccagacaggcgcagccacgggtctgaccagtgtcctagccatcggctgtgcttgtcattcagggagctcgattgatttgtagtatttcttctatttattctcacagcatactaagatgctaagaactgcttttgaaacagattcatgacatattaagatccacttttttcaagactaatcaagctctgagtttggcataggctcccagttccctctcatccttctctctgttcctgccactttgacatggcttgtttggcagacggactggcaagagcgtgggagtgatggcagg

SEQ ID NO: 489783 - DNA, 627 bp, Homo sapiens
aaaaaaaaaaaaaaaaaaaaaaaaaaaaaaaaaaaaaaaaaaaaaaaaaaaaaaaaaaaaaaaaaaaaaaaaaaaaaaaaaaaaagagagggggggcgcgccctaaaaattctctctctctctcggagggggccccatttccgcgctcccccacatttttttaaaaaaggggcgcctcattaatatgggatgtgttattatattatgaaaataaaggaggggtgggtgcgtatgttattataaaaacgaaatagtaggtggagggagaacaaatagtggcgcagcgatgggagactattgatggatagaaaagaagccatcttatatatgtgtggcgggcgggaggaacaaataagttgtggtggaaacatcattcttgtgtaggaagaatagttatatatagcagcagaattatagtgggaagagatatatataatattaatattatttaggaaggagagtgtatatatgtgggtgatgaaaaaaaaatcgcgtggatgtatattgtgtgatagtggtagcggagaagaaaaatattgtggagtcatattgagtgagattatattatttatttttatatacattattttttattatcgcgggggcgctaatgatataataatcggc

SEQ ID NO: 489784 - DNA, 123 bp, Homo sapiens
tccacgttctggcgacggtacgtcttactacctcactcaccccacctcgtgccgaccacccttttacacgtggacacctcctccacacggcacttctacaacacgactgttacacacacccta

SEQ ID NO: 489785 - DNA, 719 bp, Homo sapiens
  misc_feature (22)..(22): n is a, c, g, or t
  misc_feature (89)..(89): n is a, c, g, or t
  misc_feature (144)..(144): n is a, c, g, or t
  misc_feature (146)..(146): n is a, c, g, or t
  misc_feature (175)..(175): n is a, c, g, or t
  misc_feature (179)..(179): n is a, c, g, or t
  misc_feature (273)..(279): n is a, c, g, or t
  misc_feature (281)..(281): n is a, c, g, or t
  misc_feature (284)..(284): n is a, c, g, or t
  misc_feature (286)..(288): n is a, c, g, or t
  misc_feature (295)..(295): n is a, c, g, or t
  misc_feature (309)..(309): n is a, c, g, or t
  misc_feature (321)..(321): n is a, c, g, or t
  misc_feature (333)..(333): n is a, c, g, or t
  misc_feature (336)..(337): n is a, c, g, or t
  misc_feature (352)..(352): n is a, c, g, or t
  misc_feature (367)..(368): n is a, c, g, or t
  misc_feature (378)..(378): n is a, c, g, or t
  misc_feature (385)..(385): n is a, c, g, or t
  misc_feature (394)..(394): n is a, c, g, or t
  misc_feature (396)..(397): n is a, c, g, or t
  misc_feature (408)..(408): n is a, c, g, or t
  misc_feature (411)..(411): n is a, c, g, or t
  misc_feature (413)..(413): n is a, c, g, or t
  misc_feature (415)..(415): n is a, c, g, or t
  misc_feature (421)..(421): n is a, c, g, or t
  misc_feature (426)..(426): n is a, c, g, or t
  misc_feature (452)..(452): n is a, c, g, or t
  misc_feature (461)..(461): n is a, c, g, or t
  misc_feature (480)..(480): n is a, c, g, or t
  misc_feature (487)..(487): n is a, c, g, or t
  misc_feature (538)..(538): n is a, c, g, or t
  misc_feature (564)..(564): n is a, c, g, or t
  misc_feature (570)..(570): n is a, c, g, or t
  misc_feature (630)..(630): n is a, c, g, or t
  misc_feature (639)..(639): n is a, c, g, or t
  misc_feature (671)..(671): n is a, c, g, or t
cgccaaggcaagaaaatttttntagccttgggcctatcaggaatagcacaaaaaaggaaaaattaaggagcaaacacaaatgagaggancaaaattgggaaaaaaaaaaaaaaaaaaaaaaaaaaaaaaaaggggggagacaanangggaaaaacggaggaaggaaaggcaagcngccncctacccgcctggctgcagagagcggggacagaggccaagaggggcccaccagtcgccccccagcccagccagccaccctgagcaggccgggcnnnnnnngnggncnnngggacanccgtccggcccggnagacgggaacangggccactcccngannacaggaagccggacngtatgccaatctcannaagactaccnactaacncccccaatncnnaaataaacaanaanananaaatanctccnccataataaaactctcatggaaaaanggaaggccnggggcctcgagccgcctgncttcccngcatcacacgtcatcaaactacaaactcacgaggaagtcggcagccaaganctcacttcactcacacgcgaaacacncctggntgaccaggctctctgggaagcccagggccttcaacctctctatagcttctttctcctgcngcgtcaccnggatgtagtacaactgcagggcctcctctccnatggagcccacctccccctccacatctgaaaagtccgccagcacccca

SEQ ID NO: 489786 - DNA, 483 bp, Homo sapiens
  misc_feature (21)..(21): n is a, c, g, or t
  misc_feature (46)..(46): n is a, c, g, or t
  misc_feature (129)..(129): n is a, c, g, or t
  misc_feature (149)..(149): n is a, c, g, or t
  misc_feature (201)..(201): n is a, c, g, or t
  misc_feature (204)..(204): n is a, c, g, or t
  misc_feature (237)..(237): n is a, c, g, or t
  misc_feature (322)..(322): n is a, c, g, or t
  misc_feature (333)..(333): n is a, c, g, or t
attgtgggttctccccagatngatatttatgttagtaagattgagnccggtaaaagctttccacatcctcacattgtagggttttctccagatgaatatcttatgttagtaaggttgaggaccagtaangccttaccacatcttcacantgtaagaaactctctagtatgaatttcttatgttgagtaattgtgaagcatnccnaatgatttgcccggtttttacatttgaaaggtntctttccagtatgtcttatcttatttctatttacatttggaaatttatgaaagactttcacatatttatcacactgaaaatcttnctgtcagtagntgtcaaacactggtaagtccattataacctcctttgtacaccttacatgcatccacacttttatggtcttttcttagctgtaaattctcatgtccatattttccatatgttctcagtatcactttttgctcgtgccgaattcctgcagcc

SEQ ID NO: 489787 - DNA, 96 bp, Homo sapiens
agcggaggcagatttgcctgctgagggtggagacccacgagcggaggcctcctgcagtgttccgcacagcaaaccgcacgctatggctgacagccg

SEQ ID NO: 489788 - DNA, 787 bp, Homo sapiens
taggactattctctacaaaccacaaagacattggaacacgataccgtattattcggcgcatgagctggagtccgtagcgcacagcatctaagcctccttattcgagccgagctgggccagaccaggcaacacttctagagtaacagaccacatctacaacgattatcgttcacagcccatgcatttgtaataattcttcttcatagtaatacccatcataatcggaggctttggcaactgactagttcccctaataatcggtgcccccgaatatgtgcgtttcgccctgtcataaacaactataagcttctgactcttacgcttccctctctcctactcctgctcgcatctgctatagtggatggccggagcaggaactacgtgttgaatcagtcataccctcccttagcatggaactactcgcagcctgtgagcgctccgtagacctaacgcatcttctccttacacctaggcaggtgtctcctctagtcttaggggccatcagattgtcatcagcaacaattatcaagtatagaaaccgcccgtgagcatatcccgagataccaaaacgcccctcttcggtctgatccgtcctaatcagcagagagtccctacttctccgtatactctatccagtcactagactgctggcatcacctatactactagcagaccgtgacctcaacaacaacttcttcgaccccgacggaggaggagaccccatgtctataccaacagcctatagtgatttaccggtcacctgaagtttatattgcttatcctaaca

SEQ ID NO: 489789 - DNA, 257 bp, Homo sapiens
gggtgtctatggggctctcaccaaagccccagtgcccggagcccagaactccagccagagcagaagagatgtccaggctacagacacgagtattgaagaactgggtagagtcaagctcagttagtagagatgactcggccagggagtctaggggccgggagctgctctcaaaaaagattctggttccatctcccggccaaattttagtttttatttttttatttgaacttactaatcatgtaataaagtgaccagtg

SEQ ID NO: 489790 - DNA, 139 bp, Homo sapiens
  misc_feature (8)..(8): n is a, c, g, or t
  misc_feature (40)..(40): n is a, c, g, or t
  misc_feature (81)..(81): n is a, c, g, or t
  misc_feature (94)..(94): n is a, c, g, or t
ggatcacntgagcccagagttccagaccagcctgggtatnatggaggcccctcttacaaaaacgaaaaagccaggcatggngttgcaacgactngaaggctgaggtgggaggatcacctaacccagggaggttgaggct

SEQ ID NO: 489791 - DNA, 161 bp, Homo sapiens
tcggacaaagggggaaggccccccaaagggggaaggacccacaaagggggaaggacccacaaaagggaaagggcccacaaagggggacggccacaataagggggatggacccaccaagggggaaggcaccccaaaaggggatggaccccaaaagggggagg

SEQ ID NO: 489792 - DNA, 1458 bp, Homo sapiens
cgtggtggtgggtgcctgtaatcttagctaatcgggaggctgaggcagggagaaattgcttgaacccgggaggcgcgaggtgtgcagtgagccgagattgcgccattgtagctccggactgcgggaacagcgagtgaaacatcctctcgacgacatagcacgtagtaaacctgtatactcatcgtaacttgttgtgcgtacctttcgggacgtacaagacactgtgatgcacagcattgccgtggcggacgcctgggcccccaactcgaggtagcgtgagcactcgggccgaaaacgcgagggaccaaaagggcaaccccggtcgcgaccacccagaacaggggtgaggcctcaatctaccccgatcgaagagccgacccgcgggcagcggcgacgtaacacgaggcagaatgtgttcggctaaaccaccaagcacgcaataacaatcgagtcaacagagcccaagcaaccggacttccgtcaacacgcgagagcccagctcagatacaaccacaaggtgcgcctcggcctcaacccggagccgaaccgcaagcaagtgagtccgcccagtagccccccacgcacgagacacacgcgagggccacgcaacacagaacacaccaggccgcgaacatgagcacgggccaccccccaaaagcagaccaacccccacgaagagaaggcgagaaacacccggatcttctccgaaccccagacgtaacggcgcactagtgcgtccctcctgggggacccgcaggcacctacaaagcccacacccccctcaactccacgccgcccagcaacagcaggacccaccagccacccgcaggcaaaacaccggcccaaccggcaccaaagagaacaggcccacaacaccaccgaccaacccctgcgctcacccacgcaaaggacccgtcgcacgcacacaccggaggcctcacggctaaaccaaggcggccactggtccacaagcgacccagacggccaaagagccgcccgcaggcacaaccagcagacaactaaaccaccacgcacgccgcccacacagagcgcacccagtcacacacgcaccccagcgcaacagccacccgacccaggccccgcccacgcctgcccgaaaacgccaatctgagcacccacaccatatggcacgaccgacgaatatggaacctccgcaacagatcgcgcgcgagacgagtaatccaacacagacaggagacacaacaccaaggagggacaacacacgaaagtaaattcgccaccccaccaagtaggcgagacacaaaccacccccccgcaacatcccggcaaacagaagccaccgccctccacaacgcacaaaacagacggagcaccgcgggaccgaccaaaaacacaactcgagcccacgaccacccacagcagaggcaccacgcccaacctcccctagccagcaaaggcgacaaacaatcggacgag

SEQ ID NO: 489793 - DNA, 223 bp, Homo sapiens
aatccatctacacagatacaggggaccttactacagtatgactctcatgatactcatccaacatattaaaaagtaatataagctctatcatcaaaataatatcaaaatccaaacatatatagaagaatctactgttacacccgcatgatacgcactaccaacataatggggccttcttctacctcctatagcttatatcctattcccacagtgcgttggccta

SEQ ID NO: 489794 - DNA, 422 bp, Homo sapiens
  misc_feature (77)..(77): n is a, c, g, or t
tcccacgactaccgcagggacgagggggggtctaaggatgaactggctctgagaggagaagtggagcagcaccaggnagcttctgccagcccgattacatgtgaccaggggcgctaaggaaactgttcccttaatggcgagatgagagaattatggggtcccaccatccatgggaaatgaggggggatctgcagaggctggaggtgcagcctaagaggactgactcaaattcagctgttaaagattccccaaagcatctgagacaccatctggggtgcagcacaacagaagacgtttaagatgggaccagaaagaagaatgtatagctcttctctaaataaacgaatggtctgccccaagccttcaggaaggagaatggtctatggtgactggggaaagttctctttgcaggctaagagatc

SEQ ID NO: 489795 - DNA, 226 bp, Homo sapiens
tgactggacagaggggctgcgtttcagattcaagcctggattcatacccagtgcccggctgagcagtcctatgtaagcctcagtggaacagatagccaatcatgataccctccagcccagtctgttatttatttatatatttatttatgttgacacagggtctttctctgtctcccaggctggagtgcagtagtgccatcttggctcattgcaacacggtctctca

SEQ ID NO: 489796 - DNA, 568 bp, Homo sapiens
ggaagcaccagcggctgctgtggaccctggaatccctggtgactgggcgggctgttcgagaggttcgagacggggactgtccagctggcccaggcagctgctccactaccatgcaatccaggcatccacccaggaggaggcactggcaggctgggagcccatgggagtaattggcctcatcctgccacccgactattctccttccttgagatgatgtggaggatttgccctgtccctggctgtgggctgctgccggtggtggccctcgttgccccgctggcctccccaggcgccctcgtccttccttggcccagactggcgggggagctgggccccttcccggtgaatccttgagtgtgctcgagttggtcctgtcgtcccatggtgtcgcctatccttggcctctcgcaagacctggtaatccggacggtggccgttcctgcggagcgcccggtaggaagggcgtgcctcttcgacggagcctggcgggagagtgtgcggagctgggcctggggctggggacggagtcgctgtgtgctgctgcacgggacactgtggcaggtcactc

SEQ ID NO: 489797 - DNA, 217 bp, Homo sapiens
tgatgatactctcatagaagctataaatcagtgcagtctgggcaaattatttaagcttcattcaatccaagtttaagttagctcaaactttgactcagtaattccatttctaggagcttatgagtcgactgttgcacactgtgcacaaagcacatatgtacagtgaatgtttacagctagggtcttctcgtaaacaaattgtctatggtccaccaac

SEQ ID NO: 489798 - DNA, 923 bp, Homo sapiens
gtgcgtgccgctggagatgagagttcggagcccttgattgctgagtgcgtatatataccgttccctgggcaggacataggggctggcgaacgtgaagggcggaaacgtgagtccacgtcatgtgtgtggcagagacaccccttctgatgatcattttgacaagatatcctcaaaacgattggacggcatcatgactagtcgccatgaaaggagtgaccgagttaaagatgacgtggcaaccggagctgtttgaagcacgttgggtactgggtgggcccgaatcatgcagagaactgcggacatcttaacgaagtagtgagcaatttcaaacgggactgactgtcaccctgacctggctaaaggtggccccgaggcacggactgacccagatggccgtgagagggacagggcctctccaggtgtatgtaccaacgatgacgttgagacactccgtacgaagatgtacttgacgacgacgagccaagcagtgtgtcatgctatgcagacctggccctactggtgcacgccctgtgaagtgagaggttttacaggaagctgagtggcactatcatgggatcaacggtgctgggaggagcattctgggaacatgtccgtataccattcaatggataggactgcccaaatggagtgatgggggagactagttgcctagctgaacgtgtaagaaggtggaagagaagggatagtgaaagcgttgtgaagttgaagacgatctaactttgtcgaccactggtgatacaattaagtgaaaaaatcctgttgatactaggtagaattcctaatatataaattttcccttaaatcgtaagatttgaggtgaccaagtttaggtaaggtgagtcattttaatggcacagtgatttcgtaacaggtggttaagttcaagatattctataggtgcc

SEQ ID NO: 489799 - DNA, 372 bp, Homo sapiens
  misc_feature (231)..(231): n is a, c, g, or t
ccccctaatcccagtctgaattccaccctaaactaacctagatcctgcaaagacctcctatttccccaactaaagtcacattctgaggtttcagggtagacatgaagttttgggggacacccactcaaccccattgcagaaccccattagcagtcacttccccgttccctcaacgccccctacccccgggcaatcagtaatcctactttctgtctgtttggatttgtctantctgaacatttcatataaatggaatcatagaatatgtggtcttttgtgactggcttctttcacttaacatgttttcaagatttatgttgtagcatgaatcagtactttattactatttatggaataaaaatcagttgtatg

SEQ ID NO: 489800 - DNA, 1421 bp, Homo sapiens
ggagatcaagaggtttaaagtctaacttgctaagatatattagcataactatgtctatggtcatggtgggtcatctaaagccaagtctagtcattagaaagataagacatcaaacacgtgtagaatcgatccgcagaacagaaagagagagtcatgagtacagaggaatataagcgaggaggagccagcatgagaaaaggtataaggtaagatcaaaagaaaaagcgtgatccaccacacggcctcagacgaggaaccacacagcgagaacaccaccgcaaagactcaaggtaacgacaagccagcaaacgaacagccccgggaccaacaaacaccgccaaccacaccaacacaaccgccccccgaagcaccagactcaagccggaaccacgccccaccaaagacacaacacgcacaagacccaccaacgcacacgacagacccggaacacagcaaacaacacagaacacaccaacacacccagtccaccacaacacaccgcaggcaaacaccgggtcaccccacacccacaccacacacccgccacccacagacgcaaaccaaccaccaccaccagccgcccagaccccaaccccagacaaccagcacacacatcccaccgcacacacaccacagcggaaccaagcacacagaaacccacaccagagcaccaacacaaccacaccgccaaaaacgcacacccaaacaacacacacaacaacacaacaagaccaccacaccggctcagcccaccgcgggacaacacacgacaagaaccccaacacacacacgcccgcgcaaacaccccccccccaagacacgacaaacaaaacgcacagccgaagcacaacacggcacagggaaagcaccacacacacccgacaaaagacacaagagaacgcaacacaccccgagcgagcccggcacgacgcgagggaccgagcgaccaggagacgagccagcaaaggacgaccaccgcgcagcggaaggacggcaaggaaaaggggacacggagaggaggagaaagaaaagaagccgaagcagaaccgcacaagcccacgccgagaccagcggcgccgggcaccgagaagcagaccagccccagcaggccaccgcggcccaaagagcgaagaagcgcagacgccgcggggccaggcaaacgacgcacggacgagcagggacggcgagcggacgaacgacacagagaagaaagagcgaggcgacaccagacggcgagggccgagcagcgaagagcagacgaaaccgcccaagagcggcaaggcccaaggacagagaagcggcagcggaagcacgcaccgacaacaaagagcagccaaggcacgcagcaccaccgacaccgcacggagacgacacgcccacgacaagacgcggcgaccgacgcccaacacgacacagacagg

SEQ ID NO: 489801 - DNA, 1746 bp, Homo sapiens
  misc_feature (1011)..(1011): n is a, c, g, or t
tcgcgcaaggggttggccgccaaaacacaggtgtcgtgaaaactacccctataaaagccaaaatgtgggaaaggaaaagacctcattactcaacattgtgctcgctcattgggacacgttaaatttcgggcaagttccaccacttatcgggccactcgtgattctataaagtgcgggggcactcgacaaaagacaccttatgtgcaacaatattggcagaaagaggagagctgtgcgtgagagaagtgggacaagaggggctctccttctcagagtgttatgccccgtgggactcgtggggagaataaacacgtgcacaaagcgtgacacctgtttgcacacgtgtgggtctactccaacgcaatgtgaaaatatctctccctgtgtgtgtggggaacatgtgtgtgagagagcacagcgacaaaagtaataccctatgtgggtgacctctatctcattgtgtgtatgttgccccacaggagacacaacaagaagacgcttgtttctctcaaacaaacacatgtgacttcacgcagggggggagccactctctatcagagggactgttgacctgtggtgtggcgtggttacccctgtgaaactgatggctgtggccactagggcagtgcggagttgaatgaggggtgacaacatactgtgtagacaagcgctgtgggtatctactctctcgccaaaagcaacaatgtggtggtacaagataaccccacgaagaaaaggctatgtgccgcacttatgcggtgggggactattaacaccaccagcgtgtggcgggtgtgttgcacaaacacaaaactaaaaacatgtgtggcgtcagcgtgggtctatacaacccaacaaggtggggggtgcatatccccccaacgagttggaaggtcgacagcccactattaaaagaggctcgatagcagaagaacagcacatcatttgcaaggcgcaaacacgctgggtgctaacgcgggacatgctcaaggacaacctttatgcacaacntgcacaaggcaacaccagttgggggccgataaacaaaacccgccgcagcaacaacaatgattaagcgctaattgtgggttgtgccacaacatacacgtggaggtgtgggcacactggggcgtgaaaacaaacgcaatttgctgttggacaccccacaggggtggtgacaaaagtgcgccgtgagggactaacgagggacagggcaaaaggcatcccccgcggcaaaggacatgtggcaaacccgcgccgcgtgggaacaaccacacgccggtaattagagagccccatggaaagtggcagatcaccaaaaccaacaaaaagtggctgcacatgatgagaacagacgacgtgtaccccgaggccctcctacagggaggtgttcacaccaacaaggtgggggaattgaggcgacacggttcaactgtagggtcgcaactgtgcacatccgttggtgtattcacacccgcgagaatggagagcaacccatcagctaaacaacagataacaagaagcgcaaaaagtcgtacagaagcacgacaatcaatctagtatgaacactcgtcgaaagatgtggagtcaccaacgaatgtgtctcgatgactgtagcagcgtggcatgaaccacgccaccgacaggctgatcatatcaatcaaacaaccatgatatcgtgacgttcgtcgctccgcaccttgtcgcctcatctcgctcgtccttctgatcgatatgcgggggcat

SEQ ID NO: 489802 - DNA, 698 bp, Homo sapiens
atgccaagtgaagtgcgtgtatttcgataactgtgtacttctggtgactgtacagttgaaatactattttttatcaagttggtataaaaatgcagaatttgttttactcttttttttttttcttttaaaagcctatgctggattagcccacacaagaacaactctcaatgggtctgctcttatggggggaaaggcggcatactgctccactaactagcaagtgtcctcccaacacgcgtggcatttgcactgcctggaagaaaaaccacctcttcccatctccataactcctggcagcagacacctcccactcttgggcctcccagcgacgggaagaggcatcccgtgacctctcggaaacaacaacatgggcacaacctggggacacaccaaaaacgccctgggggggggtattacgaacaaaaccacaactctgggttctccatagggagcccttctactctcaccctgtcacgcaactatttcgcagcccaatacgaagctgtaaacgatccccgtttgaagcccagggaaacatcggctaggaggacccggggaaccccataaactacatggcgcttcacccaacgggggctcagggcaacaatcgggagaatcatacaacgcagaatgcacaacggcgaatggtccccgggtccaacaagaagcacggaggcgaccaactaccagaaaggcgg

SEQ ID NO: 489803 - DNA, 534 bp, Homo sapiens
actgctgcacttacattacagttgctatttgtgtgctaatggtggtgatggggggcagatataagaatatacatttgtatttgtttaaaaacattggaacaatatataagaaaaatggagtatgtatcagtcaggagacaaaaaccatggaaatctgaacagggaatctgaatagagacctcgaaagcaacactttccaacaggactttctgcaatgaaggatatgttctataactttactatccaatgtacctgtatggctatgaaacacttgaaatgtagctagtgcaactaagaaactgaatttttaattttacttcatgttaacttgtatttaaatagaagtgacacatttggcaagtggtcgccacattagatagagcagctccaaagaatacagacggagcagatgttgggagtagctgctgcctctaaggctgagtgtacccaaggaagggacaaggttaggagagtcctttccccaacccatcccaaggttgagatgcagacctcattggggagtgtgtggctata

SEQ ID NO: 489804 - DNA, 141 bp, Homo sapiens
atgctggtcagtgattatagggagagtcaggccatcagaggaatgaagtggctaagggtgctccagtcccaatagccacaagtgaattctgttgaacagggagttctagcatctcacagaccaagtggagcctcagtgatg

SEQ ID NO: 489805 - DNA, 1691 bp, Homo sapiens
tccccttggaccataaattttaattgggacaggtcatggaaaaaagccgggggttaagggttccctttccttctcccatctcccttcttacccagaaagacacccctccaaaggacagcaaaagccccagagcctgctgcctcagaggaccttggaggcagacaaattggtggtagtgactcttccgtgtcccctcgaagcagagcgtgcggatagggtggcaactcctcctgtgcctcacagccgcaacttgtggagtgctccagtgaacgcccgtgtggtataacctccgtgaatctacgtgccgctctcactatatcagctctcgcacattcgccccagctgtggtgattctcaatatcaccgatgtgaactcaggcgccccgtggaaatagtgacgccccaagacagtgagatctctcacaaaaaggcggcagcccactcacgaatatatcctgtgcccgagttgtgtgttgtctctctctcccaagagggacaggtatttcacaagatgacctcgagagcagtgtgatagagcagtgcaagactttcaaaactctctcaaaaagaacccactttgtaaaaggtgtgttggcccgcccgaacatgagtactccaagatataaacccctgcaggaacacgtggtgctacaattcagtgagaagccgttggcactacacgatgtagtgagccacaaggggagaacccctccacgcggggtattacaaaatatcattataccagctaccccggggcgtgtgggtttgaaaaccccaagggcctttaaaggacaaatcccattttacaccgagaataacagtggacacatcggggcgcaagttgaagccctctcaatatattgatgcgcagctacttcacgaccatgatttgttccaagagtccaagagagcaaatcctatgtgagagcgagaagaaagcacggtggaaaggcacccgaggaaagacgtgggataattcacacacctttctccaacagatctatggacacgtagtgtgcccaccccccaagtgttttgttgatgccccccctatcaaagaggacacaggaaatttcccccaccaccagcaaagaggggaccacacacatcacaagagataagacgcaacaggacactacacctacacagagagaccacttaggaaacaagtggagactctacccaggagataggacaccaagtagaccaagaggggataccaaacgaatacacacaagacaccccttgtacagagcagccacggaaaaaaaatactaacgacccaccagacgacaaagatgagaaaaaaagcagtagtagagcgcgacaacaaaacgtgtgtgtgagaacgagatctctgtgcggccacacaagcgggtatagtgacgcagcagtgaagaggacacagcggtgcggacttcaagagtgatggcaccacaaactgtatcgccagagcgataggtgagttacaaccaaagagaatgaagtgcaagacaagacgacaactcaagatatatagagaagcgtgaactaacataagaagcagctagactaaggcccaatagagacaggagagacgaaaggatagttaactgaacacgaagactgaccgtcaacattcaaatacgtaagcgccgaccgacttcacatacccatcacttctcatctaactaagtcgtaaggagaaggag

SEQ ID NO: 489806 - DNA, 199 bp, Homo sapiens
atttgtggaatgtactgtggaattagaaaaaacctgaatttagaggttcggcaaattcacaataacatgaaatggggtgggggaaatggatgacgggctcttttcagattaagcagaaaaaacttttcatgccccgagataacaccaaccctaacgccaaaaaatttatggcaggagaatcttcctattcctggagcgc

SEQ ID NO: 489807 - DNA, 101 bp, Homo sapiens
attcgtcagagcaaacacagatcgctcttagccctggagctgatgaatagctttgatttttggttaaaatttgtgagtccaccgctttctgatcaatcttg

SEQ ID NO: 489808 - DNA, 497 bp, Homo sapiens
  misc_feature (8)..(8): n is a, c, g, or t
tccccgcngccgcttaaactaggtaaccccggctgctgaccttcgggcgatttttgtcaatcccacactttttttataacaatgagaatcgggtacacctgcgatttcacattttcttttggtatcttaacattgagattaattccgacgcggcgcagttcttgtcgcacgatgtcgctacaccgagagtgcaggagggtgcgatcactccggcgtctgccacgatcattgtcgaatgatagcatacatgttttcaacgcgcctcgcgggttgacacgcgctcttgcgtcacatatttctaacgccgtgcccattttgtatataattgggcgacactagttggaccgaagtatctggtgaattgccataaaacccgatctgcggcgtgttgaggcagcatgagaaattggagagtctatcaactttgatacacccttttgggaaacacaaatatgtgcaaggtgacacctattttgtgaaaaccgtttgtggtgggg

SEQ ID NO: 489809 - DNA, 226 bp, Homo sapiens
tctttattatttaaattttttatttggattcgtggggatataatatggggatatatttatgccctatatggcatcttttgactcaggccccccatatgtaggaatttccttatgggtaataagggatccctcccctctagcctttattttttggattacccataggggaattatatgcttttattcctttttaaatgggccatttaattgtttttggctcccggga

SEQ ID NO: 489810 - DNA, 148 bp, Homo sapiens
  misc_feature (45)..(45): n is a, c, g, or t
  misc_feature (100)..(100): n is a, c, g, or t
  misc_feature (114)..(114): n is a, c, g, or t
  misc_feature (138)..(138): n is a, c, g, or t
tgcaggattcggcacgaggtttggtaaggcaaacacgaagatggncaagaacaaactcgtagggactccaaaccccagtactcctctgtccaacactgtncctcagttcatagncagagagccatatgagctcacagngcctgcactt

SEQ ID NO: 489811 - DNA, 1219 bp, Homo sapiens
tccaccagttgtcaaatgatcctttattggaaatgtttccctttgtgcttaactggcctgggcatttccacagcaccacgtggttgagtgtcatcgagtgattgtcagtgaggatgtgggggccatcaacatttacagcccacgtgacgtgggacagttccccgaggattctctttataagtggttccagaagaagtttctcgtggcctaaggatctcgggtgccgcatctctgtgtctcgagcaatgtgtgtgacaattcttcattcaaagggtgatttttcccacgtggtgtttaatgtgttttctcgtgttctcttctcgtgtcctctggggtggtctcctttgagaggcgctttgtgatgacttcaggggcaaaaagcgcgcaaaaggggccacaaccctctatcaaatgtcggtgggacctgtgatcgtgtctctgacatgtgcgctcagttttcactgtgtgtaatctccttcgaggccctttcacagttcaccccggtgtgcctgtttggcacatttgttcatctcacacaaccttttttcttgtggaagaacagagaccacaggggggggccagatctctttgtgggggcgccacggggcaagaaggtgttggcacccgacttttcactctcgcggtgccacctcgaggttatagcgatcttggcatctgcgtgggggggctcgaaccttcggacggctattggtggcaggccggtctggttgtccggaatgaacccggtattcgggaacgaccgaaaggggacacgtctttggcggaacccttaagtttcattaggaatttcgggggaaaggggggggccccggccccctttttttttttcatccatgtccattacaacctgcaggcgttacgtgtctacatcatcaatttattctttcctcatgcttctcatgccctataatctatatcataacgagatcacatacgagcacacaccaccccccacgcaatcaatagcaacatccacaaggaacccaagaaacgacacgacgggggggggggcagcctcaacatcccgccaccggccaacgaggagacaacggggcgatcgaacaaacaccccccccggagggtacaccacacggtggggcgccaccacaagaccccgcaaaaactacaccccagaaggcagggggagagccatactgcaccgcgcaggtacaaccaggcccccagcaagcgaatccgg

SEQ ID NO: 489812 - DNA, 182 bp, Homo sapiens
  misc_feature (116)..(116): n is a, c, g, or t
aaatggcatcattataagctatgagttgaaatgttctgtcaaatgtgtctcacatctacacgtggcttggaggcttttatggggccctgtccaggtaaaaaaaaaatggtatgtanagcttagatttccctattgtgacaaacccatggtgtgtttgtaataataaacccaaagacccttta

SEQ ID NO: 489813 - DNA, 352 bp, Homo sapiens
cacgagggcgacgatcagtggaagccggtggtcacccacatgcggatccgggctggattgaccgggcaggaggcaagagacatcctgcttttcctgcaggggagcaactgaaatgagggccttggcggcagtagcgatcggcgggttcctggacggtgttgggggaacggaccttgcggcaagccatggcaagtcggtctacgagcagacgtgcatcgcctgtcatggccgatgggaaggggtcggttcccggcgccccggatctgacgcgcaagagcggtcccctcgccaagccagacgacgttctcttcaagaatgtcaagaacggcttccagacgccgggatcgccgat

SEQ ID NO: 489814 - DNA, 428 bp, Homo sapiens
  misc_feature (92)..(92): n is a, c, g, or t
  misc_feature (112)..(112): n is a, c, g, or t
  misc_feature (115)..(116): n is a, c, g, or t
  misc_feature (122)..(123): n is a, c, g, or t
  misc_feature (128)..(128): n is a, c, g, or t
  misc_feature (134)..(135): n is a, c, g, or t
  misc_feature (138)..(138): n is a, c, g, or t
  misc_feature (141)..(141): n is a, c, g, or t
caggaaataaagaactttgttatcctctgtcttaaggcgccttgtaacagtcttcgacccagacggatacaatctagagtcagccatttgtnagccaggctagtctgtgctntgnntgtaanngagantgaacnntgntcncactgagagtgtcagctccttcccgtagagcaggcatgatgattgtactcacctctgacaccattgtgagtgccacattccttcccacgtccttgtcactgtaagagatgcccacctgagcaccaaccccaggttatcttcccctttgtcttccagccccccagaaacagctacgactcaacctacccaatcatttcatcatcagattgccactgtctctagttcaggtctcttggaactggcactcagaaatctcataataaatcctcttgaggcttctcatacac

SEQ ID NO: 489815 - DNA, 487 bp, Homo sapiens
  misc_feature (151)..(151): n is a, c, g, or t
  misc_feature (171)..(171): n is a, c, g, or t
  misc_feature (174)..(175): n is a, c, g, or t
  misc_feature (181)..(182): n is a, c, g, or t
  misc_feature (187)..(187): n is a, c, g, or t
  misc_feature (193)..(194): n is a, c, g, or t
  misc_feature (197)..(197): n is a, c, g, or t
  misc_feature (200)..(200): n is a, c, g, or t
tcatatgctccgtcccatataggtgggacgactgagatgatgcactcgagcacaggaaatcaaaaattcgtcaacctctgctcttagaggcgcctgatcacacggccttccgaggtcagtatgggtactaccttgcattagcccatttgtnagccaggctagtctgtgctntgnntgtaanngagantgaacnntgntcncactgagagtgtcagctccttcccgtagagcaggcatgatgattgtactcacctctgacaccattgtgagtgccacattccttcccacgtccttgtcactgtaagagatgcccacctgagcaccaaccccaggttatcttcccctttgtcttccagccccccagaaacagctacgactcaacctacccaatcatttcatcatcagattgccactgtctctagttcaggtctcttggaactggcactcagaaatctcataataaatcctcttgaggcttctcatacac

SEQ ID NO: 489816 - DNA, 454 bp, Homo sapiens
aaaaaaagggagatgggttttccacagttaccacgaggagataaaggccggacagctacgcttcacgacacttgcatatcctgtcctgtgacttgtagctaaaagcatcttaactgatccacaccagcccgccttccctcccaggccacccacactctcagcctcggtggacgtgtgctgctgtgtcaggaacgctccttcctgcagcacggcctcgaccccaggtgactcctgtggtcaccagctccctggtctcacagagagcttggtggccctctttactctctcccggatctgcttcctgaggcgccaacccaccattttacaacccactttctcaagcctcctacaccgctccttcctccttcagagcctgtggccggcctcggtctctcagcctggatgctgagcatgtaagaggaaatgaaaggaatctgccagaaccgtttcccac

SEQ ID NO: 489817 - DNA, 427 bp, Homo sapiens
ggcactgcttagaagaggccagtatcccaaagcatccagtaggcaacacagacataagtgtctccagcctggaaccagaaagtcacacctctctagaggtgtgggaaatcgagagaggaaaaaggcctggtggcctcacattctacttcatcaagcctacccgctgatcttaagagagaacacataaatgagccttggctttaacaccttctcaaagcaggcaagctcctgccttcaagaggcatgttctttagcccacatatggaggctccagtccccaggaccaatgtgtacattttctaaagcacactgactttggatggggctactgtttcccagcctgctgtgaaaaccaaaatactatgccatgactaccatggccattgttctaaaagctggattatggctttgctgtgggaaggagcgg

SEQ ID NO: 489818 - DNA, 381 bp, Homo sapiens
  misc_feature (30)..(30): n is a, c, g, or t
ccaggtggaggtagggccagtttggctcangcagctccacccccaggttcaaggattttccgcccagcctccgagaggtgggattcaggcatgtccccccccccggcaatttttgatttttggagagacgggggttcccccaggggggccgggctttttttgaacccctgcccccaggtaagggggtccccccccttggcttcccaaaggggtggaattacaggggtgagccccccgctcagctgacggggcccccctttagaacgggggttttttaggtcagcttcccattattgcccaggtaatttgcccttttaccagactaaaaaagaaaagctatatgccattttcaataaatcccttaaaaagttgggaaaatta

SEQ ID NO: 489819 - DNA, 155 bp, Homo sapiens
ggatgctgtgtctgagcggtaatgcagcatcaccgaacgcgaagaagtggagatgattcggccacctctggtggtcgcaggaaatggtgaccaagaacatgcccgaatcttgatacacaggggactctggtgctattgaaacttctaaaactagg

SEQ ID NO: 489820 - DNA, 116 bp, Homo sapiens
  misc_feature (41)..(41): n is a, c, g, or t
  misc_feature (70)..(70): n is a, c, g, or t
ttcttgaggtgttcctacttgtaagtgaggaagttgctccnactattttcaaaatgaccccaagttgaanaatgcccggtgttaagggcatcagtgggactcacaacatctccctg

SEQ ID NO: 489821 - DNA, 271 bp, Homo sapiens
ctcgataaggccaacacgaccactgcctccctgcccccacacctgcacccaaacagacacatcaacgcaccccactcacagacaccccttaccccacccccactgtgcagagaccaaccatgacacccatcaccaccaccaccacggtgaccccaaccccaacacccaccggcacacagaccccaacaacgacacccatcagcaccaccaccacggtgaccccaaccccaacacccaccggcacacagaccccaagatcgacacccatcac

SEQ ID NO: 489822 - DNA, 1568 bp, Homo sapiens
  misc_feature (1018)..(1018): n is a, c, g, or t
tgcatcgttagttttccgcctgccgactcggcccccgttatattggtttttgtgtgtggggcctacacaacgattggtgtgttttttgaggggcccgcctccgctccgtttgttctgtcgctgcgctagatgtgttgtcgcgcgccctgtcgtacatctcttggtgtagtggccgccttttgtagttgggatccccgtgggggggttggctctgtgggggtctgtgttgttgtgtgcaccaggtggacgcgcggggggaaggaaacccccagccggcctgtattgttggtagacttctctttgagggcttgtggggagacccacgctcctccgctgaccgttttttctctccctccctccccgatttttgttctggttcgccgtctcttgtgggagagaggtgggttacaggcgggcaaggttgttgagaaggggcgcccctgggcagtgctaggcacacccgcctggtggtttttggtttgttctccctgggttcacgtgagcgttcgcaccctctgtctcgtccaacgtggtggtgtcgttggcgtgtctttacgcccaagaccagagccttgctgtttgtgggcacttcgggtggcgccacgaccccagagggcaggaggggcctgtcgtggggacagctttcctccttgggggggaaggaccccccgcgaaagcgccagaaagaaccccctcgggacagtggtgtttcgtcccccccttgtgggggagaacacgtcccacacgaaataaggcgccccagaattaaagccgcgcgcctctggtgtctcagagacgttgtgagaaggaaaatcttgtttgaacactcttccacgcacaaaggtgtagaggccactctcccttcatagagtgtccccccacagtgtgccctcaccttcgcctctcctcgcgcacaagacccccaacgggatataacacgctctcgtgaaagacaccacagtggcccccacaaaaaacacacggcgtctcccacagaacgcccgccacagcacacagntttggggggagaaaagagagagagccccacagagaaggtatgtccccccttctcgctctcgctcagatctcgtggcgcgccggtctccccacgcgcctccgcccccacacatgtcctttgtgagagccccccacgtttctccacgcgtcacgcccctgtgttttctcctgggtgagagaggtctcctgcacggtcacatgggccccctgtggggaacccccaacagggcacaaggccccacatgggagagggaaagggagcacaacagggcacatcccttgggcgcacaacctgtcgcaccctcttctttgtccacacttaattcttcttccgctttccacccttctctgttttcacaaaggctccttcctatggagtggaatcgggtgctaggagcacaactgcacgtccacactccacccacggtcttccctggcccctgtgttttattttcacgagacacatgagaaataactcgtaccacgtgtaaaacttatttaagcgttctttaatggttgtagattggaaataaagtatgtcatatggacca

SEQ ID NO: 489823 - DNA, 175 bp, Homo sapiens
ctcgataaggccaacacgaccactgcctccctgcccccacacctgcacccaaacagacacatcaacgcaccccactcacagacaccccttaccccacctttacggtacagagtctcaagaacggtaacttgttatggaaaagatgaacgttattgagtatctagtaccctatact

SEQ ID NO: 489824 - DNA, 410 bp, Homo sapiens
cttacccatcgcacagcctatcgccccaggctggtatgacttgagtgggtgacggtggtgaccagtgtcgctgagctggcgcagatcactttgcggatcacggctcaatgccggcttggctggcaatgatctggctgaacatctgggcctggttgagtaacttgccgatcaacgccgctttgttgagcaacgaagttcttgctgctgggccttgaacgcggcgatcaactcgtcgcgcttactgtcgaagacggcaacttgctcgggctgggtcgcaatggcgtgcaggccctgcaagcgctccatcacactggcttccaaggcgctgatcctagtctccaggtctgctgcttttccggactggccgagggtggcattgatctctacctggttgtgcgattagggttagt

SEQ ID NO: 489825 - DNA, 374 bp, Homo sapiens
  misc_feature (24)..(24): n is a, c, g, or t
  misc_feature (45)..(45): n is a, c, g, or t
  misc_feature (85)..(87): n is a, c, g, or t
  misc_feature (111)..(111): n is a, c, g, or t
  misc_feature (137)..(137): n is a, c, g, or t
  misc_feature (143)..(143): n is a, c, g, or t
  misc_feature (172)..(172): n is a, c, g, or t
  misc_feature (177)..(177): n is a, c, g, or t
  misc_feature (232)..(232): n is a, c, g, or t
  misc_feature (239)..(239): n is a, c, g, or t
  misc_feature (300)..(300): n is a, c, g, or t
  misc_feature (311)..(311): n is a, c, g, or t
  misc_feature (324)..(324): n is a, c, g, or t
  misc_feature (339)..(339): n is a, c, g, or t
  misc_feature (347)..(347): n is a, c, g, or t
  misc_feature (349)..(349): n is a, c, g, or t
  misc_feature (354)..(354): n is a, c, g, or t
  misc_feature (369)..(371): n is a, c, g, or t
ccaagaagtgagagaagccccttntcctgcagtgcccctctaccncccccctactgacaaagaacatggtgctatatggcatggnnnaaatgttcagtttgctatggcttntattttcccctcaaattcaagtgttnccaatntgacagcatcaagaggtggggactttaanagatncaactaggccatgagggattctcttagggctgggatgaaggcccataataaaagnggtttcngggagcatcctgctagcttgccttctgtatgtgagaacacagcaagaaagccctagtcaanaagtgccagcnccttgatcttagncttcccatcctccanaactgtgngnaatanatttctgttccttannnatt

SEQ ID NO: 489826 - DNA, 155 bp, Homo sapiens
ctgcaattagtactgtagcacgaaaatagtccacacattgaaattaggactatattattttattttgggccacagttacttgaaacagaattaagtcacaactcaaaaatgactctaatgtgcatgtgcacttggcatgcaaaattttcaaacca

SEQ ID NO: 489827 - DNA, 1000 bp, Homo sapiens
  misc_feature (73)..(73): n is a, c, g, or t
  misc_feature (176)..(176): n is a, c, g, or t
  misc_feature (203)..(203): n is a, c, g, or t
  misc_feature (292)..(293): n is a, c, g, or t
  misc_feature (330)..(330): n is a, c, g, or t
  misc_feature (405)..(405): n is a, c, g, or t
  misc_feature (443)..(443): n is a, c, g, or t
  misc_feature (471)..(471): n is a, c, g, or t
  misc_feature (485)..(485): n is a, c, g, or t
  misc_feature (494)..(494): n is a, c, g, or t
  misc_feature (507)..(507): n is a, c, g, or t
  misc_feature (509)..(509): n is a, c, g, or t
  misc_feature (578)..(578): n is a, c, g, or t
  misc_feature (583)..(584): n is a, c, g, or t
  misc_feature (597)..(597): n is a, c, g, or t
  misc_feature (600)..(600): n is a, c, g, or t
  misc_feature (605)..(608): n is a, c, g, or t
  misc_feature (661)..(661): n is a, c, g, or t
  misc_feature (673)..(673): n is a, c, g, or t
  misc_feature (693)..(693): n is a, c, g, or t
  misc_feature (703)..(703): n is a, c, g, or t
  misc_feature (707)..(707): n is a, c, g, or t
  misc_feature (711)..(713): n is a, c, g, or t
  misc_feature (719)..(719): n is a, c, g, or t
  misc_feature (721)..(721): n is a, c, g, or t
  misc_feature (727)..(727): n is a, c, g, or t
  misc_feature (734)..(734): n is a, c, g, or t
  misc_feature (739)..(741): n is a, c, g, or t
  misc_feature (767)..(767): n is a, c, g, or t
  misc_feature (770)..(770): n is a, c, g, or t
  misc_feature (782)..(782): n is a, c, g, or t
  misc_feature (789)..(789): n is a, c, g, or t
  misc_feature (797)..(797): n is a, c, g, or t
  misc_feature (835)..(835): n is a, c, g, or t
  misc_feature (877)..(877): n is a, c, g, or t
  misc_feature (895)..(895): n is a, c, g, or t
  misc_feature (899)..(899): n is a, c, g, or t
  misc_feature (918)..(918): n is a, c, g, or t
  misc_feature (984)..(984): n is a, c, g, or t
gtataaacgtctgcctgacaaatgcaaatctattttctttatgtaactcaatagttccacttatctgaatggntgtaccttcatgcacacgggcagcaggcactgattgctcaaacagggaagtgaggcttcaccctagtgtggcttcaccttaggcacagagcactatctaactncccagatctgtgccacccacacaaganctggggacacagcagcagacaccgatgctgtctctaagttcatcacagggacagcttaaaatcagaataatagggaactgctgattaanncccaagtgcatgggcattctagaaagaagagcaagcngttccactctctgggaagttcatgggcttgcagtgggagtttaaggtatcatctttgctggaacagatggttaanaacaccaaactttttttttaaaaaaacgatactactgnctttagcagcaatcacaaacaaaggggntgataaacgagggntacatttcngtcacagcaaagnangattatgtgcttttccgtgctgcagaccggaagactgatttgatttcctgaatgaggaaggctccttgnccttnnctgaattgagggnatngcttnnnncagccaagggagaagacgggcaaagaggacatccggaggacagaggaaggtgnaaggaccgccanaggaaggtgacagaaaaganagggaagagncaantgtnnncagccncngtcaantgatgcntcatnnntctccctgcaggctgcagcaccagcngcnacagctacagcngtgagancaggctgnatccagatctgcaggcgggtgagcaggtggagcccagngaagagatgttcctgctgcaggcaattatgcaaagtgaagangtgattgctttccttttnaaanacaaccctattggaaaaanctttttcctccaggaccctagggaaatgggggttgatgggaactcagggccttcgtagatgaaaangcctgtattggcgcac

SEQ ID NO: 489828 - DNA, 253 bp, Homo sapiens
taactatcagaggactgctgtgagaaatgctaactcctgtgaaaacactgggcacagtctctgaaacacaagtgctccaaaaaaagcaaaaaaaggccaggtgcagtggctcacacctgtaatcccagtactttagggggccggaggtaggcacatcacttgaggccaggagttcaagaccagcccggccaacatggtgaaaccccatctccactaaaaatacaaaaaaaatggccaggcgtggtagcatgcg

SEQ ID NO: 489829 - DNA, 120 bp, Homo sapiens
gtgacggagtgccaaagtggaggagaccatcgccgtgcgatgcctggataagaatctccttgcagctgagaaccgagagctgaagctggtggctcccaccctgcggtctgaactcacggc

SEQ ID NO: 489830 - DNA, 197 bp, Homo sapiens
gggggggggggggggtttccccttttttttccccctttcgggggctgggggggccctttttttttcccccccggaaaaaaggatttgggaataaatttggtttttcccaaatttcctttggggggggtgggggtttttttaataaggccctttccggggttttgggggggccattaaacccctgggcccctccccca

SEQ ID NO: 489831 - DNA, 146 bp, Homo sapiens
gcagcacttggtggtgcctaagccattggcctggaccgttatcttcttgggctcgtttactcacaggtttgtgaccctcctatgttcttgcttaagcgacccttcggtgtcacttggccccaggagagacgggccaggttttatct

SEQ ID NO: 489832 - DNA, 160 bp, Homo sapiens
gggtcatctccagggggtggtcaaagtcccagcctggttacccttgaagaactttctctggggctgtgggggtgcagggccactaggctgaagtgggtttcatggaggtccatggccacatggcaaggtcgggaaacacgtcctggcccatgggcactgg

SEQ ID NO: 489833 - DNA, 750 bp, Homo sapiens
tgctgaaaagtggctgaaggtaagtggtatgcagagtaccttcttgggcttatgcaaaatggagatgatcctgctacagttctgggaagttggagaacgggcaaagcagagagccgacgaatcgggaacagcctggagaaattcttgccagcggtgccctttagccctcaccccagcaaattcaagccacaattgctgggtgcctccagctgcaagaaaggatgtgagattcgagtttggttctataaccgcagctatgatggagcagtcgaccaatccgaatgatgcgttccccacgggagattgtggggaacagccgggcctccttgcccaggagctaccacgtgtgctttcacctgggtctggggctccctagtggatatccccctactatactacgtctctactctgcaggggttgcccactcctctgcccctagccacctactctgggcctcctctagattttagggctgaggggcttgcccttcacggctacgcttggtagaggggagaagaagggataacccaggtatgtcctagggttcatttgagggcttttagatattaatttctcattcacgtataagaagattaaggatactatagtagagaatgggaataagaaattgattcaagaaaaacatgagagagaaagaatgaagatttattaaaaataatgatgattttcacaattgatatttaaataaaaatgaattccaacgggcaattacagtattatagagactga

SEQ ID NO: 489834 - DNA, 684 bp, Homo sapiens
agcgggcggcgaggcggcggcggcggccggggcggtccccgcggcgggaggagcccagccggggtctcgggccacaggagccggcgcgggctggacggagggagtcgctagtaaggagcgtcaatgagcctcccggcgcccgtcgctcagcgcgtccgatatcccctgggggcggcatgcaaggctgccgggccagaatcgggactcctagaaagaggggaggcagtacggatggaatgacagcgtggtgtcgtgaggtggatgctctgatagagagcttgatcggagatccttactagggaggtacctgaccctgtgagacggcgataggcaaggtcgacgtcttttcactacgtctgaagaaaggttgtccatgagtgagagcatcatggtgattatggtattgattccgagagagacctgattgacgtagtcgaccgttggcaggtggcgccggagccagggtggtgtaattgcccgtccgtgccaggaagacgtcatgaacggatggttgccccttgtgttggaaaacaaggacgtttctatgtgactcagacatgtattggacacgaaagaactcgcgtgtacgagcgccgaaggatattttcgactaaccgcactactgcgtggcggagagtgcccggtgaactaaggaggtgcaggaaactgaaagaacaacactgg

SEQ ID NO: 489835 - DNA, 109 bp, Homo sapiens
cagcggcttcgttctcgaaggcttggtcttgaggtgggggtcacttcgtctttggcgggtcgaaggtagatgcagtacccaaggaaaagggccccgcatacaccggcgg

SEQ ID NO: 489836 - DNA, 402 bp, Homo sapiens
aacttgtgcatcttactagtgtcctatggttaaacacgcatacacgtatttggtttaaaacagttaaacatatgcgatgacatcatatatactgattagcacttgataatctccccctcatgcaatagtatttggaccatcatttcatatcagcacatatgagagcaacctcattattgtctccaatggttgcacagatttacattgcctggatgtatcaaattatttaaccaggaacatttcacttctagtctttcactgttaaacaatgctggggaaacaaaaaaaccccttctatatgtgtcactggacccataagcaagagtactcttaaatacacctagaatatgacgtgctaggtcaccaaatatgtgcccttttctattacggaaaagctaaatc

SEQ ID NO: 489837 - DNA, 115 bp, Homo sapiens
cacaacggcgtgcggtggtgcgcgtgtggcaggccaacatcggcaagaccatcatcgcccatgtgccgatcaccaacggcgaagtgcaggagaccggtgatttcgaactcgacgg

SEQ ID NO: 489838 - DNA, 227 bp, Homo sapiens
gatcttcctgcctcagcctctcaaagtgctgggattacaggcgtgagcctttctgagcgttttttcatcatggaaaggatgtcaaattttgtcaaatgctttttgtgcatttattgagatgatgatatgttgtttatcttttatgctgttaatgtgacatatcacaattactgatttttgtatgttgaatcattcttgcatcccagggataaatctccttaatcatg

SEQ ID NO: 489839 - DNA, 274 bp, Homo sapiens
atcccgcgcgttgttgatgaggttatgatttgctctcagaatgtaccacggctggatgagaacactaaggagaaaagcaccggatgtaaagcctctattccggcatacatcttctccctcattttcatcttcaccatctacagatagagcagcatactttcttgcagaacttaatctctcgaagctggattttcctccggtttctttggctcaggtgccgactctcgcagtcttgatcctttttgccatctttcctatctcacaacgcgacttg

SEQ ID NO: 489840 - DNA, 396 bp, Homo sapiens
gctataatcagcaggcacagcatcctccagtgaaagtgagcccattcggggtggcatgtcactccctggaataaacaccacacttagaaacaaatgcatttcgtcaggatagcacagtgacatggtgcactgtgaaacctgaggccactgtgtcaaactgtgcactggttgtgacatagggagagccaaaaattatgtcctcactggtaatagagctttcaatgtgctcgatcctctcaccactgaagctctgtagagcaagctcagagccacaaacactcccaacattgacccttctgggggtagctgtctgtggcacccacagggcaagagctggagatccccattaggattgtccatccacacttgaaggcacaaaactgcagggattggggc

SEQ ID NO: 489841 - DNA, 1069 bp, Homo sapiens
ggacgagatgaagaataccagtgaccttcctgacaccgggtcgcatgtcgatgctgcctacggacagatacgatcccgggtcggcccgccaccagtcagtcctactgattgagtgcgatgaacaagcgcctgaagagtgcactagctgctggacagattaaaacggcgaatatggctgtatgtagagcaaatgcatgacaacaatggcattgaactgccgccagatatgtttcgctggcatacaacacatgtgcttgcttcgcatggactgcagacgtaactgcaggcagcttaggcatggtgccctcttacttgatgcaattgctgataaccatacgggtagcgcgcaaaagtggggaagagaagtgcgttacaaagctcgcagttcgtgagcgggacggcttgcaagtgcaatccaaatcgctctttcatactaaacatattggccgatggaatcgctcggttttagcacagcgatgacagaagttaagagcaaaagacagttcgatcgccttcgctcgaagacccttggttcccccaagtgccctccacggttgatgtcacacgcgtcgcctgctcgttgtattttttatcccgaaggaactaaaaacttcggcatggttatgcctctttcctttgaagctttaattccctcgtacagtccaaaggagtttgtaagccccaaaattggaaatctagtgaccccaacaaatagcaaagaccaatttctttcctaatcgcgatattcacatttgtgttagaggcaaatcctgcacggtttcgggagggtcgtgataccgccttgcaacgaatggaatgttccaccatttggttggagtcacctctttgggtatgacggaaatggtggcgtacggggcgtaaagcatctgtgaagggccaaaattccgaactatgagttttttccggcacacatggaggctgtttagcggaatatgtaccgaattccggcgttttttttctggccaaaaccatattggcctaagttaaatgcgctttttgcgcttaaaggaaaagaaacgcagaaacgctctgcgttggtaacaattgg

SEQ ID NO: 489842 - DNA, 946 bp, Homo sapiens
  misc_feature (419)..(419): n is a, c, g, or t
  misc_feature (546)..(546): n is a, c, g, or t
agagttaggcgagaggtaaagggaagcattaagttttgcatggaagatcactttaggagatccttggtttagattttcggtcttgaatggactacagtagatgcagaacttgagtgatatatagaagtctgaatagacgttgtcgagacttgcttggcagaatgaagatctaacagaggaagacctttctttgaaagagaatgctcgcaagatattacagatattaagaattcagcaaatataaagaaagagaatgagaattaaaatgcaatcaacaattgttgggagcaacttaaggagcaggaagatcaaagatttgttagcacttctcagtgttgggagaggtggaggacgaaatgatgaaacgttgatcatgggtctcatggcgtgtcccaatgagagagaagtcatgtgtgccnatgcagaagaagagggggagtgtgtctatatcttgcttctcattgtaatagacatatacgcgccagtgagaggagtaagcgcttaagattgatttttgtggaacatggatcgagagagagtgcgtcntttttcgaggggggagacatgaagcggagaggtttatcttagtcaaagagagtgtgtctcgctgtggagtgacagggaggaaatgacacactttgttgcatgttttcggtgggggggtgtaaccgggttgattaagggaacttggaaacaggaagaaaaagaagtttgggtttaaaaaaacccttgtgcggtaaacccacataaggccccaacattcttggggggaaccaaaggcgaggtttttttaaaacccaaacacaattgaccttggcaagcaaccaggggaaaaggattggggcccaggccaacactttcttggaacttgggattgggccaaggtctgggtgtaccggtcttctcatttccgcctttttcttgttaggcagattaagggtcattg

SEQ ID NO: 489843 - DNA, 176 bp, Homo sapiens
actcctgactcttgtgtggaagatgacaaggacgcgcttggtgcaaattctgttgtatgcgctgcgggggcaacccgcttggatgagatactcatacgaggaacgtcaggtctttttcctaaagcaaatccgtgtaaacttgagacaacataaacctatagggagatcttgacaca

SEQ ID NO: 489844 - DNA, 377 bp, Homo sapiens
  misc_feature (24)..(24): n is a, c, g, or t
  misc_feature (32)..(32): n is a, c, g, or t
  misc_feature (109)..(109): n is a, c, g, or t
ccgaggatacgggaataagacccntcctggancaggggaggtgaccaaacgatactaatatttgatctagaaagttaatgtgccagaatactgcacacagtggctcacncctgtaatcccgcgctttgagaggttgaggagggaggatcactgaagtgagaagtttgagacctcctgggcaacatagcaagactctgtctctacaaaaaaattaaaattggccaggcatggtcttgcttgcctgtaatgccagctgcttgggagactgagcctagaagttggaggaggattgcttgagcccaggagtttgaggctgcagtgagctatgattgcgccactgtactgcatcctgggcaacagagtgacaacctgtcttt

SEQ ID NO: 489845 - DNA, 120 bp, Homo sapiens
  misc_feature (62)..(62): n is a, c, g, or t
  misc_feature (66)..(66): n is a, c, g, or t
  misc_feature (87)..(87): n is a, c, g, or t
ccaaggcctggctaagtcgcgagccaggtttaaccgttgcgtcaccgggacccgaagccccncgantcctgggggccgtgctcactnccaaatgttaataaagcccgcgtctgtgccaaa

SEQ ID NO: 489846 - DNA, 338 bp, Homo sapiens
  misc_feature (25)..(25): n is a, c, g, or t
  misc_feature (212)..(212): n is a, c, g, or t
cctcatagtctcgttagttaagaanaagagatttaaggaaataatagtatagaggaaagagttgagagatagaagagaataggagaactgggaaaagacttagctgcacatacggtgatgtgagagcctgtcacaatattaaacgagaggcactaagagaaataaatatttacagtccagcctaatgccttaactctttactccccataaancccttatgtggtcaggtgctgcagctcacgcctgtaatcccagctctttgggaggcctaggcaggagaatcacttgagaccaggagttgaggagcagcctggacaacatagcaagaccccatctct

SEQ ID NO: 489847 - DNA, 190 bp, Homo sapiens
ccaattttttttgggggccgggccccccaaaaccttgggggaagaaattaaacggggggggggggggggggttttgggggggaaaaccacaaaaggggcccccctttttttttttttccccatttttttaaaaaaaaggaaactttgggggaagcccccccccctttttaaaaaaggaaaaaagggggta

SEQ ID NO: 489848 - DNA, 549 bp, Homo sapiens
agcggcttttctggtcaaaatggctggtcacacgcacgtgccgttctcagcatcaggcaacgtgcgcgtggcatcctattacaaaatggctattacaatgctgcaggattcaactcctctggggttcctgcgagatgatacactagtacgaggatgcaagatgtagaaacgatagccataagaagacttcctgagaacctttataatgacaggatgtttcgcattgaagagggcactggatcctgaacttgaagcatcagatcttgcctaaagagcagtggaccaaatagtcaccgaggaagaatttctaccttgaatcgtatctgaacagaggttattcgggaacgctaacgacagagaagactgggccaagaacgtaatcatgtagttgaagtctgttggatgcagctgttctgaagcatggttgaaacttgatagacaatagcaaactttccaagacttaattctggtctgcacagatgtagccacgtattagaattacatgtctattgttactacctcagcatgcagggtactcccagcgcaggg

SEQ ID NO: 489849 - DNA, 478 bp, Homo sapiens
gctagtactcatgatccttgtagtacgctgatagttctatctgtcttttgttttttgggtccggagactcacactatcgccgggtggagtgcagtggtgcgatctcagttcattgcaacttctacctccctggttcaaatgattctcctgcctcaccctccggagtagctgggactacaggcatgcaccaccgtgcccaactaattttttggtatttttagtaaagatagggtttggccatgtgggccaggttagtctcaaactcctgacctcaagtgatccgtccatctcagcctcccaaagtgctgggattacaggcttgagccaccgtgcccagccagaatggctattactcaaagtaacaaaataacagatgctgatgaagctatagggacatggaaacacttataccctgttggtcgaaatgtaaatcagtttatccactgtggaacgcagttcagagatttctcaaagaact

SEQ ID NO: 489850 - DNA, 212 bp, Homo sapiens
  misc_feature (72)..(73): n is a, c, g, or t
  misc_feature (147)..(147): n is a, c, g, or t
gttgccatcgcgtctccgcctgcagcatctgtccgatctttcctgtttcccccactccattcccttcctatnnatcccacagccagaggaagtggatggcctccttgggcggccccacctttaccctaccccaggtgcagacatctngaggagagagtcggagagcagaaaccacttggctccagacaattccctacaggctttgggcctgg

SEQ ID NO: 489851 - DNA, 140 bp, Homo sapiens
agactgacgagtctgctcaggaattctctggatcctaggctcatctccacaggggtagaacacacagacagctagagaccatgggacccctctcagacccctccctgtcactcaggcacatcacctgagaatgggctcct

SEQ ID NO: 489852 - DNA, 247 bp, Homo sapiens
atctgcctacattgagtatcctcagtcccttcccaaataaacaccagcctgtcattagaacataaccactaattacaccttttataatacacaatatttttatgtaatggggaagcactaacaaatatcaataaccttttcctcagtgcctcatggtatcctaaatatagtatacaaaggtctcaatactaggcatacctatatttaacttaccttcaaaacaaccagtaaagaacaagttactaca

SEQ ID NO: 489853 - DNA, 903 bp, Homo sapiens
  misc_feature (903)..(903): n is a, c, g, or t
ggacgcggccaaagacagcacagacagattgacctattggggtgtttcgcgagtgtgagagggaagcgccgggctgtatttctagacctgcccttcgccgtggttcgtgggcgccttgtggacccccgggccccttgccggcctgcaagtcgggaaaatgtggcggctgtgcttcccttgtgcttaacggcttggtggggttgggaccgtgcctgggttggttgcccaaatgggctgggcaatgaatgaaagctctccccttgggtggccggggaatggcttggttgttgcgatacaagggcgggggggcggggcccgggagggaaggggaggggacacagaagggggaggcgacggttggggccaccggggtggtccgggcattcggacccttgggggagacccaaccctaaccttccttgaggtcaggggttgttccaagggacacgggcgccgggttggagaattcattcggcccaagggaattccaggggggcaaaccgcgggaatttcaaccgccggtccttaattgttgcggcctttacaacctctcgtggaaggggagagacccgttctggattgtggaccggactgctccggccaaaagaaaaacaaggttcatcttcaaaaaccccggagaaacaggggtctgggagaaggccagagcgggcttcaatcggggcggaacgttgagaatggacgccggctttggtggcaacgcggggaacatcaaggttcttcggtcggttccagggtgttgaaaagggaaacttaaaaccattaattcaacgtggatatgggggggtggcaaacaaaaggattttgtcttgaagaatttctgcatggttctcggtaacaaaaccacacagaaaaaaaaatgtggggggggggcacaggaaattn

SEQ ID NO: 489854 - DNA, 266 bp, Homo sapiens
tcgagcttggtacctcctgcctgggcataagagctagactctgtctcaataaaacaaaaaacaaagaaacaagaaacaaaaattgctgaccaggcccgggttttggtggctcatgcctgttagtcccagccactttggaaggctgaggcaaagggtttacttaagctcaggagtttgagatcattcagcctgggcacggtggcgaaactccgtctctacaaattttagccaggttgtggtggcgggttacttgtggccccagttcc

SEQ ID NO: 489855 - DNA, 531 bp, Homo sapiens
caacatgccctgagtcagataactaaaatacctcttagtctaggtagatactttcactggataggtagaggcctttcctacagggtctgagaaggccacggcagtcatttcttcccttctgtcagacacaattcctcagttaagccttcccacctcaatatagtctgataacagatgagcctttattagtcaaatcagccaaacagtttttcaagctcttagtattcagtgaaaccttcatatcccttacagtcctccatcttcaagaaaagtagaatggactgaagatcttttaaaaacacacctcaccaagctcagccaccaaaaaggactggactacacttttatcactttcccttctcagaattcaggcctgtcctcggaatgctgcaggtacagccatttaagctcctgtatagacgtccttttattaggcccagtctcattccagacaccagagcaacttggactgtgccccagaaaacttgtcatcctagtatcttctgtctagtcatactccattcacggtct

SEQ ID NO: 489856 - DNA, 137 bp, Homo sapiens
  misc_feature (24)..(24): n is a, c, g, or t
aagctcccaacaagagaaagtatntcattttacacaaaacagattcacatgtgccaaaaagaaagacccaaagaaacaaaaacaaaacctaatgctgacactgatggtccagtacccttgaaccagtgggcccaaag

SEQ ID NO: 489857 - DNA, 728 bp, Homo sapiens
tggcagattaaggcttgtttaatttaaatgggctgatctatgtaatcacagagtgccagtatgtccagacaaatgggggaggtttaatttctggtgtctcttccctccttgtggattaaaggctcttgtgatatgattctcccatcctttctgtgtgcctgtgggaggcggctcattataagggcagcatatgacgtgcattcctgtggtcttataggacctgtgggggccctcagcctgtggctcagcacaggagacttcttgtgacgtgggcactgtgggtgcgtagcctttctcacagcgctgtgtgcgtgagacagtggtgttctccgagtgggagaaactcccgacttgtgggtgtttgtgtgaaaacacacaattctccccctattcaacactattcgagtgatatacggaggcgtaggggaataacaagtggtgggcgaactcgacactcaatcacatatagaaatttcagggggaatacatctttcgtagagccaggccgtggcgcacaagaaactccattacatttcatcccttctactccagttgtgtgaccatttcttcgtgggcatctgcgggacagcgtggtcgtgtctcccccttatccaggcatataccctattgaccccaatgtgtgcccgtgcgcccaattcggagggggggcccaagggtgttatatactcgcgggcaaatagaagacccgcgggcaaagtgggcacggg

SEQ ID NO: 489858 - DNA, 277 bp, Homo sapiens
aaatactcaagtatttatgggtaaaaagaaaccatattcatgatttgctctcaaactatgcatatatatatataaaaattcccacacatccacagaatggaggacaatctggatgacagtatacaggaaatctttgtattatttttacaacttttctgtgagtctgaaattacactaaatttttttattttttacttttaaagtcagtcacatcatttcttaacctgcctcaagcccctcaataacttcccatctcactcaataaagtcctctgcct

SEQ ID NO: 489859 - DNA, 494 bp, Homo sapiens
  misc_feature (40)..(40): n is a, c, g, or t
  misc_feature (47)..(47): n is a, c, g, or t
  misc_feature (65)..(65): n is a, c, g, or t
  misc_feature (105)..(105): n is a, c, g, or t
aaatggagtattttaatcctgggcgaaccactgaaaaacnggacggnaaaaatatctctcccccnaacttttggaatagccagccatagtggcactgaagtcccnggagcccaagcagcccggttcaaattcccagcacccctgcttacctagcctatacaacttgggcaagttacttagtctctctgtgcctctcctcatctgtaaaataccatacagttgttgtaagaactaaattagttaatatgtataaagcatttagaaacagcactaggtgctgtatatgcccagttgttagtaacaatgttattataacaaaataaagttttccaaaagaacacatgataatgattcttagattgaagtttagatgctttgggaaaactttaatagggaataggaagttaaaacagcatatttgtccctctttccccacagtacccttcaaaataaagtaaaaggatataggttcaaatcctagtctaggaaaaaaa

SEQ ID NO: 489860 - DNA, 119 bp, Homo sapiens
ttaaactgtactaatggaaacactcatataatactcattttattgttaattaaagatactagttgttttacatttaagtggtacatttttgtcattgtattcccatagatagtggggta

SEQ ID NO: 489861 - DNA, 829 bp, Homo sapiens
  misc_feature (56)..(56): n is a, c, g, or t
  misc_feature (798)..(798): n is a, c, g, or t
  misc_feature (816)..(816): n is a, c, g, or t
  misc_feature (818)..(818): n is a, c, g, or t
  misc_feature (825)..(825): n is a, c, g, or t
gacaaatactctgaggctctcaaagatgcccaggagaagctggagctggcagaganaaaggccaccgatgctgaagccgagtagcttctctgaacagacgcatccagctggttgaggaagagttggatcgtgcccaggagcgtctggcaacagctttgcagaagctggaggaagctgagaaggcagcagatgagagtgagagaggcatgaaagtcattgagagtcgagcccaaaagatgaagaaaaaatggaaattcaggagatccaactgaaagaggcaaagcacattgctgaagatgccgaccgcaaatatgaagaggtggcccgtaagctggtcatcattgagagcgacctggaacgtgcagaggagcgggctgagctctcagaaggcaaatgtgccgagcttgaagaagaattgaaaactgtgacgaacaacttgaagtcactggaggctcaggctgagaagtactcgcagaaggaagacagatatgaggaagagatcaaggtcctttccgacaagctgaaggaggctgagactcgggctgagtttgcggagaggtcagtaactaaattggagaaaagcattgatgacttagaagacgagctgtacgctcagaaactgaagtacaaagccatcagcgaggagctggaccacgctctcaacgatatgacttccatataagtttctttgcttcagttctcccaagactccctcgtcgagctggatgtcccacctctctgagctctgcaggtggtctattctccagcgtgaccctggttctctctgcttagcatccntgccttagagccgggcanancactgtngctt

SEQ ID NO: 489862 - DNA, 174 bp, Homo sapiens
atgaactagaagcaagctgccctccacagagcggactgcaccatgcgcaggaatgtctcgactatgtccatgtcttcctgaagcagtagagcagcccgtagattcttgagcacatgcgtcatggattgtgcgagtattgggtcacaacttgactgtagagtctagcttgaagga

SEQ ID NO: 489863 - DNA, 898 bp, Homo sapiens
  misc_feature (124)..(124): n is a, c, g, or t
cgcaggcagcagccggcctctcccactgcagccctcccgcccgcctaccgtccggcgcgatggcggggagtagctcgctggaggcggtgcgcagcgaagatccggagcctgcaggagcaggcgnacgccgctgaggagcgcgcgggcaccctgcagcgcgagctggaaccacgagacggaagctgagggagaccgctgaacgcccgcccgctcaccttctctgaacagacgcatccagctggttgaggaagagttggatcgtgcccaggagcgtctggcaacagctttgcagaagctggaggaagctgagaaggcagcagatgagagtgagagaggcatgaaagtcattgagagtcgagcccaaaagatgaagaaaaaatggaaattcaggagatccaactgaaagaggcaaagcacattgctgaagatgccgaccgcaaatatgaagaggtggcccgtaagctggtcatcattgagagcgacctggaacgtgcagaggagcgggctgagctctcagaaggcaaatgtgccgagcttgaagaagaattgaaaactgtgacgaacaacttgaagtcactggaggctcaggctgagaagtactcgcagaaggaagacagatatgaggaagagatcaaggtcctttccgacaagctgaaggaggctgagactcgggctgagtttgcggagaggtcagtaactaaattggagaaaagcattgatgacttagaagagaaagtggctcatgccaaaagaagaaaaccttagtatgcatcagatgctggatcagactttactggagtaaacaacatgtgaaacctccttagctgcgaccacattctttcattttgttttgttttgttttgttttgtttttaacacctgcttacccttaaatgcat

SEQ ID NO: 489864 - DNA, 417 bp, Homo sapiens
gtatacgagtcacaccctgggctgagcagagcctttttgttagagagatctttgttacatatttgtttctgcatgccctgctttattaaaaaaaacttcagctaaaaataaatacaaaattaaaacttattaacacattgtagcaaaattaaatgtcattaaaagtaaaatgaggccaggcgtgcagtggctcacgcctgtaatcccagcactttggaaggccaaggttggcggatcacttgaggtcacttgagctcttctttggaggactttgagaccagcctggccaacatggtgaaaacccatctcactaaaaatgcagaagttagctgggtgtggtggcagatacctgtagtcctagctacttgggaggctgtggcaggagactcgcttgaacccaggaggtagaggtagtaa

SEQ ID NO: 489865 - DNA, 107 bp, Homo sapiens
aagatcccctcacagatgcgccgcatcgaatgcatcatttaccaccgcgatccgagcgctgattggcaggcagatagccctctgctgggggcacgcgggctccccgt

SEQ ID NO: 489866 - DNA, 335 bp, Homo sapiens
gcgcattgacccatgtgtgggtttctcatctgccgtcccttggagtgtgaattcttacgtgcaggaacactcagcatacacatcgtatgcgaagggcccagagaagccagacccagatacgaaaaaatagcctatttactttaattaaaccaaacattccattttaaatgtggggattgggaaccactagttcgggcagatggtattcttcagactatagaaggagcttccagttgaattcaccagtggacaaaatgaggaaaacaggttaacaagctttctctgtctttacatacaatgtcagatcagttatgggacaatagtattgtataaag

SEQ ID NO: 489867 - DNA, 614 bp, Homo sapiens
agactgcacacgggacgtgatggacggctcactatgcaatcgctgtgacttagaacaagatgtaagggacctgagctaagtatgtcagcagaccccccaaagcaaggactgtgagacaaatctggactcttgatcagatctgagtttatcattaatgtgtcacttgaatggagctttagaatcttgaaaatcgtgttccttactcagcagacacactcccacccacacccacagccacacatacattggggccctcagcctgaggtgccatccagccttatgtagggtcatggtacaagatcagactccatggcacacgattacaataggacagaagtgaaagtagtttttcttgtttatatattatcaagcaggcatctgatgacctgtggacattagaaataccagcaggcatttccaaggggtaggtgcacaggtcaccagaactcaactacagtgatcttcccttagatccttttctactgcaggtgaatagctcaaaagcacaaggcatgcctttcagtccaggctaaccccctgtagcctctaagcaattaacacagaagaaacggccttcctcccttcagcactggggacaccagtggccgagtgtt

SEQ ID NO: 489868 - DNA, 304 bp, Homo sapiens
tcccctttagtgtcaacgtgtagtatacaggtttgtgctatagaggacaagatgtcgtctgtgctgtggtccccgaggtcaaacagtgtttgtgacttccagaaagcttacaagctgactgaagaggaggccctggatgtcagcgaccactttccagttgaatttaaactacagtcttcaagggccttcaccaacagcacaacatctgtcactcttaggaagaaaacgaagagcaaacgctcctagaccctagggtctcatcttattaaccatttcttgcctctcaatgaaatgtctcttacag

SEQ ID NO: 489869 - DNA, 166 bp, Homo sapiens
ctcagtggccgtgtgttagcaagatatctaccattcgacataaaaataaggcaggcaacatagctttaacacaccattgatgtatgctattacacttttccagtggaagataacaaagcccatatcaaatttaacaacagaggaaaaactcgattttcagccactt

SEQ ID NO: 489870 - DNA, 139 bp, Homo sapiens
ataccgctgagtatcgcttcgaacagcagaactttgatcgctgagtaggctatcgtggggggattattgctccaccaaacattgctcagccattcgcggcggccattaacgtggtgggtgagcacagcctacggccgat

SEQ ID NO: 489871 - DNA, 1282 bp, Homo sapiens
ggataaagtatgatacgtagcggataaccgatgcgtcacttgctagagagtactaggatagtcgcgcacacgtcatgtcctccctattatgcctagaaggaataatagtatcgctgttcattatagctactctacataacgcctacaagcaaccagtccctgcatataaaccgattatgtgcctatggccattacgtagttctttggcgcgcgcgtgtcggaagcaggcgtgatggtgccatagtcgcgctactacgatcttcaattctccgaatgacatagtgtgcctagacctacggtaccataggcctataagctgactccgaatggtaggaaataatctgtcaccaacaatgaatattgacatagcaactagactatggactttccagaacggcacatgaatttcgaatcaaggagaagcacctcgaggagcctgaatttagtgagcatcgtcccgctactaattttctaaccaatatcaaacaagatactatgggagctgttccctgaatcctttaatccattccgtaacccttaaatagaacctcctcatcgctcaaatgacgtcacgtaaccttggactccctgctcgcgctacgacaatccatgggtggaagggcgaaacggccagacttggtcgcagttggaggccatctatctggggagaaatgaatttctagcgtctctcattactggatctccctaaggaatactcctgtaatgtggtggacatggcggagcaccagtagagagctaatgcatatgttaggatcttctatcgacaaccaagttaatggccgaagcttgggtatcatcaacccgatgagggcaaacgagcagaaccggcttgaacgcaggcactattactgtcctattgctaacaagcctaggttagggctccggttccccgtatggcatcgggacttagattgaacgtacaacaaaagcgcatagggatcagctaagcagtgctacaagttcagccactcactgtgggccaagaaactatcaaaactcctgaggccacaaatttaaatatggagtaaggttacacaaaaaggcggaagagagtaaagaaagccgttttacgggaccgcggatatgaatccgaaaaagccaagggcgaaagcccatcggtgggtacagagagctggccggaggacacctgaaaagcagggggacaggagaataaggcgtcaagcagacagcacacccgagaaaagagggcaacgctcgtggaaagcgtgagggaaacgaaccagcgcacgagcagaagaaa

SEQ ID NO: 489872 - DNA, 321 bp, Homo sapiens
acggttgaactaccctgacatggttcagctctgtatccacacccaaatctcatgtcaaattgtaattcccagtgttgcgggagggacctggatgggaggtgataggctcatgggggccgacttcccccttgctgttctcgtgatattgagtgagcgcttgtgggatctggttgtttaaaagcgtgcagccctcccacttcactctctctgtctctcctgctccaacatggccagacgtgcctgcttccccttcgccttctgccgtgattgtcagtttcctgaggcctccccagccatgcttccagtacaacctgccggtgg

SEQ ID NO: 489873 - DNA, 95 bp, Homo sapiens
ggtcgactcaaactctactcccactaatagcttttcgaagtccttgagagaggatgatgatgcgactgtgagtgcgttcgtagtttgagtttgct

SEQ ID NO: 489874 - DNA, 420 bp, Homo sapiens
  misc_feature (251)..(251): n is a, c, g, or t
gcgtcgaccaatgccatacaatactccttccgtggcctccaactgctcttaaacgctagtaaaaccaaatgcatgcttttcaaccgatcgctgcctgcacccgcatccccgactagcatcaccaccctggatggttccgaccttgaatatgtggacatctataagtacctaggtgtctgactagactgcaaactctccttccagactcatatcaaacatctccaattgaaaatcaaatcaagagtcggctntctaatcctcaacaaaacctccttcactcacgccgccaagcttaccctagtaaaactgactatcctaccgatcctcgacttcggcgatgtcatctacaaaattgcttccaacactctactcagcaaactggatgcagtttatcacagtgccatccgttttgtcactaaa

SEQ ID NO: 489875 - DNA, 403 bp, Homo sapiens
  misc_feature (57)..(57): n is a, c, g, or t
  misc_feature (304)..(304): n is a, c, g, or t
  misc_feature (312)..(312): n is a, c, g, or t
agattcactgtttagaagtttagtcccctgcagaatttaaaatagaaggtctcaatncagagaaaacccaaggccatttctgtgcttcatcatcatatccaaaccaaaactgggaaatcaggctgggcacggtgggtcacacctgtaatcccagcacttcgggaagctgaggcaggcggatcacttgaggtcaggagttcgagaccaacctggcctacacggtgtaaacctgtcactaataaaaatacaaaaaaaaattagctgggcatggtggcagatgcctgtaataccacctactcagganactgacgnagaatcatttgaacccagtaggtgaaggctgcagtgagctgagattgagccactgcactccagcctggacgacagagtgagactccatctc

SEQ ID NO: 489876 - DNA, 235 bp, Homo sapiens
catatggaagcacaactccaattcacacacatatgcgaaacacttatccagagtttccacaaaaacctagaaaacaaggagaactagataacgaagagaaatcggaacacattcacagctttatcaatgtcacatctgaacgtaaaaggggctgtcacaatactatatacttaatgcataaaatctcaacaattaaaacacctacctttagtctccagcattcactgatcaccct

SEQ ID NO: 489877 - DNA, 253 bp, Homo sapiens
cgaacgatatacagagatacccattcatgcagggaggcaactaatactcatgacaagtattttaccagtgaaataggctcacggaggttgacatataaatctatgacattattcctgtggggaagtatatttccaactttcaaacaagtaatttgttaagtaaactttcacgaactaaagtttgtcgtggctatttttagaattttgctactggaagggtgctttgtcattataacctgtaaatgaattgaat

SEQ ID NO: 489878 - DNA, 185 bp, Homo sapiens
ggggaaaccccctttttaaaaaaaatgccaaaaattagcaggatgttggggcccgggcctgtagtcccacctccttgggggggttaggcaggaaaatcgctttaaaccgggaggggggggtttcggtgaactgagatcgccccagggccctccagcctggggaacagaggggggcccccttccca

SEQ ID NO: 489879 - DNA, 154 bp, Homo sapiens
ccccggatagggcctagagactggcggcgcagatgagcgacgaaccgattccgatggatgccagtacgctggggcgttaaacccgaatcggttatgggtgcggaaattgttgaagggtaaagcggttaaggcggggtaatctgctctcgcagtg

SEQ ID NO: 489880 - DNA, 263 bp, Homo sapiens
aagtcatcctcagacgtctatgtcagcgcctcccctttccaccatgtctttcagggctgagaggcaggcagagccctgagaggtgacatttccagcattctcgtgtgcacagagggaggcctctagccccagatcagtctcctagcggaagccctaggagatagcaatgagatatggaagagctgccgctttagcctgcaagtcagaagaataaaacacacaggcttagggcaggcacagtggctcacgcctgtaatccagca

SEQ ID NO: 489881 - DNA, 181 bp, Homo sapiens
cgagagaaacttaggtatagcaaagtagccctggtccagcctgaggatcactagtactcccttgaagtggtcatcaacccatatacctacaccaaccactagtagggctagtactgtcatccctgaccctatctgtacacacagacgcctatgggtagacgtgctagctaccactacctag

SEQ ID NO: 489882 - DNA, 489 bp, Homo sapiens
atggaattgaatagagaacccagaaataaatccacacacctacagctatcaaatcttcaacaaagttgacaaaaataagcattgggacaagaactccctactcaataaatggtgctgtgatagttgactagccatatgtagaagaatgatacttgatccgtactagcagcatatacaaaaattaattcaacatggattaaagatttaaatataagacctcaaactgtaagagtcctagaagaaaacctaggaaacacaattctggacgtcagcctttggaaataatttatgactaggtcctcaaaagcaattgaaacaaaactaaaaattgacaagtggaacctagttaaactaaaaaactacacagcaaaagaaactatcaacagagtaaacagcttacagaatgggagaaaatatttgcaaactatgcatctgacaaaagtataaccactctaaagaatctatacagaacttaatagagcaagcaaa

SEQ ID NO: 489883 - DNA, 298 bp, Homo sapiens
  misc_feature (140)..(140): n is a, c, g, or t
  misc_feature (181)..(181): n is a, c, g, or t
  misc_feature (248)..(248): n is a, c, g, or t
  misc_feature (261)..(261): n is a, c, g, or t
  misc_feature (288)..(288): n is a, c, g, or t
aaaaacatatgaaaaaacctcatcagttgggcgcggtggctcacgcctgtaatcccagcactttgggaagctgaggcagttgtggtggtgggggcctgtaatctaatatccagaatctacaaggaacttaagcagatttncaagaaaaataaaccatcagaaagtgggcaaaggatatgancagacacttcgcaaaagaggccatttatgtctgtggtctcagctactcgagaggctgagacaggagntttgcttgccctnggacgtggatgttgcagtgagccaagnttgcgccact

SEQ ID NO: 489884 - DNA, 288 bp, Homo sapiens
  misc_feature (199)..(199): n is a, c, g, or t
aattcgtgagaccagaagctcttgcagaactcatgattgatgaagcactgttccaggcagtgaggacgcagtggcctatggaagacgctcttgcggaactcatgattgatgaagcactgctccaggcagcaaggatgcagtggcctatggaagacgctcttgcagaattcatgattgatgaagcactgttccaggcagngagcacgcagtggcctatgaaagatgctcttgcggaactcataattgatcaagcactgttccaggcagcgaggacgcagtggcctatgg

SEQ ID NO: 489885 - DNA, 940 bp, Homo sapiens
ggtaagaggtggcggtggagacgctacgctggcgtaagaggtggcggtggagacgctacgctggcgtaagaggtggcggtggagacgtttcgctggcgtaaggtggcggtggagacgttacgctggcgggcacgatacaactgcagctgcaataaactggtccttatacctgcttgggcttctaacccagaagtccagaacaacaagtggatcactgcaatcggactgatgtgcttcgggaacgtctgaccgtcccgctacagctagcaatcacctgaccgaaacttcgcgtatctggcaactgtgtcactcaccggacgacccttcgccttttagccttctgtacctttatttgcccgtagctgctcagtgacacgatcgtgaacgtggcaggttacagagttctaaaaggcactgaagcccgtcatcattccctatgcattgcacagagatccgagatacttccccaagcccgacggagttccagcctgagcggatcttccccgcagcaatgcacaagggcgccatccatatgcctacgtgcccttctctgcatggccccaggaacctggataggtccaacagtttgctgtgatggaaacgaccgaccatcctcccgtgcatcctgaggcacttccggatcggcatccacccacaacagaaaagcactggccccaaaacggcacgccgctactccgccccagcgtacagggccatctgcgtccggctcacgcacgcgcaacgcacatcaacgtcacgcctccatcgggcgggccctaaccccacgcacgcccccactaacaagaccccgccccccccaccccggcccacgagccaacacacgaccccaaaccaaccccacgacccagtgacgccaccccgcacacgagaaccgcgcgacaccgccccacaaacacgcaacgacgcccgcacgcgaaag

SEQ ID NO: 489886 - DNA, 201 bp, Homo sapiens
gctggtaccgcgctgtgggacgcgctcgcgcaagctggtgctggcgcgcgacgcatgggcgaaaagccgctgtactacggttactcgggcgccgagctggtgttcgcctcggaactcaagggcctgatgccgatccccgggttcggccgcaacctgaaccgcaatgcgttggcgtcgttcatgcggcacaactacattccg

SEQ ID NO: 489887 - DNA, 405 bp, Homo sapiens
taacctaatcccgggaccccaccttttgatagtgacaggaggcagacaaatcctaggcagacagggacaggttcccagtgaaaccccacctccgagccaaagacagtttaaagcctgaaagccaagctacaaattaaatcctcagcctggattgagaacccatcttcccatttggctgctttcctctgattgatccccacccttcacctattttacatgtacctatcttttcgtaattcattttgtacactggcatgcccacctttgagtggtacctttgtctcagccttttctgcataatcagaagccaatcagcatgcactcccccattctgagcccataaatgccccggacccagccacactaggagagaaaccacctgacttcaggtcgggaaccacccgt

SEQ ID NO: 489888 - DNA, 164 bp, Homo sapiens
cggatctgagatatctcccagggaggttcacttcccggactttccttttcccagaaggaggaggggaaaaatgaccaagttccaggaggcaagttacattcaagggatgtggcttttgcccttcactgagggaggaccttggccttcttgaactttgcccaaag

SEQ ID NO: 489889 - DNA, 398 bp, Homo sapiens
aatcagagattcagtccctcggtggcaccagacacatttcaagtgcccagaagccccatgtggctagtggctctcatgggatgttgccacaatacatcctttccactactcactacgaaagttctgctgggacaggacctagtgctgctctagacactacggttgcctgcggccatggcaaccacttggccccttacctagctttacttagctcccatagcacacatatgatctatacaccgtattatgtctctgagcaccctcggttcatcacatttattgtgatctccggtgtctagaacagttcctggtctgccactaagcaccccgaacacgatattcagaatgactgacattgcctgaatccgcattgctttgcatgaagcctaacacgtagt

SEQ ID NO: 489890 - DNA, 220 bp, Homo sapiens
cagggagaattgcttgaacccaggaggcggaggttacggtgagccgagatcgtgccattgcactccagcctgggcaacaagaccgaaacaccaaaaaaaaaaaaaaaaaaggaaaaaaaattaaattaaaattaattgcaaaagagtaatagctttaaatggggaaatggggattaattaattttttttttttggaaacaaggggaaccccgggggaccc

SEQ ID NO: 489891 - DNA, 818 bp, Homo sapiens
  misc_feature (46)..(46): n is a, c, g, or t
  misc_feature (50)..(50): n is a, c, g, or t
  misc_feature (64)..(64): n is a, c, g, or t
  misc_feature (238)..(238): n is a, c, g, or t
  misc_feature (263)..(263): n is a, c, g, or t
  misc_feature (284)..(284): n is a, c, g, or t
  misc_feature (288)..(288): n is a, c, g, or t
  misc_feature (291)..(291): n is a, c, g, or t
  misc_feature (296)..(296): n is a, c, g, or t
  misc_feature (310)..(310): n is a, c, g, or t
  misc_feature (330)..(331): n is a, c, g, or t
  misc_feature (355)..(355): n is a, c, g, or t
  misc_feature (380)..(380): n is a, c, g, or t
  misc_feature (429)..(429): n is a, c, g, or t
ccccaggctctctacctgctcagtggagagcggggagttgtgtccncctngccgacgtcgctanccgtggggctgtcctgggaaggcggacggcgagcgcccggtgtccgcactcggccgcctgccgtgcccgtctgcgcccgtgtcatcctcactcgggacgcagggaccgtttttaaatcacaggggcgtgtgtcagcctgccctaggacttcatgtctatatatttccccattcnctgccccgactatctgagatcggcnagatgactgaggtgatgatgnacanccngcccntggaggagatcggnctcagcccccgcaaggatgnnctttcctaccagatcttcccaganccgtcagattttgaccgctgctgcnaactgaaggaccgtctctccatagtggtggacccacagaaggggaggtngagagcggggagctccggtggacccctgaggagtacctggtccaggaggatgagcaagaataactgcgaagagacagcgacaggaaaatcaagagcagtaggaagtcccctgtggactcccatgggtcataccagacagcatctgtacctgaactgtgttttatcccaatcatgacggaagaagagagtgagccgcaattgttctgaaaattgtcgaaacgaagggctatctgtaatatgcaccatgggagaatcaccggaggtatgggtattctttcttacttatactgggacctattatgtattaaagagagacacttgggcgaaactattgggaccccctgtgagaaattggggaggggccatttgaaaaaaggagatggtttaaa

SEQ ID NO: 489892 - DNA, 136 bp, Homo sapiens
tcaaagggaatggtataatcatgcaaagctttgggactgggctttttttcatcagcatcaggcccttatccaggtggttgcatcattatgggtggaattatgtcccacccaaaactactgcacgcaacgggggcgg

SEQ ID NO: 489893 - DNA, 460 bp, Homo sapiens
tgcgcggggtcatatagagagaaaggcaggtgggaaacgtggggagtgagaaagagtgagagagcgatataggagagggagaagggaaacgggcggatgggacacggctgcgggtactagagtggcagagaacagaggagaaagaaaagagtgaagggcagaaaccaacggagagtaatggaagccaaataggggggtgttgaagatactaataagcaggaactcgtgaataacggggctgacacgggtcccagagggtaatggtatacactaagcaatgcggaattacaaacaatattatgggtaaaagataattagggctgataacttgcgcgtagtgggccgggccggtgaaagtgcgctgtagagggtgacataaaccgtgcaggggtgcagaaagaataatagtgtataacgaaaattggatgagataattatggcctggacaaataaacctttg

SEQ ID NO: 489894 - DNA, 1301 bp, Homo sapiens
gctcctccgagctcgctgttctgtcctgggttttttacgttttaatttccagtgacttgaactgccatgtcctctgaagaagtgaaagctcttctgtggtgagtggctcaactttaacacctgactgatgcagtgcactggaatgaccacttcagcagtttctggacctatctctgagtgtggtctgttgtcaatggaccgggagactcagctgtgtccagtgagtttttggtttcatcaccttcaccaacccagagcatgcttcagttgccatgatgagccatgaactggagagtactctggattgtgtctgtcagatcctgtgtgtgatcatgcaggcaagtctgctctggggaaccagaggaggtggctttggggcccatgggcgtggtcgcagctactctagaggtggtggggaccagggctatgtggagtggcaggtattatgacagtctgaactggagggctctggatatggatatgtgacgttccagcagactatcatgtgcagaaaccagtggtggttatgacctgctactcacgcagtgccatcacagcagacaacttatgcacacactgaaatgcataccattgcacctactactcgatacccactgaatactctcctgatccagtgatcgtccttacaaatggctgtatccttaccatgtccaggcaccttactacctgacagcactctataaatacccataactcactatacacaccatttcttgtttctccacttttgccccttgtccaatgcaagcttgacagcacattctatacacacatccccatctttctctatttcaaacattcttttcactgtcctcacttacacactcaattcatctgacccgtcttgtgtaccaaaccgccatctggcttatctctattactatacttcatcgcactcttcgactacgaatcgtagtgccctaggactcatcagtggcggcatttcacgtagagcttgtatttcatgtccgatcttcattctaccctcctacccctccatccaccaaccatcctcctcctaccagacaccactataacacccctactaccgcactagtgtacatctaactccaccaactcaccgtgactgcctcagacaacactaaactacacattcacacatcttagcacacccccgcctacgacacatcacacctcacacctagcattccatatctcactcacctacttactttcacctaacttctcctgttcatcacttttacacactactccttacttcaactcctctcttacgctctctcaacgcctatcttact

SEQ ID NO: 489895 - DNA, 490 bp, Homo sapiens
cacaaacctatgctccagtgtgtccagcagcagcaccagatttctccctctgtacgtctctctctctggttggtcctgtctatcgctacagatgagcaagaagcatccatggactgcccagggtttacgtttcccatacctctgctgtgtgagatctggagaacagaacacatccagtcagtagctcacaccccccgatcacaattctcagccttcacattgtgcaggaaaacagctggtcacggcaggctgctgacaatccatttataagccactaagcaagttatgacagctagacagggtcatttctgtagtcactgtgttatatgttacagcatatactgatcacctcactggtctaggaagtgagaatgatactttcagttcaaatcttcagtgtccggatgtcatatcaaacaggaagacactctaccactttgctgcttgtattagccaaagcaactgcgggtgtcagagcaactgaccaccc

SEQ ID NO: 489896 - DNA, 123 bp, Homo sapiens
  misc_feature (52)..(52): n is a, c, g, or t
attctgaaaattcttacaggttgaatacctaaaatttgtcactgacttgtgnttcctgaaactatgacacatgaatatgtgggctaagaaatattcctcttgataaataaacaattaacaaat

SEQ ID NO: 489897 - DNA, 1086 bp, Homo sapiens
aaacacataattccgaatcagcataaccaaccacagcctaattattagcatcatccctctactattttctaaccaaatcaacaacaacctatttagctgtccccaaccttttcctccgaccccctaacaaccccctcctaatactaactacctgactcctaccactcacaatcatggcaagccaacgccacttatccagatgaaccactaactcacaaaatatactctaactctctatactaatctccctacaaatctccttaactttctaacattcacagtccacagacctaatcatatttatatcttccttcgaacccaccactcatccccacccttgcctctcatcacccggctccagagcaaccagccaagaccaacctgaaacgcacgcacatacttcctacttctccaaccccatagctaacgctacacaattccatcctacatcaatccgcacctacctttctacacatcatacattgcatccttccgctcatctcaaccattacatacatagcctcactctcacctgcccaacgcacttatcatacactacctgatccccacacacacttactatcgactactcctcacaataactagtcttccatccgataacagaactcccatctacacgccgagacgtcctccttactgactctccactctgcccatagatcgacacagccccaacgggcgggatcaactagataacgtgaccgcagggtagcaccttcagacgtcgggcacgccgatgggactaactccgactccgccctagtcacgcatccaccagtgaacaagacatcaggctcaccacagtcgttgtgctagtcgcttgcactgcgttgtctatcccgcgggcatggaccatcgactagagactcaagcacgacgccgccactaaacgtcccccatatcaactctgcacggcctacaccagcccgagccagactccacgctgacgagcacaccaaccgctacacaacgggcgcgctatgttcgggcaaacccacgctgcggtgccgagccacaagacgacagtaagcacgctacggccagagcacacgcactcctgacagt

SEQ ID NO: 489898 - DNA, 181 bp, Homo sapiens
gggggggaaaaattttgaaaattaatttttttttaaaaaaccaaaaaaggcctttgggcaatgtatttttgtaaaagcttttcaaaaaatctgtctttgggagggcttttgctgcccccccccaatttataaaatgctattaaaaggtttaaaaaaaaagtttttattttttaaagggcca

SEQ ID NO: 489899 - DNA, 844 bp, Homo sapiens
  misc_feature (3)..(3): n is a, c, g, or t
agncgaaaaaaccagatagacagggaaacccaacagcgcacaaagggtgggggctcacggggcccagccgaattcgcacagtggttctggacgcataagtgtaaagatccggacctgggcgccaacgccgcagtaccgggtcccgccgggttgcgcgccccggccaatgcccgtgcccccttgtgggggccacgggtcacacacaagtcgctgccttacagaaacagtggtcgcccgtctggtccacaagttcggcagggcccccatctctaaagtctggagcccccccggataaggggccccgccacgccccactggtgcgagaggtggtccaccagtaccgcaccccctggggacgccgtcgcgctcgccgaacaatcagccacacgaccaagaggggctatccaaaacacatggccccaacaaggcatggtcgccagaggggcacatacagcccccaacagatgttcgcccgataagatccaagagcgcgaacagcaatccttgacccctatacacgtggcccccgccctccttaccacggtggggggacacccgtttgctaagcaaggcattgttacgcactggcgccccatgcatgttagtcagtcaaaacaagcgtggtaagaggcacaaagcggcttgcgtgtaccctccaaagtaggacaaagaggatcatttattgtgaggcccccacgtggcggtttacctattgtgcgcgtcgagagcccggttcttactgataagggtgtttcaaacgaagcccatttttgttgagcgacgcacgtgccccaattaccccagagtgttgggaacccgtcaaaaatcaaaaggaaacaaaaac

SEQ ID NO: 489900 - DNA, 206 bp, Homo sapiens
aaaacatagaaaatggattccaaacaatgatggtatttaaaatatactacatttcaaattagtacagagattatggaaaacagtatggaggtccctcaaaaaactaaaactaggatctacaagtatgatccaacaatcccactgcatgggtatatactcctaaagaataggatatccagtatactgaagacgatatcatgtatacc

SEQ ID NO: 489901 - DNA, 163 bp, Homo sapiens
gtgtgtacgacgtaagtagtacagaaaggaagtagtacagaaaggaagtaatacaggaaggaagtagtgcaggaaggaagtggtacaggaaggaagtggtacaggaaggaagtagtgccaggaaggaagcaagtataggcaaggcaagtaggtgaaggcaagg

SEQ ID NO: 489902 - DNA, 288 bp, Homo sapiens
cgtataatctatacatgatttaaatataggtttagtttgtccgtcagagggaggaacgaataaattatatgtgaattaactttcttccttattacaatgtattacttccatggccagaaaaaaaagaaatacttctttgttttgtttttgttatgagacagtgtctcgctctgtatgcccaggctgtaactcggtggtacaatcacagctcaatgcagcctccatctcctgggctcaagccatcctcccgcctcagcctcccaagcagctgggactacttgcatcact

SEQ ID NO: 489903 - DNA, 355 bp, Homo sapiens
  misc_feature (9)..(9): n is a, c, g, or t
  misc_feature (21)..(21): n is a, c, g, or t
  misc_feature (40)..(40): n is a, c, g, or t
  misc_feature (122)..(122): n is a, c, g, or t
  misc_feature (133)..(133): n is a, c, g, or t
  misc_feature (204)..(204): n is a, c, g, or t
  misc_feature (263)..(263): n is a, c, g, or t
  misc_feature (269)..(269): n is a, c, g, or t
atcttagancccttttattcnaaatccctcctgataagtnaaagaagccagtcttaaacagctacatactgaaccaggcatggtggctcatgcctgtggttgcagcactttgggaggctgangcgggtggatngcttgaggtcgggagttccgggccggcctggccagcatgacgaagccccatctctaccaaaaatacggaanttggctgggtgtggtggcgggcgcctgtggtcccagctgcttgggaggctgaggcgganagaatngcttgaacccaggaggcagaggttgcagtgagcggagatggcgccactgcactccagctagggggacagagtgagactttgtcttc

SEQ ID NO: 489904 - DNA, 289 bp, Homo sapiens
tttgaaaacctgcttccctgggtttttcaattttttttttaaacaacccttaatactgccagaccacaattcagacagggggctttttgtttataaagaacaaggaaggggtcctggaatttcccttgtcctttgaaacttttgctggccaagggtaaaagtgagggcatgccttttgctcacccccaaaaccccccctggggtcccctgggccttcaaaccagtggaaagacccaacgctttttgttttatttagccaaaatttggttatgctttccccaaacctgga

SEQ ID NO: 489905 - DNA, 379 bp, Homo sapiens
  misc_feature (183)..(183): n is a, c, g, or t
  misc_feature (195)..(195): n is a, c, g, or t
  misc_feature (204)..(204): n is a, c, g, or t
  misc_feature (243)..(243): n is a, c, g, or t
  misc_feature (272)..(272): n is a, c, g, or t
ggatgcgggctctcgaactcatggcttgcctcattggtcacaatcgtggacaccgtcatgccctctgatcaggaccagcctccagttcttctgagagtgtgacagtgtccacccggctctgcagcacttaggggaggggacacatggtggttccatgggcttcctgggtcgccactctccggntgccctaaaggngatggatcnggtgcttggccctgcagtccccgcgcttgagacttaagncgcatgtggcacaccgctccttccagcantagtcgcgttactgttacctgtttaggcctagaagtttaccctcatctgtaaatgtgatttaaaatctaagccatgaatatgctttatttattaaaagagttatgcg

SEQ ID NO: 489906 - DNA, 179 bp, Homo sapiens
ggatcaccaagcacatggtatgcaatcatcactgatatcagcatcctattaaaatattatctgctatcttgtcccacttcttgctctagtcagcaacaaccaagtagtgcttccataaaattctctccaagtcttccttccctactgttaggactgaggtgtcggcgttccagaatggt

SEQ ID NO: 489907 - DNA, 1574 bp, Homo sapiens
taaaaaagggaaacaaaaaaatctgagcaatttattattatttttgattatattggaaacagagtctcactgtgtcacccaggcgtggagtgtgcaggtggcggtgggtgttcagctctcacagcaacctctccacctctcccaggtttcaagtgtgaactcttcggtgccttcagcctacggaacagctgtgggacaacaggcttcccgtccacccatgtgccgtggcataacttattttatttatattgtgtgtggtgccaccagagagagtattatcactatctctgtgtgatcccacacacgcgtggagagaactgtgacagcagggagacacacacacacaccaatatgttcacacgtgtggcagcccctctcatgagagcagtgagtgggcctctacgacctctctcccccacagagatagacgccgggggacactgtgcgccgagcggcgcctctcacacacacactccgagtggcgcccacagagcacccaacagacaagtgtgagagaagatactctaaccagcgtgtgccgcctcacagtgtgcgcgcgagagacataaaagctgccccaacaggccgaggagagaaagaaaaagacactctatagagaggagacagtgtgagagagaggggcgagacacaacactcctgctgagacaaaacacatgttataccccccgcagcagtggggagggaccagacaccaccaacagtcgcgtcccctccatagagccgccacacagcagaggctgagagagagacgagagtcgtccgcgtcacgacccccccaagaagaagagagcacgagcagagaagaggcgcacacactataacagaagaaaagtggcggcactaataacaccaccagcggcgcaccatatctcagagagcagcaaatcttctccccaacagagagagagcaccgtgtcgccccacacgacgaaccagcaacgggcacacaatgtcgcgcctcttcaaaaaacctctgtactacaccaccacaaaaaaactgtgtcgtcgacaaaaaaacaccaaacagaaggaggcggagccccatctgtggcggcaacgaacacccctccccagggggagccaacaaccacagcgcgccctacgagcacaactgcgtccccacaaacagacggggcggccacccaacagggaagaaaaagcaaacctccccattgatgaagaagaagaatcctacttgcagagggaagaaggcgggcgacaacaagacaacagccccacacggtgagcgccaatcagtcggagcccgcaacccaagcgagcctcccctgcaccaacaccctcttactacgaccaagcatcgccccaaaacacacggtggcggtgccactgcaacaaacaacaacccccccctaaagacaacagctactccccggcagggcgcgcggccacccaacgcaacccccacctcggtgcataatagtgcgtagagccacccacaccagcgcccgctccccccacaccccccccactgatataggcgaagagaaaacacaagtgacggcacacgatcacctgcgtcggcagatacgaaa

SEQ ID NO: 489908 - DNA, 186 bp, Homo sapiens
atgagtcatcccagtctttgatgacagtacctagactgagcatatttggtggtcactatgggcaagatcagaattcatgaacagatctttcccaccatttctcgacaccgtatcaggtagtctggacatgagccatcgtctgtactcatccggcataacatacatgtataaaatgcacaccatcta

SEQ ID NO: 489909 - DNA, 508 bp, Homo sapiens
  misc_feature (442)..(442): n is a, c, g, or t
tgggatggagtctggctctgttgcccaggctgctcactgcaacctccgcctcccgggttcaagcgattctcctgcctcagccttccaagtagctgggactacggatgtgcactactacgcccggcttatttttgtatttttggtctagatggggttttgccatgttggccaggctgatctcaaactcctgaccttaggtgatcttcccgccttggcctcctagggtgctgggattgcaggcgtgacacccggctggctggctctttttactttagattgtatctgcctggatttggacaatgccaaattttttatgtaatcaccatttggtttggggactggagagctctttcattttctaccagttcaaaccaccattagagtctttcagttaattccccaattggtagcaaggtagaatcagcagggatagcttaatttncctatgggattccgtttgggaaaggcagtctatagcaggcagataaataatgtggtggaatcattc

SEQ ID NO: 489910 - DNA, 197 bp, Homo sapiens
ggccgcagtgcagctgcatgccgcaggctgactcttagaggtatcccgcaagtagactcattttcagattcttaacttgatgaatacaaagaaagagatactaaggtcttcctattaactagcaatccagtgtcttctcagaaacaaccagccttcaaggctacaagtggcaagggcaagccagcgaagatcgtcat

SEQ ID NO: 489911 - DNA, 607 bp, Homo sapiens
tccttcattacccctttattacaagtcacgccctttatagaagtttttgtggacttcacgtgaaaaatatcaattgttctcccagaataaaaacacacgagcacataagagtagtatagtgcttcccaggtgtttcgcccccaaaacacggcgggcggcccaagttaaaagctctctctaaaagcggccgtgactggggcaggccgggtttgccacaacggtctcgcgggcctctctaggcacccgtgtgttgtgggcgcccgcctgtgccctcctctcgcgggggcccgcggacggcgcggggggcatgccacgcagttctccttgagggccctccgaggccacggggggagaccccgagtgcccgcgggccacaaagtcccctgaagcgcacgaggcagaaaacacccccttttgtgggacgcgggagcccgataactcaggtgggccctccacggaggcagaaccacggcatcagtgttgaccagaaccacccccccacaaatacaccgcggtgagcgcacacataagcggcccgtgggcccacagggtggattcccctttcgagaagccccgacagcaataaaagcgggcctttacacagaac

SEQ ID NO: 489912 - DNA, 119 bp, Homo sapiens
cacgcctgtaaatatagaaggatatgaagatcaggtcttaattacaagagcacggtgacctgggtaatacgctagatttttagataccaagataacaaaatttcctttacaattttgac

SEQ ID NO: 489913 - DNA, 335 bp, Homo sapiens
  misc_feature (3)..(3): n is a, c, g, or t
  misc_feature (21)..(21): n is a, c, g, or t
  misc_feature (104)..(104): n is a, c, g, or t
  misc_feature (119)..(119): n is a, c, g, or t
ggnagggatcactggtactcnaccctgggcaacagagcgagaccctgtctaaaaaaataaaataaaatagactgcagcataggatggtgatttggagtgtaaancctggagccagactncccaggtttgaatcctggctttgctattctccacgttgggcaatttataaataaagtaaaacatttccgatccttggtttccttaattgtaaataaaaatagtaataacagccgggttcaggtgcttatgcctgtaatcccggcactttgggaggctgaggcaggtggatcacttgagcccaggagtttgagaccagcctgggcaacatgggaaga

SEQ ID NO: 489914 - DNA, 413 bp, Homo sapiens
  misc_feature (17)..(17): n is a, c, g, or t
  misc_feature (73)..(73): n is a, c, g, or t
  misc_feature (89)..(89): n is a, c, g, or t
  misc_feature (114)..(114): n is a, c, g, or t
  misc_feature (120)..(120): n is a, c, g, or t
  misc_feature (126)..(126): n is a, c, g, or t
  misc_feature (159)..(159): n is a, c, g, or t
  misc_feature (190)..(191): n is a, c, g, or t
  misc_feature (193)..(193): n is a, c, g, or t
  misc_feature (222)..(222): n is a, c, g, or t
  misc_feature (266)..(266): n is a, c, g, or t
cagtctctgggcctgcnggtgtctggcgttgcggtggtacctcagctccatccccggggaagtagagactganaatgtgggtacaatangcacagaggttgtgcagcccacgcnggtggncctgcngcttcccactgggcagctttgcctgcagcagcngggccaagtagctgacgacgaaggcgtcccnngnggccggggcatctccaaaggggagctttngggggcgcaggggctgggagagcagggtcagagactcccgagcntctgggtacagctccttctgcagctcttcctcgtcctcaggcctgtgctccccagtgagcagctgtagccgttccatgtactgccgctgcatgcggccagggaggaagaagtggaggggaaagggcatagcctctgcataccacttc

SEQ ID NO: 489915 - DNA, 312 bp, Homo sapiens
  misc_feature (10)..(11): n is a, c, g, or t
  misc_feature (23)..(23): n is a, c, g, or t
  misc_feature (58)..(58): n is a, c, g, or t
  misc_feature (77)..(77): n is a, c, g, or t
  misc_feature (130)..(130): n is a, c, g, or t
  misc_feature (206)..(206): n is a, c, g, or t
  misc_feature (291)..(291): n is a, c, g, or t
  misc_feature (301)..(301): n is a, c, g, or t
gagacaaggnntcgctgttgccnaggctagagcgcaggggcacaatcaccacacactnccgcttcaatctcctgggntcaaatgatccttccacctcagcctcccatgtggctgggactataggtgcatnccaccacacccagctaattaaaaaaattttttgtgtggagtctatgttgcccaggctggtctcttaactcctaggntcaagtgatcctcccacctcagcctcccaaagtgcttggatgacaggtgcgagccactacacctgggcccacattttttaaaagnggacactgtnccactaccata

SEQ ID NO: 489916 - DNA, 589 bp, Homo sapiens
taaaatttccatcttaaaggaaatgacttgggaaataacgtactttcccatgaccccaatactacagttttgcggagctcaccagtaagatacacagaattacattccggtaattaatatgaagtgccacacatgtgttcaagccagtaattggtcacatgtggcaaacaaaattcaagaaagcaaccatcaaacaaaaagagacccatagcttcagacagggcaaactcccgaggatagcatatgcagaaacagccgtggcgtgctaacagcgaaagggtatccgggcaataaccaagtgatagagggcgtgccaagagacgtggtcccaaataccagcaccgagaaaccgagccacctccatacagtggtgtgcagcaccgtggccaccatataaaattggtggcagccagtataatcaaagtggtctctcgtgaggatagagttgggcccctggtgtcttagagaatctccctttgggagctatacgcgtgagaaccacagccaattcttgtgggcccccaatttaaaaaataccggtaaaaggcccttcttccaggtcccatacaataagcctctgggtcagaaa

SEQ ID NO: 489917 - DNA, 194 bp, Homo sapiens
accacgagcgtactgcggtgggagagcagcaagtcggggaaacgagctgctcgggctgccctgaacccctgtgccccggcaggtagggtctgtgctgatgaaggggttggggatggctcatgcgtcctgcggcggattagcacacggatgtgccctggataccatgagtcccagctgccgggtgtcctccgtgg

SEQ ID NO: 489918 - DNA, 186 bp, Homo sapiens
gccccccccctttttgcccccaggtttttttgttgtgagggaccccccagggggtgatttaaaaaggtttattttttcatttccaaaaggaaaaaattgggctttttttttaagactttgagattcccaatcaccagctttaaaaaaaaaaggagcagtttggcttccggaaggaaaagggggcca

SEQ ID NO: 489919 - DNA, 1731 bp, Homo sapiens
agtgtgtgtgtgttgtttggtgttgggtgtgtggttgttgctgtgtggtgtgtgtatactaggtatgattatgtatattatgtgttggtgtgtgtgtgtctccttctgctagttgttgttgttctccggcaacacacgctgatataacagtatccgcgggtgtggatgttcctagtaccaacacgtatcaagtgtgggttatgaggggtaacacaccggtgtgttgtgatacctgctgcgagatggggagtttcccacaacacagtgggtgtgtgactcccactagtgtagctcccaggtcgcggtgggttaataaaaccagtccgcggctccccccagggtgatgccgtgatggtgatcctgcgggccgcggtataaagaggtgtgatccacaagacccccggtgggtggggggcacccaaaaatggtcgcgccacaacgtaaggaaccccccagtgtagccgactcctcccaaatggtgggtgcgtccgccgggaacacccccccgggttgtacgcaaagtgtccgctgttgtcgcggggaaaaaagttcttcagtgtcacccgggggggaaacccagagccgccactaggcgccctcggcccacaaagagtgtccccgtggggaaaacaccccgcggtggggaaatagtgttccccaaaaaagatctcagggcggtgtgtaataggaaaaccgtgatgtgtgaggtcccccccccccgcgaatagaagcatcaccaagtcacccggtggtgtgtctcggaagacaaccccgcgttcacaaggccgtgagtaaggtcccacacgtgcccccccgccccctgtgagacgtgtgtgctgcgcagtgtggagggtggtacccgtgtgagggggaaaccaccagacacgaaccaccgcttggggacacgcagaggcccgagaagggcccccccggtggagataggtccctcccccacacacggtgggaacaacggtgcgaaaggggacccccccgtgatgataaaaaatacagctgggtctcgaccgcaccactagagaagagtgatcataaaaacaccgggggtggctccacacaaaagatagccgtgtggggcctcacacaaagatagggtagtagagaaagtgtcggcgtgtgtgtgtgcgacccgctcacagaacagggtgctgcgctgtgaggtcaacacagccacagagagtgtctcaccccggatagactcgtctgcgcccacagaggtgtgtatatagatgagagacacccagaggaaaaagagtgtctccgctggctccccctgcgtccgccacacacacacccgcaccgtaacaacacagagggggtgggcccacacaaagagtggagagttgaagagggtgacagagcgcacaccacagtccacagagtgtcaccacaaagtgtaagagaagaggtgtgtgtagacgtctgtggccgtgggtgagacgtgggtgtgtggtcaccacgtgaagatagtgtcaccacacaccgagtgcacaccgtgtggtgtgatgtacaccagcagtccaccgctggacaggtgtccaacagtgtgtgtgtggggcgtccagtgtcgctctctagaaagaaacgcctgcgccagaaagtgtgtccggcgccctgtagaagatagctcactagcaccccacccgatgggcacagcccccgccccgtagtaggtaaggcaccggggaagtaaggtcggaggtgcccaccgggtag

SEQ ID NO: 489920 - DNA, 228 bp, Homo sapiens
  misc_feature (27)..(27): n is a, c, g, or t
  misc_feature (79)..(79): n is a, c, g, or t
  misc_feature (124)..(124): n is a, c, g, or t
  misc_feature (193)..(193): n is a, c, g, or t
gccaggcgattccttatgctgcctgtnatggcctatgcctcctccctttcctttctctttgtcactactatagctaggnttcctttcctacattggttttctactatgttgaccaactcctgtntgttttttatcttcctttcttaaacacattgttacttgttccaggtcagctgttatttcatcctttttnttttctttttatccccctctaccactctgcttggt

SEQ ID NO: 489921 - DNA, 131 bp, Homo sapiens
aaccgagtgtagtgcactccaagacacataattgtcagatcacaaagttgaaatgaaggaagaagtggaaaaactttgtgatcggcttgaactggcaaggcttacagtgcttgaatgaaacactcacatca

SEQ ID NO: 489922 - DNA, 308 bp, Homo sapiens
taccgactcttagaacctcttcagatccatgatttgcaaatcctttctcccattctatagactgcttttcactttctttgttttttttggagacggagtttggctttggtggccaaagcgggagggcaagggcgggatctgggttcacaaaaacttccgcctccgaaattaaggcaattctgtggcctaaacttccaagggggcggggataacgggcgggggccaccacgcccagttaatttggtatttttggcagagacggggtttctcaatgttggcaaggcgggtttaaaactccggacctaagg

SEQ ID NO: 489923 - DNA, 950 bp, Homo sapiens
  misc_feature (48)..(48): n is a, c, g, or t
  misc_feature (84)..(84): n is a, c, g, or t
  misc_feature (91)..(91): n is a, c, g, or t
  misc_feature (97)..(97): n is a, c, g, or t
  misc_feature (117)..(118): n is a, c, g, or t
  misc_feature (122)..(122): n is a, c, g, or t
  misc_feature (147)..(147): n is a, c, g, or t
  misc_feature (176)..(176): n is a, c, g, or t
  misc_feature (179)..(180): n is a, c, g, or t
  misc_feature (195)..(195): n is a, c, g, or t
  misc_feature (212)..(212): n is a, c, g, or t
  misc_feature (225)..(225): n is a, c, g, or t
  misc_feature (233)..(233): n is a, c, g, or t
  misc_feature (243)..(244): n is a, c, g, or t
  misc_feature (249)..(249): n is a, c, g, or t
  misc_feature (266)..(266): n is a, c, g, or t
  misc_feature (268)..(271): n is a, c, g, or t
  misc_feature (300)..(300): n is a, c, g, or t
  misc_feature (366)..(366): n is a, c, g, or t
ccgaacacgagagctacagtccatggccgaccaagaaaagatctcccnagctgcccttaagaagaccctcttagacagagtgangctggantccccnacagtctccacactgacccnnaaangcccaggaaagcccctcacaagaancctggccctgggaggcaagaaggactaangcnncatctgtcccctctntgattcagaccccttanttgagaccccctnccccaaangccacccccnngcccngctcccaccattccccncnnnngcttgcaaggagaaagcatgcttaggaanttttcaggtccttgtgataaaacctccttaaatctgttcagaccaagcaatgcgagcttcctctcntgtcccatgttggaagttgctctgaaggggtggtagatgctggaagccagacacaaccctgcgtacgctgctcagttggtggagactggggctgggactggagtcagcccagctgggaggaggggctggagaggatctgcagctaaaacccaaagcaagattaatgtgatgccagagcaaaatggtgaagataaaacaagaaacagactttctctaaattgataaatgggaaataagtgatcaacttaacattgtcacaattaatcacaagtatacaagattatactagatttatatttaactcttacttcataaatataccatttaaacactattatttaatgctaagtttaactactttaataaaatgtatttttaaataaaaaaaaaataaaaaaaccttcacaaaattaacccaatacccaattctccctatattcagtcagattacaattcactaaccatcatgttacaacatcctaactattctaacataatatctaataaccccgtaccgatcaccttgccaccacttatccaccttaattctatattcatatcttaatccgtaatatttattaaat

SEQ ID NO: 489924 - DNA, 108 bp, Homo sapiens
ttgttgttttactgttctttgtctataaaaagcaggtctagacaccctcttctagcaataaacctcaggtaggctgggaatggtagcacatgcctgtaacctcagcac

SEQ ID NO: 489925 - DNA, 803 bp, Homo sapiens
ccatctcgttccagctacgtgtaaggacctggtggttcacgaggctgggcttcgacacccgtgtaactgtgctgggccactgtgcagcggggagggacgccctctgcgcttcgagccggatcctgtagcagctaagatgggcatggaggcaggtgatggcgctgctggaatgccacgacctgacacgcgcggcttgcggatggtcaccgctctcggggaacctagtcagtgcggctgccccgtcatggagtgcgtgcagatgacctaagggaatgtgcaggagagagcgctagtggagtgacaagaggtttgagctgaggccagcgccagctccgtgtgtggtgagcttcggagagacaactggaacattttacaaagctcctcgtcgccaccagaagtcctcgctcctaaggatgaaagttctaaacttactgctccttgggccacttcctgaagtgttggggtgtgcctccaggacgtgtctatggcctagttgaaaattgccgaggcgctgatggctggcatacgagtcggtagactggactcgggcatcatcccatgggacaacaacaagtaatatctgtaggttgacactgataggctatcgaatggccataagccaaggggtcacgagtgcagaagacacgtatgcgctgagcacgagacgtggccggcatggttggtggcagtggtaggctccatgctgggagaccaagagagaccctgaccaagggccgacgctggaggtccacttgtcgtgacgaacatcccgatatctatggtatatcacgcgctggtggtgg

SEQ ID NO: 489926 - DNA, 115 bp, Homo sapiens
acgctctctctgatggggagacgtgacttcccttttccatgcacagcatgacggccagccagcccaggacggcagcgcgatgcccattacctgtagccccacagagagagcgtcg

SEQ ID NO: 489927 - DNA, 234 bp, Homo sapiens
tttcaattcgtctaatagttaccgaattccatcttctgcccccttgaatactgccagaggatacgagatgtaagtggctaattcattcgacttcagtcccctgggaccccttctgtagcctaaagtatggctggcaaatggacttgagaagatgggcttgaataacatcatagtcatggttgatccctgcatgaactcattggaattggtgtagcatgtaaggcactcaagctt

SEQ ID NO: 489928 - DNA, 1614 bp, Homo sapiens
gggcgcccgggcgggccgggggccgtggcggaggaggagcgctgcagcggtggagacgtcgggaccgagcggctcacctacgctggagttcagtgcatgcgagtacgtgcggccccatgatcggctggatggtctgctgtgcctgtttcgagccggtcccgttcatgccccgtatccgcccaataggctcgaccattaccctcctgagccctcgtcggcgtcaccgcagtgtgaggcatgaggagcaggtcggaatggcatggtcaggtgcacggtgactctggtcgcgacgaacatcatgcaccatatcatttctcaagaaggtgtaccagtgggcccatgctgcgtccacgtcgaacaggcttgcgtgtgcattcgattctggcggatcatgcatgtctgggattcccgtggcttgatgccatcgcgacccaagcgagctctaaactctctaaaccagcataagtgggcaactttgacctcttacacagggcaggtaatagtagggagacaagcctagcttgacatcgctccacatgggcacgcacacgagcccttcacacctgggcgtcgaagtaggatctacactccttgtggatctctacttatccgtgagcgaaacgaaagcgacatcttcttcagcgcgggacgatggagtggccccttgcttacctactttctaaccggggcccaccgtaaacttccacgcttcagacacacgcctacttttggggcccttgacttggtgggacaccgtggttctcaagggcgacttaccaaatgcggtaatttggagaagagttcaggcaatggggaagtccatggagtacttccgacgagggagaattgaccgcttttatacgaccaaggggaccaattgggaaagcgcccaaggagataagccgtccaggcaaaagctttgaagtacactacacggggggtacgcataaaagcgccggccaagggcatttaccatctttaaggcaccacccctgagaccgaaaatgcaaccggcccaaagaaaggtcttaccgaagcctcccaagaatgagaagcaatcacagctgccttgaggccctcagagtgtatccccgggggaaacgaacacttaaaccccaagcaccctagacggaacgcgagtattgagcactaggaccccttggggaaggtagtaaccaaatccggggcttaggttgaaggggttgcttggaaccatctccccctaagccgaccgggtgcgcatggactaagcgcacccaagccctggaccaacccagcggatcttcaacactacaccacatgaccacaggggcacaaagtccaaaaaaagcgttgggcaggaactggcacggagacaaacaaccgacgaacgggtcacaacgctcgctagcccacggacatctaacaacacaccaaaaaagggggggacgcaaacggcacccaagccacaagcacaccgcacaacgggttatacccaccccaaacggacggcagcaaccaggacccgcaaacaggaggccgacacagcgcaccagcaccagagcccacgacagaaaatccgcgcacaccgagcgcggccgaccacaacaaaacgagtctaggcgacgcaccaac

SEQ ID NO: 489929 - DNA, 127 bp, Homo sapiens
tcgccgaaaatcatcaggatttttcaacatactatcttcttttttttttttctttctgagactttatctcactgcatcacccaggctggagtgcagtggtgcgatcatgactcacggcagtctcgac

SEQ ID NO: 489930 - DNA, 856 bp, Homo sapiens
  misc_feature (7)..(7): n is a, c, g, or t
  misc_feature (62)..(62): n is a, c, g, or t
  misc_feature (84)..(84): n is a, c, g, or t
  misc_feature (122)..(122): n is a, c, g, or t
  misc_feature (158)..(158): n is a, c, g, or t
  misc_feature (187)..(187): n is a, c, g, or t
  misc_feature (223)..(223): n is a, c, g, or t
  misc_feature (293)..(296): n is a, c, g, or t
  misc_feature (307)..(307): n is a, c, g, or t
  misc_feature (314)..(314): n is a, c, g, or t
  misc_feature (318)..(318): n is a, c, g, or t
  misc_feature (321)..(321): n is a, c, g, or t
  misc_feature (326)..(326): n is a, c, g, or t
  misc_feature (329)..(329): n is a, c, g, or t
  misc_feature (336)..(336): n is a, c, g, or t
  misc_feature (348)..(348): n is a, c, g, or t
  misc_feature (360)..(360): n is a, c, g, or t
  misc_feature (362)..(362): n is a, c, g, or t
  misc_feature (376)..(376): n is a, c, g, or t
  misc_feature (386)..(386): n is a, c, g, or t
  misc_feature (403)..(403): n is a, c, g, or t
  misc_feature (405)..(405): n is a, c, g, or t
  misc_feature (408)..(408): n is a, c, g, or t
  misc_feature (413)..(413): n is a, c, g, or t
  misc_feature (416)..(417): n is a, c, g, or t
  misc_feature (422)..(422): n is a, c, g, or t
  misc_feature (460)..(461): n is a, c, g, or t
  misc_feature (464)..(464): n is a, c, g, or t
  misc_feature (479)..(479): n is a, c, g, or t
  misc_feature (481)..(482): n is a, c, g, or t
  misc_feature (485)..(486): n is a, c, g, or t
  misc_feature (488)..(488): n is a, c, g, or t
  misc_feature (491)..(491): n is a, c, g, or t
  misc_feature (523)..(523): n is a, c, g, or t
  misc_feature (527)..(527): n is a, c, g, or t
  misc_feature (530)..(530): n is a, c, g, or t
  misc_feature (538)..(538): n is a, c, g, or t
  misc_feature (610)..(611): n is a, c, g, or t
  misc_feature (619)..(619): n is a, c, g, or t
  misc_feature (622)..(622): n is a, c, g, or t
  misc_feature (624)..(624): n is a, c, g, or t
  misc_feature (673)..(673): n is a, c, g, or t
  misc_feature (849)..(849): n is a, c, g, or t
ttttatnctgaacatgtagtatttatctttattagcaattttattcataatataagcatgcntcaatcatccaaaagctatctncctatctatataaattgatatacatgctactgcattgncttcttaatagaatcatatggtaagtgttataatgnctaatcaacctacttctgataattttggngtaaacaaaaatgatatttaatttttattaaatcangtttacctatcaaattcccttttagaaaaacactgcaagtttagtcttaccaagattgcaagtgaatttnnnnattatggggcngtaaatnaaanggntttangtngaaatgngtactgagattngccatatcacanangtcctatcatgggnaatgggaagncttatttttaatatatntnggngtccnttnnctttnggcatggggcccaagagagggggggcttgggggggggnngcnaaagggcagtattcngnnganngnggnttaattttatatctaacaaaaacatagaaacnggcnagncatattcnagtcaattgggcacattgtatgggatacaaaaataaatgagaaaaaaaaccagttctacaaaaatgctttgnnattataanacngnaccacattaaataaaaatgcatttgtgggaaagcggcgggcgatggggnaatgaaagttagcaggataaatcataagcaaaacatttagaacaaatgtatgaacacattgtggttatcaccattacaaatgtatacaacaccttacaaaaatcttaaataaaaatgtaaaaatatttactggcagtgaatacgggcccaggctaattataccaacgggtaggtgntactggg

SEQ ID NO: 489931 - DNA, 178 bp, Homo sapiens
cgtggacctgcgactgcaggcatacgcgcttcatcccccgccgatcctgcagactgggcatccgctaggacgaggctctcgcaagctgctgggcggcgtgacgatcgcccagggaggcgtcctgcccaacatccaggccgtgctgctgcccaagaagaccagcgccgtcgcctacgca

SEQ ID NO: 489932 - DNA, 639 bp, Homo sapiens
ggtgagtaggtgagtttattaggaggtacacacagggcactaatcaggatggcccaaaagatccggcctcccccagcttctaaaatgctttcacccaaatcccctgaactgggcctgcggaaaatgagcaaagagacggcttttcatggcacggacataaagggcgaatccccgggtaccaacacaagggggcgcttcccgagaaaaaaaaaaaaagcccgtccaaagctaaaaaaaaggagcaaccccggacacaggtgttccctgtgcaaaatggataacccgtcacaagtggtaaagtactttcaacatttttcggccccggaaacaatcccaacaaccgccaccgaaattcccaacaaaaatacccgggtaaaacctcaaaccggggaactggtcaaaataaaactcacccgatatctctggaataaagctccaccccctggcatagaaagtcacggccagccagggaaatttaaactagacccacaataagttggcgaaacacggccaaaaatgatctcctggacaaaaccgtataccgcttaaaagttcccacaacaaaaccccgcccgaacactaaaacagaaagccccggggggcccaaagagggaaccacaccccaatcaaaccgtgtgc

SEQ ID NO: 489933 - DNA, 160 bp, Homo sapiens
gatacattcgtgttcacatatatcctagctcatctgcaatgcgctatttcatggcacatcattggaatacaggaagtagtccctgcacctggccgagtgagtctcgccattcacatagattggaagagtgacctgtgcatcttgtgaaatcattgtagtg

SEQ ID NO: 489934 - DNA, 926 bp, Homo sapiens
atggagggatatggcactaagaaatagtgaagggccctgtgctcagcgggaccgctcctcacaagaaattcttcttcttcgatgatgatgaaggggaatgggattgtggagtggcttgggcccgaagtgagctcaacgtatttggcagttccgcaggagcatgccaagcgggcgggatggccagctgtgttccctgtccccttccttcatgaaggcatctcgcatggctaggtgcatgtgagatgtcattggtgcccgattacacatagatcagtttgcctgcgatcgattgcgacggtgggtgccgatcgtgtctgcttcctcatcacgcagcaggctgttctgcatggggcgccggggggctgatcttggtcccgatgcagcgtgttcacggctgcctgtcgagtcgcgcggggcctggcatggtttcgctcgcatgcagtggagtgagtcatcgttgccgggcagcccctctgccgctttctctgttcgcttatagcttgtcctcgggtctcgtccagacgctcgtctggggtcattgtggggagatgcgctgcctggaactgtgcaagctgcttgtgctcgggagcctcttgttcgcttctgtggacttatttccccagctgataccgtatagagaaaatgtgttgagttccagggtggacagatgtatgcccacgggcctcattgacgggcaccatggtgggatgcatcgagctccaaatgtttccaggactaagggttgcccctgtagagaaggaaggaaaaaccaattgaaccaggggcaagacattggcttttacctttcttgggcgggtttagagagaaccccctggaaggaaaaacaaaacttgggtgggggcacttctgcggtggtggcgcaggaccgttggaaagcataacaggagacaggactaaaattaaag

SEQ ID NO: 489935 - DNA, 521 bp, Homo sapiens
aaaaataaaatgtactaaaaataaatgcttgtgtggcatgattggtaaatgatgcacaaaaataggttcttttttccttcaaggcaaaatcagtcagaaagcaggttttttcttcttcaaaccattctacataattagaaaaaacccccccaccacccaacacacaaccacaaacaccaccccccaaggagaagatgaggagggccagaaagctggcaagtaataaaccacttctctttgttactgcagatgttgatgttctccgtgttctcaggaggtgagctccccactccgtgaggagagaggtgatgatccccgacagttcgaagatggctcaagagcagagggaggttgtcgccggcgaggtcgcagcaggctgagtctgtcggttaacagcttgggttctggtgagcctttccatatcgaatgctacgttatcagtacatggcaaattcggcacaattcccagggccttcaatatattaagttttgcacataggacaggtacaatgttcactaag

SEQ ID NO: 489936 - DNA, 394 bp, Homo sapiens
  misc_feature (232)..(232): n is a, c, g, or t
  misc_feature (279)..(279): n is a, c, g, or t
  misc_feature (294)..(294): n is a, c, g, or t
  misc_feature (374)..(374): n is a, c, g, or t
  misc_feature (379)..(379): n is a, c, g, or t
gctgacctgcaccatgacggttgtcaagaacaagcgccttacgacaggcgggaacccagggagccaagaagcaaagtggttgatccatttgctaagaaagattggtatgatgtgacgagcaccgtgctactgttcacgtgatacacgaagatacttggacacagagcgctcgctcagccaggcacccgaacggaagcctaagagtatgcgatactgactcggtcatcaaggntgtgcgtgctagtttggatacgtgaggatctttgctgaattctatgntagcacagtgaatgnaaggattcgtcattcttcatgtacaacacttgcacacgcctgtaattgacatgtacagcaatgatttccaatgggattanacaanatcctgtgcgcgtgg

SEQ ID NO: 489937 - DNA, 307 bp, Homo sapiens
tggagttcgccggagtaacaacttgcctgcggttcgctgggtaggaggaccttaatattgacgctgattgccatcgcaacaggagggcggtatcgtccccaggttctcggagctcacagcctagaagctgggctttgctggtcttgtaccgtagatctcatttgggacaacttaggataaaatgctggtcatcgagcagtgtacgaacccagagctgtaaccatttttaatagaggaggaaataagatgatcattgaggaggctaaacgatcccttcacgatgctttgtgtgtcatccggaacctca

SEQ ID NO: 489938 - DNA, 248 bp, Homo sapiens
tgatgacccagccagcaattccctgtatagcttcaggacatttgaagttcacattgtgcttctaccaccatcctaatacttacttccaattcattcccctgagatcggctggttgttttcatctctgtaaccaagtcagagccatgtctcactgtcactgcaggctgacctgcccacacaactcccctcatactggcgagtcgaatccacgttagccaagcctgacaagtttgacgatcggtatccaa

SEQ ID NO: 489939 - DNA, 440 bp, Homo sapiens
  misc_feature (64)..(64): n is a, c, g, or t
ctttaaggatcaagttgcttcagaccaaaaaaaaggagaactgcctcataccttgtctacacanccttgtacaggctcctaacctgtgatgagtaaagatgtcactttctaacaggtccaggagccccaagttatcttgggacctcaagaagagaggaatttacccaactcataggtattggagggtacaaacccattgctgggcttgactttaaaaagtcttttctgatattccttatggaacagaattccatcagagccaattttaaaagcatatgtgaaaaataattattcttgctgtactttatgcaaataatcaggccaagtataagactaaagtttattttgcaaacaatcctattatgatttgtttttaacaaaaatgaagactggagagtttcaaaacttatcacacttgtcattaaattctagttttatta

SEQ ID NO: 489940 - DNA, 126 bp, Homo sapiens
tagctcggtacccggttaagacatcagtagtagacttccctggtggtccagtggttaagaatctgctcgccaaagcatgggactcaggtttgacccctggtcttggaagattctgcatgctgcagg

SEQ ID NO: 489941 - DNA, 198 bp, Homo sapiens
  misc_feature (42)..(42): n is a, c, g, or t
tagcaggactcttcgacgggtctgttattattcatctctcanttggaaatgtgagactgaaagggtagagacttttatctgtttcattgagttaaattcccatacctagaacaatacctgacatttagcaggcatccacgaaatatctgtcacataaaccagataatgatgttttctggcagcaattacagagtccct

SEQ ID NO: 489942 - DNA, 143 bp, Homo sapiens
gtaccgtcgatcctcctgctctagctcccaagtggctggggttataggcatgtgccaccacacctggctaattaaaagaaaaaaaaattcgtagaggggggatctaggtatgttgtccaggcttatttcgaactcctaacctc

SEQ ID NO: 489943 - DNA, 453 bp, Homo sapiens
gccagaggaccccccaggcgcttgttggagagctacaggagaagctgctttgaagctacttaacttcattcttgatatactggtcctcatttctttgccttcataactttaaaaggatccaaaatctggtcatcttgggctttcctttcttcctgggtttcaattctttctttgtgccccatacgtggtgggctgccccatatttgtatatgatgtctggcttcttgccaggcttgtccggacatacttctggtgggcactgtgcggaaacttgaggatgaaatcagtgagctgcatagcactttgaaaaggcatgggcttgtctcctcacttggaggtgccaggtccatcgaccaaagccctggttcttgatccaataacattctacgatcgcgcaccaattttccgggcatgaaggtcccacaggagacataggccaccccgggcaacctc

SEQ ID NO: 489944 - DNA, 250 bp, Homo sapiens
  misc_feature (2)..(2): n is a, c, g, or t
  misc_feature (8)..(8): n is a, c, g, or t
  misc_feature (12)..(12): n is a, c, g, or t
  misc_feature (17)..(17): n is a, c, g, or t
  misc_feature (19)..(19): n is a, c, g, or t
  misc_feature (26)..(26): n is a, c, g, or t
  misc_feature (94)..(94): n is a, c, g, or t
  misc_feature (96)..(96): n is a, c, g, or t
  misc_feature (119)..(119): n is a, c, g, or t
  misc_feature (128)..(128): n is a, c, g, or t
  misc_feature (148)..(148): n is a, c, g, or t
  misc_feature (152)..(152): n is a, c, g, or t
  misc_feature (170)..(170): n is a, c, g, or t
  misc_feature (179)..(179): n is a, c, g, or t
  misc_feature (182)..(182): n is a, c, g, or t
  misc_feature (234)..(234): n is a, c, g, or t
angaaacngggntcttntngggattngagaaaatctctatgaagcggcctagagattagtagcaggtgcaagacagaatcagcctccagtcttngntcagagataaggagataatgggnaccccattnacctctcctgttgtatatcncagnctttgcagtaatgcaggnctcaagcanatntgcctgagcagtgagtaataggagcagactgtaactcagagaaggagtggtnaggtgtacagagctag

SEQ ID NO: 489945 - DNA, 720 bp, Homo sapiens
  misc_feature (608)..(608): n is a, c, g, or t
  misc_feature (615)..(615): n is a, c, g, or t
cgaccctcatctagaacatcagctcctccccgggtctgcagctgcacgaccctcaatctagaacatcagctcctccccgggtctgcagctgcacgaccctcaatctagaacatcagctcctccccgggtctgcagctgcacgaccctcaatctagaacatcagctcctccccgggtctgcagctgcacgaccctcaatctagaacatcagctcctccccgggtctgcagctgcacgacctcaatctagaacatcagctcctccccgggtctgcagctgcacgacctcaatctagaacatcagctcctccccgggtctgcagctgcacgaccctcaatctagaacatcagctcctccccgggtctgcagctgcacgaccctcaatctagaacatcagctcctccccgggtctgcagctgcacgaccctcaatctagaacatcagctcctccccgggtctgcagctgcacgaccctcaatctagaacatcagctcctccccgggtctgcagctgcacgaccctcaatctagaacatcagctcctccccgggtctgcagctgcacgaccctcatctagaacatcagctcctccccgggtctgcaagctgangacctcnaatctaaacatcagctcctacccgggtctgcaagctgcacgagcctcaatctagaacatcagtcctccccgggttctagagctgaagagccttcaggttagaaca

SEQ ID NO: 489946 - DNA, 894 bp, Homo sapiens
  misc_feature (9)..(9): n is a, c, g, or t
  misc_feature (82)..(82): n is a, c, g, or t
  misc_feature (115)..(115): n is a, c, g, or t
  misc_feature (138)..(138): n is a, c, g, or t
  misc_feature (235)..(235): n is a, c, g, or t
  misc_feature (248)..(248): n is a, c, g, or t
  misc_feature (257)..(257): n is a, c, g, or t
  misc_feature (259)..(260): n is a, c, g, or t
  misc_feature (268)..(268): n is a, c, g, or t
  misc_feature (279)..(279): n is a, c, g, or t
  misc_feature (282)..(282): n is a, c, g, or t
  misc_feature (288)..(288): n is a, c, g, or t
  misc_feature (302)..(302): n is a, c, g, or t
  misc_feature (313)..(313): n is a, c, g, or t
  misc_feature (316)..(316): n is a, c, g, or t
  misc_feature (318)..(319): n is a, c, g, or t
  misc_feature (322)..(322): n is a, c, g, or t
  misc_feature (325)..(325): n is a, c, g, or t
  misc_feature (346)..(346): n is a, c, g, or t
  misc_feature (366)..(366): n is a, c, g, or t
  misc_feature (369)..(369): n is a, c, g, or t
  misc_feature (384)..(384): n is a, c, g, or t
  misc_feature (394)..(394): n is a, c, g, or t
  misc_feature (396)..(396): n is a, c, g, or t
  misc_feature (406)..(406): n is a, c, g, or t
  misc_feature (411)..(411): n is a, c, g, or t
  misc_feature (413)..(414): n is a, c, g, or t
  misc_feature (416)..(416): n is a, c, g, or t
  misc_feature (423)..(424): n is a, c, g, or t
  misc_feature (430)..(430): n is a, c, g, or t
  misc_feature (441)..(441): n is a, c, g, or t
  misc_feature (449)..(449): n is a, c, g, or t
  misc_feature (454)..(454): n is a, c, g, or t
  misc_feature (463)..(463): n is a, c, g, or t
  misc_feature (469)..(469): n is a, c, g, or t
  misc_feature (475)..(475): n is a, c, g, or t
  misc_feature (490)..(490): n is a, c, g, or t
  misc_feature (493)..(493): n is a, c, g, or t
  misc_feature (505)..(506): n is a, c, g, or t
  misc_feature (509)..(509): n is a, c, g, or t
  misc_feature (513)..(513): n is a, c, g, or t
  misc_feature (539)..(539): n is a, c, g, or t
  misc_feature (551)..(551): n is a, c, g, or t
  misc_feature (554)..(554): n is a, c, g, or t
  misc_feature (558)..(558): n is a, c, g, or t
  misc_feature (561)..(561): n is a, c, g, or t
  misc_feature (564)..(565): n is a, c, g, or t
  misc_feature (578)..(578): n is a, c, g, or t
  misc_feature (589)..(589): n is a, c, g, or t
  misc_feature (595)..(595): n is a, c, g, or t
  misc_feature (605)..(605): n is a, c, g, or t
  misc_feature (628)..(628): n is a, c, g, or t
  misc_feature (632)..(632): n is a, c, g, or t
  misc_feature (639)..(639): n is a, c, g, or t
  misc_feature (641)..(642): n is a, c, g, or t
  misc_feature (689)..(689): n is a, c, g, or t
  misc_feature (716)..(716): n is a, c, g, or t
  misc_feature (768)..(768): n is a, c, g, or t
  misc_feature (815)..(815): n is a, c, g, or t
  misc_feature (829)..(831): n is a, c, g, or t
acgcaagangggactgcgccctggggtgagacacccattcctcggcgatctgaggaagctcatcacagatgactttgtgaancagaagtacctggaatacaagaagatccccaanagaaacccacctgagtatgaatncctctggggcctgcgagcccgccatgagaccagcaagatgagggtcctgagattcatcgcccagaatcagaaccgagacccccgggaatggaaggancatttcttggagnctgtggatnannattaaaanaaaaaaaaaanagnaaaagncaagaaggaaaaanaaagggcccanaananngcnaanaaaaaaaaagagggaaaaaancgatgaatggacggaggaanaanggaagaaaaaaaaanaagagcaaananacaagggaanagganannanattaaanncgaaanaaagggaacangaaacccnaaagnaaaaaaggnaccaanaaaaanatcagaaaaaaaaantanaataagaaaaannganacanaaacaaggaagggcacaagaaggaanaaaaatagagcnaanaganaanaannacaaaaaaaaaanagaaggaggcnagcaanaagcagaacntaagatggaccccaaaaaacagntaanaaaaaananngaaccagaaaaagactgccagagctggcgccagcttcttctcctggntccagcaccgttgacgaactgcagcgntcttactggccaagccagagcgcctcctctcagattccttctcgacacagcnccctaggcggcttcttcctgtcagtcggaggtggcatgcaagatgangctctctttgcatnnnccatgctttcattttgtgcttttccttgtgttttcaatgttttgggtatcaagtgttagcatt

SEQ ID NO: 489947 - DNA, 1510 bp, Homo sapiens
catagcgctaggggtatgctatcgttccgcaccgcggccctcttggtttccttagagacgggcgcgtcatcctgtctgattattctgctcgcggggagtataatatttcgcagcgggacctgtttcaccctctgcgcttttgtgggcccaccgagagcgaccgtgggtgccacaagaacaccggggtgttgcccgtgtgcccggtttttccgcgggggttttcgcgaccccacaccgctccgtcggctcctggtgttaattccccccccctgcccccccccgggtaatgtgtgtttcccctggggggggatgggtgcccacacccctggaggaggggttgtacaccagggattctcttttggagaagaaagatgggggccttttccccccggtgagtggccttcctcggggagttttctcaccgtgaggtgttcgcccaaaagaagttctggggggttagggagccctcgtctcctgggtggatccaattattggggtctccccgccgcctcccgtggtgacctccttctaagagagcgacaccccacagaggacttgtggaggtggcccaaaatggggcacactacttttcgccggggggttcctatcgtgcgacagcccgccccaccctccccctcggggggttttccaaccggaggtttgtgtcccctgggcctcctcgggcccttctcccggggtttttctctgggggagatataccccccggcgggggtcccccccgccccgccccccgccccccccgccgttttatatttgtggggtaattttgtttatggatatagagaacccgcgggtggtttaccccccccctcgggcggggcccctcccgagagctctcctcggagaatcttcacgaggggataccccacccgcgcccctctcggcctctcccccacaaatgtgtccgcgggagtataacacacgcggggagaaccccaccccccccacacgtgtcacataaaggaccacaagcgcccgcgcccctcgggggagagacccccactctccctctctggggagggatcttctcgcgccccccccgtgtcccgccgcccactatccccacactgtggccccacacgtgtgtgtgaggtgttaagtgctctctcccctctgtgagaaagtgggatatcttcctggttccccacccccaagccctctccacagagtggaggcgcccaaccgcgtcttggggcccacacacaccgcggcttgccacgccctctcattgaggggaccccccgcgggacccctccctctgctgtggaggtgtcttcttctttgagatattcttgtggcccactaggaattgtctatgtgagtagtaaattattttttgttttttaaaccacactaagtgtttatgggtataatttagttaacccacgcacggagatgagaaaacttaaaatggggagactatattttggtcacaaaagagaggcccgggtttgtgtaccgtatccaattaaccccccttggtgggtta

SEQ ID NO: 489948 - DNA, 419 bp, Homo sapiens
tttccgagttagggtcggcaatattggggaataccgcagaaggttctgctgcagagcaatacctaaagtggttcttccatcagttaaggttaaaactccggtagagtcagttcttgcgaaagggggtaatatgctggaaatacccaaggccagggccccaacagtggcgtgccattaaggcattatctcggtaatcccattaagcagaagatccgtctcgagccccattagtgcctaggccctaaggatcccgagttgccacgtatggaatgaagcataaaagggataggctacgcgatggccgtgtttctagtaccatgtgcccagaatgttaaggcattcacatgtcatggcgatggttcatcgcgtaatggtgatgcagcacttcagatagccgctcgaacagccgcatattgtag

SEQ ID NO: 489949 - DNA, 221 bp, Homo sapiens
  misc_feature (171)..(171): n is a, c, g, or t
  misc_feature (181)..(181): n is a, c, g, or t
cgaccctcatctagaacatcagctcctccccgggtctgcagctgcacgaccctcaatctagaacatcagctcctccccgggtctgcagctgcacgaccctcaatctagaacatcagctcctccccgagctaaaacacctctcccacctggttctccagctccacgagtttnacagaacagncacactggctccttcattgttttcagcttcacaacctaag

SEQ ID NO: 489950 - DNA, 291 bp, Homo sapiens
gcacgaggaatgtcttgggataattgcctgaatcaattattgttatgatagttgccaaatgataattttctaattccattattccttctgcatttgtttgttggcattctactgttaggaagagtctttccagctgagcacagtggcttatgcctgtaatctcagccctttgggagccagtgggaaaattgcttgggcccaggagttcaaggttacagtgagctatgatggcactactgctctccagccagtgcactcactctgcacaacagagtgagaccctgtcactta

SEQ ID NO: 489951 - DNA, 1013 bp, Homo sapiens
tggtagtccaatactttttcctttataaatccatactggtactcccagggctctagctactgtaactttaaaattgggctggggcaccctgtgtgtgttcctaggtactaccagtaatgtttcctgaccttgcgccaagccgccaggcaacgtccagttatagactccaaattacagattggccagacaccttcgactggcactcgacccggtggtcctttccccattagtagtggcccagttgcaggtgtggtgggcgtgctcccccttcgtgcctcaccccaatttccaccccacggtccaggatttatctccgggggccccaattattggccccttctggaccacattcctctccccccactctaggggaatgctctagtgttcagatgttgggggagaaacagtgcccccatgtgggttctctgggcgaacgaatgtgcgtcctgtggtccccatgccagaagattgttggctctgtggccgctttggaatttgggcgggtgggttatgcgacctcttgtcgggctggttgcccccacagtgcttatttgtgttggggcagacagaaattgcgtcttgtctgtctagacctataatcgccaactactaccagagcagtttggggcaaccccaaaatgccccccaatgggctcagattcgccccccaaaaaaaagacgcccatggtttggtcatcatgcactttgaggggcaaagatgggcaccccccctttgtggtcgtctccgtccatcgtggtctatatatgtgatttgggggcaacaagcccgctgtgctgcgctgctaacaagacggacactggtgtcttttagacccctcagcatgttgttggggcgcacctctccgagctatacagccctccccctgggccgggagaagaggggcgtcacatatatagtcggccacacaccacgactgacgcccgcggccctgtgtgtaggagctcctccaccaacgccgcctgttactgtgtagcacacaccacgggggtgc

SEQ ID NO: 489952 - DNA, 151 bp, Homo sapiens
gcagcatgctgaggtgcataatgtctgcctggcctgtagtgatgcttttttgatcattctgttcaggcggcatcagggtgtgattgcttcctgtacgagtcgttccttaacctctcatttaatggatccattcatttatgatgtttaactg

SEQ ID NO: 489953 - DNA, 403 bp, Homo sapiens
  misc_feature (157)..(157): n is a, c, g, or t
  misc_feature (220)..(220): n is a, c, g, or t
  misc_feature (357)..(357): n is a, c, g, or t
  misc_feature (383)..(383): n is a, c, g, or t
  misc_feature (394)..(394): n is a, c, g, or t
ccctggaggctaggcatgttcaacatggtggctcccatctcccctttttctttatcaacccacatgtacagtaaggagcaggcaaccgtggcgcccagcccaggtagagaagccatttgtggcccaggttcggtggcacacgccctataatcccaanactttgggaggctgaggcgggcagatcacctgaggtcagaagttcaagaccagcctggccaanacgttgaaatggtgtctctactaaaaatacaaaaattagctgggtgtagtggcaggcgtctgtaatcccagctactcaggaggctgaggcatgagaatctgttgaacttgggaggtggaggttgcagtgagccgagntcacaccactgcactccagcctgggnaataggagtgnacctccatc

SEQ ID NO: 489954 - DNA, 275 bp, Homo sapiens
ctgcatggtgctaacaaagagccttctgtgagtcatctccttccatgggctgaaggaattatggcaagggtccagctcatcctggctttaaaaaaacaaaaccccagtggccttgtctgaagtggctggatgctgtggctggtggcaacgatggctcagtgctcaccaggttcatcatgtggtgtaatctaaaaagcggaattatcctttgaggagtccatcagagtcaggcctgatttcacaacagggaagtgatggatctagagcttggaaca

SEQ ID NO: 489955 - DNA, 108 bp, Homo sapiens
tgcttgaggatcggggcgcagttggcattgcgtgtgggcactgcgccggggcgtgtgcccagaactgaaccctggattgatgtcccaggcactatacgaccccatgcg

SEQ ID NO: 489956 - DNA, 553 bp, Homo sapiens
gagcgggtcggcggggtgcggagccgagcgggcgtgggaggtgtgctgggtcgcgcctgtgcctggggccgaggcggcgcgcggcagctgacagctgagtcggctcgcggactcccaggaccccctcaggctgcctcggcaccgaacctaggacctggggacattgccatgcaccacggaagctctattgacgcacccggagcttgctagcctagatacagggacagcgcacagatccatagcatcggcacataatcggactacttgactgacacctatacggatgcaaacctgaagactacagcagcacggaatagacaggaaggccatccaattcgccacgtcgggaccacgacccggctgagacccaaggattaataccgttatcataagagaaacaagcatacacgcgcttgacatattcgaggtcataacacagtgggactagaagaagatgcggcaggggcacgcatgaatgcttcccaaggcagttgttagatacaaaaagggaattaggggctatacagaaacgtaattgagacgcctagatatg

SEQ ID NO: 489957 - DNA, 161 bp, Homo sapiens
gagaacgaggacgtgaggaggacggaagtaggtgagagagagtgaagacgagaaggaaaggacctggatgagagggaggtgtgagcagaagcatcctttccatgttcaactatggacttgcaaggactggtacaacctactctggaggtctccagggtaat

SEQ ID NO: 489958 - DNA, 450 bp, Homo sapiens
agcgagcgccacggtatctataaatttaggtgttcttcctgagagacttctacatggcaccgtcacagatgatgggatcagagtcaaagagcttcacgactcaactcagtgaacctgtgaaggaacgtacgaggtcagaagtgtgggaagccaccgtgtttacccgtatactttattggtcttcgccttgcgtgaggtttgtcagccgggacgaccaggaaaacaggtcgtacagctgctccagcaaggaggaggtgtagagcatcttccactggtaggacttaatcaactcgtacaatttcctggtcaagctcacattgacctgcagggattcatcgaacacccgggcgcagattaccatgagaagggttgttggtggaacagtccacatacaaaatcttccgaaagatgtcagactgatccttcatccgcatgcgtcccgttaagttg

SEQ ID NO: 489959 - DNA, 209 bp, Homo sapiens
gatctatgtaatcactgaggccagtttgtacagacaaggtggaaggtttaattctgggtctctcctccttggataaggtcttgatgatctcttctttctgggcctggaggctgctcttcatggtgcttgcgtgcttccttggtcttagacctgcgggcctacagccgggtcagcacaggagctcctggcggggcctaatctggcgggga

SEQ ID NO: 489960 - DNA, 592 bp, Homo sapiens
tatcatatactcgtgacaccctagatgactcctactaaaaaagctcctagaactgataaagtgaatacacgcaaagtgtcagcgagacaaaattattgtactctacatcagtagctctgttatacccctagaagcgaccaagcttagaatcaaaccaacatcataaccgctttttggtgagctgcaaaactaaactaaactaaaataaaatacttgggaatagacctaaccaaggaggtgaaagatgtctacaaggaaaacaactttagtatttttaatgggttaaaatgagaggcagcaggtacagcagaagaagtcagtgcgtgggcatccgcatccaatgggtactgcacctttgatggtaaggcttaggttttgacttactaaattactaggtacgattattttctagtttttgtcattaaaccttaaaactactaagtaaccccttccatttcttgttaaatattgtacaatttcatactctcatttatgctgcctgacgttagagtgtttgtttctatttggtgactaccttaaataatacctataaagagtaaactgttagtagtgtttttgctgtaattaaatg

SEQ ID NO: 489961 - DNA, 367 bp, Homo sapiens
aggaccacaccctagaagctgacaggacattagaaatataagataggacagaccactgtttcctacttcctgaaggacagacagacatagggattgaaaagggggcccggcaaacagggaaagaggtggcaggcctggtgaccttaaagcatgtgtatgagattgcccgcatcacagctcaggatgaggcatttgccctgcaggatgtacccctgtcgtctgttgtccgctccatcatcgggtctgcccgttctctgggcattcgcgtggtgaaggacctcagttcagaagagcttgcagctttccagaaggaccgagccatcttcctggctgctcagaaggaggcagatttggctgcccaagaaga

SEQ ID NO: 489962 - DNA, 155 bp, Homo sapiens
gtagatcggctcggcccgattcctaattacgcaatcgggatgcattttacatgctgcgatggtatccactgcattcaatgacactgcatggaatcaactgcatcaatcgtgacgcattttaccatgctgcatggaaaaatgcgtcacgattgatg

SEQ ID NO: 489963 - DNA, 341 bp, Homo sapiens
gcgcctggaagggggctctgcagcctgaacccccagttaccccagggctcccaccgactgtcccggcctccgcggctgcacgtcggcccccgcagctcagcaccctctgccccgggcccgcagccccagccggccgtacctgcgtgtcagcgagatagttgaggaagaaggaggagagctcttcgtccagcagcgcgccgcagtcgttccccgccatcttccagccgcggctgcagcgtgcggcggagtcaaccgcgagccggcccggggggagggagccagcgagcgagcaagggaggagggaggagggagtgaggccggcgggaggcggagggcggagc

SEQ ID NO: 489964 - DNA, 577 bp, Homo sapiens
  misc_feature (205)..(205): n is a, c, g, or t
  misc_feature (259)..(259): n is a, c, g, or t
catcatttctaaattgacatgtgggtggccagtgttattatctagttttcttgatctaagtacaaattacctttttaataaaaaaaaatgtgattgttgcagactctcagaaatcatatttttttaatgaagaaatacactgtggttgatggcatttaaaaaaatgttttgaattacagaatattttttccaaagccaatatgantgtagcaattgatagctaatgataataaacatttactgagtgattactatgtgnccgctttgcgccgcctttgttccacatccaccctgtgaggtaggagctgaaatcagtcctgtcttacaaagagcagatgggtcattagaatttaagccattttctctgaggtcacacaactagcaggcatcggggctagattcaattccaggctgttggtgtggctacagagctcctgttcctgatagtaatacagccccgagaaaatgtagttgagtaagcccagcaaagactatgcctccatgtgtttaaattaagaaacttttgtgttgattttatgccaacatgcttgataaaaatagacaaagtatgtaatgt

SEQ ID NO: 489965 - DNA, 128 bp, Homo sapiens
ctccaaccaaataagacttccactcgatgatgcttctataattttgcctttaacagaaactttcaaaagggaaggatttttttttatgggggagaagggttaaggaggtcaaggccccacttccttcc

SEQ ID NO: 489966 - DNA, 752 bp, Homo sapiens
  misc_feature (337)..(337): n is a, c, g, or t
  misc_feature (352)..(352): n is a, c, g, or t
  misc_feature (424)..(424): n is a, c, g, or t
ggttttggggatttttccattgttgatttcttccgggacgacaagacctttgtgaacatgggtgtggttgggtttgtatcattgggtttttaggtttttttgtgtgggcacccatattttccaggtaggataggggggggaaccggagggtttttttcctccggtcccaatatttttggttttcccccgggggttgaaggttttttttggtttgccccactccggggagcaaaattaaatatttgcgcgcagtttttggggcccggggttttttttttttttccggtgggggggcgggggggggattgtattagcaaatttttcattagaattggtnttaccggaagggtantaggttgtggttcctttcccatatgttttatcaatggggggggtttttgccatcaaggggggtttttttccntgttttccccttttttcggggaaccccctgggccaaacctaggccaaattcctttttcctttattttttatggggggaattttaatttttttcccccaaaattttttgggcctttcgggaatgccccgaggtttttggggtttccccgtgggataccccccatggaaaatcttttttttttgggggtttttttttttttttaacgggggtaattttattattttttttgttttgggaggcttttgttttgaagggaaagtttttttttttaaaagacccttcctttaacttggggtggttttttggttgccccccccctttcccccca

SEQ ID NO: 489967 - DNA, 275 bp, Homo sapiens
tttatttatttatttattttttgagacggagttttgctgtgttgcccaggctggatgctatgttgctcagagtggagtgcagtggcacgatgtcagctcactgcaacctccgcctccctggttcaagaaattctgcctcagcctctggagtagctggaattataggcgcctgccatcgtgcttggctaatttttaaacttttttgatgagttggggtcttactatgttgcccaggcttggaagtgattcttccttggactcccaaagtcctggga

SEQ ID NO: 489968 - DNA, 247 bp, Homo sapiens
ttaacatcacttcatcagataaagcacacttcaggatgacttaaataatctgccatgtttctgttatcctcacaactgtacccttacacaatgcatctctacctagaaaacgtatttcagatggctataagagtacagtctgagccggtcacggtggctgacgcctgtaatcccagcactctgggagggcggggcagattgatcacgaggtcaggagattgagaccattgtggctaatatggtgaaa

SEQ ID NO: 489969 - DNA, 216 bp, Homo sapiens
ctgaccatgattactggacttctcaggcggtacatggacatttgcaaacaccactgaccaagatctggagcggtctaggacaagccccagcagggcgaacactcagctcagcactgtctctgcaggaactgcaggcccactttcttattgggaaccaggacaatgcggccacactcttcaactcccccgtctccggggccagaaccacaaatatcg

SEQ ID NO: 489970 - DNA, 265 bp, Homo sapiens
  misc_feature (38)..(38): n is a, c, g, or t
caccattagtgaacgcattgtggcgcatggatcctgantgttgcagtggagtcatgcagcgaggcccaaggcatcccgattgaatgcagtggattccatgcattgtgattgaatgcagtgaactccatgcagcgtggtaaaatgaatcccgattgaatgcagtggattccatgaagcgtgattgaatgcactgtattccatgaagtgtgaagtaatggaacgttcacttaatgccgctagcgccgttcacttaatgccgctagcg

SEQ ID NO: 489971 - DNA, 477 bp, Homo sapiens
catttaccatggtattttgggtaaaataggaggggagagttaaatatactggtatttgcatattattgcaaaaataaatcacataggataaagtatagcctaacaagcttggttatctagagaaaatggaaagaaatggggtgaaaatgataaaagtaatgggaagaaacatcacttttctgcctggccctttttatataattctgaactaactttgacttggttacctgtcaaatacaagcaattggatatttgtgtccccccaaaatttgtatgttgaatttgtcatttcaatatgatggtatttggtggtggggcttttgagtgtaattaagtcatgagggtggagcccttaggaatgggatttgtacccttataagaataagctataaaagtcctagctactcagaaggccgaggcaggagaattcttgagtccaggagtttggctggacaacatagcaagtcccttctcaaa

SEQ ID NO: 489972 - DNA, 185 bp, Homo sapiens
ctgtctactggactctacaatacacttccccttggtccatgcctggccagtggaccatgcactaaatgtgctagacagacgtccgagagcaagtcttactcttggtggctcacctctgctcaaagcacactccctagggaagtaacccacaccaacaatgcatcctgtaaagaaggggctcctct

SEQ ID NO: 489973 - DNA, 761 bp, Homo sapiens
gggaggtctggatagggtcagaagtaatgggattctttgctgctttcctctactacaggctgtttgggtcttctatggaagatgaagcttaggctcttaaactccttattcctgggcagtgatagctccagtttctttcagagaccgaaatatgttcaccacgccttcccgcgactatccgcagaagaagacatacttaatgtttctagagcaacactttggtttaacctaagtgaatctatcgtgtatttgctgcctgagtagtgtctacttctgtggcccacaaaattgttctgatgctcaagttctgtctttagaacacagcagctttctcattatctgaggtattcgacttagtgatacaaacttagctttaaaactccaacaaaatatagtcataatgatcttcagagctcccccacctaacttttggtgttggttatgctgtctggaactatacacggctaacttgggatagcggtgtaatgatatatcactttgcgtcacttactagttagaactatcgtaatccttctctagcgtggcccgtaactggttctgacgtacagtgcttaggaatgctgaagaagtccaagaaacatcctgctcctaacacctcctctagattttcaaccgacgtcgacgaacaggattgcgggcttcgtcaccaggaccatagggactcgggtcgcagatggctcacacctgcttaacccagcacttcgggaggctgaggtgggcagatccacttgagctcacga

SEQ ID NO: 489974 - DNA, 231 bp, Homo sapiens
  misc_feature (142)..(142): n is a, c, g, or t
  misc_feature (151)..(151): n is a, c, g, or t
  misc_feature (214)..(214): n is a, c, g, or t
tccaggatctcgtataagcgtttcccaagtcgatttggacatttttgcaaaaagttcttacctgaagtgtgattctaatggtgactgtacagtaatggaacaggaacggaaaattttacaacatgacgacaaatctttcgtntagttgaangagagtgctaataatgactattagtggtcgggaacatagaagacggtattactacggaaccgnctaaaaaactagaagac

SEQ ID NO: 489975 - DNA, 560 bp, Homo sapiens
  misc_feature (82)..(82): n is a, c, g, or t
  misc_feature (138)..(140): n is a, c, g, or t
  misc_feature (492)..(492): n is a, c, g, or t
gggggggggcggcggcgcggggccggggaggaaggggaggggggagagctttagtagctgcaaattttcctctgataggggnaaatataccctctattgtactttgttgtggaagtggggcatttccacgagactatnnnattttagatgcctacggggggcgcaataaaaaaaaacctcttctttcaccaggatggaaaagaaacaatgtaaaaagagtttagcacggaaagagttgtgtctgtgctttaaaggattagcatattgggggcgttgataaggaaggaattccatgtgagaagggggagaaaactgagagatgaaacaacgggggggggggagaatgtttatttgtccccccctctactataatatttatgatcgtatctgttggccgagaggaacatgttggaggaactatgaagcaggtgtaagaagatgatgttgtctctacgggagacgcagcgagcgggaggggtggcgcgggcgggngacgagaagatagtggggcgagagagaggacgcgcccacgaatgcagcgtgcgggcgctagacgggtg

SEQ ID NO: 489976 - DNA, 990 bp, Homo sapiens
gtaccgtaagggaaaattgaaaagaaattgaaaggagaggagatgagataaaatgagatgaaatgagatgatggatgaaactgagatgaaacgagatgaaatgaaataatgaaatgatactgaaataactgaaacttgtaactgagatgatatgagatgaaataatgagataaaactgatgagatgagatgaacgatgagactgaaactgactgaaactgaaatgacgactgaaaaactgactgagatgaaaaactgagatgaacactgaaataactgaaactgacgatgaaatgaaactgaaatactgaacaggaaacttactgaaactgtaatgactgaaacttgaaactgagatgagttgaaactgatgagatgtaatggtgaaactgaaatgatgaaatgagatgagatgaaatgagatgaaactaatgacgatgaaatgagactaatgagatgagatgaaatcatgagatgaaactgatgaactgcacactgaactgatggatgaaattatgagcatgaaagatgaacatgtaatgagatgaaatgacataatgaaataatgaaatgagatgacaacttaacaataatgacacatgaaataactgaaatgaacatgaaatggcaactgactgagactgcgcacagcacctgcatgcgcactgccactggcacgcaccctgcctgcagacttgacgtctcccacatgcccatgcacactggactgcacactgccgcatgcccctcctcacgcacgcactgaactgccccttacatggaaccgacacgcggcaccacaacgggcacctcctggcaactgggacaaggaaccaaggctgccgacgcgcacggaaccgcgcaccagcccacctgacacagaccgaacacgacgaaccacacacaacgaagacgaaggacgaagcccacgcaccgaaccccgagccccaccacgaaccccaaccacgaccaccaacaccccacccccccg

SEQ ID NO: 489977 - DNA, 431 bp, Homo sapiens
  misc_feature (49)..(49): n is a, c, g, or t
  misc_feature (58)..(58): n is a, c, g, or t
  misc_feature (91)..(91): n is a, c, g, or t
  misc_feature (252)..(252): n is a, c, g, or t
gccatggtgacgcaggcactccccaacaacccttgctacactttggacntatgatgangctcgatccaagatgttggttggcgcctgatangttgtcccatctctgttactgcttgtgtgacgcagatccgttccaggcctcggcagtgatcatgtcctatcacctatactagcatgtgacaccaccctaatcatttgagcctgggaatagcccctcaactaccttccttctttaaacactcttcagagaantctgcattctatttctcatgtataaaactaggaatcctccaaccaggctcctgtgatagagttcttttaagcccaagattttttatttgagggttttttgttttttaaaaaaaaattgaacaaagactactaatgactttgtttgaattatccacatgaaaataaagagccatagttcc

SEQ ID NO: 489978 - DNA, 358 bp, Homo sapiens
gaagctgaggttggcaggtgaccaaaggaatgcttcctaccctcattgccttcagtttaacttgcagccaccttctgaaaacatatctttaatagaatttgaaaacttggctattgatagagataaattgttaaaatcacttgaaaaaattgcagtgagctatgtgaaaggaactgaacactaccagactaagtgggatagtgagcttccgtagctaaacttgttcttgccaaaaaaactcatgcgacaaatataaccctccgaaaaaaaaaccatatttgctaactggaaattgcggattgacatatgctcacaaagactaaggtctaactgcgaggttattgaatatgagatggac

SEQ ID NO: 489979 - DNA, 584 bp, Homo sapiens
  misc_feature (36)..(36): n is a, c, g, or t
  misc_feature (41)..(41): n is a, c, g, or t
  misc_feature (43)..(43): n is a, c, g, or t
  misc_feature (229)..(229): n is a, c, g, or t
  misc_feature (528)..(528): n is a, c, g, or t
  misc_feature (580)..(580): n is a, c, g, or t
cgaggaggagaaaaggcgctgctggacaagcgcacncggcnanggcagccttcgaaaagatgcaggagaagcggcaaatggaaagaatcctgaagaaggcatcaaaaacccacaaacagagagtggaggacttcaaccgacacctggatacactcactgagcactatgacattcccaaagtcagctggaccaagtaacctgcccctggtgcaaaaaggcagaaggccanggttgacagtgttttgtcttgtccctccgtgttttctagaatgttttacacctggctggtgaatctgctgagaccaggttttctgagacttgattaaagtcagggtgtcctttcactggggttttggttttggggtagttccctttcctgtttggacagcaacattgtagattgatatgctgaggtcatttctgggtgaaggccttggaaggatggccccctccaacccccatttgcggcatctgtctttcacttacaccacaatgccaggacagaaagctcacgtggaccaccacagnagtttcccacagtgctgctctaatttttgggccaccttggacatcagattgntctg

SEQ ID NO: 489980 - DNA, 260 bp, Homo sapiens
gtctgccactgtcttctgggattaaaggaaggatcaggcagcgcaagctcaggcctgtactcctagcaccttgggaggcttggcaggcagatcacttgagctcaggaggcagccagatcacttgagctcaggagtgcgagaccagcctgggcaacatggcaaaatgctgtctttacaagaaatacaaaaattagccaggtgtggtggtgccacctgtagtctcagctacctggggggctgaggtgggagaatctcttgag

SEQ ID NO: 489981 - DNA, 386 bp, Homo sapiens
  misc_feature (324)..(324): n is a, c, g, or t
  misc_feature (342)..(342): n is a, c, g, or t
  misc_feature (372)..(372): n is a, c, g, or t
ggaagtcctttccaaactagcttcaggtaaaaagagaatttgcctcatataactgtaaagacaaggtttagcacaggcttcaggcttagataggtattgatacttggcatcttagcaggactgacttctcttaccatctgcttctgggctggcttctttcacagtctccacgttgtggcaaggtggccaaagtagcttttattcctgttcctccatgtgtcccagcattattgcaaatgttgtattgtttgtcattgtctgagtccctgaaccagttaggaatgttatgtgcatagtcttgggattatgttggacttcatttgnctctatctgtgtcaggantgaggcccgacctgggagcactcagactgnagatttgacagagt

SEQ ID NO: 489982 - DNA, 583 bp, Homo sapiens
  misc_feature (128)..(128): n is a, c, g, or t
  misc_feature (137)..(137): n is a, c, g, or t
  misc_feature (156)..(156): n is a, c, g, or t
  misc_feature (163)..(163): n is a, c, g, or t
  misc_feature (181)..(181): n is a, c, g, or t
  misc_feature (190)..(191): n is a, c, g, or t
  misc_feature (213)..(213): n is a, c, g, or t
  misc_feature (220)..(220): n is a, c, g, or t
  misc_feature (278)..(278): n is a, c, g, or t
  misc_feature (288)..(288): n is a, c, g, or t
  misc_feature (294)..(294): n is a, c, g, or t
  misc_feature (387)..(387): n is a, c, g, or t
  misc_feature (407)..(407): n is a, c, g, or t
  misc_feature (527)..(527): n is a, c, g, or t
ctgatgatatcatcagggcttgcgggcctggtgggaggtgagggagggaatccgtcaggagcgggggcagacacacgtacatgtatgcgtgggttaaccatgacactgccacctccacttccacctcncacaccatngctgaacatgaaacttccntttccanaatcatcaggtgcgcacnctggactannggtgggaatcacgtgcgtaganaggctanagctttggatgcctccctttctgcaaccccgctcaaccccgctgcagccacattagcnctggccagcnctccanggcctttgtccatgctccagtgctgtgccagccagttcgcctcccgtgccaatgccctgaagcacatggctggaatcccggagaagagtctcntgaagagtctctacttctcntttccttttttttttttggcgagggagtctcgctctgtggcccaggctggagggcagtggcaccatctcggctcacggcaagctccgcctccggggttcacgccattctccgggctcagnctcctgagtagctgggcacggtggctcatgcctgtaatcccagcactttgggaggc

SEQ ID NO: 489983 - DNA, 323 bp, Homo sapiens
ggatgactggtgggtctagggcgaatgcagatgctgagtcagtaagcctgggtgaggcctgtgatctggcgatttctaaccagctccggggggatgcagagggcctagccacagaacacacttgcaatagcaagggtctagggcatccctgatccaactagaactttcctggggtgatgggaaatgtctgcatatctggtgctattggtatatgttacggtcgcgcactaggcctccgtgaggactagtggagcgtgtgggaaagtgtggtctccatgcaagccggagcaaggataattcgaaaatgtgtattgcacatattc

SEQ ID NO: 489984 - DNA, 770 bp, Homo sapiens
  misc_feature (305)..(305): n is a, c, g, or t
  misc_feature (361)..(361): n is a, c, g, or t
  misc_feature (409)..(409): n is a, c, g, or t
  misc_feature (447)..(447): n is a, c, g, or t
  misc_feature (457)..(457): n is a, c, g, or t
  misc_feature (486)..(486): n is a, c, g, or t
  misc_feature (512)..(512): n is a, c, g, or t
  misc_feature (558)..(558): n is a, c, g, or t
  misc_feature (563)..(564): n is a, c, g, or t
  misc_feature (566)..(566): n is a, c, g, or t
  misc_feature (568)..(568): n is a, c, g, or t
  misc_feature (585)..(586): n is a, c, g, or t
  misc_feature (590)..(590): n is a, c, g, or t
  misc_feature (599)..(599): n is a, c, g, or t
  misc_feature (615)..(616): n is a, c, g, or t
  misc_feature (618)..(618): n is a, c, g, or t
  misc_feature (627)..(627): n is a, c, g, or t
  misc_feature (634)..(634): n is a, c, g, or t
  misc_feature (643)..(643): n is a, c, g, or t
  misc_feature (655)..(655): n is a, c, g, or t
  misc_feature (661)..(662): n is a, c, g, or t
  misc_feature (670)..(670): n is a, c, g, or t
  misc_feature (684)..(684): n is a, c, g, or t
  misc_feature (689)..(689): n is a, c, g, or t
gcaggaggattgcttaaggccagtagttcgagaccaaaggttatccaggtactcagaagagcagagcttcatctgtgtcttactcagactggagggaataccagcctccccgagacagtcctacttggagggactatatgccaaagctcattcacacaaggctgctgtgccaccttctccctgttgcaccgggcccacgcacatacacacatacacagtcactgactcactctcacccctctagccttaaatccagaatctagactgaatatggactgaatgggtcagattggggaaatgtgttnctggggacagctgagggaccagagagaggcagggcctggggcttcccaggaaggantggagggtgaagatgttcctagcgagggaagcagacctgaggacaggnagccaggtagacctgacactccgtaataaaggttaaanttcttggggnttttcacttagattatagggaaagttaanaccaaagtttagctgggcatggtggngggcacctgtggtccaggtacttgagaggctgaggaagagggtcgnttggnncnangaggtcaaggtgcgtgnngcgnagtatgcantgactcaagccaggtnnangagcaaganctgtttnaaaaaaacngggaacccgttntataanncagaaatngcgggtgtgggcangctgnatccaggtatcggagctaggacgaggatgttaacgggttgagttgcgcagccgatggtcatgacaagctgggaaagatctt

SEQ ID NO: 489985 - DNA, 148 bp, Homo sapiens
agcttttcctgggccaagggaggagccgctcattcccccaacaaaactgtgttttatttgccaggaaagaccagcctccctcctgggaactgtttggcaggtaggctgggccccccagtgctgttaaaataaaaagcctcgtgccgga

SEQ ID NO: 489986 - DNA, 435 bp, Homo sapiens
  misc_feature (29)..(29): n is a, c, g, or t
  misc_feature (86)..(86): n is a, c, g, or t
gtgaaagacagttccattttcctttagantcacagccttggcaaaatcccccttccctttaccagggaaatcccttcctttaggantgaaaggtaggggtcctttcccccaaaaaagtcctgccctcatttgaaaaaactgtctttccatatgggtaaggggggccccccccccctttttgccctcccgggacattgattggtcctgttttgggcaggtttagtgagctgtaaaattgaatcaatgtgaacccagggaactggggaaggctgagccccctctttggtgttgcggtaaaataacccccagggctggtgaaagtcccccaatggcaggatatttggtttcaaagtaaggactaggggcccccccatgcctgactatcaatcaaaatgtttgtaacttaaaatttttaatgaaggataatgaatttta

SEQ ID NO: 489987 - DNA, 109 bp, Homo sapiens
acgcgagtgatgtgggtgtagtcgggactatatgtgagatacttctcagatgtaggtgaggatcagaaagctgtagtgctggcacggtggtcatgctgtaatcccagca

SEQ ID NO: 489988 - DNA, 564 bp, Homo sapiens
gcctcagcccctttgaatatgcatggccccagaggaaatggatctacttttaagtattaacacaagacaaaagtcaccaaggccactgagttatgattgcagaaaaaaccatcactctcaacgtgctgctctaagggaaaaggaagcaataaaatttgatcgattcaacttttaagtacacgtgaggtccaggaaatataattcttaagccataatgttgaattaacatatttcattgcacttaattttcttagaatggtgcaacttgggatgttccagacacagaagcaagacaactgcatgacgtggcagggggacactgaaataaacacagtaggaaagccagctctccttttacagatgtaaacagtcaccggatttataaaagcagtaaatttggcctgctcagtcataaaaaagccttaaccattcaatatgtggaaattcagttatttacacaagaaccaggccgggtttcaagtcttaccaaaaaccattttttaccttaggccattttggccctggaaattttggttgttcttaaacccaaaattttttgagttt

SEQ ID NO: 489989 - DNA, 737 bp, Homo sapiens
  misc_feature (467)..(467): n is a, c, g, or t
  misc_feature (484)..(484): n is a, c, g, or t
  misc_feature (496)..(496): n is a, c, g, or t
  misc_feature (499)..(499): n is a, c, g, or t
  misc_feature (510)..(510): n is a, c, g, or t
  misc_feature (514)..(514): n is a, c, g, or t
  misc_feature (517)..(517): n is a, c, g, or t
  misc_feature (528)..(528): n is a, c, g, or t
  misc_feature (543)..(544): n is a, c, g, or t
  misc_feature (554)..(554): n is a, c, g, or t
  misc_feature (656)..(656): n is a, c, g, or t
  misc_feature (663)..(664): n is a, c, g, or t
  misc_feature (672)..(672): n is a, c, g, or t
  misc_feature (683)..(684): n is a, c, g, or t
gaacagcggcggcaggaggagaacgacaagctgcgccacgagtttgcccagcatcgccaacgccttccaccagtggatccaagagaccaggacatacctcctcgatgggtcctgtatggtggaagagtcggggacccttcgagatcccagtcttgaagctaccaaatcgcaatgcaccatggaaatccgagccatgatgaagtcagtctctactaagagatcgacggtacctgggggccgccatggaggaggccctcatcctggactacaagtacacggagcacagctccgtgggcctctgcccagtcatgtggcgacctatgcatggaacacagcgtggtgtcgatgtctgctatgtcagcacaatcctggatgcagcagatccaggccaggaacacaacatggtgtgactgaggaggcccgtcaaatgaattcagcatgatgttttagacactttgcacaagganaagtctggcaggctganccatcaggagtncanatcttgcctgngctnccntgggctatganctgcccatggtgganncaaggggaanctgaccctgagttcgaggcaatcctggacacggtggatccgaacagagatggccatgtctccttgcaagaatacatggctttcatgatcagccgcgaaactnagaacgnnaagtccancgaggagattnngagcgccttccggccctcagctcagagggaaagccttacgtgaccaaggagga

SEQ ID NO: 489990 - DNA, 175 bp, Homo sapiens
  misc_feature (24)..(24): n is a, c, g, or t
gatctacaggatccttcgcatctngctcccatcagaaagaaatatatatttctatagtataacctccacactatggaatattatgtgatatgatttgtcactgtgctccacccaaatctcatctcaaattgtaatccccacatgctgggggaggggcctgatgggagaagatgcg

SEQ ID NO: 489991 - DNA, 310 bp, Homo sapiens
gacccgacacagaaactctccctcccagataagcaagacaaagaaacacagaataagagtccatctatgtcctcagcgaatggcgctaagagatgatttaaaaaaactctgatctatatagaaggcacacatggtcccaaccaaaccactggcccataagaggataagacctcctctgctcatgaaaaccctcatcagtaaaccataaataaaaaccctgacaattttactaccacttggcaacccgctcgggacccctctctgtgatggagagctgttattttcttttgcatattaaactcctgctcca

SEQ ID NO: 489992 - DNA, 497 bp, Homo sapiens
aggacttgaagacacagacagtacaggtgtggtcctgcctcgagaggttacagtctaggtggagaacggcaccaggacacatgcgagctgagagaaacagtccagtgcagtttgtaacaggagctggaaggtgtctggggtcagaccccaatactccaagtacactaagcacttcagtgcctccaggggctcaacgttagtgccaggaaagacaactactcccagtcccatatgagcccacgtgtcatgccctgtccatagcctctactgccaccatcttagaatgtctgactccttgttccgctgctaatcaaagtgcaatgaactggggagggatggggtggatgaggaaggtcgctggaccgatttgaggggccagtgtctccctcctagaaagatctactcccccatcatatacccctaacacagagataaccccactcaaggggtgctgtgccaacacatgggaccctcacccccacagctagaggaggggc

SEQ ID NO: 489993 - DNA, 295 bp, Homo sapiens
tcactgatgaatagtgtcccgggtacattgagtcacaggtcataggatacgaccagagcgcataggaggtccttaaggttaagagagtataccagtggcacaagtagtgttcaggctcggtagcattgatagcaatccggcagcgtgagcacagtgcggcataggacgcctcttggatatccagaggcgtaagtgtgctgcgaaacacatccggaggcagtgctaggtcactcttgagctgggtggacgtacgccattggcaatctgataaggactgttcttcctgaggtcagag

SEQ ID NO: 489994 - DNA, 462 bp, Homo sapiens
  misc_feature (9)..(9): n is a, c, g, or t
  misc_feature (65)..(67): n is a, c, g, or t
  misc_feature (102)..(102): n is a, c, g, or t
  misc_feature (104)..(107): n is a, c, g, or t
  misc_feature (136)..(136): n is a, c, g, or t
  misc_feature (140)..(141): n is a, c, g, or t
  misc_feature (208)..(208): n is a, c, g, or t
  misc_feature (218)..(218): n is a, c, g, or t
  misc_feature (228)..(229): n is a, c, g, or t
  misc_feature (233)..(233): n is a, c, g, or t
  misc_feature (243)..(243): n is a, c, g, or t
  misc_feature (252)..(252): n is a, c, g, or t
  misc_feature (254)..(256): n is a, c, g, or t
  misc_feature (269)..(269): n is a, c, g, or t
  misc_feature (277)..(280): n is a, c, g, or t
  misc_feature (285)..(285): n is a, c, g, or t
  misc_feature (292)..(292): n is a, c, g, or t
  misc_feature (298)..(298): n is a, c, g, or t
  misc_feature (362)..(362): n is a, c, g, or t
  misc_feature (388)..(389): n is a, c, g, or t
  misc_feature (402)..(402): n is a, c, g, or t
  misc_feature (456)..(456): n is a, c, g, or t
cccactttnttccatcgcccttcccaacctcttcttctaccccctcccctcccattccatttccnnnctctccaccactctctccctcccccatcccatctntnnnnacccatcacctcatatcacccccacaacnctcnntcccctccatccccacacaactccctccaacttcctcccctcttctccttctactccaccccctttngcaacacctncacaccacgnnctcnacacaaatcncacctctcntnnnccaccttcacacnccacctcnnnngtccnggaaacnggttcngccatcacccaggcacctcccaagcagtcactgaggccacggaccctccacccacgtcatcggnccacctccctctcactcctccccttnntcctcacctacanaccacttcacttcccctttcctcatcctcactatgtcctcatatttggctgtcngggcaa

SEQ ID NO: 489995 - DNA, 124 bp, Homo sapiens
taggtaagcgccgcaggatgttaggaagcaagacgtcctggaaatgaacgcatgtatgctctatggtggggaggggggagggctgcctgaaaaccatccatctgtggaaacgagaagcggcgaa

SEQ ID NO: 489996 - DNA, 122 bp, Homo sapiens
gcggttccgaggctcccccgccactctctctctgcccaggttctgctggtgggaagggatgggacccctctctgctgcccccttcttcccttcaacaacttgaccatctcttgatgttcttg

SEQ ID NO: 489997 - DNA, 464 bp, Homo sapiens
tgtggagacgggggtctcacctggtggggatgggccgccaaccccagggactgggcccagcaagtccggcaggagcctggggggatggggaaccccagcggggattcctcggccagcagccctgccgatcccggggcccccggcagctccagcaagtggaactcgagcaataccagtatcttggggaggaggtccctctacggtcatggagaccagattctcccctcgcagcagcaccagaccgaggactcgcttctcttccctttcggctggtggggagttcttgggcttgatctttctgaactcatcacagtcacagaggatcaaattcaggtgctggtcaaaagcctggaaggtgccaatgaagatccggccgtccggcgggatgcacctcatccggtaatcaatatggtgcagcatctggctgctcttgcccaccgtcaggggggcggttctgatggctc

SEQ ID NO: 489998 - DNA, 908 bp, Homo sapiens
ggctgccgcgagcgtggacgcaggcggatctctgaagagctgggtcgccagcctctcccgcgcacgttgcctggctccagcacctacttggtcccgcgcgctccctcgtgtcgcccctcggagcagcagccgccgcggtcgccgtacccggaaagaagtcagagacgccgcgaggtcgccgcaccgcatgcccaaagaataaccggtaaccggaggtacaaacagacgcaggggtacagactgagaatgactctgaaaaaagagaactggtattcaaacgaggatggtcaggagtatgctcaggtattcaaaatgttgggaaatggacggttagaagcaattgtgtttcgatggtgtacaagaggttatgtcaccatcagaggaaaccttgagaacacaacggtttgataaataacctcggacatttatttgggttggtctccgagactaccaggataaacaaagctgatgtaattttaaaataccaattggcaagacgaaggctagaagtctgaaggcaataacggggagcttcaggagcattgctagaattcaatgaaactgatacatttggtccctggagatgatgatgaaattcagttttgctgaccttgccgatgatgcatggacgcattttggtggccctcttacattgaacttcgacattttacatccctctttgctgaaggattgtcctacaccttgggtttggtcctgccacgacgactttaatttcttagcttgaatgccttggtaagcaaactgggtggtcaaacaatttgggtttccacggcacaaggcgatactgtaagagtagcccctgtttttggaggcggcgcggagaccgtctttacacaaaaaccgccttgcgtcccccacggggggaaatcggccggcacacgcgtgga

SEQ ID NO: 489999 - DNA, 175 bp, Homo sapiens
  misc_feature (175)..(175): n is a, c, g, or t
cccagagcacagagggtgagtagcctatcacgtgcagtaggaggagataggacggtagtacacgagtctgaggaggtgttgcgctctattggtgcaaacaaaatattctagtatcacagttcccagcctgtccagaaccctggtcctgaattttcatatccttgtttgcctgtgn

SEQ ID NO: 490000 - DNA, 276 bp, Homo sapiens
gggggggtttttttttttgccccggggggtttccgggttctggggtcaaatgggccccccccccccgctttccaagggcccgggccagttggggtttttttccctcccctcttgcccccccaaggggtttttccccttttaaaaaatggcctttctaaattgggtttgttgggggggcagtttttttaaccgggaaattgtaattcccccccaaaagttttttttccccggtccccctgacttatttccccaaaaagggggggtttggggggccca

SEQ ID NO: 490001 - DNA, 385 bp, Homo sapiens
ttttaagaaaagataaccccccttttttttttttataaaaccaaaattagtttcaaatatttttgccattgggatttttttttccccatttcccagcaaagctaagggtattttaatcattatttttgccggtcataaaaaaacttttagctgaaatggccgaaaactgtgaaccatgctatggaagctgaatcccggccgctagcccagtttactttttccctttttaatcggctgatgttactctcccttgatggggttaaccccttttaaaggtaaaaaagccagccagtttgaatatttgtaaacttgtttttttttgggaaatttaggacttaggggtcctctgttgctattgttttttatatatcccaaagaaaaccca

SEQ ID NO: 490002 - DNA, 186 bp, Homo sapiens
ccctaaaaaaaaaaaaggtttctttggggaaaagggaaatttaaaaattcccggggggggaaaacttttttatttccccccttacccccccccagacttccttcaaaatcaggggcaaaaattttttaccggttttaattattggctttcaagcccgggagaagaaaaccccaactttttttttta

SEQ ID NO: 490003 - DNA, 133 bp, Homo sapiens
acaaggacaaggacggatacaaacccgacgttaagatcgaatacgtgaatgagacgggccggaaactcacacccaaggaggcttcccggcagctgtcgcaccgcttccatggcaagggatcccgccaagattg

SEQ ID NO: 490004 - DNA, 109 bp, Homo sapiens
tcacactagtcgctagaaaacatgcttcaatattctatctaatgaaaacgacaccatgcagaacaataagctaatcctctggatgtgcggtatttctcttcaactgcta

SEQ ID NO: 490005 - DNA, 238 bp, Homo sapiens
ctgaccacctcggcacaggtcatgttctttcctgacccattgccattccccttgctgccctgtgaccctctgtctgtccatccatcttcatcaaccactcgcagcggacccctgctcactccctccgatccccgctccatccgtccgcccacacatgggcccatctgactgtcgcctgcctgtagctagccctgccgtgagcagtctatccctacccagccctgcccatcacttctgc

SEQ ID NO: 490006 - DNA, 987 bp, Homo sapiens
  misc_feature (327)..(327): n is a, c, g, or t
tggaaacttataaaatccctcaaaaacggttttttatacaagtgattttggattcaccaatgggcttatcggtaggatttctggtagcaagcgcgggcaccagggcctccaaatctttttgggactacgcagcgacaaggtggtcagctaaccagcacgggtccggtacataactgggatagacggatcgtcttagagatactacctttctttgcgaagcctacataccactaatatttctgggtacataaggccaccagggcttctggaccagtggcctgcacggaatacgcaataaatctcttgggccacctgtgaccaccaccnctttttacacggaccacggatgtgtcataccaccagaaaattcgtctccttatgccagaaaacgcaaacacgtggcctccaccagcttgggctcgtgatcagctgtgccgcgggcatcaaatcatactcccaaggggctcggccccgtttacactctgtgatcttgaatacccatagtgccccgggatttgagcccagtgccgcaccacacgcttgttccgccatgatactacacatatgaccgtaccggaagaacacttgacaacgcggatcgtgcaccggggcaccccctttggacaccgggctatagggcctcgcagaagcctgtttggcaaccttaagcaacacaactttcaacccggccgctccgggtcgcgccactccaaattagctccggggattgccggaacacaaaacgcaggcgttatcttgacagcggtgcgccccccagtcggcctccaactaagccttgtattccccgtggaaacccacagaatatatatcttcgggattcacacaacaagcgtgagttaacaaaatacttgacccgggggtgccatcccattattctagggcgacgtcgctttattataacttattcggcatcaacagcccacgggcttcacacccctggcatttacctgacggcgtgcgaaacac

SEQ ID NO: 490007 - DNA, 305 bp, Homo sapiens
gatcatactttagatatgagttaaataaaatctattaaaattatgagaacttatggacacaaaagaaggaaacaacgacactggggtcttcttgagggtggaggttgggaggagggagaggagcagaaaagataaatattgggtagtgagcttaattcctgggtgatgaaatgatctgtatgacaaacctctgtgacatgagtttatatatgtaacacaccttcacatgtaccctcaaacctacaataaaagttaaaaaagattgcaacctaaaataaatggataaataaaatctgttaaaaaaa

SEQ ID NO: 490008 - DNA, 172 bp, Homo sapiens
ccgacagccacggacgctggcatagcacaccctacaagtcatttctgcaaggtgccattagtcatgtgccacctgaaacaagaacaatctgcacaccccagagtcgtactcagaaacatctattccctggatacaatttacacgtcattgcgacaacattactacagtccta

SEQ ID NO: 490009 - DNA, 121 bp, Homo sapiens
tacagccgatgaatatatagttaaatgtctgcggcgtagcttaggtctagaggtgtcagcctgagtaatacggcgaaatcagatgcatgaagcctccattttatggcaaataccagctcct

SEQ ID NO: 490010 - DNA, 267 bp, Homo sapiens
gttgaaactagcctgggcaacatagcaagacctcatctcaaaaaaaaaaaaaaattggtcttgggaacgggattgtcagaggcagggttgtcaggtgtgttgaccccaaggctgaaaagccatatttgtgagacatgaggccctctagaaagctgttgtggaaaatgggcccagggctctgagccattcggggatttggagcacctatttcatgacagccactgggggcaaggactgggggagagagaggtgctaaacgttctgggc

SEQ ID NO: 490011 - DNA, 243 bp, Homo sapiens
ttttttttaaaaaaaaaaaaagaagaagaagaaagaaagaaagaaaatagagccctccataacccttagagtgccttttaattatttgggtcttacccaaaaattaggggaaattcccgtttagtgggagggtttcctgttactacgatttggatttcccctttaaataaactatattagttttgcttgctttttccaaaatattatatttttccttttaaaagctgttcctgctcttatttg

SEQ ID NO: 490012 - DNA, 199 bp, Homo sapiens
gaaagttaactccaaaattctttctagaataagctgaaacagggaagtggtctgtggtgtccagccactcaacaggtccccaaggttgtacactgagtttgacatttggtatcgcttgacaggacgcaggtgcaacaatgctttactaataagaataagccaaagaaaaccagcaatttccacccacaaagtgcaccca

SEQ ID NO: 490013 - DNA, 211 bp, Homo sapiens
  misc_feature (182)..(182): n is a, c, g, or t
ggcgctctttcttactttgtcgagctacccggctgaggtgtactagctcgggcctttcctgaggaaacgtgccgtcttgacgcctctacctgttgcactgtcacagacggtacaacgtcggtctcgagtatggatgtacatgcttggctgatggagcgcctatctgcatgcttgatcggtcncatcgtaatatcgacttgctatcatacat

SEQ ID NO: 490014 - DNA, 1358 bp, Homo sapiens
cagatggtctcactgctcttcggtgccatgaaaaaaatcactgctggatgagaaatccttacaaatgtaaacagtgtggaaaagcctttatatattaccagctctttttctaactcctacgaaaggactcacacgtgtgagagaaagcttatgaatgtaagcgatgtgggaaaggcttcagattgtcccgatgtgaacgtttctggaaggtcgactgtatgaaaaaccttcaatacctcggcacgacgaacatcctcttttgtagtgtatggggaagtcgttgtgcgaagagccattgcatcttgtcttcgacgttcaacgcccatttgccgagaatagcacctggtggtaaacaacgcacaacgacgggggcaagtttctaaaccttctcatgaagaggtgattacggagaagttgttcgggggaagcgcctttctaacgtcagtcataaggatttccggtgattgaaagggtgcgacaagatatatggaaacttcgatttctttgggaggaaaaaaaccccggtaatggaaacataggtcacaaacagagtgttgggttacaaaggccgtgtcaaaatttgcttaccacagggtttaacacgttccagccttgccacgcacagatgtacgtttccacccacctgggagcgaaggactacgagaccgtctacagaaactggtgacccaggcacagtggctgggttcaaagccccattgtcccttttaacttcccatgcgtccaccatgtcccgaaagttcccagttgaatcgccaggtaagcccccaattacttacggacgcaagcgacacaaccgccgtgaactggcaaattggcccaaacacccaagcctggcttgcgctaccgggcgttccctttcccacttcttttaaccttgtcccacgttcccaaccccttgtacaggcaacccgggccaccccgtacaacacggaaacggttccacccaactttgggcaaggtttgcacacatcccgcccactagcattggcacagctcgctcacaggccaacagttggtttgggggccacacaaccggccgttttacgcacacttgcgtggtagcgaaaccactctgccgcccttgacagcaagggttacgcagcctaacaccagacagcgttgccacttacgctggcgaccgacatagcgaccaccctctcttcccaggctggcttagtaaccgcgagtggccgcggactaacaacgcgcccgttactcacgcttgcttacacgcttcacaacggcgtccttatggacaccgtctgccccgggcacacggggcactctccagctgacgtatgcgactctgcgacaagcccccctacagcgacaccgct

SEQ ID NO: 490015 - DNA, 457 bp, Homo sapiens
gcagctggcaaagaaggctgtgacatcaatgctatcatctttcacacaaagaaaaagttgtctagtgtgcgcaactccaaaacagacttgggtgaaatatatggtagcgtctcctacagtaaaaaagtcaagaacatgtaacaactgtggcttatctaggaatggaattggacatagcccaagaacagaaagaaccttgcaggggtaggcaggtttcacattgcacatcatggcagggttaagtgctatatctaattggtgcctcactggacttgtccaattaatgaagttgatacatatatgcatcatagtaggtcaagtaataagcatcacattcaagttacactgtctctcatgtcatcatatagctataggttacctagtgtatagctatttaatactaatttcccataagcaatttgggtttagtgcacagcatactacatcccgggttgat

SEQ ID NO: 490016 - DNA, 83 bp, Homo sapiens
tgtgcggctatgagcggtgcggcgcggctctcatcgaggcggcggcggcggcggcggcggctccggcagcatcgcccccgccc

SEQ ID NO: 490017 - DNA, 905 bp, Homo sapiens
tctcagctcagtgcaagctccgctcccgggttcactgccattgtgctgcgtcagtctcccgagtatgctgggagccatcgtcgtcccagtctaataggactttgcaagtcagtattactacgatttcacattagagtgtgggacatgtgatggtaaagtgccgcgtgataggctaaaatacgtgaatagtatacagttgtctatgtgcattgaagcatgatgctgtcccgtgatgaggatgaaggaaagtagatattcgttttcagctgtaggattcatggagagctgttttgtctacttgttctaccccagatttaacctcatacattgcttgtatagatactaagccatcttgaaggagctagagagggagggtagaagacaggaagggggatctatgtggtaacctaagaggaagtgtttctgttgtgtggaatgatctgtgtgtgtggtggtttgattgttttgcttagagagaatcaaaagagggggcaaaagtgagaataccaggagatgggtctagtagatgttgaagctgtgtttacagctagttaatgctctactgtctttgttcaagagacgattgttcactggccaggtcgtttttggtctgagcgctatggccagcaacttataaatcatgcctgtgtagatgtcgaggggtctgtggcatgtatctaaggggttactctgaatgcggaattgataagtcgataagtctggtaagtgaaaccaaggttattctaatggccagcggggggggttgtaattggaaaggatagggtccttggccaatggaaacaggtttaaaccgggaagacgcggggcaatggaaaggattgtggaaaaggggtgaggaggggcctttaaaagtgggggaacccaaaaacaggggggaggtgggg

SEQ ID NO: 490018 - DNA, 668 bp, Homo sapiens
  misc_feature (395)..(395): n is a, c, g, or t
gagtctcgctcttcgcccaggctggagtgcagtggcgtgatctcagctcactgcaagctccgtctcccgggttcacaccattctctggcctcaggctcccgagtagctgggactgcaggtgcccgtcaccacgcctggctaattttttgtattttttgtatttttttttttttttcagtagtgacagagtttcaccgcgttagccaggatggtctcgatctcctgacctcgtgatccgcccgcctcggcctcccaaagtgctaggattacaggggtgagccactgcgcccagcctgcttctttgtgttttatcttgcattgcattactgtggagagaagcaattcatttaaaatatctggctgatgcaaaggcataagaaggacacaatggactntggaaacttggggggaagagtgggagtggtgccagggattaaagactacaaatttgcgcccgggctcctgctccgggatgagggcatcaaaaacttccaaataccccctaagaacttacttatgccaccaaatcccccttgtccttaataacctacagaaacctaaacggtaatactggccgcccttccaacttcgcctcggaaacccctcgctcccaatctaatcgctgccacctatcccttctgcagttcgctctaccccaatcgcccgcc

SEQ ID NO: 490019 - DNA, 1204 bp, Homo sapiens
  misc_feature (309)..(309): n is a, c, g, or t
agcggcgtgagcgccgcggcgccgcagccatgaccgggagtacgaggagtgcgtacaaggactaccccgcgcttcagggcgaccatagacgaggtggagacggacgtggtggagatgaggccaaactggacaagcctgtgtgaagcttttagctggtagctgaatggggagaatgcgaagagaggccgattgtacttgggcgacctaggatggcatgcgaaattgactatgcgagacccgactgaccttgagtcgcctgctattagccaatatcagggctggccatgcatgtggcggataaatttcagnggtaaagagcatcgaagatctggccgatgaatgatggggggaaatacgaatccgatttagataccttagatgatgtaaaatctcctagtgaatgccagatcaatcattgggtgctacctttaatttgtgggacaaatatagtagaggtaactttagtttatgcagaaaaggttggaagtaatcaattatagagcaagaaaacatggagagatcttgagaggcaatgcgcctatatagatgtattgtgcccagtagcctcctatatctacgtggagccccagcgaggaagcggttgattcccatcctgaatcctcacagccgcgacagccgatagtgagatatcttgcccaacccgggtctaattgtacggaaaactgtatataatgggcccaggagaaccacgtgttggatcttggcgaatagctcgggtaaaaaaaaggcggttaaggtgcaaccctaaattgcttccggagaggcttaaccctttgcataatcatcgggctcggtaatctcatttcaatttctaatactcgtttccagttttacattgctttgttcttacccaagttaactcgagttggagggaattcggcgaacaataaaattaaattcagttggtaaacccttatgcgtaatttgggaacaggtaataatatgccaacttgctattttatagtgggtttgtcttgaaaactaatatggtgcgcggaaaagcgggctctttctctgaccgcgcgggcatccaatgaacaagcctattgtgagactgtgtatccaggcggctcaagggaatttgggtcacccataaggcggtttgatttgtgccgagatatggcgtcgtcgcttttgtatttggctagggttttctatggtttggtcttgcgcgacactgggt

SEQ ID NO: 490020 - DNA, 461 bp, Homo sapiens
tgtgtgccctctgctgttgcctggtctggccttctacttttgctggtctgagccctcggcttctgcctggttgggcccctcacttttccctggttgggttgatctaccttttacctggttctggcccctccgcttttgctggattgggtccttctgctttttgcttggtttggggtccctctgccttttcccttgattaggggtccctctgtctttttgccctggtaaggggtaccctctgcctttctgccctggtttggggctccttcagcctttttgctttgattctgagtcccctccgcctttttgccctgagtagtgccagtggctggtgtgttgcccttgccacccactgggtgcacatccaccatcggcacctccttgggagcagttacaagatggcagccttcgaagtgagaacctggatggaatcacaacagagctgaaagctgggttccact

SEQ ID NO: 490021 - DNA, 410 bp, Homo sapiens
tggactctgtatattatttgcaaatgtatatgaatggtctcatgcagcagataatcttttgagataggccttcttgacccagcacaattcccttgagagccacccagattttttgcatgtatcaatagtttgctcctttttattaatgagcaatattccagtggcatggttgtaccagtttgtttaaccatttatctgttgaaatacatctgggttgtttccaatgtttggctattacgaattgagctgctacgaacattcatgtacaagttcctacacaaaaataagtcttaaattatctgaaatacattgcccaagagtacaattactaggtcatatggtaagtctatttttagtcttaacaggaactgacaaactattttccagagtggctacaccattttacgttc

SEQ ID NO: 490022 - DNA, 1429 bp, Homo sapiens
cgcaatattcaaaatgtctacatgcaactcactacacacctctgtacacacaataaaaagaaccccataccaattagcacactccaacatactacacctacaaacccacctccatcatcctcttttataacacacaaactacacactacacaaacaacataaaagtatatatcacaacacaatccacatacgacagaccaacacaactaaacatcacacctcccacacacacaaccatggaaaggacccgcatgagaagcccaacccaccaaacgaaccaccaccactaaatggagagcggacaacgcacaacacgcaccgcgcacctacgcggcgaccgacgacacacggcaacgcacaaacgcgaaggcgcggacgcgagcatacgaacccccaccctggccacctgcacgccccgcgcgaacaagccatccatacttcacccttacatacacaaacgtcatcctcccatatcacaacattacaaccctaacacacatcccctccccaacaacacacccaccactcccacccacccacccaaacaaacattatccacccacctcacactcaactcccacccacaaaatacgcaacccacccacagccctcaccctcacctcacacccaatactcccataacacactacctctagcataacactctcattatactaaataacaaacaatcatacaatatcactatcatccctcacatagtaccgaatacacctcaacaattaccacacctcactcccaaatacaaaactatataaacaaaacaaaaaatatacaataatatccctaatacatttagtaaacattattctacatcacatacccatcgcaccatataactctaatcatcacaacaaacaatcatacatacacccactcaccaccataactttaccccaaatccacaataccatacacaccaatttacaacaacaccacacaaccaacatccgatctcatcacactctccacatctactaactcttactcctctctccctatccttcacccgtatccagacctctccaacaacaacccaacatcacttaccctacccactaaatcacccccaccacaagccacacacacatacaccacaacatacatcacagaacattcatcctataccactcaccttaactcctgcccatcctgcataccacgccatctaacccacacacaccccgccacctctactacctattctctcaatctcaccataccatactcctcctcccaacaactaccccatccccaattcgtcattcctcacattttcacagcacctcatctaaacactaccactcccacttctaaactctatcacagaccatactaaactacacactatacatcaaccaatccactcacctcctaccacacacatcacatacacactcctcaaacttcc

SEQ ID NO: 490023 - DNA, 294 bp, Homo sapiens
tttttttgggggggggggaaaaaaaaaaaaaatttgggcctttggcccttttttttggtttttaaaaggggcccctttttcccccccttttttaaaaaggttgggggcccctttttaaattttcccccccccgggaaaattttttttgtttttaggggggcccaatttttcccctttttgggccggttcttccccccctgggttttttccccccctttggttccccttcccgggttttttcccatggggaaaaaaatccccttttttaaggggcctttttggttttccccctta

SEQ ID NO: 490024 - DNA, 394 bp, Homo sapiens
  misc_feature (194)..(194): n is a, c, g, or t
  misc_feature (319)..(319): n is a, c, g, or t
  misc_feature (373)..(373): n is a, c, g, or t
  misc_feature (389)..(389): n is a, c, g, or t
tcttccctgcccttcccagggactaagaggctggtgtctggctggattccctggaggtctgggaatggggagggcagaggcaggaagctcagcagcccaggcatccccggagccggacactttgcataccctctccagccccggactccttgctggttgctgaaagattcccattggaactcagaccctgtggnccaactgttgcctcctgccatcctctctggctggcaagcacttggtgttccagggaccctccttcagttgggggttcttaattcccccttcccattcacaagccggccttcgtttgcctttcctngcattgcaggctttgcttcctgttttcaaccctgttgggccaaaagcccttttnggttttttcccaaaantgcat

SEQ ID NO: 490025 - DNA, 191 bp, Homo sapiens
catcatgacctccaggcatcaaaggatccttccatctcagaacatcaggattagctgggacaacagagcacataccatcatgcccaggtaaatataagtataaaatggtagagactgggattacatcattgttgctctaggctgctctctacatatctagagctccagacgatccaacactcctcagacct

SEQ ID NO: 490026 - DNA, 180 bp, Homo sapiens
cgtgtcctttgattcctttctcctgaatcacagtctggagtatacagtagctgctcttggcctccacactggggatgccgctgcactcccacttgttccagggcttccagtggattcttccgaggccctgatgtgagaaacttccccattggtgtgcaccaagagcaggcctcacatggt

SEQ ID NO: 490027 - DNA, 806 bp, Homo sapiens
aattcattgacgtgccggggcgttaattgatacattacgtgtgccgtgggctgacaattatacattgccccgccgggcaggaggctagtagtagggccctcggtggggccacctatcctagtacagtgcccgagggacggtagggacagttgcccctgcgccaagggagcccactagccatcccccgctggctggcgctgcagtcgcgcaccctgtgttagcctagctagactatgcttatagtctagtattaggaagctagctatctgtattaggccacagcgcctagtagtatcctagggctagataggccacagagctagacactatgagggtatatgagtatccagacttgcagaccctgggcatccgctatacttcctaccgcgccacggctgctgtgcttccagaggtggcatgatgcctcccggggccacggtggggtagaaggatggcgagccggacataccattgtaaggatgtattttttttaaaacagcaataattagccattttaaaggagggatgtacctgtgtagtgtgcatgtgcacgtgtttgagcgtgtgtgtgtagtgtgcaagtgggttcttggatatgtgtagtgtgagcatgttgtgcatagtgtgaagcctgtgcacgtgcatgttgtaggtgcataagcatgtacacgcgtgagcatgcatgtgcgtgtacacgtgtataggtgtacattgtgctgattggtggaccatgcgtgacccgtgtaagatgtccgtgtttcccatttccgttcctcatgcgcccgggaagaaacatcccgtttcat

SEQ ID NO: 490028 - DNA, 165 bp, Homo sapiens
ctcgctccgctctccgtgaactgatcgccagttggctgatcagcaaatccatggagcggctcacctagccaattggtgcgcgtacttgatcacatgggcaggaaaaaattcttcataaaaagcagtgggaatgccgaggatacttatctcgatgcaatcgggcag

SEQ ID NO: 490029 - DNA, 318 bp, Homo sapiens
cgagtggatcttctagggaataacgccgggtaatgcctgttggggctcagcgccccctaagttgcggggtaggggttagcctgaagtgttcaaagcctcagatatatttgctatgcacaggtggtgttttgagcccttggtatgtcctttgtcgtgttacatcgccccaccatgggtatacggaatgtgtcatgattagtagacctagcaagaggctcgttatggagtgcaagtgacatcacgtgcttagccccacgctcattaagatggtttatcccccccgtctcagttctcatgcacagagttcttctatatgct

SEQ ID NO: 490030 - DNA, 580 bp, Homo sapiens
  misc_feature (44)..(44): n is a, c, g, or t
  misc_feature (51)..(51): n is a, c, g, or t
  misc_feature (53)..(53): n is a, c, g, or t
  misc_feature (55)..(55): n is a, c, g, or t
  misc_feature (62)..(62): n is a, c, g, or t
  misc_feature (580)..(580): n is a, c, g, or t
agaagaagtgagagaacaatagggagagtacagcaccatggagnatcattngnanaggcagngaggcattgagaagaaaaacgggaataaggagattaaggttgaggagagataagaagagaagatatggagagggaggaaagaaaaaggagatgagaggagaatgaagaagagagggaaaggaggaggaagaggaagagaataaataagggagaagagaagaaagagagaagaagaggaggaagagaagtgaggatgagaggagagaaagaaggaagagaggaaaagagagatgaaagaaagagaaagaagagagataaggaagagagaggaaaggagaatgaagaaaggaagagaggagaagaggaaagaggagagaagagaagggaagaaagtgggaagaaaagagagagggaaggagaagaaggtaaaagagaggaaggaggagatgaaggagaagaagagaaagagagaggaggaagagagagaaagagaagagagagagaagaagagaaaaaggagagagagggagagagaaggatatagggaaagggaggagagagagaaggagagggagagn

SEQ ID NO: 490031 - DNA, 944 bp, Homo sapiens
  misc_feature (927)..(927): n is a, c, g, or t
ggaactcacaccatatgtgtcctgttccagtgcgcgggtctgtggagagccgggtgtgatcgtgggtcgccggagggcaatcgagctgagcggagacctaagagtcagccgggagacagtgggtctgtgagagaccgaagtagtaggggctggggccacgatgcgcgcattgaacatgcaatggggaagaatcagaataacaagagcgaggagagagctaaggatgactgttgatcttgatgcccttggttgcaggaaatagaaggagcgtggtgatgcttaaagaagaggagcctcggtatagtcatgcagggaaagagattagaggagtaaataaaagcaggacttcgttgaggatgatgtcctgaaagaagtggaaggaatggtcttggaagtctcaaggcagtcatcagtctgactagagaagtgttgcaggtgatggcaagagagatcaatgaagtaggaattcgcctcaggagatgagagtggagaaatcggcccatgaggggctgcataacaggagttttgatgatatgataggcgaagaattgggtagataaagattccaaatcaaaaaaagaatgcaaaacgaaagtggaaatgtactctgggagtggctgatgatgatgattttaacaaagttcctaaaaaagttaagggaaggtcaaaatcaatagagggatgggtcagggaggtggggtacagtacaaattaagagcgtcaggaataatttttgtgaagtgggtggatcatgactttgaggctaaagggaaagtctgaacagcagtcattgaggggtaggattaggccttaattaacggcaaaaggaaggggcgaaacggtcaaaccattgagggataaattattgcgataacatatgggagtagggtggctcccccttatatttgcaggcatatataaaatatntaatgtatatcatactc

SEQ ID NO: 490032 - DNA, 213 bp, Homo sapiens
tcttaacatcgagaccgtcaacgcaatgatccaagacaatggatggcattcacgtcctgaccagcagagtgttgatctttgcacggaaagacagctggaagattggcgcaccctgtctgactacgatcatccagaacagagtctaccctgccacctggttgctccggtctcagagggtgggaatgcagactcttcgtagaagacccatgacat

SEQ ID NO: 490033 - DNA, 162 bp, Homo sapiens
ccacatttgcaggaacatttatactgcttataataacaatattttcacagttttgatttttataagtctgtcatcatgtgctaattttgtgttattttataaattcttctttaaagccattattacgttaaacgattaagactcataatcttatggtaatct

SEQ ID NO: 490034 - DNA, 376 bp, Homo sapiens
gcttcccacccttttgaactggacggtcctttcggtgtccctaaagtggttggtaaggttcttgaatttgattccctcactggtgagggtcctggaaaagttttcaggaaaaacccttaatttatggagaccgttgcggaaaaagggctgcaggaataccgccaaaagcccccggaggagttaaatgtggaagttggttttgcccctacggggggattttagttcaggtcccccccaaattaggtgcagccccccaaaaaaaggtttggacgtcaccaagtaaacaggccccagccttcaggcccccaaatccggccagcctttccccggtttggatcctgcactttaacactcgactttgctggtcatgggaaga

SEQ ID NO: 490035 - DNA, 273 bp, Homo sapiens
  misc_feature (273)..(273): n is a, c, g, or t
taagtaattacaatttttttaataagtatggtggtcctttccataggtcggaaattttcctcctggaggggaagcaagtcttctggttgggcccatttggattcccttgatttatcacagggtatatcctttcatatagtaggctaataaaaagctttggtctacacacctggcataatcatagtggggggtaaggtcaggtggagatagtttccatccataatggaacatccaaaatctggatcagttaagaaatttcggtgcccatttcan

SEQ ID NO: 490036 - DNA, 282 bp, Homo sapiens
tactaggtgggtgggtttgttctttgagatggagtctagcgtgtgtgggccaggcacgagcgcggctcatggcaacctctgcctcccgggttcaacgcgattctcctgtctcagcctcccgagtagctgggactacaggcgcccaccaccacacccagctaaattttgtatttttagtagagatggggtttcaccatatgggtcaggctggtcttgaacttctgacctcaggtgttctgcccaccttggcctcgcaaagtgctgggattacaagcatgagcc

SEQ ID NO: 490037 - DNA, 163 bp, Homo sapiens
ggggggcccccttttttgggggggggggggggtttttttttccccccgggcccccccccggggtctatttttttttttaatgtggggggggtttttttattccccctttttttttgcggggggggtttgggggggggctttaaaggttttttttttcccccca

SEQ ID NO: 490038 - DNA, 369 bp, Homo sapiens
cttataggaacatcgtaaaaactcactcctaggaggcaaatcattacccgctactttgaacatttcaagtcttagaccacttgacagcatgtatagctagtggacgtagtagccagccatcttcaacagtccagccctcgcatcgcattgcctgtcgccaattgatacctcaggttatgcttttagtaagtatcagcataggtaagcgcatgcttcaatcagggatagtcgcaagcgtataggatatgaccttgtgtgacaatttcgtgacagctatgcttattaatcctatgcagaaggttcatatacagcaacaataagtatgttgcatatcaactttgtgtgcaagatcagaaagcatcacatttt

SEQ ID NO: 490039 - DNA, 284 bp, Homo sapiens
taaagagccaaccaaggcgctggacacggcctcctcgtgatagtggagaatgaggacggggacttcatggtgtacgagtgccctggcctggcccctaccggggaaataggaggtgcgcaagcctactgtacgaccacgccgcactgtacctgcgcccctaccggcccccagctacaccgcctgcacttgccatgacctggaggcagactgacgcccaactactccccgacctacgaggccccctggaaggcgcaggccctggagcttcccactcaaaacatgtt

SEQ ID NO: 490040 - DNA, 131 bp, Homo sapiens
catagctggtccctatctgcttttagagcaatggtgagtgtacatgaagccaggctttccaatgtccccagaatgatagcaggaaccaggctgggcacagtgtgctcatgcctgtagttccatgcactttg

SEQ ID NO: 490041 - DNA, 200 bp, Homo sapiens
tgtagagatggggtttcactatgttgcccaggctggtctcaaactcctgacctcaactgatcttccctccttggcctcccaaagtgctgggattacaggcatgagccgctgcctctggcctataccaatgatttttaagtgcaattagttattatctccctgtttcacttatatttgtcttacccttctgtcgtcttctc

SEQ ID NO: 490042 - DNA, 871 bp, Homo sapiens
ggcgaggactaagcgtcgtaatagtgaactgtggccgaagccgccttggttaaccgcgcgagattgtgtggcaagtcttttgaaacagatggtcaccatgtggagatattagcagtcgcgtatgtgcatgtcatgcattgtgaagaatggtacagagggaaacaacaagtgaagaggataattgagtatgaataaaattgcattgccatcgaggagcaaaactttgtagatgatgccttctggtaaatagccaggagttatccgaaagcagagcagcgacagatagtcatcaatcaaaatccccagatagtcaagatcatgcatggacccagccacgcatgagacaaaagctctgccgtaaccagtatggacatttgttctgaactattcgtaaaatcgactcgctcttgtagcagctacagtgctccatcgcagagctaggtgaaccctcctgcttggccgacgttcaccacggtgctcagtagatcaggacatcaatgtgagtgccctgaaacgagctccaaatggacacgtatgcaattcaccccgaaaggccttttggctgagtgccgattaagcaaatggcagtgaagctagtcatacaagaagcggcacggtgcgaaaccacaggtacaacaagacaccaccacgaaccattgaaccccaggattattctctaagactacgatagccgcaccgtatggaaacaaaaggggcgttgggggcactcctgcaacattccactccttgaggaattcctcgtaggtgcactggacccgaagtaaacacaccacggccttggaccagccttgcgtttccccctcaaaaggtccccttccgtgggcctgggctacctcttcgcaactcgaaa

SEQ ID NO: 490043 - DNA, 263 bp, Homo sapiens
tgcgtgaacaccgtctctagtaaaatagaaaaatgagctgggcgtggcggcgggcacctataaccccagcgggctcaggaggctgaagcacaagaatcgcttgaacccaggaggcagaggttgcattgacgccgagattgtgccactgcactccagcttgggtgatatagcgagactcagtctcaaaaacaaaacaaaacaatcttcatatgtaccggtatcctttctcaatcctgatttcattataatgttacctttttccc

SEQ ID NO: 490044 - DNA, 629 bp, Homo sapiens
gcaaagaggaagagaggaaagattttctacaaaagcaacagccatgaagaacaaggaggaaaggtgtgggaagaacattctaggcataagaacagtataatcagaatgtaagtgtgaaatgtatttgggaacctcaagaaactaagtatggcttgagtataaagtgaaaatggtgcatgagtaggcagtggtagtatagagagtgccacagaaactcttggttgcctacccaacatacaccctcacttcttgttaaggaaggcactctcagtaggtctcacctcagtcccaggggatagttatgattaaaccagtcactttaactccatttttcttttccagtcattagtctgtgggtagccatatgacctagctctggccagtaaactggaagagaaagtctattggagaattctggaaagattgtctttcctagttaagagagtgtgtatgtgagttaatctctggaaagaaggctctttttttatttcctccatccattccttttacttccgtgctgtggtacactgtagagtgtgatgttcaaagcaatgacagtcaacttgtaatcatgactaaaaggtggtccactgagaatagcaaagagcgaagaaagggtctggatcctg

SEQ ID NO: 490045 - DNA, 343 bp, Homo sapiens
tacaaagattattctacgctaccaactcagtaatgtttttaagacagtacatttgcttggaactctggagaaatgtgttgcagagatagatgaatggcagattgaatttcatttatacactaattaccttgtgatctctgcacagttacctaacggtttgagtctggagttacatttcatgatgctatggcagatcctgagatggacttagtggtgatgcttttgtaatcttcttgtgtgtagtgtgtagagatctttataagatcaaagtactgattaactattaagtacaactttgagattttagcttttaactcttcagaagcgcgagtgtgaagataga

SEQ ID NO: 490046 - DNA, 729 bp, Homo sapiens
agcgggtggagctgccagagtaaagcaaagagaaaggtaagcaggcccgttggaacgtggttgtgactagacgcccagcgaagtgtggagcaagcctggggtcttgccctggctctctgtctcgcatcaccgatcgggaggaactagagagctcatggatcgatagcgtgcctgtatgtagatggcgaacccccagactggagcactaagagagtcaagatcctaatgcataaactcgcaatggttctagtgacatgtggttgcgtcttctgtcaagccagcgtgatacgctgtgtcatactgcgaggcatctaaagttgaagaacgacctgacgatgtataaatctgaaggaaagaaggatattctactatttcttatattggtcgttaatcgtcaaggactctcttctcgattaaaatacacatgatcttaagaataaggttacagagcatattcctggttatcaatcgagaagaatagcgaaatcagatgtcgtgggacgtcgttttatagatggagagcgaaagatgacttcactcatatatgatagatgtggccgtcttgtctatcatcttggttagccttttcccttcctaacttatccgcatatgtagaagaagccattaggattgtatactgtgaaaagaaatgtggacaactgctctactcacgactctcaacatgatgaagactagggtaaacgtgtatctatggctactgtgggatac

SEQ ID NO: 490047 - DNA, 404 bp, Homo sapiens
  misc_feature (342)..(342): n is a, c, g, or t
  misc_feature (404)..(404): n is a, c, g, or t
ggggtcaataaagggccccccaagttggtttttgggggaaagggccccctctttggggggtttgggggggtgggggttttccctttgaaaccccccaaaaaatttttgttttttccacaaaaccccattttttttaaaaaaaaaaggggggaaaaaaattttttcctttttccccccccccccaccctaataaaaaggtggggagagaagaaaaacccccctcccctgggggagcgctttttgttaaaaaaaaaaccccccccccccccccccaaaagtggttttcccccacaataaaaaaaaattttttttttgggggggggccctttttttttttatttnagaagaagagaagaaaaaaaaggttttattataaaaaacccccccgccgcgggggggggggn

SEQ ID NO: 490048 - DNA, 155 bp, Homo sapiens
  misc_feature (124)..(124): n is a, c, g, or t
ccaggaagatgccagacctatagctaacatgtatatccaatcatatcaatttatttttgtaaactaaaaaatgttgacagacaactttgtatcaacccactctatagcgcctctctttttgtcntttcctaatccaattagtaactagctgctaa

SEQ ID NO: 490049 - DNA, 325 bp, Homo sapiens
ctaggctcctgccatcaggtgcactggtggcttcatgcaggaacaccttgctggtatgcttgggctggaagctgtgtgcgagcctagcgcatgctgcccatgtccctgttggaagcccgccagttcagcgcctgactgctgtggtaggtctcccccacagcctggctggcactggcctgtatttttgccaaagctgctgtccgtggcgacagtagcaggtcacagtgttgagcaggtggaacatgtggttgagtggcagggtcagaggtggccccactgacgttgaggcttgctccataggtggccactggccctctcgcaatgg

SEQ ID NO: 490050 - DNA, 96 bp, Homo sapiens
gggtggtggactagtgggaaggaaagcattagtgagaagtacctaatgtagcataggggttgatggcgatctgtttgccccatttttaaaagaagg

SEQ ID NO: 490051 - DNA, 257 bp, Homo sapiens
ctgagcttctgtggcccacggtcctctgactgccaccctggaggccctggccctgtggaacggcgccgggcagcattgtcaccactagtgtggatctgacgtgtgtgcccattgtccggtaccttctcaggtgagccgtctcgtcctcaggctctggggccgccaggctcttcgtcctcctcccctcttcaaaagcacaggcctccacacacacacctgcacatactcatgcatgcacatgtacacacgcagtcacc

SEQ ID NO: 490052 - DNA, 225 bp, Homo sapiens
cacttctgcagaaatagtgacgcttccccgtcaatgacaaatgtcatttcttatttgtcacctattcatgtagctcatggttcctctatgtggatacttcattacgtgaaagatgttcttagttgtactacaatatattatgctcacatatgcatcttggtcttcattatattgctgttgtcatttaaaataattttttataattcaaaaacaactgtgctcgtg

SEQ ID NO: 490053 - DNA, 185 bp, Homo sapiens
gcgagttgactgcaggaggacagtggctgatagcgctggccaagctttctgagatcgatgtggccctggagggtgtcaaaggtgcaagaacttctttgaagccaaggtccaagccttgtcatcgggcagtaagtttgaagcagagttgaaagctgagcacgatataacggaaacgggaggaggag

SEQ ID NO: 490054 - DNA, 353 bp, Homo sapiens
gcatctctattgaaaaatgtcatccagggatgcagcacttcattatttcaacaaggagttcgtttaatctctttggtttttttcgtacaatggcaggaacttgcttgccccacaaccgacctgaagctgccgaggcctgctgagtaatcgtccagacttgcttcaaacttctcactaatcatactttgtacgtccaccagaacttgtcaacaaagagatatatgcttcatcttatctcatgatttccaccagaccttttaatcggaattgcccgagcctcaactaagtatacctatatcagccagtaaaagttcagttgaagagagggtagtgtgccgtgctgttaacctctc

SEQ ID NO: 490055 - DNA, 305 bp, Homo sapiens
ttccaaagacacctgatggatcccagcagagtccagtatggcaacacagcttccgtctggacaccccttgtcctgtccacaagccagggcatctgcaatgcaaatgccctttcctgtggcagcacagatgaatcagagaggcagcagtgtcttcatgcaaaagccagtcttgtaacttcagagaggatagtgcaggaaatgacatgcgcgtgaggaacagaggtttgctgaaacctcatgtaggccccagatgtggttagttgtgaaaaccgcatggaggggatcccagatggacctgtaggcgc

SEQ ID NO: 490056 - DNA, 210 bp, Homo sapiens
gctggggctttttggccgggccttttaggaccctttgctgaacctggtgtcccccctgggctgttaggtggatgtcaaggaggggggcctggggagggactccaaaaaacgcaggcttgtgtgagcctcctgcctcggccctgacaaacggggattttttacccccctttgccctgattaattttaagcaattgaaaaattgcccttcca

SEQ ID NO: 490057 - DNA, 782 bp, Homo sapiens
tggtctttggtttccattttttctggcttccaggaaaaaaaaaatcttgggcccataagggggggattttacttcatgaagtatccttacttaaaacttgcttgtgggccgcgcaggggggctcaggccggtaatcccagccactggggaggctggagacaggagaatcgctggaacctgcagggcagatgctgcagtgagccgagatggcaccacggcactccagccggggcaacaagagcgaaactccatctcaaaaaaaaaaaaaaaaaaaaaaaaacccggaaaaatatagtccttcctccgtgggacagcgcgctctcctagagagaacaagggggcgcaacccaataatgatagaggggagagggcgaccaggggggtctccccaaaaatagggaaccgccggagtactaccggtggcaaactacgggcgaagcttaaacagaaaacaccgcgcggagagcgcgcggcctattacccccaaagaaaggccaccaaagagacaaacctctgcggacaactcttacaacatggtgctcaaaaaagaagccctcccaaaaagacctctgtgggaggccccggagtgcacctgtggggaccccccggaaaaaggaggagccgtggggcaccaaacttcctcgtgctaacggcgcgttccaccaggcggcacaaacagacatgtggggcaccaacacctaacagcggggcacaaaccacagagtgtccaggacaacaagggacgacatcgagcgggggggaacacattacccccagttggg

SEQ ID NO: 490058 - DNA, 544 bp, Homo sapiens
  misc_feature (284)..(284): n is a, c, g, or t
  misc_feature (458)..(458): n is a, c, g, or t
  misc_feature (519)..(519): n is a, c, g, or t
  misc_feature (538)..(538): n is a, c, g, or t
ttcacttaggctttttaaattggctttgacagaactctgttccatgaagaatctcagataagactgttagtcgagcccagccatgggtttgtaccctcaaatacttacgagttgggcaaattcctctcctcttgaggtcccaagataacttggggttcctggcctgttagaaagtgacattcttagccaggcgcagtggctcacacctgtaaactcagcctcccgagtatctaggattacaggcacatgccaccactccctggctaatattgtatttttagtanagacagggtttctccatgttggtcaggctggtctcaaactcctgacctcaggtgatccatctgctttggcctcccaaagtgctgggattacaggcgtgagctactgtgcctgccaattcttttatcactgttgggataaggacaggctactcaagtcagatttaaccattgcanaattcttaactttggccttgagaatggtgcacaatcaccattagccttattttctggctgnactttttgggctttggtgnatcctt

SEQ ID NO: 490059 - DNA, 341 bp, Homo sapiens
  misc_feature (12)..(12): n is a, c, g, or t
  misc_feature (27)..(27): n is a, c, g, or t
  misc_feature (286)..(286): n is a, c, g, or t
  misc_feature (289)..(289): n is a, c, g, or t
  misc_feature (322)..(322): n is a, c, g, or t
  misc_feature (334)..(334): n is a, c, g, or t
cgttgactattnaccaccactcccttncacaaccccttggcggcacactccagccacatcgcggcccgagcgttccttaacgatcgcggccaggggagcgcgaaccatcgttccacgtgcgtcagagcccttccacttccatgcgcgtaaatggccccacacatagtccgggggcgtacgcgtccgggtcacacacggtccgttaagtcgcgggggccccaaacgtggaaaggtcgaaacggcgtgtcggggaaaccgatgttaggcagcacgtgcgcgcgcaatncgngtcccaaattttggcccatagtccattttcggncatccgtcaccngtcatcc

SEQ ID NO: 490060 - DNA, 751 bp, Homo sapiens
tgatactccatcttacaaaagaatcaccaatacaagtgaattagaatacctctcatgttccaactgttatgttaattactgtcatgtatgataatgcgtggaatggtaacggggtcagtagtaactcatcgaagctttagtggccagtttaaggattttatatcctattagtctgttgggaatggtacctcttacgaacatgcaccacttattttgaaagaggcaagtcagtacatctagtgaatactcaagacgggcgaacaacattctgttaaccattttatcattatgagcttggacggttatatgtgaaatacagaaaagatctcaggtctgtctgattcatcggaacttctagatcaaacacatctcttccatgtctgcagtaattcacaagttactggaaaggaaccatgtaagagggttctgatatctaaaacctacccagttattctgtaggatcttgattttatttaaatgcacagactgctgaccccatgatcctgtgtgtacttcagagatactactttacctggatgattgtattaacatgaagcctttctgatccagtaacggtccacgtttcgtccgcgtcctcaaagtaccttcgggtaatatggtgggtaacatcgaggaaatgataagctaattatttacgtggagattcttctatattgcccaggtaatctacattcctattaaagatccacacctaacagcaaaaagtaagtaacaagcactaccgactcca

SEQ ID NO: 490061 - DNA, 628 bp, Homo sapiens
  misc_feature (1)..(1): n is a, c, g, or t
  misc_feature (61)..(61): n is a, c, g, or t
  misc_feature (95)..(100): n is a, c, g, or t
  misc_feature (185)..(185): n is a, c, g, or t
  misc_feature (187)..(187): n is a, c, g, or t
  misc_feature (223)..(223): n is a, c, g, or t
  misc_feature (230)..(230): n is a, c, g, or t
  misc_feature (272)..(272): n is a, c, g, or t
  misc_feature (289)..(289): n is a, c, g, or t
  misc_feature (297)..(297): n is a, c, g, or t
  misc_feature (309)..(309): n is a, c, g, or t
  misc_feature (314)..(314): n is a, c, g, or t
  misc_feature (316)..(316): n is a, c, g, or t
  misc_feature (321)..(322): n is a, c, g, or t
  misc_feature (348)..(348): n is a, c, g, or t
  misc_feature (353)..(353): n is a, c, g, or t
  misc_feature (402)..(402): n is a, c, g, or t
  misc_feature (413)..(413): n is a, c, g, or t
  misc_feature (444)..(444): n is a, c, g, or t
  misc_feature (449)..(449): n is a, c, g, or t
  misc_feature (456)..(456): n is a, c, g, or t
  misc_feature (509)..(509): n is a, c, g, or t
  misc_feature (530)..(530): n is a, c, g, or t
  misc_feature (542)..(542): n is a, c, g, or t
  misc_feature (545)..(545): n is a, c, g, or t
  misc_feature (622)..(622): n is a, c, g, or t
nggaggatgagcagtccctgtcctcagggatccagcgctggacgtagttggggccgttgtnccgaggccacacgatcacagtgtctctggatgcnnnnnnggggtcctctgggaagaagttgaatggccggagcaggaagcccacggagttcccaggtgtggctgtgttgggaatgtcctctgantnggggatgtgcaggaagcccaccgtcacccaggccancaggtcntcattttcaatgttctcgttgttgtgaagaaactgctaaaanccaacgggagggtcccnggggtcgntctggtggtagntgctnangctgnncagatctgactccaggtaattgatcnatgcnagggggtcccttgccccagtgcatggcaatgctccatcaatgaccagcnatgggggccanacacacatggtcggcccatggagtggatatnacaancggtagntgcgctatagtggaccccaggggttcttctagggggatggtaaagcgcaggtncttgggccaattccttttgangaggaaggccgnctngcgctccccggacgtcctgcgtctgatccagagttggctggaaaaagcggtgtctcgggctcccggggttggtgctnttttct

SEQ ID NO: 490062 - DNA, 159 bp, Homo sapiens
atcgagctccggtaccgaattcgacagttgttgcagtggcacgacagcttgagtcacaagaatggttacctcaacttggccggcctttctttggtttctctgaaccccttgccgcacctaatatgatggactttgctccaaaatagactgtagtgatgt

SEQ ID NO: 490063 - DNA, 102 bp, Homo sapiens
cgggagcgaacgtatgtccgatacagtcgtggagtatggtgagcgttccgcgctatccaatgcccttcctctaggcatgaagggagatccttctagtatgtt

SEQ ID NO: 490064 - DNA, 493 bp, Homo sapiens
ctctaagaggatatacttttaaaaccagtggcagcttgggagggagtggggattagctgagaaggggagaaggcagcatttttgaggtgacgtaaatgtttttgtatcttgattatggtggctgttatgggggtgcacatccaagtgtcaagactcatcgaactgtacacttttgttctaggtacattagacctcaataaagtagattttaaacctaaataagccaggtaacagctttgcctgggtggctgggggagaggcttgggacactttacattgatctccctcttaggcatgttcgttttggtttggttatggtccgattgtgtagtatttaatcaaaaatatatcattagcagagtcggtgatgtgcacgcctaaccggtgttaagagaaccagcggaatcgggaacaagagaccctggtgcatcctggtatagggataagaataagcgctcgctgtccaagttcataaaagagtttggcaacacga

SEQ ID NO: 490065 - DNA, 943 bp, Homo sapiens
agcaaggcctgcgagtgaggcgcagtatggacggcgtcgtgctgtcatgatgtaggagctcctgtacctagactaccatgcccggcgcagggtagaacaacgagcttatggaccgggtgcgggggctagcatagtgcgagaaagcctacctgctggcccgggagcgttcgccggcccatgctggatggctattcgccgtgtgactgtaataacggagcgacttccgcaccggcctcccgacgtttatgatgcaggcgatccgtcgtatacatgcactattcttcgaggctagattctcgaaagacatccctgaaggtggcatttcgttaattgacagacttgtcctacgaccggctagtggcgtgacgcaagttcagtaaggtcccctaacattctggagcagggagaagccaccgtaccttgggctcagtaatctagagaacgactatcagtatgtgacgcagtttagtaagacagggtcatttcgcacggtcgctaggagatagagaaaacaactgctcacggggccagaggattcacccccggagtgatctacgaggagaagcggcgaatgcacgacgcacgggggccactggcagaccagaacgcgccaggggtaacacacggtaccataaccacacgcaccagggctccaacttaagattgcgcacaaagcgtagactgagaactaatatgacagcacatacgacacaggaggcacaggccatatgacgtcgaggcggtcccagtcgatcgacatcagacccagaaatctatccattaaatgcccaatataggacaccagtaggaacccaagactaaaagcaccggggtcaaacgatgtaccacatgagaacccagtggttaaaccaacaggtatggaaatggagaaccatacccacaagcaaagatcacacgcccgcgactggcacaacacggagcg

SEQ ID NO: 490066 - DNA, 164 bp, Homo sapiens
gatccatggggtcgcatctatgggaggcacaggcatggagtgtgtcatgaccatcatactgtatcagtccagtgtgtacctgtcatagataagtgtctcccaggcaggccatggtaggggcctcgcaaggggccattggggagcacagggtcaggcttctcggg

SEQ ID NO: 490067 - DNA, 365 bp, Homo sapiens
  misc_feature (123)..(123): n is a, c, g, or t
ccccaaggaaaaaaaaaaatgggttttggaattaaattccaaatgttaccctgccccctatattttgcccatattccggtatagtgaaaggaagccctcctcggaaaaggtcccgggggctgnttttagtgataattgttcttgaaaaaaagccaggcctgccccccttcccccccctagggggtattatgtgttcccaggcaaagtgcccccccaaaaatttttttttttttttggcccatttattcggggcccttttatttttggaaaactggggcaaaaacattattctgggtatgtttttccaaaaattagggggcctattttttttaaaaggctattaaataaaaattacctatccgtta

SEQ ID NO: 490068 - DNA, 280 bp, Homo sapiens
  misc_feature (147)..(148): n is a, c, g, or t
ggggggggggggggggcccccccccctttttggggggggaagaaccaactgttttaaaggggcaggggggcttccccccccctggtgaaaaaggggaccggggttttgggtttcccttggggccccccccggggtttcctggggggnngcccttgtccccccaggggggggggcccttccataaaacaaaaaccccgggctttttggggggggttttttttttaggggccccgggtcccgggggtttagggggggggggggataaatttttttttggcca

SEQ ID NO: 490069 - DNA, 281 bp, Homo sapiens
  misc_feature (4)..(4): n is a, c, g, or t
  misc_feature (10)..(10): n is a, c, g, or t
  misc_feature (12)..(12): n is a, c, g, or t
  misc_feature (18)..(18): n is a, c, g, or t
  misc_feature (20)..(20): n is a, c, g, or t
  misc_feature (26)..(26): n is a, c, g, or t
  misc_feature (28)..(28): n is a, c, g, or t
  misc_feature (39)..(39): n is a, c, g, or t
  misc_feature (72)..(73): n is a, c, g, or t
  misc_feature (76)..(78): n is a, c, g, or t
  misc_feature (81)..(81): n is a, c, g, or t
  misc_feature (86)..(88): n is a, c, g, or t
  misc_feature (99)..(99): n is a, c, g, or t
  misc_feature (104)..(104): n is a, c, g, or t
cgcntaaaantncaccangnccgatnancactggaaccntcaaccctaacagccatcgctggcccccaccanncannnctntgatnnncccaggatccnacccnacttctgaaccccaggaccttcattatccaccccatcccagactcccaccccaggattgcccgtgagctttgcctagcaaattgtgtggttatgtgagtgttgttttaatcagagatgtacatgattgccaactgcatttcttaccatgtgaccacactgttacgatgcaatctacc

SEQ ID NO: 490070 - DNA, 815 bp, Homo sapiens
  misc_feature (28)..(28): n is a, c, g, or t
  misc_feature (70)..(71): n is a, c, g, or t
  misc_feature (100)..(100): n is a, c, g, or t
  misc_feature (102)..(102): n is a, c, g, or t
  misc_feature (104)..(104): n is a, c, g, or t
  misc_feature (130)..(130): n is a, c, g, or t
  misc_feature (134)..(134): n is a, c, g, or t
  misc_feature (138)..(138): n is a, c, g, or t
  misc_feature (144)..(144): n is a, c, g, or t
  misc_feature (151)..(151): n is a, c, g, or t
  misc_feature (162)..(162): n is a, c, g, or t
  misc_feature (174)..(174): n is a, c, g, or t
  misc_feature (179)..(180): n is a, c, g, or t
  misc_feature (206)..(206): n is a, c, g, or t
  misc_feature (215)..(215): n is a, c, g, or t
  misc_feature (221)..(221): n is a, c, g, or t
  misc_feature (223)..(225): n is a, c, g, or t
  misc_feature (232)..(232): n is a, c, g, or t
  misc_feature (246)..(246): n is a, c, g, or t
  misc_feature (253)..(253): n is a, c, g, or t
  misc_feature (264)..(264): n is a, c, g, or t
  misc_feature (273)..(273): n is a, c, g, or t
  misc_feature (323)..(323): n is a, c, g, or t
  misc_feature (349)..(349): n is a, c, g, or t
  misc_feature (359)..(359): n is a, c, g, or t
  misc_feature (471)..(471): n is a, c, g, or t
  misc_feature (578)..(578): n is a, c, g, or t
  misc_feature (792)..(792): n is a, c, g, or t
acacaggataaaaggttatatatatgtncagaggcagagtttggggctctaggttgggttctagggtgtnntcaaacaggctgaggaggttccgaggatnanangaggggaaggagccccgaggaggctntganttgntgttanttaggtncagggcatccntgggtgtgctcntgctnnggggggtggaggtgctccccacagtncgggccagntcagcntnnngggaganttaaggccctaggntgttgtnatcccagttgntggagaggntgctgttcaggagcaaactgcagggtggtgagccaggtggggtggctggngggcccaggggctgttgccagctggnagggtgagcnagcccatgccagatccagcggagcagggcaagcagggcctgccacagggcccaccctcggctcagggcctccgctgccatgcaccacagcacaccccaggcccgcggctgcntcaacacaggcagtgccagcagggcctcggccgtggcccgcagcttggggtctggctccagcatcatgacaaggacagaacgcagctcggaagacagaccggcagtnaactcagggggcaggtagccctggcgcactgtctgccagccctccccaccgtggggcagctccatgttgcatgccacttccaggatggtgaggcccagactgaacacatccgctgctgtcccataggagccctgcagcagctcgggggccatgtagcgggggtctccctcctggacctcaccagctcctgctgttcccagctccaccagcagtncgaagtcacccagcttgcagcgg

SEQ ID NO: 490071 - DNA, 366 bp, Homo sapiens
aagtctagcaagcaggccaaagatgtctcccgcatgcgctcagtcctcatctccctcaagcaggccccgctggtgcactgaagagccaccctgtggaaacactacatctgcaatatcttaatcctaatcagtgaagctcttcacagtccttggattaaataaggtgagatcctttgggccaaacccttttgccttaagaagtggtcaatggttgggaatgccaggttccctccctccaccggtgtcctccttgcaattcaggaaagaaggaagagacgaaggaggaggggaggaaagcttcccaagagtagcctcaacctgtgcttctgtgcattattctgagaataaatttctgtttcaaactgt

SEQ ID NO: 490072 - DNA, 209 bp, Homo sapiens
cagtgctaggtaagcgagctggggatttgtgaatcggggggcaccgggaggcgggaacatgcagactggcattaggctgtggatagcttggtgccaattgggtcgtggtcaaggccgtgaactgattattggtgaccgacagactgggaaactcaatgctatgacacaatcattaaccagaaacgttcaatgatggatctgatgaaaga

SEQ ID NO: 490073 - DNA, 398 bp, Homo sapiens
  misc_feature (387)..(387): n is a, c, g, or t
taaataaagtcctaaaggtagcattaaaatgacttaactggaggcaggaggatcactgaagcccaggagtttgaagctgcagtaagctaagaaggtgccactgcctgcagcctggatgacagagtgaaactttgtctcttaatagaactatggactgaagttgtgatattgagtgttatatttctcaataaaggttttttcttttaatactgtattaggtcaaattcaaggtcttaattccttgaattccaatttccttgtgaaatttcatgtgattaatttaaaattccagggatcctatctaacatcacagttgatggatataacaatgtattttgagaaatcagttttggtgaacagtacagcattactgataataggcacaancactactgctg

SEQ ID NO: 490074 - DNA, 360 bp, Homo sapiens
cgagcggccgcccgggtaggtacgcgggcgaatgtaatggaacggaatgcaatggaagggaatcatccggaatggaatggaatggaatggaatcaacccgagtgcaatgcaatggagtggaatggaatggaatggaatggaacagcacgaatggaatggaatgtaatggagagtaagggagttgaatagaatcaacccgaatgtaatggaatggaatggaacggaatggaatggaatggaatgcaatggaatggaatcaacccgagtgcaggggaatggaatggaacggaatggaatggaatggaatcatccggaatggaatggaatggaatggaatgcaaagcaatggaatcaactcga

SEQ ID NO: 490075 - DNA, 537 bp, Homo sapiens
  misc_feature (491)..(491): n is a, c, g, or t
  misc_feature (511)..(511): n is a, c, g, or t
  misc_feature (520)..(520): n is a, c, g, or t
ggaaaaaagggggaaaaaaaaaaggggggaaaaaaaaaactttttttttcgcgccaagagagagggggccccccaaaaaaaaagggggcccccccttcccccccccctttaaaacccccgccgaatattccccccccccccaggggggggggggccccccccccccatttttttttttttttttttttgaggggggaaaaccttttttgggggggaaaatgggggggggcccccggccggccccttgttttttctcccaaaaagggcaggggggccccccccccccttaaagaggggcgggggagaggggccccaagtccccccccgggggaaaaaaaccccgggaactcttcccaaaaaaaaaaacccccttggggggttccagggggaggccaaacccgaccaaccggaagcccaaaggtggggccccaaagtcccccctcctgggaaccaggcaagccaacccttggttttgccaagaggggcgggtnccatgctgagagtagatcgnccagcatgntggtcactgccctgcac

SEQ ID NO: 490076 - DNA, 145 bp, Homo sapiens
  misc_feature (17)..(17): n is a, c, g, or t
  misc_feature (135)..(135): n is a, c, g, or t
atatctagctgcagagnggagatggaggaggcttgcttgtatcccactacttttacttgtggccctccgacgggggctcttctgggttggggtgggaaaatcagtggttagagaaaaagacacagagtctcctgnttgtgcggtg

SEQ ID NO: 490077 - DNA, 198 bp, Homo sapiens
acctgctacaatcactcacacaccctcgtaaatactgctgcccagctgtcaaagcggcaaaccccgagcacacagtgggacgcaccataaaaatgagtctcaccttgtgctttcagatccatttaagcatttcagtgtacaatagtccttacatttcacctttatagtaagatcctgttgcagtgcagcacatatgca

SEQ ID NO: 490078 - DNA, 246 bp, Homo sapiens
tctagagtatcccagaaatgcccagattactgcaccatcagcaactgatagagaggcatggaacagtttctccctcatgtcctccagaactacccaacccagatttcaggttccagtcttcatcactgtgagcgaataaatttctgtatcattaagccaccaagtttgtggtgctttgttatggaagattcaggaaactaacacattacacataaattattttgaaaaatgaggtagtattatgaa

SEQ ID NO: 490079 - DNA, 668 bp, Homo sapiens
cacggtggctcacgcctgtaatacccagcactttgggaggcctaggtgggtggatcgcctgagctcgggagttcgagaccaccctggtcaacatagatgaaacccgtactctactacaaacatgcaaacaaatttagccgggcgtgtaggcacgtgcctgaagggaggcagaatcgctacgaacctgggaggtggaggttgcggtacgctgacatcgccacactgaactaccagcctgggcgacggagcgagactccagtctcaaaaaaacaagacaacaacaatggcagagaccacaccatacaccatatgaaacagcccggggcccgcacggacacaacaccagcggcaacccagagccacaaagaaacaagcagagcgcaagcggggaaatcactatgaagtgctcagagtaaatacttaacataaacctctctgtgtgcgcaccaccacaaaatggggaagaaaacacgccccaccaaggaaccaacaaaaacgcacccacgactataacgaaacaacaacacccaagcccatggcgcagagcaagcacgtcgacgcacggcacgcgggcccgctgtcaccacacccccccacagagacataccacaccgacacaaagcgactcaaacgcaccggcgcgagacaacacaccgtagggacagaca

SEQ ID NO: 490080 - DNA, 421 bp, Homo sapiens
  misc_feature (38)..(38): n is a, c, g, or t
  misc_feature (63)..(63): n is a, c, g, or t
  misc_feature (78)..(78): n is a, c, g, or t
  misc_feature (80)..(80): n is a, c, g, or t
  misc_feature (98)..(98): n is a, c, g, or t
  misc_feature (154)..(154): n is a, c, g, or t
  misc_feature (167)..(167): n is a, c, g, or t
  misc_feature (174)..(174): n is a, c, g, or t
  misc_feature (183)..(183): n is a, c, g, or t
  misc_feature (185)..(186): n is a, c, g, or t
  misc_feature (191)..(191): n is a, c, g, or t
  misc_feature (205)..(205): n is a, c, g, or t
  misc_feature (213)..(213): n is a, c, g, or t
  misc_feature (238)..(238): n is a, c, g, or t
  misc_feature (261)..(261): n is a, c, g, or t
  misc_feature (274)..(275): n is a, c, g, or t
  misc_feature (302)..(302): n is a, c, g, or t
  misc_feature (333)..(333): n is a, c, g, or t
  misc_feature (338)..(338): n is a, c, g, or t
  misc_feature (341)..(341): n is a, c, g, or t
  misc_feature (344)..(345): n is a, c, g, or t
  misc_feature (420)..(420): n is a, c, g, or t
acattagcattctataatttcaaatgcaaagccaaacngggaaaacaagtgagggcaaatatngtcagaaaatctgantntcaggccaactatttaangttagaacaatttaaaaaaaaaagtcacaaacacttgaacgcgagaccgaacaacnctcggtcggaaanaatcgtngacatttangnncgagnaagcgaaaagaganagacaggnaataatggtaaagactcgacaactncagaatcaaagccaaaacaaaanaactaaaaaaganngggaaaaaagagaaaaaagcactaganaacggtaaactgatattcgaaacaactcaanaaagnatnatnngaaaagcaaacgaaccagcaatgcgtggctaatttaggaagaaacaaatatacccgcctccaattagagaaagant

SEQ ID NO: 490081 - DNA, 108 bp, Homo sapiens
  misc_feature (8)..(8): n is a, c, g, or t
  misc_feature (13)..(13): n is a, c, g, or t
  misc_feature (95)..(95): n is a, c, g, or t
catctttnaaacnttgtttatacaccctgtaaaaaactttacacacacacacacacacagagagagagagagagagagagagagagagagagaancagacctaagatc

SEQ ID NO: 490082 - DNA, 194 bp, Homo sapiens
taccagctacctccctcagcagatgcccatgaagatatgaaattatagacagagcccgtgagaaggaaagatgaaggaaaatcggtgcgctgcattcatggcccccagaatcctaggcctacccgccgcaggactgatcattctattgccccctctattgatccccacctccaaatatctcagcacaaccgggg

SEQ ID NO: 490083 - DNA, 1053 bp, Homo sapiens
gagtgcggaaggaggaaggacagccgcgatgtctgacagtgcgtgcttcaggaattgtctggatcctaggctcatctcctacacgaggagaaccgactacagggcaggcagagatccaatggaggtcgccctctcgagcacactgtccctgcgacagagctcatcatatggaaggggctcctggtcacagggtatcacttataacatgttcttgggaaccgtgacacccgaccattgcctcgagttcacgatgtgagagacccgagccacctagaatgtttccgaggggaaggatgtgcttctacttgtgcacaaagtttgcgcccctagaactcttaagctagtgctgagcaattcattgggtagcaaagagggcaaataatcagggactcttccttacctatttgtcatttacgtcaatgatgttagataggacctggtccaagctcatatttatgaagtatggtgagtcctggccgtaattaggtggttgcagaaaggacaatcgaggcgatattaccaattgtccagtcccgcttggtttgtatcccacgaaaattgttcaacccgagtgaacggaagctgcagtgtattccttaacaaacaccttttagcacagtttcaacttaataatgaccggaagtggtggataatgggacctaagtatgcggaaaagttgatcgagggtactaatctatctaccgttaaaaatccctatttggttatccatggaaggatcttcgccgaaaggaccctcgtcctttcttgccagacatgcaatactttaaatatcccaggggacgggccgaatgggcaacctctgttgactctttggaaagccctgatgattcccctgaagtatctaccgaggaaagggaatgccttacccatggtggggtgggcatgaacatgcgtcatgagatgcctttcaccgttagttgatttcaactagtggtttcgaggcattgttcccggaaagaggcccaaaagagagaatcccatccatttcccttattttggggcatgtccaacaccaaaggtaattacttggaa

SEQ ID NO: 490084 - DNA, 171 bp, Homo sapiens
gatagtgtgaggaaggttatggtcgatatgtagggggctccaataggtgcatgagtaggtggctgagtaatgtagcggttaggcgtacggccaggctatggttgaatgagtaggctgatggtttcgataataactagtatggggataaggggtgtaggtgtgccttgtggt

SEQ ID NO: 490085 - DNA, 217 bp, Homo sapiens
aacgcagccatggctcgtggtccaagaagcatctcaagcgggtgcagctccaagcattggatgctggataaatgaccgctgtgtttgctctcgtccatccacggtccccacaggtgagagagtgtctcccctcatcattttctgaggacagactgagtatgccctgacagagatgagtaagagattgcatgcgcggttcataaaatgatggcaggtc

SEQ ID NO: 490086 - DNA, 115 bp, Homo sapiens
taggagctgtagcttacaggcgcaccaccacatctggactaatttttgtcttagtattattattagaagatggggttttgccatgttggctagagcgtggtctcagaatctccca

SEQ ID NO: 490087 - DNA, 230 bp, Homo sapiens
gccaaaataattgttcagtggcaataggcagcacatagtcagagataaccagatatacagtagtctcccgctatccttggttttactttctcaaggttcaggtaccttcagttgactgtggtcttaaaggataaatgtaaaattttccaaaataaacattcataagtgtttaattgtgttgccattctgagttgggggatatttcaccatcttgctccattccagcaggg

SEQ ID NO: 490088 - DNA, 293 bp, Homo sapiens
tcccggtcgacgggattagctaaatgcattacaattgtgaacatatctattaaatatactaaaatatagcttacaaaacactgcgaatgtttaaaatatattctggtgcagaatttttagtgtacaaacgacgtctatggaaacctgcaggttcagtcatttcatacaacctttttattgaggggagttacacgataccttagtgaggaaacccgagggccatactacaagacgaaaaagtgccccgttcctggcaatgatttcagaagaccaagaggcgatagttaccagct

SEQ ID NO: 490089 - DNA, 310 bp, Homo sapiens
ctttgacttgcaggagcacaccagggaccagggggttgagtggaacagtaaagccacacattctgtgactatataacctatctaggctaaatgtgtggactcgtacgagctttgcattgacatggcaagctgatggcgtgggtggtgggggtatcaggccgggagctttggaggaagggagcgttagaggagctgccttggaggtcagggagtcctttggactggttgtttcttggcctgagcgaatgtcggggtcccaaggaggttgtgtgtatgtcttatcacaggacaagacccacatgtgtgacct

SEQ ID NO: 490090 - DNA, 160 bp, Homo sapiens
agaacagttgaaggtctgaggtgttgagaggcaaatggggtctctgggtggatcctggtcctgtcagcaggcctggacttgttcaggatggactggtggcgttataaagggcagatcagggtgcctgtcccttggcatgtcccttaagatttccttttcc

SEQ ID NO: 490091 - DNA, 148 bp, Homo sapiens
gtcttgtgatgtaattattatacgaatgggggcttcaatcgggagtactactcgattgtcaacgtcaaggagtcgcaggacgatgggcatgaaactgtggtttgctccacaaatttcagagcattgaccgtagtatacccccggtcgt

SEQ ID NO: 490092 - DNA, 131 bp, Homo sapiens
gctttattaaggactcactaaaccaaattcttgaggagagtgactctaggcagatctccaactcttgtgcttgcactctggtagtctttaactgttaattgacatatcctaaaagcataatctccgattcc

SEQ ID NO: 490093 - DNA, 253 bp, Homo sapiens
ccgcccgattaactctgtcctggggggggtgcggaaggatagaacaacgtgagcagttagtgcacaggtatcggaaggttgagcacattaatactgctgccttagcacgggttattggtgtataggtgcactggggattcccctgtaccctcagaggaacggatcatgtctactttaaagtagaattttacacgtttcatatcttagaaaaacaatcctattgagagcatatggacaggggctaatccacgga

SEQ ID NO: 490094 - DNA, 179 bp, Homo sapiens
ccccccctaacaggtgcctctcagctcctaatgactccggctacgcatgtgattcacttccactccattcacgctcctcatactatgcctacttaaccgtagctacactaaccatactccatttatggcgcgatgtaacatgagaaagcacataccatggccagcagacaccatctgtc

SEQ ID NO: 490095 - DNA, 344 bp, Homo sapiens
gagagagactctgtctcaaaaataagataaactgaatttaaaaaataggctgggctggccgggcgtggtggctcacgcctgtaatctcagcactttgggaggccgaggcgggtggatcacgaggtcaggagatcgagaccatcttggctaacacggtgaaaccccatctctcctaaaaatacaaaaaattagccaggcgtggtggcgggcgcctgtagtcccagctactcaggaggctgaggcaggagaatggcgtgaacccgggaggcagagtttgcagtgagccgagatcgtgccactgcactccagcctgggcgacagagcgagactctgtctcagaaaaa

SEQ ID NO: 490096 - DNA, 114 bp, Homo sapiens
agttagataatgtgcttgtctactttagcccaccaagtattgtgattcccaggggtaacaagagaggagacacatacttcgtccttaacgagcgtgcatggtcattgtagatcc

SEQ ID NO: 490097 - DNA, 472 bp, Homo sapiens
ttaaaattggctggacttgctatgcctggatccattgccacaaaaaacagggcactttacctgatgtgatgacactgactggattttgctcatacctacaacagcctaaaaaccgtaggaagagtcatctaattgacactactttgctttaatcaatgggtgccctttttgctgactgagtgtatgacagtcctgaacaagaagggttctctgataacgctgtagtaacatttcatgacatatggatcatgcgattcttatgagacagatttttacagtacctctaaagcattagggacaactgtctgaaagcatcctgtaactattcttaggcccaattgctgcagcccgatgtacccactcctgttagagcataccacaccgcatatgaggtacattatcttgctacttgtagagaggtataataaccatgcttggcgagatcatggtgcatgctgagtcctagagcgag

SEQ ID NO: 490098 - DNA, 815 bp, Homo sapiens
cgtcccaacaattatatgactaccactgacatgactttccaaaaaacacataatttgaagtcaagcacaagccacccacagccataattattagcatcagtcccccgtacatatcttttgtacaccaacatcaacaagcaagcctagtttaggcgtgttccccaagccttttcctccgaccccgctaaacaaccccgcctcctaaatagctaagctagctagaatcctacccctcacaatcatggcaagccaacgccacttatccagtgaaccactatcacgaaaaaaactctacctctctatactaatctccctacaaatctccttaattataacattcacagccacagaactaatctccttcactatcttgcttcgaaagcacacttatgcccagctgggctatcatcagccgatgaggcaacaggcagaagcctgaacgccggcacatacttgctatgactacagcgctagtaggcttccctttccctaatcatcgcactagttgccacgcaggaagaccctagggctcactaagcattctataactgaatcgtcaatggcccaggaactatcaaaatctggaccaacaactgatctgactagcctgcacaagaagttccacagccaagataaccacttacaggaatccagcgatgaacgccccaaagaccaaggtggaaagccgcatcggctggatcacgcaggaagcgggcggaaggaagacatatagacagcaggaggaaaacggacaacaagcggcgagaaaacaagacctgagaccccaggacgaaaggaagaggaacaccggcacg

SEQ ID NO: 490099 - DNA, 303 bp, Homo sapiens
cccacgcagctgggataacaggtgccctgccaccatgcccagctaattcttgcattttcagtagagatggggttcaaccatgtgggccatgctcgtctccaactcctgacctcaggtaatccgtctgccttgcgctcccaaagtgctgcgatcacagactttaaccaccatgcatggatggaatacttactcttgtcgggagattgacaccactaaaatgtcagagcagaattcattatgctgtggtcaccaggagtgtctggtctgaacaccaaatacaattcagacttctctttggggtat

SEQ ID NO: 490100 - DNA, 165 bp, Homo sapiens
gctcggtaccatattggctgtgagctacaacgtagtactgtgtcgtgtatgtacgatgtctagtgatgagtttggtaaatacaatgccagtcgagtgccacctagcggtgaacagagagatgaactcctagggctcagagcacgtgagcagatcatttcatattg

SEQ ID NO: 490101 - DNA, 222 bp, Homo sapiens
ttgcagatcacggtagccctccggacactctgctctggggctcccattagctgtgtacgacgcaccaccaaggacttggcggcggccacgctagccgccaccttgagcccacaggccgcctcccagacagacactagctcacctttgcgcagtatggcagctcatcgaggacacaaggagtcctcttctgactccagatggactcgtagccttgcacaacgc

SEQ ID NO: 490102 - DNA, 308 bp, Homo sapiens
atgggtaacaacgtgaaacatgaaaaaatactccactctgcaatcaaaaccacaatgagataccatcttgcaccagtcataaagaatatcattaaaaagtcaaaaaattacagatgtggcaaggctgcggagaaaaggaaacacttaagacagtgctggtgggaatgtaaattagttaagctgctgtggaaagcagtttggagatttctcaaagaactaaaaatggaactaccattcaaccaagcaatcccagtactgggtacatacccaagagaaaacaaataattctaccaaaagacacatgctct

SEQ ID NO: 490103 - DNA, 644 bp, Homo sapiens
gttcttttgtgcctatggtacatgtgtaggacatgccactagcatgtgtggtaggtgtcctcgtattttgtttggggaaaaaatagctatccacaatgaggaagagaatttcccctcatgttatagccctaggtttctgtgctcttttctttgagtttcttctggagtagatagttaaatttgataccttcaatggtaaatgaaaattatgatggaggctgtgttaataaattccgctaatgtcacgaggcccagtgcggtatgcctttgtcccttcatgccctttcaaattctgaggtgggaaggagaaagccaacatcctaaacacgtgcttcagcccaattccatatgtaatgccacttgggagaagtattgactataaatatcattcgtcacgggaaatatagttgtaataattttacaggatattcctaggtaaatgaaggagccttcagttgtaaatttccagttacccccaaatgtatttgctacaccttttgttgtttgaagtattacctcttaaccttctttggtaatttttttcatatttgtcttatatagtcccggtttcccagataaggtcagtcctttttcaaatgtcccccttttacccatactttttcattaaattatggaaactgcca

SEQ ID NO: 490104 - DNA, 931 bp, Homo sapiens
ccagtgtctcgcctgctgaaaacataactaaatatgggcaaatgatatccgtaaagatgtccgagaagagtcgaaatgtcatcatatgcttttgttttgatggcggtcttgtcgtgggagagaacataagaagaaccacccagatgtcgtctctgtcctaccgttctcctagtttgctcatgtaatgtgccctatatgagagtagcgtaagagccagtgattctgcttatacgtaggattaggcaagcgtttgtaatgattctgctcctaagatgtcggacaagagactcgctgtgtactcgaacacgagataattgcaatcaccacatataatacgcacttccgctaaagggatagaactaaagtacgtacagcttcaccaggtattctcgccacttgtcatcccaccaataaggacttcacttgcgtggcaccttcacttgccgtctttgctgccctctgaagttaatcgctgccatacaaaatctactatgcggatgaatcagtttcctgcgtctcatgttccatgtgggatgccatgattggcagtatgatatccttggagaaaagcagtggtgtatttaagtcttggttgaagtagtgactaaggcagatcttatgtacaatagattcgggctggatagcgctaagtaggggattgcttttactgatcagagggttagtttgactgggcatatttggtagctgataagggaatagttcctgcattgccttggaaaatataaggggaaggtaagctcagtggattgaaaaaaaatagttttagaaataagagaattgaaagaagggaggacacgattgaaggggaaagcatgaaagaatgtagtgacggtgagggagtgaccggaaattaagtaggtagatgatcgccggaattcatgtataaagaattgtctgctgcaataattca

SEQ ID NO: 490105 - DNA, 225 bp, Homo sapiens
atttacaaagtcgctctgcgtttcagctctgattcaatcagtttttcaagcatctgcgcctgggtaataccttcctcatctgccagttcactcagcctgtcttttaaccgggcctggataaccgcatgaaaagccttatgagtgttgcttctgcgagctagagaagccctttgcctctctctggccggaacagggttacctttccggtatgcacgcttgttacct

SEQ ID NO: 490106 - DNA, 469 bp, Homo sapiens
gtcgctctccggatctacagactaaccccacatgctcacaatcaagtgatacatattcctgagagacccagcaataccataagaattactaaaaaaaaaaaaaaaaaaaagacttaagccccatgtattcatactaaccctattttcactttaaatagtgtaataaccttcatgaccttaattagggtattttaacggtatactttggatttggtcacaatatgatgatatcagtgatgggttgggtccagtcccagaatcttggactagttacagattggatagcacttaaatgtacatggaatagctaatgctacatggctggggcatatccagcatgttatgacctaataactattaaacttgatttacccagtcattcattattatttttccaaggataacttaggggcctcccaaaagacatcttgttttggggccactgcccagtttttagccaattaaatct

SEQ ID NO: 490107 - DNA, 406 bp, Homo sapiens
cataatacatggaaggaacagatagggtaacgtcaggtaagtaggtcacaggacagtctagactctcgctagactgtggagactagagcagagaatgtacatggtagactagtctcaggtattgacttcagtggtgcagacgtaaagaaagctgctgggctctggagatactaaggaggaatgatagacacatccagctgcctatgagacgaggagcaaggactgtgatggcgctgatcatctaaatgatcatgacactgcagacactcagcatgctgaggtcctcgcgtcgagtactcgctcgctcatgtgagacatctgagaatatattgcgtgcctggagtgtaatataagatgagatagagtgctgtagctagtctatacgctcatagagagggtttcatct

SEQ ID NO: 490108 - DNA, 865 bp, Homo sapiens
gacgactgttagggaggtctccagagccctctctctctcctgtgcaacatggcgactcttaagcgaaaaactcattgcgccagttgcggatacgaagaggcaagagttccaaacaatacaggatcactgtatgtgggtgttggacaagttgcgtatggcgtgtgctatcagcattctgggaaagtctctggctgatgaacttgctcttgattggcatgtttgggagagatagagcttaaaggagaaatgataggactctgtcagcatggcgtagcttattctcttcagtagcacctatagcattgtgttgcagatacaacgattatctcgtgtgaccgccaaattcgtaagattgtatgtggtatactgcaggagtccgtcagcaagaaggggagagtcggctcaatctggtgcagagaaactgttaactgtcttcatacattcacttattcctcagatcgtcacacgtacagtcctgattgctatcataagttgtggtattccaacccatgtggacattcttacgtatgttacctggtaaactaagtggattacccagaacaccgcgttgattggaagtggatgtaatctgggattctgctagatttcgctaccttatggctgacacaaacttggcattcatcccagcagactgccatggatggatctcgggcggaacatggcgactcaagtgtggcgtgtgtggagtggtggtgaatggtaggcaggtgatatctcgtccaggaatttgaagttccaaaaactgggaacctgacgagtgatagtgaagaattgggaaggcatttgcttaagatggtggtggcacagtgcctatagaagtaattccagctaagatgatatacca

SEQ ID NO: 490109 - DNA, 771 bp, Homo sapiens
caactatcggctacgatcaggccgcgtgttactcggccgaggagttcataatatccttagggtcgtgcctgggcgggccatgcgctgagcacggtgatggccaccactggggccctggtgcaactactacgtggactcgttcctgctgggcgccgacgccgcggatgagctgatgctgttgtgccgctatgctgcctgtgtggaccctgtgtgccagcctcccctgtgcatggctgtgctgactgctgtgcctgatgcacccctgacttcagccctgtgcagcttccatgtccaatggcgactgtgtgttttgtgctgcctcgtggaacccagtgcactgcggctgggctgccaactgctgtaccctgctgcgtgtgtaccaccaccatcaccaccacccctacgtgcacccccagtgcgcccgtggctggctggcgtgcgccggacggcaggtacatgcgctcctgtgctgtgagcccactgccctgtgtgcgctctccttcgctgggcttgccctccagccggccttatggcattaaacctgaaccgctgtacaggccagaaggggtgactgtcccacgcttgacactcacactttgtaccctgactgactatgctatgtggttctcctccaggttgatatgagaaaaaccatcccagccgacaggcgcctatctctgaaaaacaatgattagaaatgagagcggctgataacaagcccatccatagattcccaaattaccacagacagcaactggcttcatgcggcgc

SEQ ID NO: 490110 - DNA, 203 bp, Homo sapiens
cattgccagcggcgacgagcagcgcgcctggatgatggcgcgcttgcagccctaccgcgtggaaaccaccgacggcaaccccgacggcctgctcaccgcctactacgaacccttgatggacgccgcccgccagcccggcaacggcttcaacgtgcccatttaccgcacgccagcgggctttggcgcgcgcaagccctggtaca

SEQ ID NO: 490111 - DNA, 673 bp, Homo sapiens
tactcccctcgtcgaactacggattctagtcccaaagagggatgactgtaacggcaaatcaccggtgctccaggagcagatgtgatacgatcgcgtgatggaaaaacgtgggtagggaccactaagagtgcgaatagtgacaatcacatcataaaaaggaccacctcggcgagtaagatggagaataaagaactatgactcgaaagaatagtctagcctaggctgcgcaaactatgtaagcatgcacaaattcctggtctctggattatcataatgaagctatgatgtgaaacatgtcttctgttgtaatgaaaaccatcacttggagatagtttagtaatcatatgtgattactggtaaccaatgatctactagggaaatgccttttgtactttagggaagtactttttggcattttaacatgtacagacagaaaaaactgagattgatagcccctctcactggaagtgcataattttgaaaaactgctcatatgatgtacatgtactgattactgcctattttaataaacactcttgaaaaatgcatgttgccctgttgctgcctgccctattcttcctcatctccccatctattggtacccaccttgcgttttaaaatccaactttatcattgaataagtgtaagacaaatatgttctgacataagtata

SEQ ID NO: 490112 - DNA, 112 bp, Homo sapiens
agagcggccttcaggtatggtgatttttgaagaacgatctcggttctgcaacatttgtcacatgttggcgcaattctggtgatgtctctctcttatgatctctcttaatttc

SEQ ID NO: 490113 - DNA, 150 bp, Homo sapiens
  misc_feature (5)..(5): n is a, c, g, or t
tctanaactcagacaaccagaagatatttaatctatactgcttatggttaatatattgggtctagtattaataaagaaaaatgttattaaagatagcatacatagtagtaaaataaaatacaaaaagtgtgttgatttatacgctgtttg

SEQ ID NO: 490114 - DNA, 106 bp, Homo sapiens
cgtgatgagctggtacctggtgggtagaaacttgactgcactaggacacatcaaacacagccaggctttggtcttacccaggcactaaaaagctgagccctgtgct

SEQ ID NO: 490115 - DNA, 298 bp, Homo sapiens
agagctcggcccgaattaccacctcatctgcccaccactcatctggctgactgcactgacggtcacgtgattgttgatccctgagactagagccggaaatcgctcagcgatccccgagggcctctcagtgtcttttatgatcactaagacaggggcctggactgagcttcttgctggtaccaataaccgtattctttcgacaatgcatctccaaagcaggtgattctggccgatctgtcctggggacactgacaccgagggtgactgtgtcaggtcatatggaggcctcataacctgt

SEQ ID NO: 490116 - DNA, 127 bp, Homo sapiens
acactgaggggctgggacctcactggcaatggacatgctcagagaggccagtgcgattacatgcaacaggaggatcagtcaggcaacttcaactatgaggctgggcatctgtgagggctgaaagctc

SEQ ID NO: 490117 - DNA, 1311 bp, Homo sapiens
ttttgttcgctttgctgcgtctcgtgtgggtcttgtttcttattgctcctctctcgtcttttcttctttgcctttgtctttctgttctttttgttgtgcttctgcgggtctttctcttgtttgtcgttgttgttgcgatcacttctttctcccttgttgtctctttcgctctcttctttcttttgtttttttcctggtctgtcctcctcctcgtgctgttgttgtgttcttcttctttgttgtttcttcgtgtgtttttcgcttttgtttttctttctcttcggtatgtcttcttgttctctttgctttatctttcttgttttggttgtgtttgtcttttcagtggtgtttttactgtatctcttttgcttgatgtgtatgagtgattatgtggatgtgtgtgttgtgacaggatataataaaagtatacgagataggacattcaggtgcccccattctttagcggtggtctctgcgcccttcttcgagtaacccagaaaaggtctcgcgccattcgaaaaccgcgtaaaaagggaacccggttgaaaaccttaagatttggcatgcaggcttcgccccggaggcctccgcggctgtgtgaatgcgccggttatcaggttcagcggcagagagcatcctcttaacggcttgaagtcctcctgcgattaccggtcacccaggccatggaccgcccaacagctactcagctgcttaagctggccccccagtaccgacccgagaccaagccagagaagaagcagagactgttggcccgggccgagaagaaggctgctggccaaaggggacgtccccaccaagagaccccctgtccttcgagcacggagttaacaccgtcaaccacccctggtggagaacccagaaagctcagctggtggtgattgcaccacgacgtggatccccatcgagctggttgtcttctttgcctgcccctgtgtctgtaaaatgggggtccccttactgccattatcaagggaaaggccagactgggacagtcttagtcccacaggaagacctgcaccactgtctgccttcacacaggtgaactcggaagaccaaggcgctttggctaagctggtggaagctatcaggacccattaccaatgaccagatacgatgagatccgcccgtcactggggtggccaaagtcctgggtcctaaggatctgtggctcgtatcgcccagctcgaaaaggccaagggctaaagaacttgcccctaaactgggttaaatgtaccctgttgagttttctgtacataaaaataattgaaataataccaattttcccttcca

SEQ ID NO: 490118 - DNA, 1194 bp, Homo sapiens
ggcaagagtcagctgagcatccagagtttctactactgatgagtttggtttccgtgtgtacattgaacgaaggtggatgagcctggttcccagtctgcttggcgaactcccctgctgtagtggatggatgctccatcagaggctgcggtaggcaggcccacctggtagttcacccatataccagcgatgtgggggatctcaccgtgggacagaggattgcacgtctacccgtacctccgacttctgagaagactacccggtccctgcgttgctaggccggacaatcctccacgagtggtcagtgagagccagcagcatgttgcgatgcgtgctcctctggcgcgcccctgccacgcatatgcaatggatggacatctcttgcaggcttgtcctatccggcgaggatcggttgaatgatatcagtttccaagcgcattgatgcacgcaattctgactggcgctagagccaggaattcgcaggacacgggacgctgacttacgcgggcactcaattggcgcccgacgccaaccaggccttgctttacgcccacggtgcatttgcgggtacggccattccgtggggttagccccctggcctttggcccgtccatggggttgccttccccggggccccttgggtcctgggtcttccttaccccctaggcaggcattcttgcgctaatcgttgtccaagggggtcctaccccggtcatttgggtgggccccggcccttgcccttcccttgcgttgttcgcttgtggagcgtacgtgtcgcgaccgccctttcttgtgcattgcactggtcttggcccattcgattccggaagggacccttgcttccccccggtccttcccttatcttttcagctcagatcccagcccctttgcttggggttggttcccaggaaccttggatcccaatgctggtggttccctagctgcccaaccttcacttctgtccccaagttacccttggccttcggccctggggactcaaaggcctggcttcccagggaggcacttgacccactctgatgcgttgtcccccttggattcagacctcttggcaccatgggtttccctcgacctgggccctttccgcccagccgttgggtgagaccacttccatggcttgggtcccttgcggcattccttggggaccctggttttcttcctatcggaggggcttcccgg

SEQ ID NO: 490119 - DNA, 146 bp, Homo sapiens
aatccttggggctaaattaactcttttgacataaagtcaaatgccgccgaactctagcaatgtattaatctcctttattattggtgaagccttatttgagtatgtaagttcaatatgggctatgtaaaattttcactgtcatattg

SEQ ID NO: 490120 - DNA, 154 bp, Homo sapiens
ctagcggatcctacacaccagctcatctgcacactttcctggtgtaatcggagcccctgtcatggacgacttgaatatcaaggaatatcaagggagagagagctctttaaatcatgtgacccaagtccttcgtttacacagataaatgtgatgt

SEQ ID NO: 490121 - DNA, 665 bp, Homo sapiens
gagtgcgggtaagataaggtatgataccatggagaaatgaagtcataatgactatacaggcataatgctctcccagttagggagaatcctttagcaggtaagtcccaagcatagaaaaggcaaataggcaatggtgggcaagaagtttacccctttcaggacaataagatctgctagtagtactcctttgcatagcataatgtaaggtttcctttcctctcatctcaccacggaagcacctgatcaaggtgaactgagctccttctgtaattctcttccctctagccgccacgcacgttcctattccgcatcttccccacattcttatacctgcctattccgcgaacgccgccctgaccccgcctttccctggctccgcccatcagacctgcaccggcacagccctcgctcagcggggcaggaagctcatggtgtagtttcgtgggatcgtggcacagcccacgtgtctgggggacacgtcaatgtccttaggtgactgggaggacttgaggcggaagttctgcatgacggtggtgaagaagagaaagagttccattctggtcaggccttctccgaaacagttccgctttccgatggaaaagggcacaaaagcatcactcttcttaaactgccccttctcattcagcaagtgctggggattgaag

SEQ ID NO: 490122 - DNA, 596 bp, Homo sapiens
  misc_feature (14)..(14): n is a, c, g, or t
  misc_feature (23)..(23): n is a, c, g, or t
  misc_feature (142)..(142): n is a, c, g, or t
  misc_feature (187)..(187): n is a, c, g, or t
  misc_feature (378)..(378): n is a, c, g, or t
  misc_feature (409)..(409): n is a, c, g, or t
acctgtaagccacnggaagatgnagggccagatggaccccagaagtcccgtgtggatttaaggccccacataccgggttagccaaatcctaaataccgaatcctctcattggggaaatgttggtcaaaagatagagaatttncagttagacaagaggaataagtcccaagagaccctagtgtgcagncccatggtgacaaagtgcctcaacagtgtgttgtatgctggaaattgatgagagtagatttcacaaaatgaaaagtgaggtaatgcatttgttattagctcaatttagccatttcacaatgtatacacatttccaaacatggtatatacctacatgtatgcaatttttgtcaacttaaaaaaaaaaaggantcacttaagccaaacaaaacaacccatgganttctgggatggaagccatgtctattacaagagaacctccagggatgaaggaggctggggctttagcagctctccagctgcctctgccccaggcagacccacacagggccagagtttgggaatcatgcgccgggtgcagcctgcagtgctacttgtcaatgtggagtatggtctacctgtaacagaat

SEQ ID NO: 490123 - DNA, 625 bp, Homo sapiens
cgagtaatgtactctagcctggtagacgagtgagagcccatctcaggaaaaaggaaaaaaaaaaagatgtcatacagcagagttaagtggataaactgttggacacattccagaaaagctttaacattctttcaaagaaaatagaaaacacaatcctaaaatttatatgggaaccacaaaagacttagaatagtcagctatcctgagcaaaaggaatcaaactggaggaatcatattacctgacttccaattattcaacagagctacagtaaccaaaacagcacgatactggcataacaacagacacataggaacagtatagacaacccagaaacaaattcatacatctatggtgaccactttggacaaaggaatgaagaacatacactggggaaaagataatgtctttaataaatggtgctgggaaaactggatatccatatgcagaagattgaaactagacccccatctcttagcatatacaaaaatcacaattacttaaaaagttaaatctaagacctcaaactatgaaacagctaaaagaaaacatcggggaatctctccaggacattggagtgggcaaagatttcttgtgtaatacctgacaaccaggcaaccaagcaaa

SEQ ID NO: 490124 - DNA, 717 bp, Homo sapiens
  misc_feature (578)..(578): n is a, c, g, or t
caaaaaaattagcaggtgtaccaagctcacataatacatgcacttgtagattctatttatctattttctaatttgcatgcagtaaagttcactctttgtagcatacagtcctatcagcttgagcaaatgatacagttctgtaagcaccaccataatcaagacgcagttctatcacactaattcccttgaggtgccccctttgtaatcaactccttgccccacacttaaaccctgcaaccactgatgcgttcttcagtgctgatctgatgttttacctttttccacagtgtcacgtaaatggaatcacacagtatgttgcctttggggcctgacttctttcagttagtagaaggcctttaagaataatccatgttgttgcaagtatcaatatttcattttgttttattgctgagtattccctgccatatatgttattccttgttttgggcaattatgaataaggttgcttgtaaattcatgtacaggtttttatatgaatatgttttcatttaacaggcaaatacttataagtgggattgcttggtaatgtaggtttaactctataagacactaacagnttttccaaggtgtttttaaacattttacaactcccaccagtaaacgtattgagaacttcccaattgcttgtacaatctaatttaaccatttggatatttgatgcattttagtctttaaactttttattttcccctggcg

SEQ ID NO: 490125 - DNA, 731 bp, Homo sapiens
  misc_feature (731)..(731): n is a, c, g, or t
tggacggtcgtggtgctgctgataaaggccctcctgtgccttgcctgatcctggcctgcgacgcgtacgcatgtgaggaacccgattccctttcccttggagacgttttgacgtgctgatacactgacctgactccgctgtgagttcatctgttgcagactgtggctccctacaatgatatctgttggactgagaacactgttctccagctgactgccctagaagtgtgacagttcctcgatcacgcctgccgtcacatggggaccctggcacactgctagatgtggtagactcccgctaacaattcaaagaaatgtgagatgcacccccataccgtacatagtagactataacctgtgggcctttaacttgagacctgatgatttgaaagggcgagagtactatcatgggacttgtgtgcaggatgatgggatctcgacgggagccttactaagtgagccagtgagagggacagcgctcgtggggcccccttgtgcagtgtggatagtgtgctagcatacatgttgggagagacggcggtgctccctgcaataagcatggctattactatttgagcaacatgaccatgcccaaaggggaatacatgccaaacaccctgaggcatggccccacattccaaccttcccaggactgcaataccactatacgcactccatatctagacgcgcgtcaagcaacagaatgacatgctagcacagatatagcgctcn

SEQ ID NO: 490126 - DNA, 375 bp, Homo sapiens
gcgtccgactcttttccatagtagctgaaccattttacatacccaccagcaatgcataagagttccagttccggccaggcatggaggctcaggctgggcatggtggctcgcgcctgtaatctcagcactttggggggcaggggcgggcggatcacctgaggtcaggagttcgagaccagcctggccaacatggtgaaaccccatctctgctaaaaacacaaaaattggccgggcgtggtggcaggcgcctgtaatcccagctactggggaggctgaggcgggagaatcgcttgaacctgggaggcggaggttgcagtgagctgagatcgcgctgttgcactccagcctgggcaacaagagcgagacttcgtctca

SEQ ID NO: 490127 - DNA, 1109 bp, Homo sapiens
gcgtgacgcgtggggacaatgctggcagcagaggcagcagcggcatgaggcagctaccagtgactgacggagctgctgggagtgggagtgactcccccagctcgtggcccccaccctgtccctgtacctcttcccgcttgccctgagtttagaagacgcagatcgctgacaccatctgtccactcgggagtggcaccatgcggtcatgctgtggctagtggatgcggacagtgtgcatgtggagtgctctagggccacgtcccatgcagtccgtgtgtgacatgatgcctgatcgagattgtagtgcagatatcacaatttgcctcgagcgaggaatgcgaacaccccaatggcaacgacacgcggaggcacgcggcgatagatcgcatgagcgctaccatcgcggggcttgtttgcaccccttgagatgcaatcaccccctgaattacactgtgccaacctttatgcccagcaactcacgcgaactcccttgccatttgggaactttggtgccctagtgtgaccctggatgatgccccacagagcacacccaactggacctttggcgaacaacacaaagccccgctgatatggagcccacttgtgacccagtaaactacaagcctacggcatagggcaatagaccgtatacaccttgctaaccaccaatggactgcagcattgggcaccatatagagcaccctgagaggccttaacccatatgaacccccggggacgcatagaacaccatggtgattggcccaacacttgcagaatcccccctggcttttggccccaaagacacacaccaaggatcgacaaagggcacatacacccccggtcaagtaggaacaccccccttcctttggaccacgtacattccacacaccgtggcatattcaccaggacgcagatattccgaagcacacataccgaaggcctcacgtagccccagaccaaattattatccaaaagcattgggcccaaaatccataggaccaatggggacattgaccacacacccaacaaatgaccctgtgaaatcgggagcaaccaatgacgcaggatatagcgccctttacgcgatagcccacacataccccttgaag

SEQ ID NO: 490128 - DNA, 706 bp, Homo sapiens
acatgacaaaaactagcccccatctcagtcatataccaaatctctccctcattaaacgtgatgccttctccgtcagctctcatcaactctctatccatccatacgacatggactacggatggatgtgtgggattataaccaaaacacaggctatcgctaaaatcttagacagtacttcgctcaattatcccacataggatgaatattagcagttctaccgtacaaccctaacatagccatcctcaatgaaacatatgttatattcatcctaagcttagttatcgggcattggccatactactctaacattagagagctcactagactaccaatcgtacctctaactacgtagtcgtcgctaccgtgataagcaagcataacagtgagttaagacccgcttaagtgccatctcacctctccttctcccatatgtgagggcactgactccctcgttgaagctcggctttaaagcccattatcggggccataaatcgcacagcaattccacaataaacaattagcctcatcatccccaccatgatagctcatcagttatcctccttaatctctagttctacctacgccataatctatctccgacctctaatcacagctagtccgcatatctatcaatgtataagacttctgtgacaggtttgatcattctaaaacaatcccattgcctcctctacattcatcgtcctta

SEQ ID NO: 490129 - DNA, 772 bp, Homo sapiens
gatccttggccggcaaagtgtctcattctggcactgcagcaaaatccatcaccaagtaagtgtgacgcaaacgcagcagctcatggaacggaaactgaagcttgtcgtagttgacacaccatggcattttcgactacagaggtgcccaatgctgcaaacgtccaaggagattattcggctgcgattcttctgacctccccagggcctcatgctctgcgttctggtggttccactgggccgttacactgaggaagagcacaaagccacagagacgatcctgaaccatgtttgggacgagagggctagaatgtttcatgattgctcatattcacccggatagagatgacttatggtgacaccaagtgttgtcattgactacttaagggaagctccagaagactttcatagacttgatggacattttcggtgaccgctacttgtgcgttcaaacaacgaaggctagacatggcgctgagcaggaggcccagagggctcagttgctggggctgatccagcgcgtggtgagggagaacaaggcaaggctgatacactaataggatgtaccaagagtggcgcaggaggagatccagaagctaacacaagcaatgcaagaactccacagaggtggagctggagagagagaacgcgcggataagcagaggccgtctgaccgagaatatcagcaagctggcatatcctgtggagcagtgagacgcagaaatgcagcaagatggcccaagaaactcaccagacacggggaggctcactatgc

SEQ ID NO: 490130 - DNA, 419 bp, Homo sapiens
  misc_feature (3)..(3): n is a, c, g, or t
gcnttgaggaccccctcacctggcatttaacacagagatccatttatttgaaagatatttaaggaagagaacagaagtctccacctgggggttcagtgaattcttctggatcttatccaaaatcaccaaagtggtataccgctatgagtctgcaaaaagcacagtgtttttgggcttgggacccaagtccctttgaatacctggaaagctttcccaagaagaatgggcacaaacaagcccagactgtgaggcctacaagatacaaggcctatatataactcttcaatgcccagacaccaacaaacatccacaaacatcaagaccatacagaaaatcacgacctcaacatagggaccaaaaatcatgacctcaacaaagggaccaaataaggcaccagtggccaatcctggagagagata

SEQ ID NO: 490131 - DNA, 660 bp, Homo sapiens
cagttgggatgggggtagaagatgattacagcagacgagttcactgttgtgtcactcgaaaccctgtaataactgtcgagaggacctatctatactggacaatgaatgactctgcgaccgaagtgagtccccaaagggtagtgctatcatttaggcaaaggctggaatgtcatctatgatttagcaagacagctgatcttcctcgcatatattcgcggtgtgtcaagagccatgtccgttcagagctaggctgaggtaatgggagctaacaagtcgtggtaattccctatgatatctgcagaacgtagattggagtctgtcatctacacatccagagaggtctatgggaaagtgacgcatagatggcgaggaagatgttgcgagcaactccgcctgcggcgcctcgttcaatggaatcccttggtcgagagttcaagaaggcttacggatgatacatgctggttcatggtatcgccgtattctggcctgggggtccccctaaaatctcgaagtcccgtcttgtgaggctaatggtgacaacgcggtgggtttggcaatgtctactgcggtgcccaataggtttgtggaggatggcgggttggtcctgaccgaatctctgggccattcggttcttttgctttgggggatgcctttgggtct

SEQ ID NO: 490132 - DNA, 355 bp, Homo sapiens
gcgttctgtttttacgtgacaaaacgatagggaagatggtcaagaggtggcctgatgtctgctgtcagtcctgaaaagctgaacgggatggttcccctcaatcaagccaagcctgcgaccttctcctaggctcatttaaacgctaatgggaaatctggggacgcatttgacagccagagtgctactgcatttacaccacagatgtggttgcccagcgtcgcctttggaccccaggtggaatcctagcagggccctcaggatccctttgttgaataactacaagcattatttcgaattctgcatccgagacctatcctggtgtactctatcatggcatcttaatggtccactgtcc

SEQ ID NO: 490133 - DNA, 236 bp, Homo sapiens
  misc_feature (10)..(10): n is a, c, g, or t
  misc_feature (180)..(180): n is a, c, g, or t
  misc_feature (186)..(186): n is a, c, g, or t
cgaggtatanggtaaagtatatttaatggcacagtagaataaacaggctatgattacaagtccaaagattacaaatatgatgatgatatcaaatatatgcacacacaacacatccaaaaattcttggactctcttttctttttttcaccgctaaaggtagcaaacattcctctgtacctngctctnaaaacacatctacagaagcaaatgaactcatctgcaaataaaagcacata

SEQ ID NO: 490134 - DNA, 746 bp, Homo sapiens
gcaagggcctgcaaggcatcactcccagggccctcgccttctagggcaccctcagcaaaggggcaggtggggacactccaagtggggcagctctccgtacatgcgccccaccccatgagccagttcagccctactggggctgagcgggggcatcccctcctttgtacatagtctccatggcttgtccctgcccctgtaggccaccagtccccttggctgctctccctttaatgccatatggccctgcctagggcacaggccccaagctgtgtgctggggtccccagcagcaaacactggaaagtctggttttttttcgctttgtttttccccaccccttaatttacgcttgggggtacctgagtgcccccgggtgcctgcgtgttgagtgtgtgggcggcaggtcgccgtcccgggaggcctggcccaatctgggagtttgggaggggttgagggtgcccatgagtcgtgtgggggccccgacgtgggggttcggttacccttccccaccgtggaggccaggggacggtccccgggtgtagaccaggtttggggtcctccccagtgtgccctcccttgtttccctccccgagtttggcgacctttctcttattgcattgtaattcgagaaaccgatttcccctcagattccttcatgggctcctgggttgggaggggcaacttgtgtgctggctaggggtggggggattgaccccctgaggcggtgggcatggtcccgcgggttcc

SEQ ID NO: 490135 - DNA, 285 bp, Homo sapiens
cctctgcggacatccagactgagcgagtacctgatggaggataagatggaggtcgacgtacagtacgtacacatgagcctgtgggtctcacgagaccattgacgactatatcgttagatgccggtactcctggtgtaagagcatgttgaccaactgctatgaacatgactcagcgctgacattacaccaggcttgactacacaaggagctgggatgccgacgcgtatagtccataccaggcctatgcactgttcactgcagtagcatgcatcatatggcttaggc

SEQ ID NO: 490136 - DNA, 303 bp, Homo sapiens
aactgacttcgtgactgagacggccacgggaggttctggcacgagaaacaggtcatgccaggagtggaggagtggcatccccctggctgtgggctgcaggaagaaacaccctcagcatctccagagggaaggatgggctacatcacccccattgcttctgcagtccaaacaagaccctgacccaaagaccagaaggactgccactcaccgggaatacaacacgagctaataggaattgtaagaggtgccgctgttgcagctcgaggcataggcctcctggacattgccatccaggtagatttt

SEQ ID NO: 490137 - DNA, 968 bp, Homo sapiens
gacgccatctgttctgtggtagaagaagttcatgttatactcaccgaccataactcctggtgtggggaagaacatcttgttgtgttcaccaccccaaattctgctcgcgcaaaatgtttggcctgtcgcattagaaaagcgcctggtctattatatgccttttccgaaaccgtctgataggtaataatcgcctccctcttcttttgttccctaacacaagaatgtttcccagaaccttttaattgcgcccacccgggttgtatagagtgctcgcctagccgcctagtgcctcggaagcctctatgagattggctcccgcccaaaaaaatttattgtggcgcaccccccccatctttaaaacataaaagcggggccttgtgggatcaaaaagaaaaaggcgccacggtttggaaagattaatatagggaggcctcgccaccttccccgagatggggaacaccccccgggttacccccgcgctttaagaaaaatagaggatcgagcttccgcgtctagtaaagaggtatccagacgcctgttgcacccaaaaagatgggggagaggcgccactcctcttaaagacctatgctcggaggaagtgggtttaaaaattttagatgtcaatataaacccgggtattttggaatattaatatttaaaaatctgtgggaaaattccgtttcacccttgctgttattgaccccgccccactagtttcaccccgttggtggttgtggtgttcaatgttcacattttgccctctttaaaaggcacacaggggttgataaaaataaataaaggtgatcccacacgtctattaagttttgggcgccgtaatctatatgccccatcgtcaagtatttgtaattccctccgtgttttttaaaagggtttttttaacttttggaaagcccttttattggggttaatgggaaaaataaaaaattttccccccccctcccaaaaaa

SEQ ID NO: 490138 - DNA, 680 bp, Homo sapiens
  misc_feature (16)..(16): n is a, c, g, or t
  misc_feature (100)..(100): n is a, c, g, or t
  misc_feature (103)..(103): n is a, c, g, or t
  misc_feature (112)..(112): n is a, c, g, or t
  misc_feature (122)..(122): n is a, c, g, or t
  misc_feature (125)..(125): n is a, c, g, or t
  misc_feature (128)..(128): n is a, c, g, or t
  misc_feature (132)..(132): n is a, c, g, or t
  misc_feature (134)..(134): n is a, c, g, or t
  misc_feature (141)..(142): n is a, c, g, or t
  misc_feature (144)..(144): n is a, c, g, or t
  misc_feature (177)..(177): n is a, c, g, or t
  misc_feature (180)..(180): n is a, c, g, or t
  misc_feature (198)..(198): n is a, c, g, or t
  misc_feature (211)..(211): n is a, c, g, or t
  misc_feature (221)..(221): n is a, c, g, or t
  misc_feature (228)..(228): n is a, c, g, or t
  misc_feature (232)..(232): n is a, c, g, or t
  misc_feature (236)..(236): n is a, c, g, or t
  misc_feature (248)..(248): n is a, c, g, or t
  misc_feature (330)..(330): n is a, c, g, or t
  misc_feature (387)..(387): n is a, c, g, or t
  misc_feature (399)..(399): n is a, c, g, or t
  misc_feature (412)..(412): n is a, c, g, or t
  misc_feature (431)..(431): n is a, c, g, or t
  misc_feature (433)..(433): n is a, c, g, or t
  misc_feature (444)..(444): n is a, c, g, or t
  misc_feature (450)..(450): n is a, c, g, or t
  misc_feature (570)..(570): n is a, c, g, or t
  misc_feature (615)..(615): n is a, c, g, or t
  misc_feature (624)..(624): n is a, c, g, or t
  misc_feature (629)..(629): n is a, c, g, or t
  misc_feature (638)..(639): n is a, c, g, or t
  misc_feature (641)..(641): n is a, c, g, or t
  misc_feature (643)..(644): n is a, c, g, or t
  misc_feature (646)..(646): n is a, c, g, or t
  misc_feature (648)..(648): n is a, c, g, or t
  misc_feature (673)..(673): n is a, c, g, or t
aaaaacgcccctctgnttacccatgcccacccagcgccggcgccgcttgctttcggggccccttgcagaaagcgggttttttaattgaatatatttttanatntactttttntaggtttttntanaantttntntaaaaanntnttccttttttttaagcagccctttttttttttngtntccacccccctccccccnccccgaactcctnagggcccctntgcccancctntgantttttttttttntttttttttttttaccccaattatccttttttttctcctgcccccgcatcccactcccaggtttttacgagccctgggctgnaatggcccgggcctgcagggcggggtaggggagggcaggggctcagccccgaagccngctcagtacctnaggggctgctttntgctgtgtatgcgcctttntngcatccgaaanatcctntttgtggcgcttgctgcaggggggacccccccccccgtccccaggtgaaccaagggtttgctccggggcccatttccagcttggccgccgtttgtgaccttgggcaagtcacttgacctntgtgtgcctcaacttcctcctctgtaaaacggggacagtccctgnccctccctncctcncaggcatgnntnannananatgaggtaacgtgtggggtgatttngagggga

SEQ ID NO: 490139 - DNA, 353 bp, Homo sapiens
  misc_feature (13)..(13): n is a, c, g, or t
gggaatgtccccncttctgggatgggagagagtctccagcatgacacgcagattgttgaacactcaatgatggattgtggaatgccagcatagtgatggccgtcagttgagttgggtagcatatcccctgccaccgtggacctgagctcctgtactctctcgtatttccttgatcttgcatccaccttttccaatgaagaggagctcatcacttgacatagctagggaccaccagcctcagggtgagcgggggtctaactgagccagctcgtgctaattgtgtcactagagcatgctgtatgtccctcttccagttagtcagtgatcatacgtaccaggctgttggatagcga

SEQ ID NO: 490140 - DNA, 185 bp, Homo sapiens
ggctgggtttacaggcgtgagccaccatgcccagccaactggcggtttcttaaaaggttaaacctattcttcacagatgcaccatccatttcacttccagcatcattcacgcaagcatacatgcaaaacatcatgtcctccacagtgcacttcatatcatatgcacatgttccatagccagcgtt

SEQ ID NO: 490141 - DNA, 329 bp, Homo sapiens
tgtgcggtcgatagagcaggttgctgcctcccggcgttgctcgtggggttctactgctctccctttcgctccccaacaatgggtttgaactcctccgctgtttcatgtgtagacaagctcccttgtgtttgcacccgcggggtcggtgagctagcgccgcgcattccccctgcttcctctgcggagtgctcgtgcaagactgctaattttcttttcgacatgctgcagagcgcacggcgcggccgcacttgtggccgcacggttggtagggccgcaccgattgcccccccccccgggggcaaggggcccatttccccgcacacataaca

SEQ ID NO: 490142 - DNA, 115 bp, Homo sapiens
tcatggtgtaacactgtgggatttgagagtcagttatgccaacacctcactctagtgcagaacaaaatacgttatcaatcagatggacatgctggggcttacagggacccttggg

SEQ ID NO: 490143 - DNA, 276 bp, Homo sapiens
tcccaccggctttggaagacagaggcgggtgggtcacttcagcccaggagttcatcactgagcccaggggtttgagaccagcctgggcaacatggcaaagccccgtctccacacacacacccacgcaaatagaaaaaaatttagtcgggaatggtggcacagacctatggtcccagctactcgggaagctgaggtgggagggtcacctgagcccaggagtcagacgctgcagtgagccttgatgacagcactgcactccagcctgggcaacagagt

SEQ ID NO: 490144 - DNA, 128 bp, Homo sapiens
gttaataatcaacaccttcctagccttactactaataattattacattttgacttaccacacttcaacggctacatagagaattccaccccttacgagtgcggcttcgaccttatatacccgcccgcg

SEQ ID NO: 490145 - DNA, 369 bp, Homo sapiens
gtgatgctgttggtcactctgaggatccccggccgccagcttctcacagttctgggattactggttgagccactgcgcctggcagaatgtttgagtgtttttttaagtggacttcctatttattttcggtttaacatgctgaaggttatacatttttacttcatctgtcatagtgattgttgattatgataaaatcttatttctcttagcactttgccatagcttaataccttagtataacatgcgataaacaagggtccggtcattagccacagaaaggctgtcactgttttagcagaatgtcatatggaaggaacattttatgcctctataagaacagtgtatttgctttagatagtaataaactct

SEQ ID NO: 490146 - DNA, 322 bp, Homo sapiens
  misc_feature (206)..(206): n is a, c, g, or t
  misc_feature (230)..(230): n is a, c, g, or t
  misc_feature (305)..(305): n is a, c, g, or t
atgtgatggggagtagggtcaggatgagggggaagaagatagagaggaagtaaagtttaattatgccttttggggtggaggtgatgatggaggtggagattgggtggctggtgaaattggttttagtgtaataagcttttctagtcggtgtttactatggtggattgggcactatggggttattttgggagtggtaggtgactggntttactccattggaagcagatttnctggcttccttttatttttatacggaatacgaggaagaaatggtcagatggcgtgcccaggctcttcaccccccnaatcaacatagtggggt

SEQ ID NO: 490147 - DNA, 408 bp, Homo sapiens
aaattaaaaacccgtcgaccattgaacagtttgagaagtatacgggtatagttgtttgctccaaaatttccaaaacatacatccttttaatagtgtttgatatgtcctcatcagaaagttactcctttgccttttccatttttaaaaggagatattaccagtaggtggaaaggttaaggcttgtctggaacaaggaggagatattacagaataaggagagacaaagttgcaaagtgagaaggaaggagtagaggcatttgagagaacaataagatgttaattcctttgcgaattgttttggggcaaggtagaatgtattttatcataaatgattagaccctccctgaaagggttggattagtgttctcataatactgatgagttggaaacaaagtgttgtgccctaag

SEQ ID NO: 490148 - DNA, 107 bp, Homo sapiens
gcttatactgcggctggaggacagtggcgaaggtatgctatgtctcacccaccacggtacacgtaggttttgttgtggaccagcgctcgtagtacacaatgttgaag

SEQ ID NO: 490149 - DNA, 515 bp, Homo sapiens
  misc_feature (38)..(38): n is a, c, g, or t
gtgcgcgtgcctcgctaaagctgtactaagagtctcgntcatcatagctctcagcgctactctgacagctttggtaacaaccatttgcgatattcgccctcaggccgttcagaactgaccttcagcgtctcggctccagcgccatggcgccctccaggaagctcttcgctgcgggaaactggaagatgaacggtcggaagcagagtctgggggagctcatcgggactctgaacgcggccaaggagccggccgacaccgaggtggttcgtgctccccctactgcctatatcgatttcgcccggccgaagctagatcccaagattgctgtggctgcgcagaactgttacaaagtgactaatggggcttttactggggagatcacgcctggcatgatcaaagactgcggagccacgtgtctggccctggggcactccagagagaaggcatgtttttggggagtcagatgagctgattgcgcaggtggcccacgctctggcagaaggacttgggttgcg

SEQ ID NO: 490150 - DNA, 1503 bp, Homo sapiens
  misc_feature (985)..(985): n is a, c, g, or t
caaacaccttgtggggaaaacacatatacccgctttgtccgaaggaggaagaatttccgctcccctgttggtggtgccaacgcgagatgattgggtcttcctcggtggtggggtaccgcaaccacaggtagaagtatgtaagagttggggttgcgacccgttgtggggaactcttgtgtgggaaaaaattgtgggaaggggcctcctgcacaagaagccaagagggggccagaatttccccgagggggtgattagacgaccttgtcgttcagaacgacaggcacaatttttggaaggaaagaggggaaatggagaatattttcaaccgcggggggaaaaaaacctggtgtgtgttttggaaaatattgtttggtttccaaaaacgcgccgtggtgtatataaaataggcttttctacatacacgttcctctgcattaatttcccggctagggggagatttttgtagaaaaaggaagagggggcgcacacattggaaaacccccccacaacggcctttatccttgaggagtgtagaaataataatggccttcgaagacctttcgtcgtagaatgagaggggggcctctacggcgacttgtaaatgccccctaataacctctgggaagagaaagggaagatgtaaatcagggagaggtgaaaaagggccaacacaagaagattctcccgcgggagaagtgagagagaaaatgtccccccgaaatgtaggcacgcgcccacacgcgcggagattggacgactctccacacgggagagagaaagagatactctcgagcagtgagagcttcacattcataaacaaccccacaggtgtgagaaagaagagaggagagtgagaaagagattgtgtggcccacagagagagagagtttttgagacacaggcacagacggcgctctctttgcgcaacagcgctctcctctcacgggtaaaatagagagggggtgacgacacagggtggacgccntgggggagatagagagagaagaagtaagcgcgggagataacaccgcgtctctcaaaaagagcgccaacaacagagatgggcacacacaggagcccgtcacacagaggagcccgcgacacagagagagtccctgtgtggagagggtgagaagagaaggcgcgacaaaagagacccccacaagtgcgccctcacacagaggggcgccaacatgtgtcttgacgacataacacatgtcctgtgtgtgcgctcacatatgcgcacacgccggagagagagagaagagatcacacaggtcagagccacatccctggcgacatcagcactctccggagatcttttccacaagaaaggcacaggcgaagaatctggaaagggaaatgtccacaaagaagaaagaaaagagaggagagtgggagatctccaaaggctgagaggaatgccacggagggactatggaaaagacccatgtaaagaaaatgaagggggccgaggcgagttttttaagagggacaagtcca

SEQ ID NO: 490151 - DNA, 84 bp, Homo sapiens
ggatgagtgcaaatcagagtaaagtagtcattcaagatccttatcgccttcctggacctccaggaaaaccaaaagtttacgcta

SEQ ID NO: 490152 - DNA, 190 bp, Homo sapiens
ctcagtcactataatatcacatgcggatctcgttcaccctcgaccgtctcgaggggagaggcctcatttctttgtatgaactctatgccgagagctcacttcctttaacctgtctcccagtcagtcttcactatttggacgagcttcttctttgcagtccctctctaaaagactctcaaattcatactgg

SEQ ID NO: 490153 - DNA, 212 bp, Homo sapiens
actatctcaatgaactagaaatgtggttgaagtgtaccttatgacctctgagggaaggtagaaaaggtgataaagtttccgcctggctctctctctcttgggcatctgacattagaacctcgggaggaagcccaggctgtatgaagagttcatatgtaggtattctggttatcagtccacaaaggtgctagttgacaaagaccgctctaccg

SEQ ID NO: 490154 - DNA, 2071 bp, Homo sapiens
  misc_feature (840)..(840): n is a, c, g, or t
ggtgctcacactgtagcctgctcaagtcgtctctatcaattagatgctcgcataacatttgtgtgccgacagcccgggataggggaagctcctccggcagaactctcctctatcctcccggtacccacgttctcccatgcaagagatcttccctcgacgctcaggacctcagaccagctccgcgagcactccggcctctgtcgtatggactatgaagatccaacaccggtcacggacatcttcttggggagacagccttccttcaagagtacggatcaatgcccgggacgcccggcattgggcatttgccaggcacataaccaggacctccaatgtggacgcccaattgacggatcctagtggttggttctttatccttgtctctattctttccacccagacattgccattgtgactaatcatgggcaatatcccggcattcatcccgtcttttttctgtctggctggtgtcctcagagacgtcaaactgctatcacgttggacccaatgtagaggctaacgtctacggaattcggtagcatgtcctggacccagtaataattagaaaacggcgcccaagggcgcacaacaggaactcaacataccaattggcgggccgaagacacaaccatggaaaacgggcaaggggcttgaggaccctactccgggcaattaaacgaacgcccagactagcacagggagacgccaggacaaaggcgttgggaccctttcaaggcgagaccctgtgggccagacaacctcgacagcagagggttcacaacaagacaccgcacacaccccgctgcgcctccgcgcggtcgtagctacttcaatgatgcngacctcacaaacaggcgaaagcaagaccagcacacagacgacgagacgaaacgacacgagacgaaccaccagccactcagaagcatctcacccatacatagcaaccaacgaggacacaagcgcacacgacacacagcaagacaaccagcaagcaagccagcacaacaaccaacgccagccgacaacacagccggcacgcaaggagcaacagaatagtcaaaggagagagcagtaagagacgccacaagacagagagacagcggcagagatgcacacgacgagacgggtcgcacacacccagccaaggcaagacatgccaagcgagaacaagagccgaggagaaagagaagaagagagaaaaacacaaagcgagccagcaaccggagaacagagcgacaacgagagagcgcacaacacagcacgagccagaccggacagagccaggagaacgagaagcagaagcatcagacagcgagtataagcagagcagagaacgcagagaggcacaaggcgcacagcccagcgccgacgcaacgcagagaggcagcaacaaaggcacaagagagacagcgagcaaagcgacgggacagagtgagacggcgacgcagagaggaaacgagagatacgcgaagagtagagacgagagtaaagaagcggccagccagagaggacgaagagagacgagcggagcagagagacaacagcgaggaggagcaggaacgagcccaacgtggagcagcagagagcagagagcagagcacgcagcagcagcacgccgcgagagacgcagagaggaggcgaataggacggacagaaggtagcgcaagcagggagcgaggggacgagtgacaggaagcgaagaaagagcgagacgcgccagggagcgcagaacagaggacgaagaagaggacggagcgggaggaagagcagacagggagcgaagcgaagggagagaccgcaagagcagacaagcgcgacaggacaggagcggcgaaggagcgcagcgacgagccgagcagtaaggaggtaggagaagagaacagagaggagagcgcggcacgaggaccagcacagaagaccaaacgcaggctgcagcgagagacaggcaggagccagcgagcaagaagacaagacgacgccagccgaaaaggcgaagacggcaggaggcgagacaagagagagaagagagcaacgagacgagagaagagagggcagacaagagggcgaaatg

SEQ ID NO: 490155 - DNA, 376 bp, Homo sapiens
gaccctcagctcttaaagtgctgggattacagacgtgagccaacgtgccggctactctcagaatttttaaggtatagtgccaggttcctaactctagtcaccgtgttacacagtagatctcctgaacttctggctgatattttgtgttctttgaccaacatcaccctgaactcccccctcgcccagtcccccacctccagcccctagtaaccacctttacactctgcatctcttaagtcaaacttaggaagtttgactttttaagatttcatggatcagtaagatcatgaagcatttgtctttttgtgcctggcttattttacttaaccgtgtcttctaggttcctccaaattgttgcatattgcaggagttcctt

SEQ ID NO: 490156 - DNA, 165 bp, Homo sapiens
ctacttgtctgccgactgtgtgaccatgctcgtcgttccatgtgggctggctgtgtggtggggactgacggcctcctcaggaggagacatgtgatgaccccagtgcagtgggtgatggccactgtcagaccatgagagatctgcgatgtggccaaacgatagagg

SEQ ID NO: 490157 - DNA, 970 bp, Homo sapiens
ggccctctcagactatcctaatgaactctcggcactaaccttgttattcaacttccattccattacgctctttatactaggcttactaaccaaatgacataaccatctgtcacgtgatgggctaggtcccacgatactacgcctacccgggcgcagctactgatcatctgtatcaaccacacgcgtctatggaattccccatcatctccatatatcatcatctcaaaaacgtatttaatcttctcaccccagataatgcattgaatctattcttacactccaaaacctagtgatataccatacaaaaataacgtagagaggactgaaccctgatctcgttatcatactatctatatattcataaaaattgcaataattaaaccatcacttcgtattcactcactctccatcattttcacctcaactgcacatctactcatattatactagacatggaccgtacccttattagtcgcgggacgcacgtgcattataacgacattttctgactcgtagatcattttaattttatggccctcaagtacaagtctcttagcagataatggcgaagatctaccattccttattcccgataggtagttttattagtctcaaccttcaggtactcattcgatcacataggccctggacgtactcctaggcgctaatatttattgctagtctgcctaatcatgcacactaattggacggcttcaaccatttaacaatattcaaattcagggaatcctatagccctgctagcactgtattcatgttctcagtcctaatttctgttgactattctagaatgctgctcgttgctcattgatgcaggctatgttttccacacttcctagtaagccctaactgacgacaagggcttagccaaaaatctcccggggggccccacgtccccaccaatagaggaggggggcccaaaagactctggaccacgtacgcccccttaaaa

SEQ ID NO: 490158 - DNA, 178 bp, Homo sapiens
ggagtagaaaacatagacatttctaccccaattcataaatctattcataagtctttttatcatgtaaacttgtaccaaagacttatgaatagaaatgtgatttgtcttcccttctttgcacttttgaaataaagtatttatctcctgtctacagtttaataaatagcatctagtacac

SEQ ID NO: 490159 - DNA, 309 bp, Homo sapiens
atcaaaccccataaccaaatacaactttttaggaactaagtggataatcactctgtgttgtatgaacatgtgggcagtgtgtttcctacacagcttaaaagtgcaacaaaaaaagatctaggtgtcatatagagaatttctaccacagttagggtaatggtggactgacaggcagagggtcttagatgtgacttaagtaaagttcaatagaagttccagcacagatattcatgtttcgaattggaccgctcagttaaaaagttttcccattagacttcccctaatcaaattagaaattatctaattttc

SEQ ID NO: 490160 - DNA, 153 bp, Homo sapiens
  misc_feature (134)..(134): n is a, c, g, or t
tggcaggctgccagttgcaatccccatcgcggtcgtcaggatggatgaactgacgtgaaaaatcctgaccagctccattgtcgataccaggctggtccaaggtggctggacggacggcgcgggcgggttgcatncttcatcagtctgtcaccc

SEQ ID NO: 490161 - DNA, 330 bp, Homo sapiens
aggatgcctcggccatcaactgtgcacggattgagttctggattctgactcatcgtcggtggtggtagtcgcgagagccttgtgcaaggcagaagtatttgctggtcctcccaagtgggaggaaggggcccccccggaaggtgagagtaaggaccttctccagccggtgtaggtggttgtctcgagctgcgtgaccggccttccatccatgctactgtgcagggcagccaggctcctgaaatgctcctggcctgaagaactccccatagaggcagaagagggtctccacctatgtgcccaggcctttgcgatcttgcttcaaccacctgt

SEQ ID NO: 490162 - DNA, 1449 bp, Homo sapiens
  misc_feature (1238)..(1238): n is a, c, g, or t
  misc_feature (1290)..(1290): n is a, c, g, or t
caaatgaggtgatgaattaacccagcgttcggccccccgtcttgaaagaggggtggaatatgcccgaagatgatcaccacgcgcacagttgtatcctggatatttttttaaaagggtgtggacaccacacgccctttaatggttgaggtgaaccccttgtccggtgatagagggggaatcttccctccccaccaccacaaagaggtgtttttggtgttcacccgacacaaaaatataaagtcctcactggggcctctttgttgggttattaaaagaaaccctcgtactcctgcggcgcccccacacgtgtagtatcctgttatattaatgatccccccggggtttctcctctaaaaaaagtggttatatctcgccgaagaggggccctctcttgtgggttttgcgcgccggaaaaatttttttcggggggccaccccgcaggagggggggggtccttctgtccttcgggtgttagccaacatggccccgccccacccgcagcttgtcggctttttttttgggggggcgcacaaccgcttgggggttgtccaacaacctgttccgccccccttcgtcttcagcaggggcttaaaaactttttggggggaggaacaacttttatgaccacacacatcttctcctcacggggaggtcccccccctccgttatcacagccttggcccccctcgtcgctgctcccactctcgttatacgcccccgcttgtgtcgagactcttctgtttctggcgcttttggagcacacacaggaaaaaaatggagcacacctctggggagaaaggggagaaggttgtcttctccgcgctctctcccacagcgctcttttttctctccacaaatatatgtttctctctatatatagagatatcctcgggtgaatatttctggggagaaatttggagaaggaaagttgagaattttctcggtgtctctctggacacacctcacactcttgtggccacagagaattgtgtccacaaaggagaagtatatttttctctgtggtgtgtagagtatgattataatggcccccacacaagagtgtgtgtgtttgtaaaaaggtgtttggtgatactccacggcaccacttcactaccccacacgccaccactgtaactcttctcgtgcacactctcccggggcactctcggagaactcgggctcggcggcccctctgttataatgtggctatttttaaattcacagtgggaaccacattnggtcccacagttgtgtaccccacagtgtatatgctgtggtgttaatacacangtgtaatattcgtcccacagaaatgtatttaaaggctttaaggtaagaacgccacctggcgaaccctctggaagagggaatgctgattgtcttgacccaaccccccgcctgtctcttctcttgtttagttacttccgggccataaatcatctatgagtt

SEQ ID NO: 490163 - DNA, 134 bp, Homo sapiens
actaagcctgaagggcagagtgcatgtagtatccacttgacctctgaggcttaatgcatactataatgcacatagagtcctataaaagaagctagtcagacttccagcacactaaacccatgagcacatgcagg

SEQ ID NO: 490164 - DNA, 392 bp, Homo sapiens
  misc_feature (92)..(92): n is a, c, g, or t
  misc_feature (94)..(94): n is a, c, g, or t
tcccacgctgacagaggtcagcctgagccccttgcctcacaccggcccctcccacgctgacagaggtcagcctgagccccttgcgtcacacngncccctccctcgctgacagaggtcagcgtgagcccctagcctctcccggctcagctcctgccctccgatggcatctgcaggccccaaatggcctccggtcggtgggctcctctaggcccagcttgggcctcccggcggcctctgcaggcccaaaacgtcccgaagtcggcctctccaggcccagctccggcctcccggcggcctttgcaggcccaagtcgtcctcaagtcggcctggaattaggcctggaagagcagcaagtcagcctctccgggcccagctccatcctctcggcggcc

SEQ ID NO: 490165 - DNA, 195 bp, Homo sapiens
gcggccgcctactactactactactgctcgaattcaagcttctaacgatgtacggggacatgcctgtaatcccagctactcgggaggctgaggcaggagaatcgcttgaacccgggaggcggaggttgcagtgagctgagattgcgccattgcactccagcctgggcaaggagagtgaaactccatcccaaaaaa

SEQ ID NO: 490166 - DNA, 751 bp, Homo sapiens
ccgcaagatgaggcgggcgcccctgataggtcaccgctcgctgctgtgctcggtatctgccgcatgctatggcccagtgtgtgccgggccacgccgggaatcctggaagcgggaatgtcattacctctacgtatgtatgcatgtgctcaagtgtacatcctccgacccaatccatgcgacagagttcggcaagggctgtggtccaccctttttgaggcctctccgagagagtgtctgcaggcagacacggggccatctgtgggcaagtggtgctgagcatttttgcgcccgatgccggtgcaaatgctcgtgaaccaggtggcatccgccaggctcaacttggaatgttgtgtagaccatgggatatttgccgtggctttccttgaggatatccgtctggaacgggaggaaaactgggtgaatcggttgattggactgcaccaggtatgtctaaacattgtattaagtgtgcgcagtgggtaagttgaaccggaatctccttgaaaatgagggcggaaagtatcagggagtgatatagccttgtggactacataattagggaggtccgcaatactggaggaacgttttcagactatgaaatgcaagttgatgggagttgcagaatgttgacacaagttggaattccaggaacaggagtacgggctgtgtagtacagatgccttactgatgaatttgacacgtattttcgagattcagggcatttggagatgatgttgttattccgtgcaaa

SEQ ID NO: 490167 - DNA, 306 bp, Homo sapiens
ctcactcttcttttttccttcttttatccctaactccctcccctaaaccctgcttcagcacaatggactaatttctagcattctgatcataaggccctccattttcctaatgtgtttcaaggaatcttttaggaaaatatccagattattcatccactcttttgagtatctactaacaactccttttttctctagagagtatgaaggcacaggtgtcctgtctgagtcaagctaacacaatgatttgtttcatcacagctggagcagagtgaaatgtcttcgtaaacagtatttgcatctgagctt

SEQ ID NO: 490168 - DNA, 413 bp, Homo sapiens
  misc_feature (54)..(54): n is a, c, g, or t
  misc_feature (167)..(167): n is a, c, g, or t
taagaggtgagggggaagtgcttgggaaacaatgacaactgggacagcaggcantagagagaagaggaaccttgtaagtcacatgttcctcaggccagggaggaggtggttggaaactcagctgatcctggagaggtggccctcttgcaggcatgaagggctcaacntgcagaacagctgtgcaggaagcagggccttcagcacgggcctatcgtggccctgggggagctaaaggaggggggctctgaggagcttttcagccaggaaggctttttcgtgggagttcaataggtagcacagccagagggcattaaggccaggtatccttctgggagcttctaggctcaggcagaatcagtccaacatctacctcataagaccccactcttctctgctttgtctccggtcgacgc

SEQ ID NO: 490169 - DNA, 194 bp, Homo sapiens
  misc_feature (131)..(131): n is a, c, g, or t
acttcctctaggtgggtcgtcaaaaaatccagaggtgaaatgacattcgaactatggtttaatgaaaatagatgaaccaagcactccttaccatagtatgatgggggatgatgaagatgcctgtagtgacnaccgaggcactgaagccatggcgccagacatcttagccaggaaattagctggagctgaggacc

SEQ ID NO: 490170 - DNA, 474 bp, Homo sapiens
  misc_feature (49)..(49): n is a, c, g, or t
  misc_feature (81)..(81): n is a, c, g, or t
  misc_feature (86)..(86): n is a, c, g, or t
  misc_feature (95)..(95): n is a, c, g, or t
  misc_feature (106)..(106): n is a, c, g, or t
  misc_feature (115)..(115): n is a, c, g, or t
  misc_feature (137)..(138): n is a, c, g, or t
  misc_feature (161)..(162): n is a, c, g, or t
  misc_feature (167)..(167): n is a, c, g, or t
  misc_feature (172)..(173): n is a, c, g, or t
  misc_feature (212)..(212): n is a, c, g, or t
  misc_feature (215)..(215): n is a, c, g, or t
  misc_feature (278)..(278): n is a, c, g, or t
  misc_feature (316)..(316): n is a, c, g, or t
  misc_feature (326)..(330): n is a, c, g, or t
  misc_feature (348)..(348): n is a, c, g, or t
  misc_feature (355)..(355): n is a, c, g, or t
  misc_feature (366)..(366): n is a, c, g, or t
  misc_feature (378)..(378): n is a, c, g, or t
  misc_feature (405)..(405): n is a, c, g, or t
  misc_feature (473)..(473): n is a, c, g, or t
accagccccaggtcctttcccagagatgcccttgtgcctcatgaccagnttgttgaagagatccgacatcaagtgcccacnttggntcgtggctntcatttgctcntgctccttntgctgttttttttccagttttnnttcctttatgttgcgcagttggnnttgcngatgnncccagcttgggggatggactctagcagagtggcccagcnacnggaggggtcgaccacttccctgggagctccctggactgaaggagacgtgctgctgctgctgtngtcctgcctggggccttggcctacaggggcggcggttnatggtgggannnnnggggcactggacagaaantcaggancagggggtggnggagggggcggngggggtggtgtaagtaccccatcttgnaggtctgccttgagaggctcggctacctcagtgtggaaggtgggcagttctggaatggtgccaggggna

SEQ ID NO: 490171 - DNA, 156 bp, Homo sapiens
acctcatgtatattgcacaacacaaaaccaggtaccaacgaaatccttttaatctttccacacaggataacctctgcttcacaacatcaagactttaagtctccatcaactttttacagtttacagcagataacaaggatcgtccctggcgcatga

SEQ ID NO: 490172 - DNA, 912 bp, Homo sapiens
cttcaacagatgcttggacggaacccgggcgctcgttccccaccccggacgggcgcccatagccagaccctccgtcacctcttcaccgcaccctcggactgccccaaggccccgacgccgtccagcgccgcgcaaccacctgctcgccgccgacgcctctccttagtcgccgccatgcacgaccgggtccacctcgcacagggtggcgcccagaactacccacacaggactcaagaggccggacatcaaccgccaggatcaacactggagctctacgcctccctacgttataccgtgtccatgtcataactacttaagcaccgcgatgaatgtggggctatagacagaactttgcccacaatacagttattactttgcaccaatactcatgcaggcgagggcccccatgctgcagaacacgtgactgacaaggcttgcgagacccccacacgagtgtggccgccatcctacccttcaggatatcaagaacacccaggactggtgatgaactgccgacacgccggagctgaatgcacactggacgtgtgccttcccattttgggcaacacaacatgtgcctcacagtcacataccgtgagcaactgacaacacaaactgggccaacggacaaaaagtgaagccccccaatttagatgatggactacaattgcagaacactttaaacctgcactgacagcaggtgaaacagaccatcacaagaacttgggtggacccaggatgcagccacatttgacgcacagcatgggacggcgccagaactctggactaggcggaaaatttctctatggacaaagcaagccccctggacaaccgtgcaatacgaaaggtacgcctaccgggctaatatcaccaataccgggggtgaactatcctgtgtcacacaggacagag

SEQ ID NO: 490173 - DNA, 136 bp, Homo sapiens
tgtcggtgtgtcttccagggcaagacacaaaggtttccgtggggggatgaggtgagtggggccatgagcaccctcctgggaggggacaggctccactgtcgggcttgttgttttttgaatgtaaaaacaggactgt

SEQ ID NO: 490174 - DNA, 1133 bp, Homo sapiens
  misc_feature (159)..(159): n is a, c, g, or t
agcgggacccgactctgctgtcaaaaccctgttacatctgtcatttctaaaagacatataaccatgttgtccatcaagtctggagaaagaatagtctttacctttagctgccagagtcctgagaatcactttgtcatagagatccagaaaaatattgantgtatgtcaggcccatgtccttttggggaggttcagcttcagccctcgacatcgttgttgcctaccctcaacagaactttcatctgggatgtcaaagctcataagagcatcggttagagctgcagttttccatccctcgcctgaggcagatcggtccgggtgagagctgcccagacggagtcactcactccatcagcggccgaatcgatgccaccgtggtcaggatcggaaccttctgcagcaatggcactgtgtcccggatcaagatgcaagaaggagtgaaaatggccttacacctcccatggttccaccccagaaatgtctccggcttcagcattgcaaaccgctcatctataaaacgtctgtgcatcatcgagtctgtgtttgagggtgaaggctcagcaaccctgatgtctgccaactacccagaaggcttccctgaggatgagctcatgacgtggcagtttgtcgttcctgcacacctgcgggccagcgtctccttcctcaacttcaacctctccaactgtgagaggaaggaggagcgggttgaatactacatcccgggctccaccaccaaccccgaggtgttcaagctggaggacaagcagcctgggaacatggcggggaacttcaacctctctctgcaaggctgtgaccaagatgcccaaagtccagggatcctccggctgcagttccaagttttggtccaacatccacaaaatgaaagcagtgagtgagccccactttcctttttcttcctcctccagcaccttcgttgtttcctgggtagtctgcctgggtgaggctcccttcctgtttctcatctgtggcttctgaaacacttagactctggacccagcaagagtttcaggaagtgggttgctaggcagttagacaggcttgttggtgaacacccggtatgtagttccatttcagcacaataaaaagaaatcttgcattcaagatgctaaaag

SEQ ID NO: 490175 - DNA, 444 bp, Homo sapiens
  misc_feature (403)..(403): n is a, c, g, or t
atcggagccgagactgcttataggttgtcatttagatactcaccgacggcttctccagctaaaaagattctctacggctccagctacagcacaatctaggcaaaactcgagctccgaaaccatggatctccgcaagaaagcaaagcgccgaaactgccttaaatacagcagaaatggaacgcccacataacctttggaatacaaacgcactcctcccctgacttgcacctccaatgcggaaattccgagctctcccgctggtgctcggcttatcctcgaggagctagctttgaattgccgcctttgacttactcataagctcctcggccccgggagcaagatccacgccctagcgcgcctggctctactgccagaaaacttctacttgccacttaattgctcnaaaccaacaccggctccaaattaaaccaaatctctcgcacc

SEQ ID NO: 490176 - DNA, 1144 bp, Homo sapiens
ggcggagcgcggcggtggagatggtcagagcaaatatccaagaagaggaagattggtcgcatggatgcgcgatcgtgtcaaaggcatgacatcgtgagagtgacgtttatcttgactcgcggagactgggcgtgcaagatggctactcgtggagctagaggtgcgagtttacaccaatcacaggaccagtaatatcattatcttagccaccaggatacgactacgaatgttcttgtggtgaggataggggccgggcgtgcttcaggagaatcgtgatctgcgtgtacagttcacgaaggagagtatgagcgttttctcgaggaagtggctacgatgtacgatgcttaagtcgctgatagaatggtgggcctagcgtagcaggttcatgatgatgacacgagttgtggcctagtgtcgaggagatcttcatgactgttcactagaaatcttgccgtaggaagaggtcgttgcctggtgccggaggggccatgcgtatggtcgtggctgcgggttcgatcatgtggagagtggggccctaaggctgcgaagcgttgtgcgtgtctgggcagacgtccgacggaccagaagggctagaatcccatgaagttagtggatggcctggatgcatccgacagcgcgaagacccatgtataactactagcgtagacactgctggtgcgccacgtgtcgctccagacagggtgtgctgggcactcaaggtgacagatcatgctgccctgggacccaaactggtaagataggcctaagaagaccctgactgaccaatgtgaggcattggtgagaatacccaaaagacttgaagattagtggcacaccagccacaatgtcagaaacaaaaagggggtgaagcctgatccgcatttcatgccccaatcaagatacacaatgaaataacagggtctctgggcagcatgtatctggagtctggattgcctttaagaacttgaatacaaatggtccaagacgacatcacacaaaaaaacctcgaggaaaacacgaggggaaacaggcacaaaggcaaggcaaaggcagaaactgtgacaggagaagacggtcacaaagggaagcaacaagagaacaaaaaggagaaaaagaacaacacaaaaaagaagaaaacgccgag

SEQ ID NO: 490177 - DNA, 404 bp, Homo sapiens
  misc_feature (160)..(160): n is a, c, g, or t
  misc_feature (168)..(168): n is a, c, g, or t
  misc_feature (185)..(185): n is a, c, g, or t
  misc_feature (235)..(235): n is a, c, g, or t
  misc_feature (247)..(247): n is a, c, g, or t
  misc_feature (345)..(345): n is a, c, g, or t
aggtgggtgaggggaatcctggatttatttgggataaaacttcctttttccctttactcagtggaagccccttcaaagccagccagggctagtgaaccccagctcaaaaggcaaaagaagacaaaagccccccaggatgtagaaatgaagggccttgaanatgagagntaaaccttttcccctanaagattttcaactggagccagccttcagactcagtggttgtttcaaaggnctttgacaaaancaaggccccttttccctttccagatttcctcctacctaatggcctactgacctcccctaaagggatgtttttgggagggaaaaagggacaaaaaaaanattggagaagggcctctttagcagtcaactccctttgtaataaagccctagccctttta

SEQ ID NO: 490178 - DNA, 453 bp, Homo sapiens
catagcaagaacgcatctctaaaaaaaaaaaaaaattaaaaaattaactggacatggtggcacacgcctgtcatcccagctacttgggaggctgaggcaggaggatcgctgaccccgggaatttgaggctgcagtgagtcctgctcaggccactgcactccagccttggctacacagcaagactctgtctaagaaaaaaaaataataataattttagggatcatttaatcatgttttctagtcatgtttcagtgcgttttttaatcatgtttcagggcatgcactggcagtgcccatctgttcctaagtgtgtgatcagcaacattacgttggtaacttaaaattggccatggtgaaagtgtttaccccccagtcattggcaaaccctagaaattgaagattttaaattcctgggagaacggcttattaaacctcaaccagcaccccgctgca

SEQ ID NO: 490179 - DNA, 1499 bp, Homo sapiens
tgatctacccgcccaagacaacacacaccctcatctccactcgcaccgtaccatgcacagccgcccactcacaaagaccaactttcacacaacaataaacaccctactctcaaacattagcacaccattgaactcctttcagtataacatcctaaataatcacctaactggcacactatactcttcaacacacacacaatcctaaatcgcctctcaactaacatatcatataccatacccacatcctatccatcacacacttaaccgagtactagacacaccttctatgctaccctgataccaaccatcacaataacttacccatctacccatctacacccaactaactcatctcaccttaacactcacagagaccctcaatacaatgatatcactcttactcacaaatactcatatagaatatcaccgtttccaaacccacgcgaacacaaaaaatctgcaccacccactactccacaaaactcaacacaccccctacaccacctcgcacaccacctacacacgacaccacctctctacacctccactatcaccccaactaaacacaacccaatcacacaaccaaagcacaccactattacttcgcctcaccactcctccacacgccaactccatcacgactccacagcaacacccatcatccgacacaacacccacattaccatccataatatctgaactaccctacagccatcaatcacccaccctctcaacacctatacccaccatcaaccatcccatacagtacacactacctccctcctaaccacaagcacactacaccactaatatagaccatctacacccttccttcaacacccaaaccctatcaatacacacctacccacacagctactccacacctacttccaacaaacataaaccaataacaaatttctactcccacccactccactacaccaaaacaattcacaataaacatctaaagactcaatcaccactacaactccacaaactactctaccccaaacaaatcacacaataacacacaccatacaaacctacacacaccacctaactttcaagccaatctcatcatcatcctcccacagaatcacatccacactattcatatatcgaccatcaactatagaccatacactctagtctctcatatcacttaacacgcaatcttcacgatgcctagttgttcccactcataccagactccgactcatatactcaatctcctcatcagactcactacttatcaatcactccagttacctacctactttcttaactcacatgttcacagactactagacccttgtcgatcatcctacatcatcctatatactcatgacaatgttctcctcatcattcacccacacactttcaacccattccttccccctcattcactctacactacaccagtaccttcctcaatgcatctgcatcacaactgcctcaactgccacctacccctctctactcagcactcacctacaacg

SEQ ID NO: 490180 - DNA, 210 bp, Homo sapiens
gcgcagcagagcacagcgactgcccaaggagctgctgtcctagccaccctcccagtcatcttcaagaagaacaaaagttcactgatcgcctcagttcctttattctcctcttgttcttgaggactgaccaatgggtgtgtgtccctgtttgcctctttgctggggtcacagaggaacccaggagctcacattgagtggcccccagacatg

SEQ ID NO: 490181 - DNA, 777 bp, Homo sapiens
tactctatggggaaaatatttcaatccgcctcctttaagggtttaaatattgccacaggggggccccaccactgtgttggccttcgaagttggccgcccccccccccccacaaacattgtttggggagagtttctctcgtatatagtgtgggagaggagacactatctcggagatttaccgcccccgagaaacagttcaactaagggttgtggcccccacagcactcttggagagacttcacatgagaagagagctttaaaacatcttggcaaatcgtgtccacccatatgttgtcacaaacgggtatatgtataagagagagaatatatataggggcacgccacattttttgcacatcctgaccacattttttcccttaaaaaataatacaaagacccaccccccacacatttttggcgcgaagggggtggaaaatcacgttgttaacccttataaccctaacacgaggtggtgagcacatgtaacactgagcttattgagaccactcatagagatcgatttcttgtatattgagttttatctctttctcgtattctatagggtaaattctccagggtaaaatgttaggtgttgaaccttgagaaccctggaacccccttccctgctcagaggaacagtgtgaaaaaaaatctcttgagagatttagaatatcttttcttttgctcatcttagacccccgactgactttgaaattatgttaagtgaaatatccatgaaaattaagtttactattaataattaaaaagaaaaaaaaa

SEQ ID NO: 490182 - DNA, 479 bp, Homo sapiens
cttgggatcacgggacttttaaacaccgcaaagtgaccctgatggaagaggggcttcaatccccacggtcatccaaggataccttgtatttcatggatgatgcagagaaaacatttgtgcccatgactgagaacatttataatgcccataattgataaaactctgaagctctgaatattccctggtggtttagctcatgacatttccagaaagaaactcgatagacctcgcagagccacttcatacgtagaatccaactttaacttgattgaagactataaggtgcgattttatttttaggaaattattcattaaaaggatagttttttttttttttttaattacacctgaacctttgcaagtaaaaagatttagagacaattatttttcaatgtgcacctgccatttgtccttgcaaactaagcttcttggagagagggccttatttttttaaagacataataaactatattaacact

SEQ ID NO: 490183 - DNA, 745 bp, Homo sapiens
ttttttttttgtttttatttaactttgggtagagacaaagtgatcactatgttgcccacggctgggttaggactcctgagctcaagtgatccgcctggccactgccttcccaaggtgctaggattacaggcgtgagccacaagtgccgtgggccctgtccactgttgttaaatagcgctcagacaataagagtcatgaagaaggaactctcttctgtgacagttcgcaaaagaagttctaccatgtttacaaaataacagataatctaggataaactctgggcgcaaattcaaagttaaagagaaaagaacaatttttactagaaagtttgtcttaagagcctctcagcgcacagggtactatgctgagcccagaaggtacttcatttgtctacagtagagtaatgtacacgaagctcacctccggggtacagtgacattatggcggggcttccaactggaacgcaggggcagctcagggccctgtaaaatctgagtctactgacagaaatcctctcggccccacccccaagaagacctctaaagtccagatacagtgactgctaatccctagtcggcagggttagcccggttcagcaaaagcattaacaggaataccaagaaaacccatgtaggacgcgcagattaaattgggaattacctgagaagctttttaaaaaatcccatgtcgggtacacccaagagatcaaacccagaactgggggattcgctaatcatcaacattt

SEQ ID NO: 490184 - DNA, 705 bp, Homo sapiens
ttgtctacaacatgcttctagtccaggaggcacaaacaagaactgggattaatgaagcatttgtttcatttacacaaagtagtgagtttactgtgtggagatcctgctcagttttattttctattgatgaagtaagactggggactcaatccagagccagatagtagggggaagccacagcatttcctttataacctcagtgtcaattttgtagtgagactgagcagttttaaatccttgcgtgcatgcatacctcatcagtgatgtacataccttgccactcctagagacagctgtgctcaccttttccgtgctttgtgcctgattaaggcgtactgacccgtaaatttctgaagcaggcaggcaagaaaaattacattccttgtcatcgtaaattacctttgtgtgtacattttgactgtatttgagacatttttggtgtgtgactagttagatttgcaggatgtggcatatcattgaacggaagctaaagtcgtgtgacagtggatatagctgctggaccattccatcttatatgtcaagaaatctggaattattagtgttaaagacatatgacatgtggattataattttgcttagcattgctttgtaagaagtacaatataaactagtgggtatataaacgtactgaagtctgagaagagttatcttaggaaaatacgtttatatgcgggggtgtgcagg

SEQ ID NO: 490185 - DNA, 226 bp, Homo sapiens
  misc_feature (69)..(69): n is a, c, g, or t
ccttcccccacagtgtaggtggagcgcggaacaggaaatgtcagacacaggctcgctgctcgttggaangcagggtgggacttccttcctctgtccggagaggcacaggtgtcaccagttccagccaaagctcctcacaggcgctgtaaatttttgtccacgtcttgtatttatcgaatcaacaatttgtttcattttattaaaattgctcccttgttggggaagg

SEQ ID NO: 490186 - DNA, 453 bp, Homo sapiens
atgtggcatatcaggggaccggggtgggaggggctgatgaagccgaggccagaactaggtctgcgccctggccctctccctaatggccagatccggcctcacccgtgaagctggcctggcaggggatggcccttcctgaatttctgtgtggtctaggctggggttggcatgcttttctgtacagagacagatagtcaatatgctcagctctgcaggctgcacgggttgtgtctcagctactcagccctgctgctgtgatgctgaggctgccattgacgacacagaaataagtcgaggtggccgctgtgggccagtgccactgcatttatgaacaccaaaatgtgaatttcatataactttcacatgtcatgaaatggcatttttctttcaattgtttgtttatttatttttaacatattttttggtgacagaccgagactccatctcaaaaaa

SEQ ID NO: 490187 - DNA, 263 bp, Homo sapiens
  misc_feature (17)..(17): n is a, c, g, or t
ttagtacttctattagnggtatacattggtccaacttggggtgtgacgagtcagttatattttgggatttacaaatttattacttgtaaaaccctaccgcttcttatttttggctgctttaaggcctacaatggttttaaaatttttaatcctctcaacaaggtttttcccaattgtccaaaaacctgtccttcttcgaacaaccagtttaatttacaaggggatttaaagggttctgtggccaaatttaaaggttgaccata

SEQ ID NO: 490188 - DNA, 566 bp, Homo sapiens
tagcgccgaggttttcatggggcccgtggacacgtcaaggggacaacaagaagcggtgcccgtgcgtgtcaaactgggcttggctcctggcccacccggtaagacgcggggtttctagcactctgtgggccccgcaactctgtctggcggtgaacaccgggcctccccccgtggggtgcgcggtgtacccaattttcgtgtccaaccccccctcagaccacaatagctgtccccagacgcttgccaatcaccccggggccccgagcctttgggccctctatgggtgttgcgggttctccgtcctctcccccctggtccatcgctatctgggacaggcttcccctttttggggtctgtgacaggcctgtagcagagccacccagtggtttctatgccaactcctccccgcggcgggcctgtagtctgcgaggccacgcttcacccgcgcacgaggtgctgggcgagcatccttgtctccaccgcgtcactgggcccccacaggttacatgtgggcgaaaatcttcaacaaaatctctggggcaaaaaaaaaacacaacaataaagca

SEQ ID NO: 490189 - DNA, 216 bp, Homo sapiens
accaggaagttggatgggacttagagcccttgatcaacccagaacgccatgaccgcaggctggatcacttcagggtctgcagtgacatcactctgtacaagggtaaaacgtggggcttaggagatgatccccacaagtagcatcccagcggatgagcccatctgtggatgtaatgccttaagtgtgcacagcccaaagaaataaaatgctacttta

SEQ ID NO: 490190 - DNA, 635 bp, Homo sapiens
cacggtggctcacacctataatcccagcacttgggaggccgagtcggacagattatgaggtcaggcgttcgaggccaggagttcgagaccagcctggccgatcatggcaaaagccccatctctagctaaaaatacaaaaattagccaggcgtggtgacgggcacctgtagtcccagctacttgggaagctgaggcagtgagaatcgcttgaacccaggaggcggaggttgccgtgagccaagatggtgccactgcatttccagcctgggcgacagagtgagactctgtctcaagaaaaaaacaaaattgggcagggttacaggggttcatgcctgtaattccagcacttgggttgggccaagggggggtgggctggcgttgagcccaggagttcaagaccagcctgggcaatatgggtggaaacctcatctctacaaatacagaaactagctgagcatgggtgatgctcgcctgtggtcccagttgactcgagaggctgaggtcaggaaggacctaactggagcctggggagtcaggctgcacggagtcctgatcaaggcagtgcagtctaagctgggaccagagtggactcctggctgcaacaacaacacaacacgttggccaagcaagcaaac

SEQ ID NO: 490191 - DNA, 174 bp, Homo sapiens
tgacaatcgaaaggatcggggtagttgtcgacggactataagtgggtccacttggtcccatctacggtttgcaggttttaacctttgtaataacatgttgttgaatcgtcgtagtatgtaaaaaagtagtattgttgccagtggttgaacaactatactcgtaataaaccaggt

SEQ ID NO: 490192 - DNA, 793 bp, Homo sapiens
agcggagtcttctccctcgccgcaggtccagtgcccgagcttcggctctcccatgttcctgcaagccacctgggtccccacaatgcaacaatcgaatgtgtggagtcccagcagaagcaccactggaacgagcacagagcacggcgtgccaaagccatgtgtgggagggggagctgatcggaaccagcatggccgtggtcctactctacgcgactggaccccagagctactcagcccgggacacacagactgcgactgatgcgggcagacgacaacgatcccaagggaacgaagaacgccagcactcatcggcgtcccaacgtggacgaaatacgtggacactgccgcggaaaacgagaggcagcactggcgcacaccgcctggacaccgcagcggagcgaaccgagaaccacacagccgccacaggaagaacactgtggcacccaagaccctgcccgaggagcgaccccctaacacgcagccggcagcacacgatcacgcacactacctaccatccaaatccatcgggggaccaaccgcacgcaatcacagcaccatagccaacgccgtccgcacgcgacaacgcgcgccccggggggacccccgccatcgaggaccacgcggaccctgggcgccccaaggggacattgacgtaaagctaagcacgcgccacaaagcacgaacggtgatccaccgagggcaaaacgaaacggcgtgagccaccggcaggccgtgccacgccgacccggaagacaggcggcccggcgacgcacaggagcaagcacaacaggga

SEQ ID NO: 490193 - DNA, 429 bp, Homo sapiens
aggttcggcacgcggagagagagagagagagagagagagagagagagagagagagagagagagagagagatagagtagagcgagtgcgtgagcgatagcgagagtgctatagttcgtgcctctgacctatacctctcatccctctcttttacttactctccatctctttcctctcactcgttccctttcccccctccctttctcctcccctctttccatgcgctttcacttgctctccactcctctcctcctcctctccctcctctccctctctctgcccttcttcccctgttgctccgttttttccctctttagctcatacctttgcctccactcacctcctcttttacctctccttcctttccccttcctcctatctattacctctcatgctcttttcttcccttgctctttttttcctctctcccc

SEQ ID NO: 490194 - DNA, 351 bp, Homo sapiens
ggtcgactgatcatgtccttcttgcggtcgacgatacgcacgaagccgtccgggtcgatcaccgcgatatcgccggtcttgaaccagccctcggcatccagcacctgttccgtggcctcgacctgctgccagtagcccttcatgacctgcggccccttgatacacaactcgccacgctcgcccaacggctgctcgaccccgttgtcgtcaatgaccttcaaggccgtaccgggcactggcaaacccaccgtgcccagcttgcccttgtcgccataggggttggtgcaggcgatcggcgacgtctcggtcagcccgtagccttcggttgatgcggcaacccggtgaagtttg

SEQ ID NO: 490195 - DNA, 449 bp, Homo sapiens
  misc_feature (6)..(6): n is a, c, g, or t
  misc_feature (240)..(240): n is a, c, g, or t
  misc_feature (254)..(254): n is a, c, g, or t
  misc_feature (327)..(327): n is a, c, g, or t
  misc_feature (334)..(334): n is a, c, g, or t
  misc_feature (393)..(393): n is a, c, g, or t
  misc_feature (415)..(415): n is a, c, g, or t
cgccantccctcacatgtacttggtccaactgtaggtgactggttatcacatcttcactggcccctgtggccgtgcatgtagtaggggaggcttcagtcagcccctcactgtggtccaagaatgccacacacctttccgtagatatgccgatggtaattatcttttcttttggcttaatccgatttggtttggtttttccctttccctggattctttcctaccttcttcaggctgtcaanaccgggaaaagganacacagtgggagggaatcataaggaagaaacaagccgtctggcaggcaatggcaagaaaagttcctgttaaanatttaanctggcttcccttgttcaattggttccaagaagatgggttgttggaagaaacggcttaantgtaaggatcctctccgaatgnagcctgtgtaatcctgttacaggtttgtgttggt

SEQ ID NO: 490196 - DNA, 832 bp, Homo sapiens
  misc_feature (29)..(29): n is a, c, g, or t
  misc_feature (774)..(774): n is a, c, g, or t
ttttagggtttacgttctaaacatgttanctgggctgaccggagtactttcgcgaatgaacagtctagaaatcatatacctagaggaactttgcagcttgcaggagctgtaatatcacccagcgatgaggattctcacaccttcactgtaaacgctgccagtggggaacaatataaactcagagctacagatgcaaaagagcgaccgcactgggttagcagacttcatattttttctcagcatcatactgaagctattggaaagaatcctcctcctctgaagtcacagagcttctcacttgcatctagtagtaattctcctatatcgcagaggagagcatgtgataatgccctttcttttcttaatgttggacattccaaactgcgatcactgttcccaagaactaatctacctccagacccacttttgggactgtgagacttggagtcccattctctaggccctcctacacactttaattcgtggaatggaatgccttcctcttttcgcccccccttactccctccggctcgggacgctcttattgctcctcgtcttctcttcatgggcaactcttacctgttctaaaacgcccgccttccttttctctccatctaccttccctgcaccgtgataccataccggctccattcgccttcctgcacccaatacttcgctcttctctcccccaccttcccatgatctcttctgttcaatcctgtctccactttatcgtcctctaaccattacctctctgctcttcggttgttgttntcgttgtgccgttctcttcccactcatcacaatatttcacatcacgcaatctacacat

SEQ ID NO: 490197 - DNA, 229 bp, Homo sapiens
ttggggaatgataaacgcagccagatatttaccctgcgcgttatgcggtatcttacgccgctgcttaaaggagaatgctatgtccgcccagaaaccggggttgcatccgcgcaaccgtcatcacagccgctacgatctcgccacgctttgtcaggtcaatcctgaactgaggcaattccttacgcttacacccgccgggagcaaagctagactttgccaatccgctggg

SEQ ID NO: 490198 - DNA, 148 bp, Homo sapiens
gcggtcatatgactgatacatttcacgctggtcggcacccacggtctgcacgttcgctggcctgctgtggatggcggtgatgatgtatcaggtcaataagcacggcctgaccaacaccaacaagacccgcctgagctgcctgagcctg

SEQ ID NO: 490199 - DNA, 177 bp, Homo sapiens
ggaggggctggggggatcccagcagggggagggcatccttctaccccagttgcccaaacagtccccccacccctggggattttccttctccctccatccctttggacgggttctgggcctttccaaacttgcttttgatctttttggattcctcttggggcttgaaggcagacccaa

SEQ ID NO: 490200 - DNA, 335 bp, Homo sapiens
  misc_feature (22)..(22): n is a, c, g, or t
  misc_feature (76)..(76): n is a, c, g, or t
  misc_feature (215)..(215): n is a, c, g, or t
  misc_feature (232)..(232): n is a, c, g, or t
  misc_feature (299)..(299): n is a, c, g, or t
aaaaatgagtattacataattntttttagacagttatccttggctacaaggatgaataacatgggtggtgccagtncaagattggacaggcagttgttggacagatggccatgcaggaatttgttttgttttgttttgtttgagagagtctcgtcgctctgtcaccgaggctggagtgcaatggtgcgatcttagctcactgcaacctccgcctnctgggttcaagcaattntcctgcctcagcctcccaagtagctggggattttcaggcatgcaccaccatggcccgggttaaattnttggtaattttccagtagagaatggggtttcgccat

SEQ ID NO: 490201 - DNA, 98 bp, Homo sapiens
caatctcagatgatcagtatccactgttctcaggtctacttgctatgtacatcatgaaactgaatagaatcataataattgatgatttgaagttatcg

SEQ ID NO: 490202 - DNA, 237 bp, Homo sapiens
aggtacgtgggtgttgagctcgaacgctatcttaattcggtggctgcttttagccctactctgggtgttaccacttatttactctactctacacggttttttcctagtgtccacagagctgttcctctttggactcacagttaaatttacacggggctttagagggttctgtgggtcacctttcacagttgaacctacagacttctacttttggaccacccagactactcaccacgg

SEQ ID NO: 490203 - DNA, 491 bp, Homo sapiens
ccccaaaattttttaaatggaaaaattgttaaaatttgggttgggccccccaataataaagggggacccaaaaaggttctctttttccccccccccccttggggcaaaggggggtgtttttaaaccaagggcgccccaaaaaaaaacagggtttttttcccccatttaggggggggccccccttttcccaacgggtttttaaatggggcccccccaaggggtttttggaaaggaaacaaaggatttttttttttccccaaaaaaggcgggcccttttttttaactttccaaaagggttttccccggggccccaacttggggttcctttttgggaaaaaaaaaaagggccccccccccgccctttaaatttccgttttttttaagggcaaaacccctttttttttttgaaaccttgggaaaaaccccttttttcccattcccgggggtttttaattttgaaattttaaattaaaacccaaccccccaaccca

SEQ ID NO: 490204 - DNA, 355 bp, Homo sapiens
gggagacagagacccagagagagagagagagagacagagacccagagagggaaacagggacccagagagagggagacaaagacccagagaaagagggaaacagagacccagagagagagagacggttacagagacctggagagatagacagggacccagagagagggagacagacagcctgacagctgcgagagcgacacccacacttatcgacggctacacacatagactgctactgatgactagtacctagcctggaacatcatttgcagggagccccacaactataaacattgacgattccttctctgagcacaggcagctttctagaagtttcccttcctccatccagtct

SEQ ID NO: 490205 - DNA, 156 bp, Homo sapiens
aatgcagcattcagcaccacccgtgcagagagcttgactcacataacaggaagccctggggctcattccatgtacacatattgccacacggtatcccatgtactaggctagcatatatagtagctccacaagggaaggcctctgcaatgctccaaa

SEQ ID NO: 490206 - DNA, 123 bp, Homo sapiens
tctaagatcgtcatgagcgatgaaagtggttggttaacgtcggaattgcatctgttttaagctaatgaggggcagctcatgagtgcagacgtcttgtgatgtaattattatacgaatgggggc

SEQ ID NO: 490207 - DNA, 254 bp, Homo sapiens
ctgctataactaataataatttagaaagtgttaaaatccacctagaatttattttgggtgtgatgtgtgattcaaattattttattctcaagttagcccgttattcaaacactaaaatatggaaaaaggcatcctaagccgggtgcaggggctcacaccagcacttggggaggccaacgcaggcggatcacccgaggtggggagttcaagaccagccggaccaacatggagaataataataagccgagatcgca

SEQ ID NO: 490208 - DNA, 281 bp, Homo sapiens
ttgcaccggtggcaacgagcatttcaaacagagccatcgcgattcacggcttcatcagcccctgtgaacctgcaggtggcctgcgagtgcaggaggagcctaatcagcccgtgtggctcccagcctcatgcactatgatccatgaagaaagaggagacataaaccacaccaactcccgaggccggggcggcacaggcagtgacccaagacagcccgatagcttaggccccgactggctcctaggaagccccacttaatatcccaccgatccttagcctaga

SEQ ID NO: 490209 - DNA, 102 bp, Homo sapiens
  misc_feature (29)..(29): n is a, c, g, or t
attcaatatgcgtggtggaaatttcagangaggagcccctgggaatcggggcggatataataggaggggcaacatgcacagagagtgtggcggtggaggaag

SEQ ID NO: 490210 - DNA, 279 bp, Homo sapiens
cccccccccccccctttttttttcccccccgggggtattttttaagggggggggggggggtttcccccaaaaattttcccccggggggtatggggggggggccccccaaattttttttccaggagcttttgggggtcccccccccccccccggaaaaaaaaatcccccccccccaggggttccccccccccccccccccaattttggggggccccaaaaggggtttttttttttttttttcccttcccaaaaggttttttaatgggggggcgtttttta

SEQ ID NO: 490211 - DNA, 211 bp, Homo sapiens
tactggtgtattcactcgccacacgcccggctagttttttatattttagtagagatgggatttcaccatgttggccaggctggtctcgaactcctgacctcagatgatccacccgccttggcctcccaaagtgctgggattataggcgtgagccactgcgtccagccggcagcacccctttctttcggagtggcgagtgaaattacggcca

SEQ ID NO: 490212 - DNA, 276 bp, Homo sapiens
caactgcaagcgcggaagatagagtgcctctaaaactcgggcatgtgggaaagtctagtagatgttacaaattttaggctttaaagtttttattctcttaacaatgagaggatgagttagcttagatctttttggacgaccacctcccatttactatctgttaaatgttaaatgtgaaattcctaacagttccacttcagacaaattattcctacagaaatgctcactagagtaggtaaagatatatgcatgaagatgtacaagaattagcaattg

SEQ ID NO: 490213 - DNA, 393 bp, Homo sapiens
  misc_feature (7)..(7): n is a, c, g, or t
tatcagnaccaggatttcttcccaatccaaataaagaatatgatcaggagttacaccgggcttattttaaattaaaatatttttacatggggttccttattgaaaaatcaggggattagtcataaaacccccctcataagaataattgaaccataaagtttgctttcagaagcaggtttccaattaaaatctcatttccatttaaaacggtttcagtcctttggtaaaaatttcccttttcaaggaaggttaaatatctgcatttatcttttttcccaggttttctaaaaccaaaggtattttttaaaattcagggagatataggataaaataatgctttgagaagaatggttaatagaaaattaaaataaccttttttggccaaaaaaaaaa

SEQ ID NO: 490214 - DNA, 449 bp, Homo sapiens
  misc_feature (36)..(36): n is a, c, g, or t
  misc_feature (44)..(44): n is a, c, g, or t
  misc_feature (105)..(105): n is a, c, g, or t
aaatgagctaagaatgcacccctaaactcccaaccngggtgaanaaggccaaaactctgtcctcaaaacaaaaaaaaacattgttttccatatgcctggggtggnatgggaagagaatgttgagcccaggggattgataattgactgttactttaaaaccaaggccgggcacagtggctcacacctgtaatcccagcactttgggaggccgaggagggaggatcacttgagcctagcagtttgagaccagcctgggcaagagaggggagaccctgtctctacaaaaaaatgtaaaaatcagccaggtgtggtggtatacacgtatagtcccagctgtgtgccagaggctgaggtgggagtattgcttgttcctgggaggtcgaggttgcagtgagccatgatagtgccactattctccagcctgggcaacagagtgagaccttgtctca

SEQ ID NO: 490215 - DNA, 643 bp, Homo sapiens
tacccccctaatggaatccattaactgagtgagtcttctgatacagcagtggacagcacaaaaagaataaattagttgacaggcaagatacctttttttattaaattttttttatttccataggttattggggaacaggtggtatttggttacatgagtaggttctttagtggtgacttgtgagattttggtgcacccatcacccgagcagcatacactgcacccaatttgtggtcttttatccctcacacccttcccactttctccccaagttcccaaagcccattgtatctttctttcttatgcctttgcatcctcacagcttagctcccacatatgagtgagaacataccatgtttggttttccattcctgagatacttcacttagaataatagtctccaatctcatccaggtcactgtgagtgccattaattcattccttcttacagttgagtagtattccatcatactttctttgcactgtttatccactcgtttattgatgcgcatttgggttggttccatgtttttgccattgcaaattgtgctgctataaacatgcgtgtgccagtatctttttcatatgacgacttcattttctctgggtagatacccagtgggattgctggatcaatgatagt

SEQ ID NO: 490216 - DNA, 290 bp, Homo sapiens
tgatgctacggtctgtctgaggatcccctggtggaacgacgtgaccggggccaggctatcatcacgcaagtgcttaacatctggggcctgattttggggctcttcatgagcattctgtcatcatcatcccagtgttggtcgtccaggcccagcgatagatcaggaggcatccattgaggccaggagctctgcccgtgacctgtatcccacgtactctatcttccattcctcggcctgccccagaaggcaggagctctgcccttgacctgtattccacttactccaactag

SEQ ID NO: 490217 - DNA, 412 bp, Homo sapiens
gttctaaatccagtgctgatatcagatacaagctcaaggacaatcttttcgaaggcttataccagtttgtgtgaggctagcatgaggtgtgtgcatttgccaggttgaaatttctattctcaattagcccatgcagcaaatgctacgcaatctgctgagtccgtctagaagcatttgctgtgtcactgatggatgggtgcctgactcgtcgtactccgtgcttgctagtccacatctgctggaagtgtggacagttgagtccaggatggatgaccagcgatctaaaccgagtactagcgctcatgggcatgcgatgatcttgatcttcatggtgctgggctgcgaagccgtgtgatctccttctgcatacagtcgggaatgcccggatacatggtggtgccgcccgacagca

SEQ ID NO: 490218 - DNA, 423 bp, Homo sapiens
  misc_feature (81)..(81): n is a, c, g, or t
  misc_feature (133)..(133): n is a, c, g, or t
  misc_feature (201)..(201): n is a, c, g, or t
  misc_feature (289)..(289): n is a, c, g, or t
  misc_feature (302)..(302): n is a, c, g, or t
  misc_feature (307)..(307): n is a, c, g, or t
  misc_feature (311)..(311): n is a, c, g, or t
tgtgggttgtatggtgaattatcaaacctgaggacgtggtgggaacctccaaatttgcagccagttggtgaaaagtacatncggtctgtggacacccaagcttgcagctgcatctgaagcgagggcagcctancgggggctggtggccttaacctgtggcatttgatgtaacatcagggagttgacatcagaattacgtcncacaggccaggtgcagtggctcatgcttataatcccagcaattagaaaggcaagataagaagattgcttgagcttgagtctgagcccncagtgagctatgnccgcnccantgcactccagcctgggagacagagcgagactgtctccaaaacaaacaaacaaacaaacaaacaaaaaaaccctgtagcttgggatcagccttctcttctgttgtttttcttt

SEQ ID NO: 490219 - DNA, 1492 bp, Homo sapiens
ggggaggcgtcctattcacacttgtgcagctccagggctcttgctcgtggcatggccaggtgtagggcccggggcgtactgggtcctctgcgagactagggcgcgagcatgtgcgtgcagctgggggtccctcgagtgggtggtgctgctctgtcgactggggtcccttgtctggacggaagatggggtgcatcgtgtcgatcgtatggagggcgtgctccggtgttctgcctccgcaccatttcctcgcccggtaatgtcgtccctggcgaatccccggaagaacaatcaaggaggacgtctcgaagagcatgacaaccctagtatgtcaccgtataaattgcggaaaccagagtgcacgtggggaaccaagagtggcctggaagcgcgattcagaggaagaggccgcacttctcggttgcgactactccactagtgggaaagaggggaactacggaaagtcccaaggggggcccttcctttgggaagtagggtggggggcctatggcatcattgagtgctcgattcaacgaccaattggccccccccggaggacccggcgttggacactacggtgcacaattccttgggggtaacgacttcgtgggctatctaggtgtgaggccgttgacccacatggaattgaccgccacgagaacttaggggattgaaggattcacgtacaaaataccacatacccggttggtcccccggcaaagcctaaaggacatcggtagacgtttacccgtgccccggttcgtgtgctctgggtgaccacccaatgtggtaagagcaccgaagggttccaagggcgccttggaagatggagacccaccaaccttatgggattaccaattcttcgaagttgaccaattctgtatgcaagaccgaaggcaaaagaggcgatcttgcatccatcggtgcggcacacacatgtgcgccaccgatatggcgtgtacacccacttagggggcagtacgtatccccgaaagaggttataaccatttcgaacaatcttaaacactgcgctaccctatgtgacacactccctagggacccccccatgacgcgacaaaataacacacaccaatttacacgccaagaacccacttttggggcaccgcgtgcaaacacgaacatgataccagaggcccacaggtgggtgcctcctcaagcacacggcaaccccgcaaggcaacaccacaaggcgacaggacactacgccagatgggcaaaaacccgcctaaggtagcgaaagcaccccaaacaatgggcacacagaggccaacaccccccccccaagaaaaaaagaaccgaaaggagaacaccccaccccgaaaacgcgggccggcccccccaacaaacaaaacaaacgggcgcaccatggtgaccccccatcgtagtaagacaccacagaagaagacaacaccccccccataggggcacagacaacatcgcccgcacagcacaacgcgacctaccccgcaacaat

SEQ ID NO: 490220 - DNA, 304 bp, Homo sapiens
aaaaattgggcccccccgggggggggctggggctttaatttttttgttaccccaaaaaggggggggatgttggggttccctttggccgaaaccccacccgctggccccgttgggtcctttggggggggcccttggccccccctttccccccccctttcagcccgggggtcccttttgggttttgggggggggccaacaagccaagttggggggtccctttttttccccccccctggaccccttttggcccggccttttccctggtttggaacctggttcctaataaagattttattccccccca

SEQ ID NO: 490221 - DNA, 771 bp, Homo sapiens
ggagtcttcggcgggctcgcgagccgggcgcggcctgctggtttcagacggagtcttactctctctcccggtctggagtgcagtggcgtgatctcgcgtcaatgtaacctccactctcacgggttcaaggggttctcctgcctcagacctcccaagtagctgggaccgcagggatgaacaccatcacggctggctacatataacacgatatatttatgtagagacggggtttagccgtgattgcccgggcctgagatctacacaaatccatggtctacaagctaccatgactcgagtctcacccaaaagctgcgtggagaactcactaagcgcagtgagagaccaacaagacatacccaggacacaagaatcccgaatacgacacaaaatcacaacaccacacaagcataaccactactggcggaagcaacgatccagatgacgagaccacgcacaataccacatacaagccatacataaacgcaacgaacccacagacatagccccataacggccaactatcaccatccacaacggcccggaacgccaggcgtaaacacgagctacaatcataagaaaataacaaccaacaagaaacagcacagacatcaggagggacacccaccgcgagctcacagcgaaacaaccacgaacacagacctacagggcacaaacaacatggcccacccaaggcaaaacgcccagacagaaacacacctaatagaaacaccagccaagacaccaacatacaaggcgccaaacacctggcaa

SEQ ID NO: 490222 - DNA, 202 bp, Homo sapiens
atctagaggacccccggtacgagcggtttgtaagagcggtctgttctcagtgacccagataactgctccagcccccagtggtgtgatgcacccctggacgagcagctgcccaacactgccaaccaccgtgcaggaaccccacagcctaaaaacaccagagcaagctctgcatgaccatgtgaaatctgctaccatcgtggtg

SEQ ID NO: 490223 - DNA, 343 bp, Homo sapiens
taccaggcaaagcatgacacctccctgacgctgggcacagtgactcacacctgtaatcccaacacttctggaggccaaggcaagaggatcgagaccagcctgggcaaaatagaccccatctctggaaaaacaacaacaaaactttccgcgtggtggctcatgcctataatcaataggactttgggaggccgaggtgggaggattgcttgagtccagaagttcaagaccagcctgggcaacatggcaaaaccctatctttacttaaaaaacaaaataaaacacacacacacacacacacaaaaacctagctgggcagagcagcacatgcctgtagtgctcgggt

SEQ ID NO: 490224 - DNA, 1494 bp, Homo sapiens
gcttgtctgtgaaacaaaaaaagtatttattcgagcgcctactatgtgccaggcactcaacaaacaagtatttattagagcgcctactatgtgccaggcactcacacaaaccaagtatttattgcagcgcctcactatgtgccaggcactgttcatagaacccccccccagaagaaaaaacgacaaaaaccaagatagaggcagcaaacaccaacatctgagggagaggcaaacaggggcagttggcagtaagacacggataaagggacaactagagcaagccctgcaggtgcatcggagggcctctcgcccttacaggcctaccctccttacgagcctcctccaccgaacaatcccatacctcctcctctctcgcagagacgcgccatcccacgggaaaaacatggctgaatactcaagacagacacgcacgagacaaacaccaatagatagactccatcacggcacctcaggagagaaaccctcccaaatcacagaccaccaaatgcaccaaacagaacacagagagattaccacagaatgagagagaacagggccccatggtaccggcgcaggcacaaccactcggagcacggagagcaacctggcataccggaccgacttagacagccataggacaacaacagacctccctaggacaagaggctagaagctcacaagcgacccacaatgagaccagggtcgcacatagcacaatactctgaagggcacccaccgcaaaaagacgagggcactaggccggcagacacagggccatggacctcaggaaacaaatctaggtcaggaagacgatatccccaacgatacacaacaaagacaaaagccaagagcaagacaacctcagcgaccaacgacacacgatacaacgacctcgaggacccagaccgcacccctaccaaaaccaaggagccaaactcccgaaccgacaggaacaaaaaccacgacgaccccacgacagaaagcacaatacgaaacccgtgcgcgagacaggaacaacccaggggcacacacgaaccagacctccctagtgggcagtcacaacaaccaggcacgccggcaccaaccaggccaccacgcaaacagacacgaaacacgagcacggacaacacagaccgcggagtcaaaacggagcacacccagcagaactaagacacacacacaagtagaccacggccacccacagccagccacacaacacaaagacaacaagacaaaagccagacaaacagaacacgacgatgcaacaccaccagagtgcggaacaacgtgcaccacacaagcagagcaaagaacaaacaaaagagacaagaaaaaagaagcaccacgcaacagaacgacacaacacaaaacagcgtagcgaacaacgagacagaaaagaacccacacagacagcacaagaacaaacagaaaacacaacaaaacagcagacgcacgccacgtgcccccgcgacccaaacacaccgacaacacgca

SEQ ID NO: 490225 - DNA, 480 bp, Homo sapiens
aaatgggtcgtgttagaacaaaaaccgttaagagagcttctaaggctttgattgagcgttactacccaaagttgactttggactttgagaccaacaagcgtttgacctctgagattgctaccatcccatccaagcgtttgagaaacaagattgctggttacaccacccacttgatgaagagaattcaaaagggtccagttagaggtatttccttcaagttgcaagaggaggagcgtgagagaaaggaccaatacgttccagaagtttctgctttggacttgtctcacaccaagaaccaattggaggttgaccaacaaaccgctgacttggttaagtctttgggtttcgacttgccaatctctgtcattgctgtttcttctcaaagaggtgctgagagacgtttcagaaagagaaactaagcatttttcctatatttttagtctcttctcttctgtaaaaatataatcactggtttaaggt

SEQ ID NO: 490226 - DNA, 955 bp, Homo sapiens
  misc_feature (953)..(954): n is a, c, g, or t
ggtagtggagcgccggtgcttacctgggtgcaggagacagccggagtcgctgggggagctccgagccgcggacgcccgtgaccatgtggaggctgcgtggctcgcgctagtgcgccgctcctgcgggtgcccttgtcagattcctgggcactcctccccgccagtgctggcgtgaagacactgctcccagtaccaagtttgaagataggtttccattcctgaaaaagcctaagcttatgatttattgaaagggcaccacttgtgcctacaaatgtacagaagagaacctaacaatttaagtgacatacggggaccttccactgaggctacggagttgaccagaaggcaatgttgcaatcttgcgcattggtgtggtggctagcctgcattggggccactttgaaatgatgcgctctgacaattcaaccgctctatggaccccaagaacatgttgtgccaatatggatgagtaccagcccctttcaagcccatccactcgcaacacatgtgttgggcatcgcatggggggaggcaacaggtgctattgacactagtgacaacctgtgaaggctggtcgcttgttgtagagatggctgggcgtgtgaatctgacgaagtgcaaggtttccttgaccaggttgtccaaagtaggcttcgcagcagaggtgtgaggcgggggactctagagaggatggaaagatcggaagaagagagtaggaggcagaaccctgggatgtgatgtgaatagcaatggcaactgcgggcataggaggtatgagcattgattggactgaggaatgtggggagttaatgccaagtttatgggtgggaacgttagctgagaagggtgtttgctagtgcagggtgggcaagaaaggcgggaaatgcagtgtggcaaaggtgaaatgaaaacagggggagggaaaaaggagagatttttcctgtggttgtttnng

SEQ ID NO: 490227 - DNA, 452 bp, Homo sapiens
  misc_feature (4)..(4): n is a, c, g, or t
  misc_feature (26)..(26): n is a, c, g, or t
  misc_feature (41)..(41): n is a, c, g, or t
  misc_feature (61)..(61): n is a, c, g, or t
  misc_feature (74)..(74): n is a, c, g, or t
  misc_feature (116)..(116): n is a, c, g, or t
aacncccctgtgtccccccttttgcncccttctgaccccanctccttcacatcacgggaanaatctcctcaaancccaacaaagggcccttaccctctttttccctgccttgaaanccctctgatggtttcatatgtttccttgcaattaaaaaaaatgaaataagtggctgggcgtggtggttcatgccctgtgatccctagcactttgggaggccgaggcaggcagatcacaaggtcaggagatcgagacccatcttggctaacatggtgaaaccctatctctactaaaaaaatacaaaaaattagtcgggcgtggtggcgggtacctgtggtcccagctacttgggaggctgaggcaggagaatggtgtgaacccgagaggcggagcttgcagtgagcctagatagagccactgcactccagcctgggccacagagggagactctgact

SEQ ID NO: 490228 - DNA, 103 bp, Homo sapiens
aggccgggtctgaactgatgggaagaacagggcgcgctagtgaaaatctggcatgaaataaggactaatggccccaaaaaaagggcggcgctgggtaccgagc

SEQ ID NO: 490229 - DNA, 1629 bp, Homo sapiens
  misc_feature (1)..(1): n is a, c, g, or t
  misc_feature (871)..(871): n is a, c, g, or t
  misc_feature (1019)..(1019): n is a, c, g, or t
  misc_feature (1190)..(1190): n is a, c, g, or t
ntcgctcgctacttcattttgttgtgggtgttacgaccgctcctttctcgtccccttgtgtgggccgcgtcagtatagtcctcctttgtgaccgcagccgcatgtatgtcgctgcccggctccctgttgtcgctccgtcggccgtctttgtgatagtgttgtgccccgccccgggttgtcttccctagggcggcttttgatcaacgccgccccgctgcggtgttttaagggtgtcaaatgtggttgtactacggcgccccgtcgcaattttattggggccccgccccttgttatgtctcgctctggggggagaaaagaattcctcagagggcttcataggaaaggtttgtaaaagtcaggagggacggatattgtgtagaaaccttctattgataggaagtattctttgggaaaacccccggtgtctcgcccccccgctgggagagggtggggatcaacccaacgggctctcccccacgaaacataaagtgtaaaacccgttggcgtgtcttctgagtgtgagaaggaaattggatttggcccgcgcattggagttggattgtaacggagggggaattgtatatggaagtgaaaaaggattgtaattgacttggtaactgaaatgaactttttttggaaatggaattgaagcgggagaaagcctgggaaaggaaaataaagcccccccccttgtgaaaaggagaaattctgttagtttcccgcgagattaacgctcccccgcccccttaaaatgggcgcaccccaaaaagcgtcccgcaactctcagagaaatagtgcgaaaaagagaaccctctctctatacacccccatgctgcagtctcggcacacgctctctcaggacttcccacanaaagaggcaccaccagatagattctcgctctccagcagagaacaccaccagagggaataaagacacactctctctgttaagcacccacgcccccaaaagagcggacaccctaaggagtgtctctgtgtgagagagagacacacacctntgatagagacgcacatatataagtcgcacagcccacagagttattatagagaaatatagaggtgggtgttctctctcttctccccccagagatgtggatagcccacagatatctcatctcacatatatatagggtgacagaatatatgcgtttctccgcgtgatagccctngcgcaccacagagagagcgcttatatctcacagaatctctcttgcgcccagatgggaggaagatcttccttttaagaaaaataagtttaaccaccacatattgtttagaaaatatttcccgtctcttatattccatattcctgtacaccagattgataatctggcctgtccctttttataaatagccagagtgaggaactttccccatcccgtgtttgagtaaaatgttgtcccggttcttaattgcccagaaatgtgttgtcccaaaatgcccgtttagtttttaaaagagatggacctccccccctttgcttggttttaaagtatgtatggaatgttatgataggacactagtagtacccgtggtcagacacctggagaatggtggggagacccaaaaataaacaccatgtgaaattaaactccgtattttaataaa

SEQ ID NO: 490230 - DNA, 407 bp, Homo sapiens
gcagaatatcggctaacatgatcgtacatcgagtcgtgatcgatagagcaagcagcaggtgtgtgactgggggctgcatgccctggcaattaaaaacaaaacaggacagggatttacacagtgcttttctatacaatgtctgtaatctatagataacataaccgattaggtcaggggtcgatctttaactaccaggcccagggtgtggcgctgggctgtctgcttgtggatttcatatctgcctttaagtattactctttctttctttggaggcagaaactgggcataagacaatatgaggggtggtctcctcccttagcccaagacaattattcttccaatgtggccagggaaaccaaaaggttaaataccccttaggtgtaaagttaggttgtaaatttgaaatc

SEQ ID NO: 490231 - DNA, 228 bp, Homo sapiens
  misc_feature (6)..(6): n is a, c, g, or t
  misc_feature (36)..(37): n is a, c, g, or t
  misc_feature (39)..(39): n is a, c, g, or t
  misc_feature (42)..(42): n is a, c, g, or t
  misc_feature (44)..(44): n is a, c, g, or t
  misc_feature (46)..(47): n is a, c, g, or t
  misc_feature (68)..(68): n is a, c, g, or t
  misc_feature (78)..(78): n is a, c, g, or t
  misc_feature (97)..(98): n is a, c, g, or t
  misc_feature (101)..(101): n is a, c, g, or t
  misc_feature (103)..(104): n is a, c, g, or t
  misc_feature (125)..(125): n is a, c, g, or t
  misc_feature (221)..(221): n is a, c, g, or t
  misc_feature (226)..(226): n is a, c, g, or t
attatntttaaataacaaaatctttaaaaataatanncnatntncnncttttagccataatgtaaganaataaaattntctagcagaataatcaaanngtngnncaaagttccaacatgtttttnctttgcaattaaacatggcacttttacagttatttattattcatatcagtgcacttaccgacttcatattttcaaatcaaaatacagtgtttttcnccagngg

SEQ ID NO: 490232 - DNA, 626 bp, Homo sapiens
gctcttttcctccttggtctgtctgaagatagatccgccatcatgaacgacaccgtaagctatccgcactagaaagttcatgatccaatccgatctacttcagaggaacacaaatggtcattgatgtccttcaccccgggaaggcgacagatgcctaagacagaaatatcgcggaataaaactagaccaaaatgtacaagaccacaccggatgtcatctttgtatttggattcagaactcattcttggtggtggcaagacaactggctttggcatgatatatgattccctggcattgatgcatagagaagatatgaacgccatacacagtagactttgtccatatggacctaagtggcctgtatgagaagaaaaagacctcaagataaagcaagcgaataaggaacgcaagaacagaatgaagaaagtcagggggatctgtcaagaggccaatgttggtgctggcaaaaagccgaaggagtcaaggtgctgcgatgatgttagctgtggccactgtggattattgcgcaagaacattaataaacctatatagacttctaaatggagaccccattttggctatagacactttctgtcatcgcttcccctacgatccattggaccagt

SEQ ID NO: 490233 - DNA, 124 bp, Homo sapiens
aggtgtctccatggacagagggtgctagctatcctgggggatcttatgggcaatggaggttccttgggagtgcccagatcccctcgttctcatggctgagattgttgactgggagtctcgagcg

SEQ ID NO: 490234 - DNA, 1165 bp, Homo sapiens
ttgtcatttgaaggtgcaactaaaagaaacagaccaaatgtgcaggttggagatctcatctatggccagtttgtggttgctaataaagacatggaaccagagatggtctgtattgacagctgtggacgagccaatggaatgggtgtcattggacaggatggtctgctttctcaaagtgactctgggcttaattagaaagctattagctccagcattgtgcaaatcatacaggcaagtgggaaaactctatccactggagatacgtattccggcaatgaactggacagaatatgggcttacaggcaaaaaccatccagcagcacttcaatctcggcaaacattttacgaagcttgtgaacacatgacgtcagatcaaacgaaaacagcatcttctccagattgggcagcacacgttgaattataggtggacttatttacaggtcagctggaggcaaaaaactactgggtaactcaccgtgaaacctcccccatttaaatactcagcaagcctaagggtgtgcaactgtatgtacttatccagagtccgaaagtataccgcactaagttacatggcttacaccccacagacttttgtgggcagcagcaacaatccattgccacactcatttaaacagcatcggtacacatacaacgtttacttaacacaagcaggtcatacacagggttcaatatcgaaacgcttaagcatccccatttagctaactcggctacagagcacttaaccattacatgtacgctgcgagagtcaagcagagacaaaaatagttacacgcgcattactcacacaggtcacacacaacgcatgcaccacgaacggcaacatgtgcgaatcacctcacgctataacgacacgcacaccggacacctgttcacgacccgggtcgaccccccaaacactgacacgagggacgacacaatagtaatacaacaaacacacaacacatctgcgaaatctaagccaaagatattgcgcacgcggcaagtgatcacaacgcacacagttgatctacagaacatgtcggaagaccaccactatctcctcaatataagggaacctgacacgacccacacatgaaaactggcgacaaaaaagcacaagatgtacaaagagcagagcgaaagaatatcaagaagacgtggaaca

SEQ ID NO: 490235 - DNA, 445 bp, Homo sapiens
attggttgctacgtgggtgttaaggcagtaagagaatatttaaagctgaagagctcaatagtagctgtcaaagcaaggagagtaggatgaaggcaggctactgggacagtggcaaaatggtagtgtaccagaaaatacacacctcaccaaaaaataaatttggttttaaaaattagacaacagttgatcaattcatatggctaaagatgcatagtatgcaggctctttcacacagaaaattaattggatcagaaagcctaaaggaaagatatatcaagcaaatacaaataaaaaggaaacaggagttgcagtcttggtacttaacaagaataccagtatagaatcgagaaagcatttagaatgaggtgaagaaagatgctataagataataaagtccgtcataggaaactttaacatctacctgcagttcccagtgggtcaggtg

SEQ ID NO: 490236 - DNA, 1074 bp, Homo sapiens
caatgccccagcctgttgcttcatcccaccacacatgatgtgcattgattgcacctacatgcctccgtgtgtttctaccctcctccagtgccctcaccagccatggtctaatacgcccgagggactaacgaccgcctagtggaccctacccgtggagccgtgctgaggctcacaacatgcgcgacatgctccgtgtcgtcgcctctccacgtgcatgcatgcacaacacacgcgcgtgcagcagctgccttgacctccgtcatgacgaccccttccgcagcgcgatgcctactagtagccgaccgcgtgctgtcgcccacttgcccgccacccccccctccacccctctcccacagatcctccctccacccacgactctcgcgcctctcaccacttcaactcctcaccactcgcttgcccgttcccctaccctccctctcccttccactccggcatccgtccactcccttcgacccctcgccttgccctctgcattccaccactgaccctcccctacccaactccacccttccacaccccctatcatgagccaaagcccgacccatatagccccccccccgacaatggcgcggaacgacccctaccgacaccacgtcccaacagcgtacccccacacccgcccacctgaccagcctcgaaaccggcagcaatcggggccgcactcacagcaagcacgccgagccgcgccacagccccagaccctcgccacccaacctcgtaccccctatacccacgcacaagtcgcatagcgcccaggttggcgacgcaacccacacccccccgcgtccccagccccaatggcgggcgacccagcgcgcgacccatccatcgacccgaccgcactccgccgcataacgaacggctcccccggctcccccccccttcagacaccgcctgcaccccgtcacacctcgcagcacccgaccttcgcaccgctcgtccctcgggcgcccacacacctccccttgctacgagggcgaatctaccgagcgctgccgccagcggcatcaccagcccgccgttcagaccacagtgtgcggctacgcaaccaca

SEQ ID NO: 490237 - DNA, 328 bp, Homo sapiens
ggtttttttcctcctaggcgggagtgcaggggcacagtcttagctcacggcaacctcgacctcccgggttcaagtgattctccggcctcagcctcccgagtagctgggattacaggctatgcaccaccaactacgcccgggcaaatttttttggtatttttatgtaagagacacgggtttcacacaagttgggccagggctctgtcttcaaatctcctggactctcatggtatctctcctggctctctggctctccacaaagtggctggggtattacagggcttagagccaccggcgcccgggcctggtgtttacaagtattttaatg

SEQ ID NO: 490238 - DNA, 165 bp, Homo sapiens
tacattttctaccccagaaaattacgatagcccttataatacttaagggtcgaaggtggatttagcagttaactgagagtagagtgattagttgaacagggccctgaagcgcgtacacaccgcctgtcaccctccccaagtataattcaaaggacatgtcgacgc

SEQ ID NO: 490239 - DNA, 325 bp, Homo sapiens
ttctgggataacaggcatgaaccagcattttactttcttccaaagtatgttttactttcttctgaagccctacatgactccccattgcctacataagttccctacttggcccttgggaccctcagactggcctcacctgcccactcagtctcagatcacactggccccagccatacagatccgggcccactccgcaggtcatgctgctcccactgcctggaagaccctccccaatttctacctggcagatgcctattctaccctctagacctgctcacatgtcatctcctttttgaggatttccccaacctgggcacaattaggc

SEQ ID NO: 490240 - DNA, 311 bp, Homo sapiens
agctgccccggtaactggacttctggaaatgcgcggtgatatcccgctgtcttcctttccttggctgcttatgtcagttgtcgtggctctaaccagtctcaagtgttcgggtaaaaagaggaactttttatcacagccgtcctgtttctttttttcctttattttttttttggaaagggattcccgctctgtcgcccaggttgaagcaaagtggaaacgggtacaaggagaagcctgagaggtatgtgaaagccacaccttgtaagaaccttctaaagctttggtgagagagctaaagtattatttattcc

SEQ ID NO: 490241 - DNA, 160 bp, Homo sapiens
ccccatctctactaaaaatacgaaaattagccaggcatggtgacgcgcctgtagtcccacctactcgggctgggactacaggtgctcacagtgagccaagattgcacagatgcgctccagcctgggtgatggagtaagactctgtctcaaacaaacaaac

SEQ ID NO: 490242 - DNA, 125 bp, Homo sapiens
  misc_feature (56)..(56): n is a, c, g, or t
taatgcatcaccactaaattttattaaaattcaattcattggtcaaataacagtantctgctcaccctcacaccgtgttaggagactactgttatttgaccaatgaattgacttctaataaaatc

SEQ ID NO: 490243 - DNA, 1212 bp, Homo sapiens
gcagactgccgtggtgcagagagatgctgacattggcgtggccgaggctgaacgggacgcaggcatccgggaagctgacgtgcaagaaggagatgctggatgtgaagttcatggcagacaccaagattgctgactctaagcgagccttcgacgctgcaacaagtcagccttcagtgaggaggttaacatcaagcacagctgaggcccagtcggcctactgagctgcagggggcccgctgcaacagccagaagactccggcaggcaagacgactcgagcactcgagcgcttgctgcacgcgcaagaacacacgacttgcccgtggaggcaccaggagactcctggcgtaccgacaaggcagctcatcgcctacagctgcgccggcactgccgcaggcacgaggcccaccgcaatccacgcagatttgccgagggtgaaaacggtgaacgcaggtcctcttgcgcacaggcagagcgctgagaagatccgcaaaatcgggcgaggcggaagcggcagctcatcgaggcgatgggcaacggccgaggctgagcggatgaagctcaaggcagaagcctaccagaacatacggggatgcagccaacgatggcctggtgctagaggccctgccccagattgctgccaaaatcgctgccccacttatcaacggtcgatgacgcatcgtggtcctcagtcggagaccaccagtcaaggtacacattcagacgttgaaacgactgctgagccgagcttgcctggcctctgtagcatgccctcaacaaggcgtggacctggtctaagataaccctgactcagaaggcaacggctgttgcacagtgctgacgctcctgccaggccactctcttacgaagcaaccggtacctcctacaagacacggaataaatacacagaaacaagggcaaggtcaggaacacgggatgccctttttccgaagcgtgaccacaaatggtagtgagtttataagccaatctagcaaacttaacagaacttcggtatagaccataccatacaacacattatacaagtataaggagaatacatagatagggatgccacacacaggataacagtgtgtgttttacccaaatatcatataacagaaatatataacatcagggaggcacattcattgtatagattatatcatcaagacatagtgtgtatacaatagtagggcaacacacaacataaagag

SEQ ID NO: 490244 - DNA, 846 bp, Homo sapiens
ccccgttcttggtttctctgcttcttcttgctgttgttggtttctggtctgtttgttccacacagacaagtggggtgggcttgaggcagcgacgcgagagagggcctgtgagggtcgccataatactcggctatttccttgtttttcgtcgccgatgatctctcctgtgcgtgaaggctctttatccgcccctggatctgtgtccgttcctctcgtgatggagggtgtgaccactctggcgccggggccactctgggttttttagagtttggggactcagcagcggcctgtctgttgccccccccgttgtgcccgggtatcggggaccgctctctgtggccggccgtcaacctctgttctcctgggcgcccccctcctccggtgccttgaggtgtcgccccccctgggggttcttctcccggtggtttctccgacctcgcttagcctgcacggctcttatgcttctgagcgcattccttttccctgggccactcccgctgaatgggcgcccccagggcgcgctcctggctctccccatcaggtgtcacggagtctcgcttcccacagggggtcttccccggaggagctgttcaaggcggaagactggccccccccctgcccccgcgtcccgcggtcgcccctgtccaccgctgccgccctcagcacccttgtgtaccacaggggccataccccatttcacgactcctcccacctctcgtttttctatccgcctctataccacccctccctcatcgcgagcgtgagctggtagtatatattcatatctagggggggagagaaagagaaaaaaataaagacaaattctgtgggacaatagtcagaaaa

SEQ ID NO: 490245 - DNA, 139 bp, Homo sapiens
gctgagtcctcagcgggtggcggtggacctgttcgcgggaggagatgaccttgccatccgggacctcttccacaagggtacgcaccggacgggtggtcaccggttctttctggtactgagtcaggtgggcatcctctcc

SEQ ID NO: 490246 - DNA, 848 bp, Homo sapiens
  misc_feature (169)..(169): n is a, c, g, or t
  misc_feature (344)..(344): n is a, c, g, or t
agcggagtcgcaggtgtgctgctgaggcgtgagaatggcgtcccgcggtcggcgtcaggagcatgggggacccccagaggtgttatatgacgagacagaagcgccggatacattactgtttcgcgaacattcgaacgagactgatatgataatccaagacgcatgatgngctgggcagagtcgattgggagcgttcttctatactgcgcagaggaataaggcgcctgtgtacctgactggactattggcatgtggtacctgggctgagtggaagttatctgtcagatgaagggcactattgggtgggcctggatatcagaccctggcacatgtctggatgaganatgtgtgagcgagcagatagagggatgatctgtctgctggagggtatatgggccaggtcatcccatgcaatgccaggcgcgattacgatggttggcatcagccatttctgcatgtgcaggggcgtctgtaatgcgtaacgaagaagtctggaataaccgctgcctgagcggcctgtacatgttttcttgcgtatcatctatttattctgtacgtacgtccaggggaatccactgatgctgtccatgctagctgtactccatgtagaacttcagagccagtaggagctgatcacaagcactaaggcaacataaggccaggcattcatcctggtggcatggtggtagactaccgctaacagtgccaaagcaacagaagattctacctctgcttgttgatctagggccttcgacccttatagcagaggggctgacgtgaaagatcaggatgaagttgaacccagaggagtcctgagtgcacgaatgagaggttcccatgaaggatgc

SEQ ID NO: 490247 - DNA, 111 bp, Homo sapiens
tcaccttaccaccagacaaccttagcaaaccatttcccaaataagtataggcgatagaaattgtaacctggcgcaatagatattgtaccccaagggtgaagatgaaaattt

SEQ ID NO: 490248 - DNA, 272 bp, Homo sapiens
aagaaggaggcgccggccatggcagatgccgaaggtggtgatgatgcacctgcgggagcatgatcatgctacccgaaactggtggtcatcatgagtggtggtctacgtcggcaaggagcttcacccaggtggagatcaagcccgagatgatcgggcacgaccatggagcgagtctccattcacctacaagtccgtaaaggatgggcgtgccggccctcggggtcgcccactcctccggtttcatctctctcaagtatagctcagggccgggt

SEQ ID NO: 490249 - DNA, 115 bp, Homo sapiens
  misc_feature (1)..(1): n is a, c, g, or t
  misc_feature (76)..(76): n is a, c, g, or t
ngcaccatagtgcatggtgtgtggtgcccccagggctccaggacagatcaggccccaccgtgtctacccccatccnggctgtgaacgtgccactgaataaagtcggggaaacgtg

SEQ ID NO: 490250 - DNA, 286 bp, Homo sapiens
gctgctgcggtgatctagaggatcccagttccgggtcctccacggtcatcacttaccctggcccttctttttcctcagaacaccggaactttgggtggtattatttggtatctccccactggcatgtaaactcccgggtgacctggcatgtcttatgcaatcctcattaaaacctttttttttttttttttttttttttttttttttttttttttttttttttttttttttttttttttggggtgtgggctatcttcttcaaaaaaaaaggggggacagcgccaaa

SEQ ID NO: 490251 - DNA, 214 bp, Homo sapiens
aagggaatgtagggtgacaaaggggaggtagagttgttagaactgtgtgtattacagtttacagcgtaaggaaaataatcttaagtatgtcttatactgttgtggttgtttgtttatctagccatgaaacaatctcagcatacacttctgatccagcacttctgtcatttgctgaatattactgcaagccaactgtgaacatgggtcaggtata

SEQ ID NO: 490252 - DNA, 306 bp, Homo sapiens
  misc_feature (208)..(208): n is a, c, g, or t
gctgctgcggtgatctagaggatcccagttccgggtcctccacggtcatcacttaccctggcccttctttttcctcagaacaccggaactttgggtggtattatttggtatctccccactggcatgtaaactcccgggtgacctggcatgtcttatgcaatcctcattaaaacctttttttttttttttttttttttttttttttttntttttttttttttttttttttttacaaaaggggagggagtgtaatataggagagatatagagagtagtacaaaacccccccgagaaaaaaaaaaagtg

SEQ ID NO: 490253 - DNA, 176 bp, Homo sapiens
acttgaaggccgcattaccttccgcgacacggactgatacaccgcacgactgtgggcgtggagccggtagccgacgggaaaggtgtcgtggtggtcataaagcggagatacgggcaacggaagcctggcacctcctatggtgcggaccaccatcacacaagaaatgctacgcgcca

SEQ ID NO: 490254 - DNA, 258 bp, Homo sapiens
tgctttgatgctgggcagtccttcccatgcactggtgaggtgttgcatggtgacagcagtcattcagcttctttcacccattgacttctgtttctgtgtcaggtagtcactcagagctaagtgagccttctccaattcagaaccggagagaacagaccatgggttgggatactgcaacttgtttcttgtagtctgtgggcagcaggtcagggtacaggcccatgatgggtgggatttgtgccaagtttagcacagacc

SEQ ID NO: 490255 - DNA, 158 bp, Homo sapiens
ctggctggacacagtggcaccgccgcagcccagaccaagcacaccatcccggacatcgtgaacgtcctgctcgaagagctggtgcaccatcgctacgagctaccaggcttccggacccttgagatggccgctatcggggcgcgcgaacgggtcaacct

SEQ ID NO: 490256 - DNA, 117 bp, Homo sapiens
agaacaggctccagctaaacgatatattggaggtcagcacggtgctcacgtgtcgacggacacttgtacagggaggcatgcaccgaaatggtagaatacacgtcgaccaggctccat

SEQ ID NO: 490257 - DNA, 100 bp, Homo sapiens
gcagcaggcactgtgtaccagagtcaccattctttggtagccgactataatagttctcactgtcagtcccctgactccaatcccaggctatcctccgaga

SEQ ID NO: 490258 - DNA, 958 bp, Homo sapiens
gatatcattagcaggtgacatgagttgcgaaagaacagatgagttcgatatgcagacatggagccaagcgtaaatgaggtatgcatctaagtaacgtctacatatccataggcatgtcagcgaggcgagcgatcaagttgttcaacaagctggtcctgagaatccgtaaacgatacgggctcggtaatactaaggtagccgtgacattctatcccgtgacaagtcatggggatgccaatcgggactatatgtgggtgagccacaataggatggaaataacaacatcgtaacgttgtcgtcagtcacgtaactgctgggcctacaagaacttgtcagtgtaattcaatggagttcagcagattacacgaaagcatagggtgagttctgttactcaatccgtcttcgtaatggtgagaaattctgatggcacgcgacgcgtatgggacatattccatgacacgcgactggagggggaccaagggcggaacggctgaaacgcagtgcagataccttcactattctacttcctaagtgaaggctccttgtgcccctacatcatgcggcaacataagtttcatgctgcacgaaacatgccatagggctcactacaagcatgtactaggtacctgcactatttcacctgttccggaaaaagtatactaaagcatagcgtgaaaacacacatcaaagtttaattatgtagctaagacttagcaacaaatatgctatatatctgttgactggatactctcttatggggcagtgcacattaatgcggtcctctaaacgggcacaatgggggcaaaacccacctcgggtaaagtcgataaatactggatgctgagataagtcttgaataatagcgctgcctgtgggtatttggaagtcctcaactcattctcaaaccccctgaaaaaaatagctaccatttctggtgctatcctaagaagactattat

SEQ ID NO: 490259 - DNA, 221 bp, Homo sapiens
  misc_feature (60)..(60): n is a, c, g, or t
aatgtaaccttttctaaacaagagcagcgtataagacttatcagctctggagctagatanaattcttaccggagcgaggtcagtggctgatatgcgctcactccaactggcagcagagcaagactctgtctcaaaggggaaaaaaaattgctgatgtccctgagggactgatttcccgtgaattgtggactcacacattggtactttggtctgtgtaggcc

SEQ ID NO: 490260 - DNA, 337 bp, Homo sapiens
  misc_feature (148)..(148): n is a, c, g, or t
  misc_feature (215)..(215): n is a, c, g, or t
cggttccatggcggccaaggcggtggtgcgtgacgtggcgcgggtccagggcaagtcttacggcctggccgaccgtctgtcgaagatgatccccttcgaagtcggcatgaccctggaaaaagcctacgagcaggaggagatcctgcgngacttcatcaaggtcgatgaagaggcggcggaaatctgggagatggcgcgcaagctcgagggcgtgntgcgtaacgtcggcaagcacgccgggggtgtggtgatcgcgccgaccaagcttaccgacttctcgccgatctactgcgacgaagaaggcggcggcctggtgacccagttcgacaaggatggc

SEQ ID NO: 490261 - DNA, 404 bp, Homo sapiens
  misc_feature (52)..(52): n is a, c, g, or t
  misc_feature (66)..(66): n is a, c, g, or t
tttgactacggcgaccggttctgggatatcaagagcaagtatttcacctgcnagtgtggctctganaagtgcaagcattcagctgaggccatcgccctggagcagagccgcctggcccgtctggacccccacccggagctgctccctgacctcagctccctgccccccatcaacacctgaggactgttaaaatccaggccgggcactgcccctcagacattcccccatcggaggaccccagtaaggcctggaaggtttacagcccctctcccagagctggtttctcactgggagtgagtgacttcagggctggcctaccccactgagcctggcctcagttcgctcattgaagttgggcctctgccaactgattttctgtgctctcaataaatgttgggtttggt

SEQ ID NO: 490262 - DNA, 967 bp, Homo sapiens
ggcgggaccggcgcgcgctctcgtcgcccccgctgtcccggcggcgccaaccgaatgcgccccgcctgatccgtgtgcgacatgctgcgccgggcgtctgctgtgtgctggccgtggtcgtccctggctgcgcgccgacagccccctgtaggatggacggaccgagcgtgctgcgtgctgcggaacaatgcaggcttcgcggaggcgtctggctggcccacaaggtacccctgctttgtggagttcgtatgcctccttgcgtgtggaccacctgctagagggctctggccccttgcagtattgctcataggccgcatggggacagctgaacggccagaacggttcctgaggattcaggaggttagtggccaaaaggggttgggaagcgggcgcaactagcgaacgcggactggtctttgaacccttgtggctccacggcagataaccgagcagttgacggcgaggcataattacgccagcacattcaaaggatagcgtatcaaggcggaaaattgcggaaggaaccagaccagggcgctttcctctctcccccaacatgggggcacagcttacttaccaacggcgttgggccaacggacggaaagagcgctgagtagcaccgattccgttgatagcttacggccttggaggagaaaagtcggccaaccggggcacccccgtggcagttgggcaaaacccaagcgcacttgggcgtctttgcaactcgggtcggtcaaaagcctttgcctagggaaaggtcccccttttggagtcggcgaaagcatcccaaaggcatgaaagcgcttggggccttggtgccaatcccgggcccttatcattttctcaagggggaacccgttgtgcaacggttccgggaccttccgttgacccgaagggccagagttgttccatggccaaggggtccaaagcatacatgtggcccactccagactggagccattaccct

SEQ ID NO: 490263 - DNA, 942 bp, Homo sapiens
  misc_feature (54)..(54): n is a, c, g, or t
  misc_feature (61)..(61): n is a, c, g, or t
  misc_feature (75)..(77): n is a, c, g, or t
  misc_feature (191)..(191): n is a, c, g, or t
  misc_feature (205)..(205): n is a, c, g, or t
  misc_feature (256)..(256): n is a, c, g, or t
  misc_feature (298)..(298): n is a, c, g, or t
  misc_feature (312)..(312): n is a, c, g, or t
  misc_feature (432)..(432): n is a, c, g, or t
  misc_feature (499)..(499): n is a, c, g, or t
  misc_feature (585)..(585): n is a, c, g, or t
  misc_feature (594)..(594): n is a, c, g, or t
  misc_feature (596)..(596): n is a, c, g, or t
  misc_feature (608)..(608): n is a, c, g, or t
  misc_feature (617)..(617): n is a, c, g, or t
  misc_feature (628)..(628): n is a, c, g, or t
  misc_feature (670)..(670): n is a, c, g, or t
  misc_feature (732)..(732): n is a, c, g, or t
  misc_feature (809)..(809): n is a, c, g, or t
  misc_feature (811)..(811): n is a, c, g, or t
  misc_feature (822)..(822): n is a, c, g, or t
  misc_feature (835)..(835): n is a, c, g, or t
  misc_feature (840)..(840): n is a, c, g, or t
  misc_feature (852)..(852): n is a, c, g, or t
  misc_feature (883)..(883): n is a, c, g, or t
  misc_feature (891)..(891): n is a, c, g, or t
  misc_feature (893)..(893): n is a, c, g, or t
  misc_feature (929)..(929): n is a, c, g, or t
  misc_feature (941)..(941): n is a, c, g, or t
aaagaagacccgaagccccgcacccccccgagaaagaaaaaccaaaaaaaagcnagggccnaaaagaaagacaannnaacccccacaccccaaaaacccgaaacgaaggacgccccccccacaccaaaaaaaaagagaaggcaaaaaaagcaaaaaccaaaaaagaacgcaaccaagaaaaaaaaaaacancccgacaacaaagnaaacgaaaccacacacaacaccagcccacaaaacccaaaaaacagcccccncccgagccaggaaccaccccaaaaacccacccccaacccganacacacccagcaangcagagccccgaacaaaaccaccaaaaccgcaccaaaaacacgccaacccgaagaaccaccacccaccccgccaacaaagaaacgaagaacacgaaccacccagcaccaacaacccgcanccccccaaccacaacccgcaccgccccacaacgaacaacccaacaaaaaaaccagaaaagaaagaanagaacccccgccgccgcaccggccgcagcccccaacaaaaaccgagaccccagcccccccgaaagcccaaaaccgaaaaccaacgnaacaccaanancaaaccccaggnagcgcgagncgcccccaaanaaaaaaagcaaaacccaacaacaccagcccacccgcccaaancccccagcgaaagagaaaacgagcgcaaaccccccaaaacccaaaaaaaaagagaccggcancgacaccgaccgaaccggcgaaagccaccacaaaagccacaagaaacaaagccacaaccacaaccaccgcagccaananccccaacgcgnaacccacaaccanaaccnccaccaaagcancaagcaacccaaacgcgcccgccaagacgancaacgcancnccaaaaacaacgcagcaacaaaaaaacccccagcancacccacccccng

SEQ ID NO: 490264 - DNA, 113 bp, Homo sapiens
attcatggacgggatctatgtaccccattcgtacctcgtcgggttgtacacgtccacctcagcggagtcatccctaacaaagtacataagtccgtatatagagtcgcagcctt

SEQ ID NO: 490265 - DNA, 138 bp, Homo sapiens
cggggttggggaggcaccaaagggttacagcccaggagtcacttgttggtgttcttcttgtcacaagttttcaggtcagtactgggaggcttgttgccgtttcctgatctccggccttctgatgggaggcaagatgcg

SEQ ID NO: 490266 - DNA, 588 bp, Homo sapiens
gcccaagatagtttaagggggttcgagacatgaagcagcattcatggaggtttgaagatgccgcatttggattggatgaattccaaattctgcttgcttgctttttaatattgaaaggcttatacccctaccctttatgcccaaaatggagggttataataatgttaacatggacatgattttctttataattttactttgagggctgtctccatgtttgatggatttgagcaggttgctccccaggtagctttaggagggctggcaacttaaaggtggggagcaaagaatttttttatcccacatcaacattttggtcagatttgaacttttcaattttttgccctcaaagcttgttaaaatagttaagggggcataagttaacttcccatttacaaactctgcttagaatttggggggaaatttagaaaaataattgcccggattattgggaatttgttataatgaatgaaaccttttgtcaaataagattcaaatttactttttaaacatttgataaagtaaggcaggggtgggggtaatttggtttatttttgttcccccagttaaataaatcataaaacttga

SEQ ID NO: 490267 - DNA, 265 bp, Homo sapiens
gctctaaatacttttttccgataaaagaaccaagatttccttggagaaaatggctggtccaggacaggagagggaaaaacgcaagatgtggcccggagcaatttgtggccaaatgctcagaaaattatggggatatatcagaaggacacagcagccaaactgaaggggctcccagtggccaagtatgggatgatttgagcttaaaataaatgatagtgatgaattattcgacacttacttttgcagcaaccgtcgtgggtaccga

SEQ ID NO: 490268 - DNA, 753 bp, Homo sapiens
gaataattctgtatataaacagtggaggtggataaatctatcttcttttatagtcctatctcgtccctctttctctccctctaccatttcccctgtcctcctcgtttctcccgtgttcccccggccccatatagattttgtatattctgtactgtgacacattctggatagtattttcatccagtttttagttcattagttctttcttcaggctatgtccagtatatggttaaacatgaccattgcatttaaatttacttgtgtatgatccagttaaacagacttttataactggttccaaaccactatgacttgtgagatactgaggtttcaacggttatgcatattggtctgttaacaatggccaatgacatttattatctatggcttgacttattgccatatctgaaagtcttaaatagcggtctgataatcctgtagagtacggataattatgcatgttatcctgtctctgggtggcctttaaccatttaactcttggcacagcctttacttacttcacgtagtagtggctgtagaaagagtgggcagttgtggagaaaggttagtgttggctagaaaagcaaagtaccgtgataacaagaacacaggaggttatcatatccgcactcgagaaacaggaacatttcgtgggttggaagctttcgtggtccaaggtatggccaatgggtgttaccccgacataggttcaaagggaacataatttctaaaatccaagtggttctagtgata

SEQ ID NO: 490269 - DNA, 203 bp, Homo sapiens
  misc_feature (43)..(43): n is a, c, g, or t
atcatcagtggcgtatggcggcacgcagactacagcctggaancctttagtgagaagcagcaccccaggtgagctgtacctgacggacccttggactcagatgaagagcggccctgtcccgcaccccgcaggactgtgtcacatatgcgtggcattcatcaggcagtgaatgtgcgaagaagtaacttagctctgcaccccca

SEQ ID NO: 490270 - DNA, 95 bp, Homo sapiens
gtcagcctcctgagctgggatacaggcatgcacacacgcccagctaatttttttatttttacttgagaacgaacgggttttgccatggtttggcc

SEQ ID NO: 490271 - DNA, 139 bp, Homo sapiens
gactcggccccaccacaccgtgcctgcagtcttacttgagcatctgcctcaggaagcagtttagggtgaacaggaaggcctgggttttccagttcaggccttatccgtcgccacacgtgccacacaccacaaaacaaaa

SEQ ID NO: 490272 - DNA, 297 bp, Homo sapiens
agagcagcagcagcgggaagaaaagtctaaaacggaaagccgctgccgaagaacttcaggaggctgcaggcgctggggatggggcgaccgaaaacggggtccaacccccgaaagcatctggcttcccgtcagtctatagaataccgtagataaaaaacatacattcgccactcttaacgttcacgcgctgtaaccaggggacgtgcatggcaaagctgtccgctaaggaaaaacttcgagaagacatagcggatcttgtctaaaaggttccaccaaagcctgtacccatgaccattg

SEQ ID NO: 490273 - DNA, 724 bp, Homo sapiens
  misc_feature (127)..(127): n is a, c, g, or t
  misc_feature (130)..(130): n is a, c, g, or t
  misc_feature (190)..(190): n is a, c, g, or t
  misc_feature (200)..(200): n is a, c, g, or t
  misc_feature (211)..(211): n is a, c, g, or t
  misc_feature (214)..(214): n is a, c, g, or t
  misc_feature (216)..(216): n is a, c, g, or t
  misc_feature (218)..(218): n is a, c, g, or t
  misc_feature (353)..(353): n is a, c, g, or t
  misc_feature (525)..(525): n is a, c, g, or t
  misc_feature (617)..(617): n is a, c, g, or t
  misc_feature (644)..(644): n is a, c, g, or t
  misc_feature (649)..(649): n is a, c, g, or t
  misc_feature (655)..(655): n is a, c, g, or t
  misc_feature (660)..(661): n is a, c, g, or t
  misc_feature (667)..(667): n is a, c, g, or t
  misc_feature (671)..(671): n is a, c, g, or t
  misc_feature (673)..(673): n is a, c, g, or t
  misc_feature (677)..(677): n is a, c, g, or t
gccagtctgttgtgggcattgttttctacaaccaaatctgggtttttattcgtctattctggtaaacatagaggtaccaccacaagggatgcccgtactctctcgcagcatcttgtaaagcatctgnttngagggaaaggtctctgggcaagcaagtggttatttggattgctgcttcccttttccaccngggacattgnaatcataaatnacngnanattccaaacctcaaaaactattatggcctgagcacagctgaaatctagcagagtttaactcttctgcctccatgtctgtcacttataattcaggttctgctgttggcttcagaacatgagcagaagaatcgtttnatgctagttattgcattcatggttgaaactcaacttagggaaagggttccaatgtattaagcaatgggctgcttctccccaatcctccctaacaattcgttgtgtggacttctcatctaaaaggttagtggcttttgcttgggatcagtgctcttctattgatagttcttgntggtctccagacacattcctgttgcattaagacttgaaagacttgtagatgtgtgatgttcaggcacaggatgctgaaagctatgttactanttcttagtttgtaaatgtccttttganaccancatctngtttnnttttgnaggnanaaanaaaacacctgttgaccataaataataaactcgagactagttctctcc

SEQ ID NO: 490274 - DNA, 562 bp, Homo sapiens
  misc_feature (127)..(127): n is a, c, g, or t
  misc_feature (130)..(130): n is a, c, g, or t
  misc_feature (190)..(190): n is a, c, g, or t
  misc_feature (200)..(200): n is a, c, g, or t
  misc_feature (211)..(211): n is a, c, g, or t
  misc_feature (214)..(214): n is a, c, g, or t
  misc_feature (216)..(216): n is a, c, g, or t
  misc_feature (218)..(218): n is a, c, g, or t
  misc_feature (353)..(353): n is a, c, g, or t
gccagtctgttgtgggcattgttttctacaaccaaatctgggtttttattcgtctattctggtaaacatagaggtaccaccacaagggatgcccgtactctctcgcagcatcttgtaaagcatctgnttngagggaaaggtctctgggcaagcaagtggttatttggattgctgcttcccttttccaccngggacattgnaatcataaatnacngnanattccaaacctcaaaaactattatggcctgagcacagctgaaatctagcagagtttaactcttctgcctccatgtctgtcacttataattcaggttctgctgttggcttcagaacatgagcagaagaatcgtttnatgctagttattgcattcatggttgaaactcaacttagggaaagggttccaatgtattaagcaatgggctgcttctccccaatcctccctaacaattcgttgtgtggacttctcatctaaaaggttagtagcgttagcgtcgggattccgctgcgtctgtctaacgaccgtccgcgtatccccaatacacaggtcactgctgtctcctt

SEQ ID NO: 490275 - DNA, 253 bp, Homo sapiens
tgggcataagagctctgtctgtttgttacattttgtttctcctagtctcctctcgtattcagatcgagtaactactactgttcagttttcatcatatgctatcctcctattctatgtcaggtaatgctgtcatctaagttttggcacctattgattatcttttgcattgtttttgtttttgtttctatttttgttttgagatggagtcttgctctgttgcccaggttggagtagctcttatggcccaggctgg

SEQ ID NO: 490276 - DNA, 623 bp, Homo sapiens
  misc_feature (110)..(110): n is a, c, g, or t
  misc_feature (117)..(118): n is a, c, g, or t
  misc_feature (125)..(126): n is a, c, g, or t
  misc_feature (140)..(140): n is a, c, g, or t
  misc_feature (152)..(152): n is a, c, g, or t
  misc_feature (161)..(161): n is a, c, g, or t
  misc_feature (172)..(172): n is a, c, g, or t
  misc_feature (200)..(201): n is a, c, g, or t
  misc_feature (300)..(300): n is a, c, g, or t
gcgagcggctgcagctgcaggatgaggaagacgacagcctgtgtcgcatctgcatggatgccgtcatcgactgtgtcctactggagtgtgggcacatggcgttacctggncaccaanngtgcggnncaagcgctatgagntgacgtgtcccnatctgccgngcagtatgtgngtgcgagccgtgcagcgtgttcatagtnncctgaaacagtgctcccgctcgaccaggtacaaggtcaaccccggcgaaaacttgaaaccccccctaaaaagcaatttgtccagaatgcgccaacaganaacaggcgcacctggcgacacagctttcacttgcttttccaaaaaaagggcgggccttgggcacaaaggccgtttacttttttcttacacacaaccactctaaacttcttcgggaacctttaaaccttttaacacccgcgcttggggcgcggcgggaaaacactaagggcgaaaaaccacacggccaagtttcgccaagatttccccgtttgagaaggtatttgcgtctaggcggccccacaaagcccaatttttgggcgcgagctttccgccgaaattggccccccggggattgggaaaggggccccatttgggttcccttg

SEQ ID NO: 490277 - DNA, 193 bp, Homo sapiens
atcatcagcaacgagcactgcagtgctcagcgagatctcgcgttgtctctgtccatatgtgctatagacctacagaaccgtgccaaaccagatgacttaccatctgtgacacaggacctgttagaaacattatcttgaccaggactaccgatagggcatcacacacgagtgcgggccatacacagtgtgggtc

SEQ ID NO: 490278 - DNA, 373 bp, Homo sapiens
aggaggagccctacggtctttcaggatcagagctgcgctgctgaccttggccgtgctcttcctgacgcgaagtcacgcttgacatttctggcagcaagatgaacccctccagagcccatgtgatcgagtgaaggacctggacactgtgaacgtggatgagctcaaagacagtggccgatactatgtgccccaacttgaacgcttcgacttgggcagctcaacctgctccttgacaactgggacagtgtgacctataccttcaacaagctgagcgaacagctcgagcctgcgacccacgagttctgggataacctggatgccaaggtgcaggcctactctgacgacattctgacggtggcaggaggagattggc

SEQ ID NO: 490279 - DNA, 350 bp, Homo sapiens
ctgcaccatcactgtcgtacccttgttaaaatggtgtgtacctcacaaattataatttatgttccaggttcgccttcgtacttaatttgctattattgtgatgtgtataaaatctataatctcggcacttagagctttgaatcggtctacaggcatattcctgggatgagaggattgccaaacccaaatatagactagattatccaatggggttgtgtctgtgctccactctcaacatgtcttctcacaactataagtaatccccaggtgtagcggtagcaagtgtccttcccgacaagataccatatactcccgctccagtattacaagattggaggcagtaacatctt

SEQ ID NO: 490280 - DNA, 182 bp, Homo sapiens
cgatcgaggtaggctgggtgcagtgggtgaaagagtatgatggggtggtgattgtgaaagctgctcgtgtgtctgctgtcaatacctactgtagatatatggtgtgctcacacgataaaccctagaatagttatgctgtaatcgtttatgctgtacaatcgtttatgcggtaatagtttatg

SEQ ID NO: 490281 - DNA, 150 bp, Homo sapiens
ctgcagtgtcggagagacctcatctacatctaacacgtctaccccatccttgaggtgcatctttacgtccaaccttgcccacgtgacacacctagaggctgttctttgggcctacacctcaaggggggaaggtaacgggcggtcctttac

SEQ ID NO: 490282 - DNA, 142 bp, Homo sapiens
ttatgagatcctgagcactgagcatttatggaccatatcgccttcgtttgatgcatataaaggaaattcaacacacaacacgttgtttaaacctgtgccatgaatgatgcagctacgagttttctcttcacttttatattgt

SEQ ID NO: 490283 - DNA, 446 bp, Homo sapiens
agccttttaaaaattccctttctgagataaaaaagaaatgtggtatacacatacaatggaatattattcagtcattgaaaggaatgaagttttgatacatgctataacgcagataaaccttgaagatattatgctaagtaagccagatacaaaagaataaatgttgtataattccacttatataaaatatctaaaataagcaaattcatagaaaaagtagaatataggttaccaggggatgagggtatgggggcatgggaaattactttttaattggtacagtttctgttggagtaataaaacacttcttgaaaatagtattgatggttgtacaacattatgaatgtaattaatgccaatgaattatacatttaaaaatggctaaattgcaaattttacgttatgtgtattttaccacaataaacaatattttaaaatcccaaaaa

SEQ ID NO: 490284 - DNA, 450 bp, Homo sapiens
tgacacccattcgagagcttggaagccatgtatatggcttcaaagccacctacggcagggacacactcgtgagcttgtgtggccggcagttcaggtgatacatttaccagggtcctggttggtgtggtgccaggaaatggatttgggaaaaagtgaaataccattaaaggtgaatgtgaggcttctactttaatccaaaaggagctatataagctaggcggtgtctgatatccaatcatgggttaaccaataaaggcaattggtttaatcagtaaagggaaattcctgggcttatgaacgtgacaagtccaggggtatgggcatgggcagcaggtgagcaatttcacccagggtcttcggcctccctctgcgtaggtatcggctacatcccaggcaaccacctccgaggctgaaaagatggttgcctgcggctcccacggaatccctccc

SEQ ID NO: 490285 - DNA, 459 bp, Homo sapiens
  misc_feature (31)..(31): n is a, c, g, or t
  misc_feature (165)..(165): n is a, c, g, or t
  misc_feature (188)..(188): n is a, c, g, or t
  misc_feature (197)..(197): n is a, c, g, or t
  misc_feature (201)..(201): n is a, c, g, or t
  misc_feature (205)..(205): n is a, c, g, or t
  misc_feature (210)..(210): n is a, c, g, or t
  misc_feature (238)..(238): n is a, c, g, or t
  misc_feature (250)..(250): n is a, c, g, or t
  misc_feature (262)..(262): n is a, c, g, or t
  misc_feature (286)..(286): n is a, c, g, or t
  misc_feature (288)..(288): n is a, c, g, or t
  misc_feature (315)..(315): n is a, c, g, or t
  misc_feature (333)..(333): n is a, c, g, or t
  misc_feature (339)..(339): n is a, c, g, or t
  misc_feature (361)..(361): n is a, c, g, or t
  misc_feature (374)..(374): n is a, c, g, or t
  misc_feature (377)..(377): n is a, c, g, or t
  misc_feature (380)..(380): n is a, c, g, or t
  misc_feature (388)..(389): n is a, c, g, or t
  misc_feature (454)..(454): n is a, c, g, or t
tagtacaatacatctaaatggaaatcacaanacaaggaaagatttaaaccaaagcctcagattttcatacaaacgacacgaccaaacttccaaagtattggtattacatcttaaaattgtcccgtatccttaaaaaaaaaaaaagtgctacactcagcgtgcctnacaggatattaaaccaaaaagcnagaattaanaaanatgnaaaangttttcactttgaatcgtagacacagcncctatatttganttttacagaaangacatgtttctcaacatgcatccnangttttcaatgtatttggggtataagancaacatttaacataaggnaaaccncattaacctaaatacgcttacngcttaggtacacnccnacnacataacnnacttgaggaaagctaaaaattgttttaacagttatggtcaatactgaactttgttattatgtccnagatg

SEQ ID NO: 490286 - DNA, 319 bp, Homo sapiens
agctgactatttgtgtcagtaattttacatccccgggaggggtgcttaccggagaggcttaacctttcctgtgaagagggtgtatagtgttcgccgttagcccaaaaagtgggttgatgcctgagtggcctggggaagtcggtgagaatccgacgctgacccgtaaccgtgaccaccatttgtgtgggagtcggggtaccagatcacgtgggggtggtgtggggttccgtcgcgggttacggggtcggcatcgacgcgtgaacgtctgtgttgtctgtggaatcccctcgggacgtttccgtggagggacagtcgacgc

SEQ ID NO: 490287 - DNA, 225 bp, Homo sapiens
gctttggaatctctgtgtgtttctgtggggagaaaagtaattgagccgttacagcagccaagaccgtgccttgcatggggcaccagagcaacagatgccagctgcttttgttattaaaagatgtgtcttctgcctgggcaacatagcagactccatcaaacaaaaataaaatgaaaaaaattaaccaggtgtggtagctcatgcattggtccagctctagggaag

SEQ ID NO: 490288 - DNA, 161 bp, Homo sapiens
ctgtaggtcggactagcttgtccatgggatttgtcaccggcgcagatccttgaataagggccgggtcaacttcattcttccttgtccagttgccgtcgttagcgcccaaggacttgcgtcctcccacttggattgaatgcagcgccgcagccgcggccgat

SEQ ID NO: 490289 - DNA, 496 bp, Homo sapiens
ccaacatctgtgaaacagtaagagcggtccccacatggccttctgtcctcaaagtgaggcttatcaattcagaaagagtagggattctggagctatgctagttaatatgcaggaattctcattccgtgttatccagtaactggtagaatagatagttctgcttcattacgaatgacacagtttcacagtcaaggggcaccactcccaccccctgaacctttgaagaactccatcctcaggccttggttattccacacaaagtccagagaaatgacctaaactccacagtgaggggaaccatgacctactcctaccatccccttcatggggtcatcagccagctctttcccagcagagccaccagacccaaaactcagccctagatgctcaggaaatctttgggtttttttgagacacctgtttgcatcttctgccagacttcagactggaaatgctttgtgttctgttgcccccttgaatttgatgcctaagatat

SEQ ID NO: 490290 - DNA, 91 bp, Homo sapiens
  misc_feature (11)..(11): n is a, c, g, or t
ggaaaccattngtttgctattggcttataaaatcaaatatccagagaacttctttctcttaagaggaaaccataaatgcgattgatgccca

SEQ ID NO: 490291 - DNA, 163 bp, Homo sapiens
tgagatcactactttccagcagtcaggtcactggaacacactctcacctgccgctcagcacctctggcctcgttggagagtcacaccctcacgcctcagtccaagctcaaccgaaacaacaactttacccggcagtcccacaatgccaagcaccagctgcgga

SEQ ID NO: 490292 - DNA, 93 bp, Homo sapiens
gcctcccatttggtccccaatttttgatttctccccccccatccctctccccagttttggatactaataaaaaataagcattttggttttcca

SEQ ID NO: 490293 - DNA, 159 bp, Homo sapiens
  misc_feature (32)..(32): n is a, c, g, or t
  misc_feature (68)..(68): n is a, c, g, or t
  misc_feature (99)..(99): n is a, c, g, or t
  misc_feature (148)..(148): n is a, c, g, or t
ccccagggctgcagaaggaaaaagtgcagaangaggagcccatcccacaggagcctcagtggagtctnccaagcaaggagttgccagcgtccctggtgnatggcctgcagcctctcccagcacaccaggagaatggcttctccaccancggaccctctg

SEQ ID NO: 490294 - DNA, 186 bp, Homo sapiens
ttttggcccctttgtaagtccccctccctcccctccccaaagtaaaagccgaaaataaataaaaaattatggtatttccactgggaggaattttggggcccaacccagaaaggaaaaccctttttttttgtactggatttaatgcctttgaactgtgctgtaaataaataatacagctggccctta

SEQ ID NO: 490295 - DNA, 110 bp, Homo sapiens
gagatcatgccactgtactccagcctggcgacagagtgagactctctcaaaaaaaaagaatcatgacacaagtatggaagtaatgttttgggtctccctgccagcttgct

SEQ ID NO: 490296 - DNA, 86 bp, Homo sapiens
  misc_feature (74)..(74): n is a, c, g, or t
agtgtgtgaaaggcatggatggattttattgattaccctatatctactttttgaggtaaaacagaagcaccacnttttattgccga

SEQ ID NO: 490297 - DNA, 309 bp, Homo sapiens
ttatgtgacgtcagacgtgacaactgtccactgcgagcctcctgggcaactacagcgtatgaggactcagcagacgtgagagagccgggtgcagcagaagtcctttccacctctcatccagcttcacgcctagtgcaggttctgccctggtggtctcacctctccagggggcccaccttcatgtcttcttttggggggcataagtcgcaaaactaacaaatctccaaaccccagatattgctgcttggagtcgtgcataggacttgcaaagacatccccctttagtgtcagtcccacggtttcctgcct

SEQ ID NO: 490298 - DNA, 417 bp, Homo sapiens
gtttgggagtggtaataggattaggactgttgagactgtagaaaaagcacattgtttttcttaaatgtggatgcttgtttggggtggtgtaggctgatggagagtatttgagacagcggctactctttcttttttttttttcccagctgctactctcaatgcagacattgctttagaacaccctgtataaactatatattgccacatctaaaccatatagtacttcattaaattttgaacatttaaaatattttaactatatgagacaactatgtggtgcatgtgttaattagcttgattgtgataatcatttttcaatgtatatgtatataaaaataacacattgtacactttaaatgtatacaatttttgtcaattatatgtcaataaagctgtaaaaaaattttagataatgca

SEQ ID NO: 490299 - DNA, 438 bp, Homo sapiens
agttgggaataatttttaatataaaagaagtttttcccactttgaattgcctaaaagtggcatttttccctatgtgcagtcactcctctcatttctaaaatagggacgtggcccaggcacggtggctcatgcctgtaatcccggcgctttgggaggccgaggcgggcggctcacgaggtcaggagatcgagactatcctggctaacacggtgaagccctgtctctactaaaagtacaaaaagttggctgggcgtggtggtgggcacctgtggtcccggctactcgggaggctgaggcaggagaaaggcatgaatccaagaggcagagcttgcagtgagctgagatcgcgccattgcactccagcctgggcaacagtgttaagactctgtctcaaatataaataaataaataaataaataaataaataaataaaaaaaa

SEQ ID NO: 490300 - DNA, 244 bp, Homo sapiens
tgccccccccccttggcaggttaattggtgtttaaggaaccctccagggtgggggggtttcccccccacccctgttggagccggggggggggttgcctgtttcccagccgggcccccccccccggggtttttggggaatcccaggggggccccctttggggccatttggccttggtcccggggtttccctgaaaaaaggggcccccggggtggccaaaaaaaaaaaaaatttttttcccttcca

SEQ ID NO: 490301 - DNA, 650 bp, Homo sapiens
  misc_feature (488)..(488): n is a, c, g, or t
  misc_feature (500)..(500): n is a, c, g, or t
  misc_feature (503)..(503): n is a, c, g, or t
aggccaccaacggcttcggcagcctgagctgtcaactacaccctcgtcgtgctggatgacattagcccagggaatggatgagcctggtggccctgacagctcctctgtggtggtcaatgatggaccccgccagccagcagtgtggcactgacctgcgcttcacacatgccctccaatgatgatggcgcctgtggtgatcgcactggcccgtgggtagctcctgtgcggctcaatgtgcgtggccagctggtgcaccctctgtgccctgacatcacgtggatgaatggacgaccagtgccttgacgcgcccagagtgccgctgagcccatgtgaagaagaagtggacactgagcctgaatgaactctgctgtgcctggagtgacagctggcaaatacacctgccgcgtgtcgaaccgcgctgggcgccatcaacgccacctacaaggtggatgtgatccagcggacccgttccaagcccgtgctcacangcacgcaccctntgnacacgacggtgacttcggggtggaccacgtccttccagtgcaaggtgcgcagcgacgtgaagccggtgatccagtggctgaagcgcgtggagtactggtgccgagggccgccacaactccaccatcgatgtgggcggccagaagttg

SEQ ID NO: 490302 - DNA, 173 bp, Homo sapiens
gaccagggggtggcataagtgagggcttgtcattactacacggttcaccaggctctcttggcttccttccgtgggatagaatgtctgatctaaatgtggaaaaactgtggtctcacgacctaaggatgttctggccctcacccctgttctgggatgtccacagatgcctccac

SEQ ID NO: 490303 - DNA, 303 bp, Homo sapiens
  misc_feature (28)..(28): n is a, c, g, or t
  misc_feature (70)..(70): n is a, c, g, or t
  misc_feature (103)..(103): n is a, c, g, or t
  misc_feature (148)..(148): n is a, c, g, or t
  misc_feature (179)..(179): n is a, c, g, or t
  misc_feature (192)..(192): n is a, c, g, or t
  misc_feature (251)..(251): n is a, c, g, or t
  misc_feature (295)..(295): n is a, c, g, or t
ggcacgaggtcccagagggcaaggtgcntgaagggaatgtgggcgacaggaatgctctgcctggggcagncaaggttcctggagcctgtgcggatctgcagantcctgggaacgcctcaccctgtattttggatgacaccggctgctncttcattggaaccagcagtccattgtgtttncgtcttggaattnaaaaagccattttctctcttgttaaagagtcagctgagcataccagtctctctgccagnttcatcttgcttgggagaagtggagccctcatgtgttggggatnagggtggc

SEQ ID NO: 490304 - DNA, 588 bp, Homo sapiens
  misc_feature (43)..(43): n is a, c, g, or t
  misc_feature (55)..(55): n is a, c, g, or t
  misc_feature (66)..(66): n is a, c, g, or t
caaactcatcttgtctacacacggaccaaaacttttccacacntggcacaaaccnagcttagaagnccactgattctctagatggagggactaagattttcctttttccctttatcaacattttacagttattcttcaaatgacaggtgctgctctagtagttttaaaaatgtatacaaggtatagaaattccagtcaaacacagcagatggagcacacaggcttgttcatattccctctcaaactccatctcaaataacacaaagaattaaaaagacaagaatggagaggcagaaacgacgaaccagcctggaggactgaagcagccggccacgtgaagactgacttggcacagggaaggctgagtttcaggagcccacagaaggggcatcaactagagatgagaattcaggccacagaactccagagaggcctggacactgatttggcggccagtaagggcagggtgggctgagaacttacaggccagggcagtgggacatgtcccttccttatggctcctggggccagggacacccagcacagccacagggtgaccagacaccatccagaaatagggaacttggt

SEQ ID NO: 490305 - DNA, 195 bp, Homo sapiens
gtaccattagataaagatggggtctcactatgctggccaggctggtcttgaactcccggccttgagcaatcctttcctgctgggctcccaacgcactaagattagaggtgtgaggccagcaggaaaggattgctccaggctggtctggaactcctggcctcaggtagtcgcacccacctcggcctcccaaagtgg

SEQ ID NO: 490306 - DNA, 158 bp, Homo sapiens
acgaggatttccccacaccagttgagaggctcagcttggttgagggcagctttcccacccctggcgtgcgtgttcggtccctggtctgtagacctgtgcccaagctgccccagagcctggagccccgagttccgcaggcggggatacatggccttcat

SEQ ID NO: 490307 - DNA, 407 bp, Homo sapiens
  misc_feature (2)..(2): n is a, c, g, or t
  misc_feature (6)..(6): n is a, c, g, or t
  misc_feature (154)..(154): n is a, c, g, or t
gnggantatagtcatgcgtaatccagaaaaatcgagccgacgagtattgtgtgtagtctggttcagtaatgcttgtgcaccgtaagcttgagagtcacttagctaagaacccaaaggagtctgtattttgggctctatactattttgtctttanatatttatccgtccttagcatgaagggagatgggtatacaactaattgttcctgtttatttgcctctgtatctatagaacatattagtttgttaatataactaagtgagccatgttggggaaaggtgatagcattgtacttcatcgtcagcccagacttgataggaagcaaaatctaaatattcattacttattatatatctcctcttagaagccctataggcaacccaaacttaatgcattaaaaacaaacc

SEQ ID NO: 490308 - DNA, 164 bp, Homo sapiens
gagctgctcgggatctgctgtagtcgtctgcgctttcttctttaatctcgcctgctctcggggtactcaggtggtctttctttccttttcttctccccctgtggggttccatcggaggcatggattgagtatcttgagcactgggagatggctggtccaaattc

SEQ ID NO: 490309 - DNA, 925 bp, Homo sapiens
tgtagacgtttcatacctcctgggggggggcgactaatctcccgggcgctcctaattctaagctgccgtgccattttcctgtcccaaagggagccgaaatttgtgtgtctccaggagaaggaatcgaattttggattcccccggctcataaatgctcggtgaccattttcggaaaccatgcttgcgcccccgcttgacaaaggtagcccccgctgcccaccctctatgagggaggtttcttcttgcgggaaccgcaatacactccttgtctcgaggacgaagttttccccgcagcatggggtataccccagagaagacatggcgcgaagcccccttgttggggtcttgaacacggacccaatggcccccgaggggccccgcacgattctttcaaggacgcccgctgtgtactcacttggaggttcatatatgatcaacagacgtggcgtgttcccactttcgccagtggcaaggtactccccgggcgttctccctggaacccaccacaagagttggttggcagtgcccgcatctgccatcgtccatgggctagtccccgtaggacgggaggattcataagaacattgtatcagtgcgcggtgttacaacagacgcaggggtattattatcttcatgtggccaatggtctgtgttatttactcgtctcgagctcgcggcagttagttgatcttttttaaagaagactcgtagtcaagggattaacccccccgccgacgcgtgttgtttccgccaaggacacacagaatttttcctgcttgattccacgcatgcagacacgcgctcatgcccaataagtactaaggacgaaaaagaataataagagtggggcaccctagaggacaaccactacactcctgggaaccaaaacaagggaaaacaggggtattcttcccaacaaaaacaa

SEQ ID NO: 490310 - DNA, 1393 bp, Homo sapiens
gagaggacgtcagtacaagcttgatcaggtctgtggtgagatttgattctttgtaaacgtagggcactaggtaatgtggtagagataggtggtgcatgggacattggattagtatgaggagagatggagcctctacagagagatttgaggatcttacttgagtgggtgactgtctgttcagatcaaatttgtcatcaatccaaaggttattatgaggggagttgggggagaacacagtttagtttaaagacgaaatgagtcatcgtaagatggtgataactttgaagaattggaattgggcaagtaacactacatggaggcgatatgaaggggagatcgcgggggccgaaaagggggagatcagaaggattaggaggaattgaatgggagtttaacgggaaaagtctttaacacatgtttggggcccgttttgcttgggatagagagggggtaccattgtgtgatatcataacattatatggtatcgtctagaagggctcactagagagtgtccggggttaatcccgcgacatcttagattaggcgggtgtattgaaatattccgaagtagcgggttgggtataacggggacgtgtgggcgacaaaaagagtcgtggcgctcgatggaacgaaaaaacatccgtggtggatataagggaagtgggctaggttggattaacattagtaggctttgccttattggaaaattgttacattcgcaataatacagccgtaaggagagactggtgcagtattcagggggagaacaaggtgaaccaaattgggggggcagatcggttaaaactttttattctctaagttggaaaaagaatttacagtggatgaacctaaggggtagggaaataagacttgtttgggtaggaaggatcatgtaattctgccaagatggagggtcgccaccaaattgtctatcaggaaggaaaaggccttggtggacacttatgcacacgttgagttaccaataaagggtcaattgaattaagaaacgtgggaacccgggagaggagcgacatatttctgttgaccaagttccaatttcattataagaagtatgaagaggctgttcaattgggtataggtgtgggacaagaggttcacactttctagtgtgaaaagacaatgggggtgattgcttataaagggagtaacgaatttatgccatggggtaaagttagtggacaagggttcggatgagagcacaaacagtggaagtatatttggactatagggggtgacattgcgtggaatggagtgtagtacataattatataggaaataggtagagtagcacaagagtgtatgtggcgccgaaggagtaagagaaaaggcatgtgagagggcgacgaagatatagtgtagggtaatcctgcag

SEQ ID NO: 490311 - DNA, 545 bp, Homo sapiens
  misc_feature (66)..(66): n is a, c, g, or t
  misc_feature (418)..(418): n is a, c, g, or t
  misc_feature (489)..(489): n is a, c, g, or t
  misc_feature (533)..(533): n is a, c, g, or t
  misc_feature (538)..(538): n is a, c, g, or t
aattcggaacgaggtgtctggctaattttttgtatatttagtagagacggggcttcaccgcgttancaggatggtctcgatctcctgacctcgtgatccacctgcctcggcctcccaaagtgttgggattacaggcgtgacaccggcgcccggtctctttacccagtttttacagaagcgcatccgagccttcatccacagaaccatacaagacatgatgctactccaagaataccaacaatttcaaagccagaacccaaaccaacccctaccttccagcctctccccctaaccaccgctccctctcagctagaagcagcctgatgagaacaacgcccccttttctatcaactattaaaagctggaatgttagggtcaccccgaccagactgttctcttctttcgcaaaggtttacantacagttctttgtgaccttcgcatagcttccccagggctaaaggcaaaccccccgccacaactgacccttngagagtaactgtttgttcagaaggatttagctgaactggcaganagttncaagatg

SEQ ID NO: 490312 - DNA, 439 bp, Homo sapiens
  misc_feature (24)..(24): n is a, c, g, or t
  misc_feature (72)..(72): n is a, c, g, or t
  misc_feature (123)..(123): n is a, c, g, or t
  misc_feature (132)..(133): n is a, c, g, or t
  misc_feature (139)..(139): n is a, c, g, or t
  misc_feature (264)..(264): n is a, c, g, or t
  misc_feature (266)..(266): n is a, c, g, or t
  misc_feature (324)..(324): n is a, c, g, or t
  misc_feature (376)..(376): n is a, c, g, or t
  misc_feature (399)..(399): n is a, c, g, or t
  misc_feature (413)..(413): n is a, c, g, or t
ctaccctagaagtgtggtcagganataaagttgagacagagattatacatccagccccacctctctggaacnggagagatgactggggaggaaacacaggccagcatgggaacaggggtcacngtggacacnngggtgngctgtctctccacctcctcacattatgctaacagggacgcagacacattcaggtgcctttgcagaaagagatgccagaggctcttgaagtcacaaaggggaggcgtgaagaaatcctgcatctcngnccctcacaagacagctgtctcaggcttttcaagctgtgagagacacatcagagccctnggcactgtcgctggacgcagcctgagagtagctcccttcttttccacctganctcttcctcctacacatcacagnagcgaccacagctncgatgaccacaacttctaaggttaag

SEQ ID NO: 490313 - DNA, 414 bp, Homo sapiens
  misc_feature (312)..(312): n is a, c, g, or t
  misc_feature (329)..(329): n is a, c, g, or t
  misc_feature (333)..(333): n is a, c, g, or t
  misc_feature (345)..(345): n is a, c, g, or t
  misc_feature (353)..(353): n is a, c, g, or t
  misc_feature (355)..(356): n is a, c, g, or t
  misc_feature (364)..(364): n is a, c, g, or t
  misc_feature (367)..(368): n is a, c, g, or t
  misc_feature (374)..(375): n is a, c, g, or t
  misc_feature (389)..(389): n is a, c, g, or t
  misc_feature (391)..(391): n is a, c, g, or t
gtcctccttttattcaagcagtcgcacgtggctcacgtggacgaccacgctgttcgtgaggttcgacagcgacgccacgagtccgaggaaggagccgcggcgcatggatagagcaggaggggccggagtattgggaccgggagacacagatctccaagaccaacacacagacttaccgagagagcctgcggaacctgcgcggttactacaaccagagcgaggccgggtctcacacttggcagaggatgtatggctgcgacctggggcccgacgggcgcctcctccgcgggtataaccagttagcctacgacngcaaggattacatcgcnctgnacgaggacctgngctcctgncnngcgacacncgnncagatnnccagcgtatataananacgatcctctagtcaccgcagca

SEQ ID NO: 490314 - DNA, 844 bp, Homo sapiens
gatgccgaggtctgtcccacgcccgcccgcctggccaccacgagagaagaagacggagcagcagcggcgggggagaaggctgtgcacaggtgcgggtacggcaggccggttggggccgcccgtctctgtgccaacgaggagctgttccggctagcagcgggatcaagggcccaggtggcctgacgctggggaagctggcagcgacgcggacaggcgggcgacaaggccgcgacgaaaggctgaggtggaacaagcccgcggaaggttggggaacgggctcaggtcccaacggcaccctggaagattcggacggtggcagcgtcttggacagctccgggacgcctggaacaaggaccttccgagcttcaagaggacccctttgaaagcccccgggaggggcaacaatattcccttttcaggaaggaacgcgggttatccaaaagaacgctttccaaggagaggggacgggacattttgtagatccggagacgcccttcgcgaagagagaaaggaacgcccactggttcgaaaagcgggccaatggttaacagggggggtggaaacggctttgggttggagaagaaaaggcagagggcagtatccccgggtggaagaaactccccaaggttttaggttaacgccattgggcaaattaaatgaatttgacgcgggagaggaactttcgggctcttttttcaagagtaagaagaaagtttcttccttatcgatagggtcttgaagaagaagagaacaacaaaaaaagaggggggggggaccccgctattcagaaaggagatatatcccctgtgagagaaggggggagcccaccaagagggattatttg

SEQ ID NO: 490315 - DNA, 144 bp, Homo sapiens
ggatgatcagaaagcaccctaccccgtgatttcaatggttacctgggtacttagttatttcaagtgttgtcgtaaaggccacaagggattcctcttctttcccttctctgaaaataagttcagacttggttgatatgtatagac

SEQ ID NO: 490316 - DNA, 347 bp, Homo sapiens
ttttcttatctttcttttttagacagagtcttgctctgttgcccaggctggagtacagtggtgcaatctcagctcactacaagctccgcctcctgggttcacaccattctcctgcctcagcctcccaagtagctgggactacgggcatccaccaccatgcccggctaattttttgtatttttagtagagacagtgtttcactgtgttagccaggatggtctcgatctcctgacctcgtgatctgcccacctcggccatgtgtggtggctctcatctgcaatcccagctacttgggaggatcacttgaggccagaagtttgagtccagcctggacgacacaggtcgac

SEQ ID NO: 490317 - DNA, 130 bp, Homo sapiens
gatgaaaaagaattgagaaggtctaaatcaagacatttcagttaagctcataaaatttcattggtttcatttaaaaggagattaacggtattgatacttggataactggctaatcatattaaaggactat

SEQ ID NO: 490318 - DNA, 223 bp, Homo sapiens
tgtgccctgtatgggagcccagccactctgcctggctcatatcctgccctctctcaggaaaacgaggggttgccctcctagccaccagtgctgaccaacagcagctgtatctttgctacttaaaccttcttgaggcgagagccctttgtccccgggatgcgaacccatgcctggctgaaatgctgcccactactagtgtcacgggctccccattcatcactcc

SEQ ID NO: 490319 - DNA, 1268 bp, Homo sapiens
  misc_feature (1268)..(1268): n is a, c, g, or t
gcgtgatgatgccctgtgtgggctgtagtgcagttgggtgacactgcggtctagcattgggcgcgtagtggtgttaatacgccgatgaaacgcaggtcgttcgaggccatctatcatgcctagccttgctggcgtttagtgatagaatcgagtaaggctgcaagcacgtgataagttcttctggtatctgccgacgtccgctagtcgcatcctaacgggtggccgtcagttttgccagtccatatgcggtgtcacagttaatggacaagtcgtgcgtgagtcaaccatagggagaccagtgatgcgctgtcaggtagcacctgagaattctgcttcgttgtatctgtcggcatctggcggatgatcttttgcttaccgggacagatttaggcgtcagggctaatgctggtatctcagcgcattcgtgcatcgtctgcacgtccaggggttagtggttgcacaggccgcatttattaacatttgccgtgctctcgatgatatcgtgtgcacaacgggccaggttgcccttttcctcaatgggagtttggtcagcaattaacaaactagtaagtgtgccactgagggactgactggttgtttgctggtggcaggtggttccaatgttataacggtttggccaaagaccataagcgtctcgggttctcccaatagaacagggataataaaaggggagccgatctgggccattgtggtttcgcatgcatcaaggaagacagaggaggtggggaaattggcggaagaagcatggaaggagtattcttgagacccagactatgtgaggtggcctggactttggcacgggcacttaaatggcagagagaattgtgacacacactgccttgtgtgggtgtaaccgccggtaattacacggcaaaggggttaatttacagcccgttgaaactcccatggtggttttcccgcgggctgtgggaattccccctggacaaagttaaacaccgggggtctccctaaggcgccagtgtttaaacatggtgccgacccttccccgtgaaccaagactggaacaacagtttaatgcgcccctcaggcgaacagattggggcgcggcaatttttggaacagttggttcacacaactttaaccgggcggttttaaaaccaaatggactgacaacgaaaaccttcccacaaggccaaggggaatttggtttatggaccggcacgcgtgccggggtcgttccaaagaccatccccaatggacaaggaaaaatccaaggcgtttacatn

SEQ ID NO: 490320 - DNA, 750 bp, Homo sapiens
ggcacctgtaatcccagttacttgggaggccaaggcaggagaatcacttgaacctgggaggcggaggttgcagtgagccaagatcacgccattgcactccagcctgggcaacaagagcgaaactctgcctcaaaaaaaaaaaagttaattaaattaattagaaaaaatttcaaggccaggcattggttggctcacgcctgttaattcccaacacttttgagagccgaggttgggccagatcacttgaggtaaggagtttgagaccagcctggacgacattggttgaaaccctgtctctactaaaaatattactaattattattacaaaatttagctgagcttggtggtgcaggcctgtagtttccagccactggggaggctgtggcttgagaatcgcttgaacgtgaacctgggaggcggaggttttagtgagccaagatcgcttcactgcactccagcctgggtgacacagtgagactctgtctcataaacaattaattacaggtaacgtaagtaacgtaaagtgttgggtccaaacaaaaggaggccagttgggaaccctctgggttcccttaacctgctgttgagactctgagcactagagaataatctggtcttacttagtttccttagtcctggtagaccgatttgccaaatggccttttcccagtttcatcagaagaacaattgtggcacacatacgtctctgtcaatacacctgttcaagatcatcgccgaatacattcgggc

SEQ ID NO: 490321 - DNA, 105 bp, Homo sapiens
gaactgtgcctgagtcaaatacattcctaatgaatcccaggagacctttgctcacatcctctgtcaccttatcctggctcttgcctcatttttctgtgcttgagt

SEQ ID NO: 490322 - DNA, 310 bp, Homo sapiens
tccaccaccagcttagtcaaacgcagaacttcccgacacaggtggaaagcattcccaaaacgagattactttctttcctggagaagatgcgaaaaacagacagaacgtgaatgagcaatggaccccactgatgtatgccttcttcactaaccagaggaaaacaactgtccgtccttgaagcccaggaggcccctagggtccaatgcacgcaccttggtggtgagcgttttcacacgcttgaggttgaagatgtaatccaagtgcacgtagttgaggtttttgcggtgaatgagaaagttgagcatgttgt

SEQ ID NO: 490323 - DNA, 266 bp, Homo sapiens
ggccggtaccctatgtctcgattgttagcttgttgggctctgtatcgttcagtcagtgggcatcaccaatgttgattaagattcatacctgtacccatcttgatggtgaaagatagtcatcagtgctgaacacaatgccatcgacgagttctgaccaagcagaattctctgtctccgcctgtggaggaggaggtcttagggtgcttgtgtgtgatggttccagtgaattcattacaatagaaatggacattggatcttcataacga

SEQ ID NO: 490324 - DNA, 304 bp, Homo sapiens
gctccttgacatcgctcacctcctgctgtgtggctctagcgctgccatggctcaggagttggggacccctgctctaggtgcatccaatagcgaaccttcccacaccagtcttcacagtggtcaagggcagcaaccacttagctcccaaggcatgtgcgtcagctggcatttcgtcacaatcaacagtaagtggtagcttgagtcactgtgaggtcacctaccggaaatcaccagcatcccatttcgcactggccgggagctcagaactgccccctgggaaaccaaacctatgcccaaatcccat

SEQ ID NO: 490325 - DNA, 212 bp, Homo sapiens
actgagcaggtcctcctgccctaagtcctccctgaccggtcctccagtcctaactcgtccctgagccgtcctcctgccctaagtctcctccctgaccggtccataccaggcccgtaactcctcccctgaccggatccatcctccccgtaactcctccctgacccgtcctccagccctaagtctcctccctgaccagtacaacctgccggtgg

SEQ ID NO: 490326 - DNA, 237 bp, Homo sapiens
caactagcgtggtatacaggcgcgcacaccacgcccagctaatttttgtatatttcttagtagatatggggtttcaccatgtaggtcaggctgatcttgaactcctgacctcaggtgatccaatacactcagcctcccaaagtgctgggattacaggtgtgaaccagcgtgtctggcctagaattgttttagaatgtcccactgtttgttaccctttctcactccatttaagatctg

SEQ ID NO: 490327 - DNA, 355 bp, Homo sapiens
gtcgctcaggctggagtgcagaggcatgatcccggctcactgcaacctctgcctcctgggctcaagcaattctcccgcctcagcctcccaggcagccgggactacaagtgcccactatcacacctggctaattttcacatttttagtaaagacagggtctcaccatgttggccaggctggtctcgaactcctgacctcaagtgatctgcccgccttggcctcccaaagtgctgggtttacaggtgtgagccaccacgcctggcctaattttgttcagatgttacaagtgtctatagtcaatcttcacattgccagtttggttggttataggatttctaggttggaaggcattttc

SEQ ID NO: 490328 - DNA, 415 bp, Homo sapiens
gaggcctcccgagtagctggaactacaggcgcacactgtcgcgccagcctatttttgtattttagtagagacagggtttcgccgtgttgcccaggcttgtctcgaactcctgagctctggcaatctgcccctcctaaagtgctaggattacaggcatgagccaccttgcccggcctactacatgattttttaatgtaaataataaaataatacatttataaaggaatagatactttagcttttcttattgaggtatgaaatgtaagcattgtaaaattgccttgttttatatgaacattgagtaattttgctggatttttcgaacacttagtttcaaagaccaagtgaataactctgacacggaaattaaaacttgagcccagtgactccaagctaaggctaatattgagcctgc

SEQ ID NO: 490329 - DNA, 246 bp, Homo sapiens
acgggagagattccggtatatattgagatgtgggctcagttgttgtcatgtgagaagaagcaggccggatgtcatagcgggtgccctgggtctgacctctgggactcagaagtgaaagggggctattcctagttttatttggtatagccattatgattattaatgagtgagtattgatttggtagtatttggttataggttcatatgtcctggagcagtatatatgtgtgaaagaaggactagcta

SEQ ID NO: 490330 - DNA, 912 bp, Homo sapiens
tggtgggcaacggacagtccgccgaggatgctcggtggagtcatggcacgtgcccttctgctcggaaggactgtcgactttgtgtcgcaaaccctgaggagcaacggtgcctactggacgcaagttcaagctatgacatgtagacattacgcatgtgtaacctgtacctgaacgcacgttcagcagctgtacaagacttggtatgactactgagaacgccgttgccagtactgacctggtccagaacaacactagttacaggaacacacgacgtagtctgttacttccaatacaccatgtctaaactcaatggaacacactggtacgtacacacactgtctagtggctcaacatggcacgacgtaacggacaactactcccacactacttctacttctgctgagcatgaatagctgatacactggcagagtacgcacgtctctctgttggaaacagggatactacgacggccatgcacgcactagaggcaatggccctgacacccagtactgccctcacggacgatttccttcgcaccttcacaccctaccactgagggcacgtgcgcaggcttggcttatattcttcggccactgggctcacctatcgtgacactttacaaggcttcacacaagcaggcgacctacttgacacacttcgccattgaacagcacactttccttaccttggttctcggggaccttgaaaccaccgagggaacctaacagccccttcaaaatattacattctgcaacggaacccttttctaggactatatagcggaccagatcaccggatacttttcccgggtttaactaggcttacaacttaccgcattgaacggccggtttctccgatctttgaccacccgaatagaactgtgtcgctaggtttatcatatataagctccct

SEQ ID NO: 490331 - DNA, 608 bp, Homo sapiens
  misc_feature (71)..(71): n is a, c, g, or t
  misc_feature (88)..(88): n is a, c, g, or t
  misc_feature (113)..(113): n is a, c, g, or t
  misc_feature (116)..(116): n is a, c, g, or t
  misc_feature (129)..(129): n is a, c, g, or t
  misc_feature (145)..(146): n is a, c, g, or t
  misc_feature (155)..(155): n is a, c, g, or t
  misc_feature (162)..(162): n is a, c, g, or t
  misc_feature (179)..(179): n is a, c, g, or t
  misc_feature (189)..(189): n is a, c, g, or t
  misc_feature (210)..(210): n is a, c, g, or t
  misc_feature (212)..(212): n is a, c, g, or t
  misc_feature (218)..(218): n is a, c, g, or t
  misc_feature (222)..(222): n is a, c, g, or t
  misc_feature (228)..(228): n is a, c, g, or t
  misc_feature (231)..(231): n is a, c, g, or t
  misc_feature (249)..(250): n is a, c, g, or t
  misc_feature (254)..(254): n is a, c, g, or t
  misc_feature (258)..(258): n is a, c, g, or t
  misc_feature (260)..(260): n is a, c, g, or t
  misc_feature (266)..(266): n is a, c, g, or t
  misc_feature (274)..(274): n is a, c, g, or t
tctagaggatcccgttcgcaggcacaacacacttcataggccatgcaaggacacacagcccccttccctcnctcccaggtaccatcanagctgctagcgtgtgactgaaggcnggntccctggcccctnctgaagcactactgcnngccagcagnctcacgnaccttggcctgttgctnctaggggtcncctgtgctattcagccaaggngnccacantgcntgctgnccnagctgagctccgcctagnnagcncacntncctttnctgccacngagtctccctcttctgcttttcccagcaggaagggcccagcctcacctatgcaacctgcagccccccgccaaccagttgaggctcccctcttagacttataagtctatgggcagtggcatctagctacctgccctccctgccttccccagggtcccttcagtggaccctgggctttctgactgcccagagagggtccaggcgcctggaccctctctgccatgcattagggcagaaatcacggtctgggtctcttcacgctgagtccttgggaggtgggccgaatcttggccaaaagtagccggatggaagaaggatcctacctggctaggccat

SEQ ID NO: 490332 - DNA, 307 bp, Homo sapiens
tgaggtctatcatcaggccagtaagcagcctgactgctgttaacccagccctccatgtaactatgtgggttctaacaactagctttcaacagttgttttatggttacttcagtgttcagctttggggaaagacgtgcttaactgccattttcattcccagggaactgcttcagtccagcatattacccaggtagaaagtcctacctacaaaagatagattcactactttaagtagcatttatcaacacctttcctaaaaaacatttaagtttttagtacagctttaaaattttacatcttaacgtga

SEQ ID NO: 490333 - DNA, 186 bp, Homo sapiens
tcacatgacatctgcctgagagccctgaggtgacaataaaacatttatgctcaaggggaaaaaaaaaaaaaaaaaaattcgggggagaccttcttgggcctccttttttccttatccccaatttaaaattttagggggggtcggggttcatgggccttggcaggagttggggcagatggccaggtg

SEQ ID NO: 490334 - DNA, 229 bp, Homo sapiens
aagcccttactgtgacagtcacatatcgttaagcatctgggcttccatacacaatccaaatcttccccttgcttcacttctaataactgcagtgcttcaaacctagtactgcacaaggtgggggtggtcctgggtcttgagttggaacaagttcaggagggtaggccatcttgtgatgcctgtacacccgaaatgcacgatttactatccccgtccactttatcattag

SEQ ID NO: 490335 - DNA, 637 bp, Homo sapiens
atgggccaggctggtctcaaactcctgtctctagtggtccacctgcctcggcctccagaagtgctgggattacagatagtgagccaccatgcctggccggcatgagtcccatttttattgcagtagaagtgtagtgactaaggaatggtaaggtatcaaaatagaacaggaaataatggaagaggcaagaccttcgacatctaggaagagactggtggaattctatgaaagttaaatatttaatactgtgtttgtccagttgttattgagtccagatcacttgcaaagatgaaaagggagaagaataaagactacctgcctctaccaggcattattaagtgcccgttggagatttgaatgaggatgttagtgtctttgagtttcatagatgaaaagcgtggaagctaggtggggagaaattgcttgatctcagaactaacttgaagctccgagtgctcagagtcgaaactaaagtagagggccttgtggacaggtggggagttagcaggcaattttattcacatcatttgtcttttatagaaaaggtgtttgctgtcagattgagcaaaaatcatggaaaatgcccaagttttaacatcattgtttgaacctatcagaaaatcagatgcttgaatat

SEQ ID NO: 490336 - DNA, 181 bp, Homo sapiens
ctccagtaactgcgtcgtaacgagcgcctccgtaacgagacgcctccaaaacacgcttccagtaacgagcgcctccgtaacgagcgcctcctaacagcgccatccattatccagggctagtagaatttggcaggtgagtagttacacactccttagagcattccgaggcgctcgttacgga

SEQ ID NO: 490337 - DNA, 338 bp, Homo sapiens
aaaatgatacactttggaaaaggtctgcagtttcttaaaatgttatatatatctttccccatgactcagaaatccactcctatgtatttacctaagagacagaaagcatatgtctacaaagacttgtctaaaaatgttcatagcagctttactataaccaaaaactggaaaagtatgttcatcataggaatatggatgaacaacctgttatatccacacaatggaattctactcagctatgaaaaatgaatgaactattattatgcaacaacatggataaatctcagaaacgtctctgagtgaaagaagctggataaaaagcagtacctatttcattt

SEQ ID NO: 490338 - DNA, 194 bp, Homo sapiens
agtcaccgcgtcagccagtatttcagtttgtagatcgtttagtcaacatgtagcccagacagctcgcaaacgctcggcgtcaagtgatccgtccgctgcgagcctcacagaagggctgggattacagacgtgagccaccacacccggctatctttcttccttttaacatgggccccacgcctggcctctgttcc

SEQ ID NO: 490339 - DNA, 108 bp, Homo sapiens
cgaccgccgccgcccgaccgctcaccgcccccagcggacgcgcgcgcgacgagacgtggggtgggggggggcgcaccggcgacccgccgggctccccgggggcggccg

SEQ ID NO: 490340 - DNA, 935 bp, Homo sapiens
  misc_feature (1)..(1): n is a, c, g, or t
  misc_feature (102)..(102): n is a, c, g, or t
  misc_feature (173)..(173): n is a, c, g, or t
  misc_feature (203)..(203): n is a, c, g, or t
  misc_feature (224)..(224): n is a, c, g, or t
  misc_feature (353)..(353): n is a, c, g, or t
  misc_feature (412)..(412): n is a, c, g, or t
  misc_feature (440)..(440): n is a, c, g, or t
  misc_feature (442)..(442): n is a, c, g, or t
  misc_feature (445)..(445): n is a, c, g, or t
  misc_feature (453)..(453): n is a, c, g, or t
  misc_feature (455)..(455): n is a, c, g, or t
  misc_feature (458)..(458): n is a, c, g, or t
  misc_feature (464)..(464): n is a, c, g, or t
  misc_feature (501)..(501): n is a, c, g, or t
  misc_feature (770)..(770): n is a, c, g, or t
  misc_feature (923)..(923): n is a, c, g, or t
naactcaataaaaaacacaaaaacacaaaggatccagagtctctgacaatgaacgtaatatatgattgccataaaaagttcactctcctttcaattccaatntacctcaccccaaatcagcgatccacttaatcaaatattcttccacttgaattgtccttatctcggcttcnatgttacacatctcacagcagctaactgcnggcaccagctcttcacattanagaaaaaactgtcagtggttgccccttaattagtctaaaactcacaacattggttctgaacattaaccagattgaagggagccgcttatgatttcactgcgactaggggacaaattcaagtcagaaagnaaaccaggatcagtcaagctagccatccatctgctgtcaaaatatggagtgcgggcccnggctttcaaactaactggaatttttttntncanaaatgtcntncgncattancccacagggcattaaaactctatttgcgttgtctctnaaattctccagcccgaaactgtctgggtaagcattgcagacacttgcctgaacgagcccaacagtccccacgagaaaatatgtcagtacaatgtaccgcataaggccacagccaaacttcagcgtctgcgacgaagggcacttcctggatattgtaaaagacaagtaactgtccctggtgggtagtccggttctttggcatgaggcacaataccgacggcttccccttctcacgggctcctgaagtcacggacgcccaccaagcttttncacaacgaggtgcagcacagttgccgcgtgaacaatgatgccattggcttccctgactctccagaggcagcttaaaggctgggaaaggttgtggttatggattttctgatgggggcagcggggagaaatgagcagaggaggctgctttgaatngtttttgtgaaa

SEQ ID NO: 490341 - DNA, 387 bp, Homo sapiens
  misc_feature (45)..(45): n is a, c, g, or t
actgaggtgatctagaggatcccgacggcttcaacggaactttanaacatcctctggaggaggctattaaggttatgttccattaatataatccaagggaactgcttgagtccaggtttgaaaaatctttgttcttggagcagacaatgagatgagagattctaccattactgactacggctcctgtctttcttccatcagagttaaaagcctttcacattacgcttttctttaaataaagttgtaaaggagcatacgtttggaacagaacactgaaaatgtaatttaatgcgtgaactcctttcagcctcactccgtacagaatcggtacagggataattacttttgacctctattttcattagctgaaagttccgttgaagccgt

SEQ ID NO: 490342 - DNA, 789 bp, Homo sapiens
  misc_feature (7)..(7): n is a, c, g, or t
  misc_feature (73)..(73): n is a, c, g, or t
  misc_feature (75)..(75): n is a, c, g, or t
  misc_feature (77)..(77): n is a, c, g, or t
  misc_feature (123)..(123): n is a, c, g, or t
  misc_feature (199)..(199): n is a, c, g, or t
  misc_feature (298)..(298): n is a, c, g, or t
  misc_feature (315)..(315): n is a, c, g, or t
  misc_feature (326)..(326): n is a, c, g, or t
  misc_feature (341)..(341): n is a, c, g, or t
  misc_feature (348)..(348): n is a, c, g, or t
  misc_feature (360)..(360): n is a, c, g, or t
  misc_feature (365)..(366): n is a, c, g, or t
  misc_feature (372)..(372): n is a, c, g, or t
  misc_feature (376)..(376): n is a, c, g, or t
  misc_feature (378)..(378): n is a, c, g, or t
  misc_feature (383)..(384): n is a, c, g, or t
  misc_feature (395)..(395): n is a, c, g, or t
  misc_feature (397)..(397): n is a, c, g, or t
  misc_feature (401)..(401): n is a, c, g, or t
  misc_feature (406)..(406): n is a, c, g, or t
  misc_feature (423)..(423): n is a, c, g, or t
  misc_feature (449)..(449): n is a, c, g, or t
  misc_feature (470)..(470): n is a, c, g, or t
  misc_feature (488)..(488): n is a, c, g, or t
  misc_feature (502)..(502): n is a, c, g, or t
  misc_feature (529)..(529): n is a, c, g, or t
  misc_feature (607)..(607): n is a, c, g, or t
  misc_feature (634)..(634): n is a, c, g, or t
  misc_feature (785)..(785): n is a, c, g, or t
ggaactnaactctaaaagcggcttttattgttactttagaaatcataaaaatctcattaaggtcacatatttntnanccccaactaccatgcagctcagtctccatattactgaaaaaaagtntggatcacgttacttttggccatttctaaaaatcaaattaacactcaggggacagagatttgtcatcacagaaganatgcagaaaaaaaggcacaagaccttgaagtgaatcccaaagaggcgctccaaccacagatggagtaaccaccaccacagctggtcaagggtgacagcngccacatgatgggtgtnctttcaaagtnagtcacatgcctgcngtttgtnttgtctagaggnaaatnnaataanccangnaaggnnatcccagcagnantaanctccnagaccctgcagccaggnttactgtgcctcattaacaaactgcntccttccaacttggccaaggnaccatgagttactgaggngcctcagcctaganccttcccagtctcttcccagggatatntattcctaaaccttcatcctgtcagcatcaactccctactctgtagggctgagagtcaggaggtcagaggggcgtctnagagagatagcggaactcatttgtgtnaccataaactcatttgtgttactgacagctgaaaactgacagctctcttgggaaagctctgaagaaaccaaagaggaacagtgaaggtttcaatgcggaagtgggtctagactgtgtgccgctccattgaacatgttcagaaatcactagnaagt

SEQ ID NO: 490343 - DNA, 1390 bp, Homo sapiens
gtgcgtggtctctggataccatgcccccccggggatcgccacgtaggcctatcgtggcatgatcagtgcagtggtgggtggtgagtagagataccttgtggtagccggtctgatctgttcagcgctagtggtccgtgcgtgaacggaagccgtggctgttgctcgtactgaggactcacagctctggtgaatctgttcaggagcccggtggttcaccccgaggtcacgccgcggccgtcccgatgttcgtgcgcacgatggaggaaccactcaccagtgtccgggcacttcaagcttctgagcatggcagtgcacaacgaggcggactagacactcttacagtcgggcctttggcactggactgtcgtggcgttatccttgaggggtggataccccagatgcattgtggggccacacgtgagcaccagatatttcctacaaatatgacccgtggactccaggtgggtaaacactgaagtgctttcctgggtgtgcgcattctgcaccattccagcttggtatcacgacttggcacgtcaaaacctttgagcacggagggcccggcaacgcctggagggacccgttggtgccgggacacggcttgtcgcgtccaacgagggggcccaactgggccacgggggtcattacagtggcagtgtaagtgcggcggccttgcgtttactgccagagcccacgaactgaccaaaacattgcccttttgcctgacattcattgcgattggtaggtccccagagccgtagctgaacgtaccttacagcttgcaactaatcgcgccgaccagtctttgcccagggaatatttggcagtagacggcattgggaaagcttgacgcagacaccccttttgcggggcaaagcgatcctctttcatttcctggtcccacgcgagttccatcgtaggatccatagaacgttaactcgtaagcgcctggcagtacgcgttgattgcccccttgtggacgttcgcgtcggggccgacttcccacgtacggggtagcccctattcagttcgagaatgtccctcaatacggtgtgcaccggcccgagaaaggctttaccattgcaaggaatccccttggcagcttcaacaccgcaaactggagctgacgcttcacgtgcatcgaccttcagcactgcttgtcgccccaacattgataccccgtacgctagggcaccttggaacaccgaccactgcattccgtaggggagccatgcggttatcttggggacgcccgaaagaggcgctaatagggagactgaccagtacaccgcgactccgcgcattgagccacatagtacgtatgacccttccacacggcatagacagtcccgttcacaacgaaataggctccatcctaattaatctcgcc

SEQ ID NO: 490344 - DNA, 240 bp, Homo sapiens
ggggtatttacggtacatcacctcaagtatttatcatgcctgtgtgtcctctttctagctattttgaaatatgcaatacctgttgttaactctagtcacctaatctgctatggaacattagagcttattctatctgtgtgtttgcacccattaatcaatctcttcatcccctcccctcccacctacacactcctcccaggctctggtatctatcggtctacctgggttaggtctacctgg

SEQ ID NO: 490345 - DNA, 80 bp, Homo sapiens
ggcacgaggggagctgaggaattgcctaggaatcagcactgtggagaatgaggaaacgtggatatcaggattcctgtttg

SEQ ID NO: 490346 - DNA, 1461 bp, Homo sapiens
ggtgccaatctcgccgaagctttcacgtatgtctccgctgtctagcgagacaacccttccgctttctcgactcctatcgctgcatagccgacccagttggcttgatgagacgttctcagcaattgtactatgtctctagaaattcatgcctgggatattcttatggagctcgtcggcggcgtagatcccgagtggtatgcatggatatgaatcgtgcttgtccaccttctcaaaagagttcatcgtctcgagaatgacatggctgttagccctccgggatgagatgtcgttcacagcatgagatatcctagttaggtcgctcatcacgctccagggtacctgctgaagtgataggacgtccgcgttgtgatgagggcgaaaggagtgctgattcgttcgagaaatgggacttggtgtcgtatgactatctacttcatactcaaagagatcgtaactttcgacggacacatgggctcgcctcgggatttatgcacatagggatagaactgggaaagcggttgcgaacaagaatagccgatagggacttacacgtatttgggaccagaacctggaatggagttccggaaggcacttgcggattgcgtaggacaggctgagcacatgataggattcctttatagctcttgggcgttggcggtacacggcacgcattatggtagggtgcgcgttggttcactccttgtggccacgtgttcggggcggatacccgccattcgcgatggccacctcggtttcgcaatgccatacggggggggggttcccgcccgctttggtatcccttgcgccgactatcgggcctttgtgcatcttgtttgcgtctttcggcgcgggagacctgctttcgagagaggatatcgatttccctttgacgccataggtacgcccagtggcgcgggttacccgcactggattcccatacccaaattagtgcccgatgtttcctttcttattgccattggagatccaaatcgacagggcttgggtccccatagccaagggcaaggtcccgattggacattcccttcgcaccgaggattccgagttgcccaaggcgaaagactatccaggggggcatagccgccgaattgccggcccacttttgcggcacgccacggaacgggggttttaaccccgaacgaagagctttggagatgaaacttgttcacttccaccagggcaagaaacatagtactttgggcgacagcagcgagtttgcccaaccccacaagttgttggcggggggcgcaacttgcccacgcggacgcggggatattggacatccgccacaaacaccagaattatcgtcttggcgcagcacaactctacgatgtgcaatgccggccccatgacggacgcgcctggcttcgccatatgcaaccgtggcggttactttgtgccggcaccaacggctttgtgctttatcccccacatgcatcttaa

SEQ ID NO: 490347 - DNA, 681 bp, Homo sapiens
agcggggagagcgttacgtgacgggtcgggtggcgctggcgggtgctgtcagctgattcccggggttggtggcagcggcggtagcagtaagggagtttctcctggggaacccgttcagctctccagatgggacagggcatcgagaaagccacagatggtccctgcagagcgaggactgggccctcaacatggagatctgcgacatcatgcgagacgagacggaggaaggtcccaaagatggcctccgagcagtaacagaagagaatcgtggggaataagaacttccacgacgggatgctggcgtctcacaggcttagaaacctgtgtcaagaactgcgggcaccgggttccacgtgctggtggccaggcaggacgtcgtggagaagtgtgctggttaggaccatgctgcccaagaacaatccagcgcgagcactagtcgggcatgacaaagtgctcaacctcatccaggtgctgggcttgacgtcgttccgcagcgtcgggcgatctgacgaggtgtggtcaccatctgatgaggacctgcaggaggaaaggcctggagttccccatgacgtgacctggacatgctgtcagcgcatgcacagagcaccagaggaccgtgtgcaactcagagacgcaatcaggacaggagactgtgggcactgactccagccagcaagagga

SEQ ID NO: 490348 - DNA, 681 bp, Homo sapiens
atacggctaggtacgaggctgggtgttggcgggcgcagcagctggaacgggagtactgcgacgcagcccggagtcggccttgtaggggcgaaggtgcagggagatcgcggcgggcgcagtcttgagcgccggagcgcgtcctgcccttagcggggcttgccccagtcgcaggggcacatccagccgctgctggctgacatgcatgcctgctgctgctgctggtgagtcttgcgtgggtctgctggcagcctgcacctgctgctgggctgaccatgctgcaatggtcccctgccctgtgcttggtgctgtgtgcatgcaatggtgccggtggagatgggttgcggtgtgcatggctggtgtgccccacagggccaccttcttgcccggcggctgccgctggaaaatgtctcaggagaggcccacgttctaccggcaggagctgaacaagacaatctgggaggtgcccgagcgttaccagaacctgtctccagtgggctctggcgcctatggctctgtgtgtgctgcttttgacacaaaaacggggttacgtgtggcagtgaagaagctctccagaccatttcagtccatcattcatgcgaaaagaacctacagagaactgcggttacttaaacatatgaaacatgaacaatgtgatttggtctgttggacgttttacacctg

SEQ ID NO: 490349 - DNA, 491 bp, Homo sapiens
tcatatatcattccagtgccagtgctgtacatctgaatacatggggaacacagagatgtgggctcctaatgaggaccccagaaactctgagctctcacaactaacaaagacacttacctccctcctctgcccacacctccaccatatacagcatatgatacccacaagtaaaggagggggcggtcctatatccaccacctactctaggtatccccccaaacttactagagttgaaagagacccaggaaagggtaaagatcaggacccctctctcctgggctgaaagatattactacacgtcagctctatgtggacacaggagtttctggctaggcctggaaactgcagacggagctaatctgcccatataaaccactgcaaggtgcactagcttagcatcccgtctgagaataaggtgagagcagggaaataaaacttagacttcaaacgggacggaatgcatgacagttggaactctagcacgggcactt

SEQ ID NO: 490350 - DNA, 832 bp, Homo sapiens
gtggatgcggcttggtgtaataagcgtggggggtactggtagagtggggtgttgggtgagagtttgtttaacgttgcctcgtggatgatgtgaataggcgcgtgttgggagaagatgtaggcgggggcgggcgtatattattatgaggtgagcgtgctattgggtgcagtcgcggtgtcatgcgcgtggggtggcggccgccttggtgaatagttgactcacgagagcgggtggtggtccgagtgatagtcttctctcgtcgtattacgcacggagagttgctatgtgtggggctgcccccggtgtggtggtggtgggtagctttcggtggggtgacaccccggctggcttactgcgtgggagtgattgtctgttttggggtgcctggggcgcataatttttctcgcgcacgctgttttgtgctttggtgctaggccgcgcgggtgtctggtcagtgcctgcgtctgcgttgtgtgaccatccacggggtgtggtttgactcccgtgcgtgtgaggttgccccccttctgtgtataatgaaacggatcgctcgacagacaagtttttcgccgtacatgaggtgagtcgcctccccatgtggggttgtaaacaagaaagctatctttcggggagtgttgtatcaccagcagcttcctttgccgctccgctaccaccaaccgcgggggggaaaattcacatggtcgtcagttttttaaattattggggggagcacccacccttttttcgccctttttttagatatttttcccccaatttttttaaaaggggggttttttccccttgaccccccctttcccccttttggggccca

SEQ ID NO: 490351 - DNA, 432 bp, Homo sapiens
  misc_feature (242)..(242): n is a, c, g, or t
ggctccatccgtggctgcaggggtctcatgtggtcctcctcgctatgttggaaatgtgcaaccactgcttcttgggaggagtggtgggtgcagtccccccgctgtctttgagttgtggtggacgctggcctgggatgagagggcccagaagaccttcgtatcccctctcagtcgcccggggctgtcccgtgcatgggttggctgtggggaccccagtgggcctggcaggattccaaagtagnacaaaaggcacaagttaggggtggggaaccacaatggggaaaacccccaaatcaccagaaaaacctggggtgggggttgaaatggcatcctgttcccccacaggggggacccaacaggaggccgtggctctgatgctgagcgaagctataggctcttgttggataaaagcttttttaacagaaaaaaaaa

SEQ ID NO: 490352 - DNA, 130 bp, Homo sapiens
cagctctcagcctgtggaactgccccctcctagcagcctggcctgctgaactctgtggtgtatgggcctgagcggactcagcagcatgctgtcccacaggtggctccgtaagtggcccatctgtgatggc

SEQ ID NO: 490353 - DNA, 142 bp, Homo sapiens
tggggggcatgcgacagagggcagagataatagatatcagtggctagcatctctccctagggccacagaggcaatatgaaccttaccctcccgcgatacacaccccacttctttcctttattctggacacacagagacccag

SEQ ID NO: 490354 - DNA, 181 bp, Homo sapiens
tgcggcattcttgatatcctagctactggaaagactgaggcagaaggattgcttgagcccgggaagtcaaggctgcagtgaactatgatcgtaccactgcactccaccctagagtgacagaactgagaccctgtcctcttaaacgaaacaaaacaaaacacaaaatcactggaaattacca

SEQ ID NO: 490355 - DNA, 137 bp, Homo sapiens
  misc_feature (108)..(108): n is a, c, g, or t
gtacacacttaatattgtgccatatgtgagttttgacatgtatacacccatgaaaccatcaccacaatcaaggcaatgaacatgttcagaccccgaaaagtttccttngggcccttctgtaatccatcccttgagtt

SEQ ID NO: 490356 - DNA, 888 bp, Homo sapiens
ctctcttctggatgtttcctagttgttaagtttggtccctgatgtctttgtttccacagcctctgggatgagagaaagctgagcaagctagctggttctaggtggctggagagggggggaggaagtgccaggccctgaggcctgtctgcatcacttcctctggaagatgctcccagcagtagtgagggcttgagagagaggcaggcagttgagcaagtggcactttagaatttggggaaagaaagatttaacaactaggattgaaaaaatattttccctctttgggctaagtctgagacactggggataattggccttgcttgtagcctgggtagaggtgttaggaatcactttggcttccattttccctatgtgctacctccctgtccctatgtgacttggtgtgctgggagcagctgacccaggactgggtgggtgcaaacaaggccacttgcagttatcttggtttggccctttcctgatgtccctcgtggtgtctccgtgcctctcagaatgcctagcagtgggcatactccacggtccaagatagtccatcttttccctttcaaacttcccatacgttttccaagctgtttttctctcaggagcaacattgctccagagattttggttggtaggagggttgggtgtttaccgagacaggtttactctgtgtagccctggctgtcctggaactcacttccgtgacaagctggcttgaactctagaaatcactggcttggctcccaggctaggattaagggcacaatttgttcttgcacgggaaggggccgggacgacgaacctttcagggattgggcagcatggccggggcacagggagtgacccggacacataaatgcacttgtatgtccttctactaggatg

SEQ ID NO: 490357 - DNA, 365 bp, Homo sapiens
ggctccggcagagaaccccatctgggtgtcctcgcttctcaccgcgatctaccttccgcttaggtatgattgtacacagctctcacgtctgtccttctgtaaagggcctcggaaaaaggctctcaccttagatgctctggctgagtggacctgtccacagataagtgtgttcctcggagctgccgtcggttctctacagtgttcagccccttgttgctctgcagccggttatccttggcacctccagattgagacgttcctctccagagctcatgtggaaaggactaaaatgcgctgggacagtgtgacaggtcgtatgggagaccagtctcctcatagatatgtatctctgtgagcgagacacc

SEQ ID NO: 490358 - DNA, 607 bp, Homo sapiens
  misc_feature (357)..(357): n is a, c, g, or t
ccctgtacacgtatcctgaaaactggagggccgttcaagggctctcatcgctgctcagtacagcggggctcaggttcgcgtgctctccgcaccaccccacttccattatgggcaaaacaaccgcaccccgtgaatttctccgcaaaatttcctgccggcgaggtcccagcatttgagggtgatgatggattctgtgtgtttgagagcgaacgcgcattgcctactatgtgagcaatgaggagctgcggggaagtactccagcaggcaggcagcccaggtggtgcagtgggtgagcttggctgtattccgatgatagtgcgccccaggccagtacctgggtgttcccgcaccttgggncatctatgcagcatgaactagaagcaggtccacgtgaggaatgctgaggaggaagtgaggcgaattctgggggctgttcggatgctttgactctgaagcaccgaggacttgttctgggtggggctgaacgagtggacatgtggctggacatcacagtcgtctggcacccatgtatggggctctatagagcacggttctagaagccttcttatcctgctcaggcctttcgccaataccaaccgctggttcc

SEQ ID NO: 490359 - DNA, 354 bp, Homo sapiens
ctaagagctcctgactagggcaccaacttcacctctacccacatagccactacactgatgtgactgctagtactaggtcttactgtctctagtacattgtcaagctagtggtcaactcaagtacccttgcattgggtataccgggtgcctcaaagattctccccttggatctttatatgtctttgacttttttcattattcatatatagagctcaaatgtcacttcttcagaaagatcactttaatagtgaagaagccagttctctatcacacaaacctgctttatgtatacacagtactttccacaatctgaagttactatatttatctttgttttcattagctttttgcctg

SEQ ID NO: 490360 - DNA, 149 bp, Homo sapiens
ggtttaaaaaatgtttaaatcacatgcttctttttctgggctccagccagatctctggggaggagtgggaggtgggaaggcggtcggggtgggtctaaatccccatgtctgtgactgtcccgtgagagtgggctggtagatcggactgc

SEQ ID NO: 490361 - DNA, 281 bp, Homo sapiens
  misc_feature (89)..(89): n is a, c, g, or t
gctagcggactcaacacgatctacatattcacgcatctctgtcaaatctacagctctttggagaatagaaagtcctctaaattatatgnataatctcagacactgagcaaacatctcgaaaagacaaatgaggactcacacttcctgatttcaaaacttactactgtacacagctacagcaatgagaacagtggggtaaagatacataaagataatgcctaataaaaacggacatattaatcaatgggatagaacaccgagtccagagattgcggtgtgtg

SEQ ID NO: 490362 - DNA, 192 bp, Homo sapiens
cccccccccccaaagggttttttttttaggggctttcctttaaaaaggggccggtccaaaaaggaatttgaaaaggggtttaagatttggcaccactatcccacttaaatttttggcttccaaggtaaagatttttaaaggttttatccctttaaaataaagccagaaaaaaaaaaatggtggtttttttta

SEQ ID NO: 490363 - DNA, 169 bp, Homo sapiens
tagttctagatcgcgagcggcgcccttttttttttttagtttaacttttcctttttggctgtctagtcatcctcgtcggtctctgctgctggtatcgactcgtatcctcatgatcttcgttgcccgttgcgagtgatgtcctcatcttcatctcgagcctcttcctcac

SEQ ID NO: 490364 - DNA, 106 bp, Homo sapiens
  misc_feature (6)..(6): n is a, c, g, or t
aagtanaggagagtatttattagacattcggttgtattaaacactaaaaattagtcagagactggaggggataaggataagagaacaggataaggagagggtaccg

SEQ ID NO: 490365 - DNA, 709 bp, Homo sapiens
agtgaaagaggagtcaccattataaagatcatatatctgatatcacacaggtaccgttgaccctaagaaagagatgagtaattgaagtcatcttatctattacaccaagacctcccttatcattgcttgagtcctggcttgtgacctaggaattccgtatgaattccttctaactggaacatttgatgtagtatctgtaacactggcactgaaataaatcaccataccggtttaaataaatctttccatattgtactttatggtgttgggactgaatccttgatagcttaccatacccctatgtcagaggaggtcttacggacaccatagggtatgaatagccttccctcagtctgaaaagattggtctcttttataagacgaatctcatgaatattcacagtcaccgacttgtgcttattctagctactgagagtgcgcaggtgtcgttcatgagaaacgtgaccccatatgtaatcagagctttgccgattgacgttgctggaatgaagtacaggtgactcttcctcggtggtacacattgaatgtactatgtatgttcaagtatccaggcgccatgtcttatatactgaagaaagaaaaagtgaggcccaccttgctcttacaatgtttgcaattgttactgtattgaatacagtataatgactactatggcttcatcttagactggaaacaatatccttttttcc

SEQ ID NO: 490366 - DNA, 444 bp, Homo sapiens
aaacaatgtgtcttcgaacaatctacagtcaaaaagtggaccccgatttctatcatagtctgattctgaagtagtatcattcatgagttatactgcaattgaattgaactttgtctaatatttcttcaagtaagtaattaagaagtcctgcttccttgcatttcttaagaaaaggaacttacacagttgcatctgtatgtctgccatgctcttctttcacttgtcttatgaatgtattacatttcattgtatcgggtggctgtacatgattgcctgagaggggtttcttccttcctctttttcttttcactcctgaaaatttagctaaaaatataaaccatttaaaaattggaatccataaaggaaaagattactctttgactaccttaaatttaccactcatatgccaaaagtttttacaaagtccaaagatatggcaaactt

SEQ ID NO: 490367 - DNA, 138 bp, Homo sapiens
tttttttccccccccccccccccccctttttggttcttccccggaatttggctcccccctaccattttgcccccttggtttttcccccccccgggggaaccccccccaaaaaaaaaaaaagggggttcccctctttta

SEQ ID NO: 490368 - DNA, 365 bp, Homo sapiens
cggtggctcacacctgtaatcccagcactttgggaggctgaggcaggcgcatcacctgaggtcaggagatcgagaccatcctggccaacatggtgaaaccccatctctactaaaaatacaaaacctagctgagcgtggtggcgtgtgcctggagtcccaactactcaagaggctgaggcaggagaatcacttgcccgggaggtggaggttgcagtgggccaagatcagcccactgcactgcagcctggcgacagaaaaaaaagaaaccttgacatctttactacaacttagcaacccgctcaggccccctctgcaacggagagctcttcttcctttttgcttattaaacttctgctccaaactca

SEQ ID NO: 490369 - DNA, 473 bp, Homo sapiens
  misc_feature (375)..(375): n is a, c, g, or t
  misc_feature (380)..(380): n is a, c, g, or t
  misc_feature (395)..(395): n is a, c, g, or t
  misc_feature (397)..(397): n is a, c, g, or t
  misc_feature (399)..(399): n is a, c, g, or t
  misc_feature (401)..(401): n is a, c, g, or t
  misc_feature (404)..(404): n is a, c, g, or t
  misc_feature (426)..(426): n is a, c, g, or t
gtggggctcccgaaaaagcccttgtttgactggggcaagctcaactccccaagctatgggtcctgggtgttggtggagatcctgcgggacttcgggggcacactgtccatcaaggacctcagccagatgaccagtatcccccaaaatgacattatcagtaccctgcaatccctcaaaatggtcaagtactggaagggccagcacgtgatttgtgtcccccccaagctggtggaggagcccctcaaaagtgcccagtataaaaaaccccccatcccagtggactccgtttgcctcaagtgggccccccccaagcccaagcaagtcaagttttccaaaaagtgagcagcctggcccctgctgtgggacctgagcctnctggntcccagcctgtaaanangnanaancctgttttgtcatttttttaanaaagtcagttttgggggccctggactttggaggggaagggggggcca

SEQ ID NO: 490370 - DNA, 794 bp, Homo sapiens
gacgcgtgagttaggccgtaatgccttggctgctctcagcccccaagctggttcccgctgtagcaagacgtccgcggcctctcagtgatgtatgttggtgttcacaggcgaaggtacatcccgttcagacctgtcccagtaaaggaggattccatcatcctgataacgttagggccagtcccagccccgtttacacaacccacatcctcacgtcaaggaccgacgcgtgagacagaacgatggtgtggcgtatgacctggatgaggcccttctagatgcacagtgttcactcgtgacgtatatgctagctcctctgcactgaggcctaatacgctcgatgagcaatgaagcaaggttgcggggtgttcaggtgagcttgtataacagctgcctccggcatgatcaagatctcctgcagaaattgaatcgaatgcagcattgtctgggcaaggctgatcgactcgacaggctttgcatagagaaccatgttcaccagtaaagcccctgtggaagaagccttgctttatgctaagtttcgatatttgaatgccgggctcgtggcgcgggtacattttagtcctatccagcctgtggtggctggtggttaatcggtcaaacacctttgcactatgtgaaatacttaatcaattcatcaaggatggggaaatggtgctttctggatggaggttgtgagtctacctgtatgtgaagtgacatcacacgtacgtggccggttgaatggctggttcaccgcactgcaggcagaactctatgaagcggtctagaggtcccgg

SEQ ID NO: 490371 - DNA, 2741 bp, Homo sapiens
  misc_feature (166)..(166): n is a, c, g, or t
  misc_feature (188)..(188): n is a, c, g, or t
  misc_feature (235)..(235): n is a, c, g, or t
  misc_feature (248)..(248): n is a, c, g, or t
  misc_feature (305)..(305): n is a, c, g, or t
  misc_feature (1326)..(1326): n is a, c, g, or t
gaattcgaattcctttgtttccactgggacggaatcggagctctggaggctgggctggccaagcgccccgaaggcccgatgcctgacggctcatgcggcctccttgtttgcagggcctgggcaaaaatttacactgagtcccactcttcgctccagggcccggcangaagatgggctcccgtggacanggactcttgctggcgtactgcctgctccttgcctttgcctctggccnggtcctgagtcgngtgccccatgtccagggggaacagcaggagtgggaggggactgaggagctgccgtcncctccggaccatgccgagagggctgaagaacaacatgaaaaatacaggcccagtcaggaccaggggctccctgcttcccggtgcttgcgctgctgtgaccccggtacctccatgtacccggcgaccgccgtgccccagatcaacatcactatcttgaaaggggagaagggtgaccgcggagatcgaggcctccaagggaaatatggcaaaacaggctcagcaggggccaggggccacactggacccaaagggcagaagggctccatgggggcccctggggagcggtgcaagagccactacgccgccttttcggtgggccggaagaagcccatgcacagcaaccactactaccagacggtgatcttcgacacggagttcgtgaacctctacgaccacttcaacatgttcaccggcaagttctactgctacgtgcccggcctctacttcttcagcctcaacgtgcacacctggaaccagaaggagacctacctgcacatcatgaagaacgaggaggaggtggtgatcttgttcgcgcaggtgggcgaccgcagcatcatgcaaagccagagcctgatgctggagctgcgagagcaggaccaggtgtgggtacgcctctacaagggcgaacgtgagaacgccatcttcagcgaggagctggacacctacatcaccttcagtggctacctggtcaagcacgccaccgagccctagctggccggccacctcctttcctctcgccaccttccacccctgcgctgtgctgaccccagggctcagcaccaggctgaccccaccgcctcttccccgatccctggactccgactccctggctttggcattcagtgagacgccctgcacacacagaaagccaaagcgatcggtgctcccagatcccgcagcctctggagagagctgacggcagatgaaatcaccagggcggggcacccgcgagaaccctctgggaccttccgcggccctctctgcacacatcctcaagtgaccccgcacggcgagacgcggntggcggcagggcgtcccagggtgcggcacccgcggctccagtccttggaaataattaggcaaattctaaaggtctcaaaaggagcaaagtaaaccgtggaggacaaagaaaagggttgttatttttgtctttccagccagcctgctggctcccaagagagaggccttttcagttgagactctgcttaagagaagatccaaagttaaagctctggggtcaggggaggggccgggggcaggaaactacctctggcttaattcttttaagccacgtaggaactttcttgagggataggtggaccctgacatccctgtggccttgcccaagggctctgctggtctttctgagtcacagctgcgaggtgatgggggctggggccccaggcgtcagcctcccagagggacagctgagccccctgccttggctccaggttggtagaagcagccgaagggctcctgacagtggccagggacccctgggtcccccaggcctgcagatgtttctatgaggggcagagctcctggtacatccatgtgtggctctgctccacccctgtgccaccccagagccctggggggtggtctccatgcctgccaccctggcatcggctttctgtgccgcctcccacacaaatcagccccagaaggccccggggctttggcttctgttttttataaaacacctcaagcagcactgcagtctcccatctcctcgtgggctaagcatcaccgcttccacgtgtgttgtgttggttggcagcaaggctgatccagaccccttctgcccccactgccctcatccaggcctctgaccagtagcctgagaggggctttttctaggcttcagagcaggggagagctggaaggggctagaaagctcccgcttgtctgtttctcaggctcctgtgagcctcagtcctgagaccagagtcaagaggaagtacacatcccaatcacccgtgtcaggattcactctcaggagctgggtggcaggagaggcaatagcccctgtggcaattgcaggaccagctggagcagggttgcggtgtctccgcggtgctctcgccctgcccatggccaccccagactctgatctccaggaaccccatagcccctctccacctcaccccatgttgatgcccagggtcactcttgctacccgctgggcccccaaacccccgctgcctctcttccttccccccatcccccacctggttttgactaatcctgcttccctctctgggcctggctgccgggatctggggtccctaagtccctctctttaaagaacttctgcgggtcagactctgaagccgagttgctgtgggcgtgcccggaagcagagcgccacactcgctgcttaagctcccccagctctttccagaaaacattaaactcagaattgtgttttcagca

SEQ ID NO: 490372 - DNA, 2947 bp, Homo sapiens
  misc_feature (372)..(372): n is a, c, g, or t
  misc_feature (394)..(394): n is a, c, g, or t
  misc_feature (441)..(441): n is a, c, g, or t
  misc_feature (454)..(454): n is a, c, g, or t
  misc_feature (511)..(511): n is a, c, g, or t
  misc_feature (1532)..(1532): n is a, c, g, or t
gtggattgcatgtgtgttgggtgcatgtgaatgtgtgggttgcatgtgagtgtatgtgactgtgtgtgcatgtgtggattgcatgtgtgctgagtgtgtgcatgtgtgggggttgcatgtatgtgaatgtgtgtgcatgtgcgtatgtgcacgtgagtgcgtcgtgagtgcgtgtatgcatgcatgggtgtgtgagagtgattgtcctcccagaagctgtgtaactgcagcatttcccagtggcgtgaggctggggaagcacctccgatttccaggctgtttctctccccaattttcaggctgtttctctgtgcggctccttcctaactcggtgccttccctgtgtgtttctttcccaccagggcccggcangaagatgggctcccgtggacanggactcttgctggcgtactgcctgctccttgcctttgcctctggccnggtcctgagtcgngtgccccatgtccagggggaacagcaggagtgggaggggactgaggagctgccgtcncctccggaccatgccgagagggctgaagaacaacatgaaaaatacaggcccagtcaggaccaggggctccctgcttcccggtgcttgcgctgctgtgaccccggtacctccatgtacccggcgaccgccgtgccccagatcaacatcactatcttgaaaggggagaagggtgaccgcggagatcgaggcctccaagggaaatatggcaaaacaggctcagcaggggccaggggccacactggacccaaagggcagaagggctccatgggggcccctggggagcggtgcaagagccactacgccgccttttcggtgggccggaagaagcccatgcacagcaaccactactaccagacggtgatcttcgacacggagttcgtgaacctctacgaccacttcaacatgttcaccggcaagttctactgctacgtgcccggcctctacttcttcagcctcaacgtgcacacctggaaccagaaggagacctacctgcacatcatgaagaacgaggaggaggtggtgatcttgttcgcgcaggtgggcgaccgcagcatcatgcaaagccagagcctgatgctggagctgcgagagcaggaccaggtgtgggtacgcctctacaagggcgaacgtgagaacgccatcttcagcgaggagctggacacctacatcaccttcagtggctacctggtcaagcacgccaccgagccctagctggccggccacctcctttcctctcgccaccttccacccctgcgctgtgctgaccccagggctcagcaccaggctgaccccaccgcctcttccccgatccctggactccgactccctggctttggcattcagtgagacgccctgcacacacagaaagccaaagcgatcggtgctcccagatcccgcagcctctggagagagctgacggcagatgaaatcaccagggcggggcacccgcgagaaccctctgggaccttccgcggccctctctgcacacatcctcaagtgaccccgcacggcgagacgcggntggcggcagggcgtcccagggtgcggcacccgcggctccagtccttggaaataattaggcaaattctaaaggtctcaaaaggagcaaagtaaaccgtggaggacaaagaaaagggttgttatttttgtctttccagccagcctgctggctcccaagagagaggccttttcagttgagactctgcttaagagaagatccaaagttaaagctctggggtcaggggaggggccgggggcaggaaactacctctggcttaattcttttaagccacgtaggaactttcttgagggataggtggaccctgacatccctgtggccttgcccaagggctctgctggtctttctgagtcacagctgcgaggtgatgggggctggggccccaggcgtcagcctcccagagggacagctgagccccctgccttggctccaggttggtagaagcagccgaagggctcctgacagtggccagggacccctgggtcccccaggcctgcagatgtttctatgaggggcagagctcctggtacatccatgtgtggctctgctccacccctgtgccaccccagagccctggggggtggtctccatgcctgccaccctggcatcggctttctgtgccgcctcccacacaaatcagccccagaaggccccggggctttggcttctgttttttataaaacacctcaagcagcactgcagtctcccatctcctcgtgggctaagcatcaccgcttccacgtgtgttgtgttggttggcagcaaggctgatccagaccccttctgcccccactgccctcatccaggcctctgaccagtagcctgagaggggctttttctaggcttcagagcaggggagagctggaaggggctagaaagctcccgcttgtctgtttctcaggctcctgtgagcctcagtcctgagaccagagtcaagaggaagtacacatcccaatcacccgtgtcaggattcactctcaggagctgggtggcaggagaggcaatagcccctgtggcaattgcaggaccagctggagcagggttgcggtgtctccgcggtgctctcgccctgcccatggccaccccagactctgatctccaggaaccccatagcccctctccacctcaccccatgttgatgcccagggtcactcttgctacccgctgggcccccaaacccccgctgcctctcttccttccccccatcccccacctggttttgactaatcctgcttccctctctgggcctggctgccgggatctggggtccctaagtccctctctttaaagaacttctgcgggtcagactctgaagccgagttgctgtgggcgtgcccggaagcagagcgccacactcgctgcttaagctcccccagctctttccagaaaacattaaactcagaattgtgttttcagca

SEQ ID NO: 490373 - DNA, 351 bp, Homo sapiens
gctggacaccctcgtggagtttcctatccgggacctggacttctctgagatgtgcatccagccacagaatgagttgatatcaggtagcttgtacaaatacgacctcattcactggtatgcaaacatgaggggagcatgcgcgatggacactacacaacattcttcctgcgaaaggaacagtggcgcttagtcggtcactagctattgatgacaacagcgtgtcctcgtgctcaatgagaattcagacttgagttcaagtcagcaatagtcgtcgtgacctacgtctgacggcagagcgcttggtgtcccggcagctagttagcgccacagcataactgcctggtcacgacc

SEQ ID NO: 490374 - DNA, 146 bp, Homo sapiens
attcgcggccgcgtcgacctgctttatggaactggaataacgctactggtcttatgaatctggtgtgcagaattgcgcacgttatggactccacagacagagaatgtagtagtagagaatttgccaactaactctgactctactta

SEQ ID NO: 490375 - DNA, 324 bp, Homo sapiens
gttgttgggggagccccccttatttaaagggggggaacccccgggcccccccccccccccttttgggttttttttttccccgggttttcgggcccccccgggggggggttttttttttaaacccggggccccccccaaatttaaaggggggggcggggtttttttttttttttgccccccaaaatgggggggggtggggggggggccccggcccctttttggggaggggccccctttcccctttccgggggttttttttttttttttgtccccccccccaaaaaatttttttttgggcccccttttttaggtccccttttttta

SEQ ID NO: 490376 - DNA, 333 bp, Homo sapiens
  misc_feature (23)..(23): n is a, c, g, or t
  misc_feature (107)..(107): n is a, c, g, or t
  misc_feature (117)..(117): n is a, c, g, or t
  misc_feature (121)..(121): n is a, c, g, or t
  misc_feature (189)..(189): n is a, c, g, or t
  misc_feature (214)..(214): n is a, c, g, or t
  misc_feature (226)..(226): n is a, c, g, or t
  misc_feature (248)..(248): n is a, c, g, or t
  misc_feature (273)..(273): n is a, c, g, or t
  misc_feature (312)..(312): n is a, c, g, or t
  misc_feature (316)..(316): n is a, c, g, or t
agttatgatggccccagctattnttggtgcagctccacagggtattctccgtgccccgacactgaacattatccagccagatttgcccagtgccagttcccattttntacagggccnttcntttggagtaacccagcatgcggcagaagaaaatggcatcagaattttgccactcgtcatcgcaaattntcccccaggtaccactgtagtaaanttcagcccggcntcggttattactgccgaaaatnctgagggaaattgagttttcacctntttgacctttttttccctttattctttgctccccagaanatcntttaattccttggtttt

SEQ ID NO: 490377 - DNA, 955 bp, Homo sapiens
  misc_feature (23)..(23): n is a, c, g, or t
  misc_feature (70)..(70): n is a, c, g, or t
  misc_feature (137)..(137): n is a, c, g, or t
  misc_feature (200)..(200): n is a, c, g, or t
  misc_feature (234)..(234): n is a, c, g, or t
  misc_feature (278)..(278): n is a, c, g, or t
  misc_feature (280)..(280): n is a, c, g, or t
  misc_feature (331)..(331): n is a, c, g, or t
  misc_feature (340)..(340): n is a, c, g, or t
  misc_feature (344)..(344): n is a, c, g, or t
  misc_feature (352)..(352): n is a, c, g, or t
  misc_feature (380)..(380): n is a, c, g, or t
  misc_feature (382)..(382): n is a, c, g, or t
  misc_feature (384)..(384): n is a, c, g, or t
  misc_feature (394)..(394): n is a, c, g, or t
  misc_feature (407)..(407): n is a, c, g, or t
  misc_feature (459)..(459): n is a, c, g, or t
  misc_feature (462)..(462): n is a, c, g, or t
  misc_feature (480)..(480): n is a, c, g, or t
  misc_feature (558)..(558): n is a, c, g, or t
  misc_feature (571)..(571): n is a, c, g, or t
  misc_feature (620)..(620): n is a, c, g, or t
  misc_feature (623)..(623): n is a, c, g, or t
  misc_feature (628)..(628): n is a, c, g, or t
  misc_feature (644)..(644): n is a, c, g, or t
  misc_feature (647)..(647): n is a, c, g, or t
  misc_feature (693)..(693): n is a, c, g, or t
  misc_feature (713)..(713): n is a, c, g, or t
  misc_feature (743)..(743): n is a, c, g, or t
  misc_feature (752)..(752): n is a, c, g, or t
  misc_feature (755)..(755): n is a, c, g, or t
  misc_feature (784)..(784): n is a, c, g, or t
  misc_feature (786)..(786): n is a, c, g, or t
  misc_feature (789)..(789): n is a, c, g, or t
  misc_feature (804)..(804): n is a, c, g, or t
  misc_feature (807)..(807): n is a, c, g, or t
  misc_feature (892)..(892): n is a, c, g, or t
  misc_feature (902)..(902): n is a, c, g, or t
aactgaggtgatgggttggtctncagcggatgccttggtggatgaggctgcttttggctgcactggcctnctcccgctcccgccgccgcgcagggtccaactcaaaacagcgccatagcctcagggtctcatctgcngctgcggatgccactgtggccccatctgggctcatggtcagactcaggacccgggatgtgtgncctttgagttcagccaccttggccatggttgggnacttccaaataactagctggttctgtgcaaagccatggcctganangagccccttgtaatggggagaccagaggatggggcacacctggggatgggnatccacggnactnagacaggncccagagcacacattccagaggcgaatntntngatcactggngccccctcctgtngccaggacattggactgccagggacaccatgctacggccttgacagcccctngangctgggtgaatgtctgcngaggaacccagccaccctctccaggagcactaggccacacattgaccaagttatcattaccaccactggccaaatgtngtccatctggggnccagcgcacccacacacttcctggctgtggccactcagtgtggccacanggngttcngctacccgaacatcanggnggtggatgtggccagaacgtgaaccactggacaggatatagctgtnccagcttagggagcccactngggcagagtgactggtcatatttcgaagcngtttctgcngcngcacatcccatagctgcacctcagcactncnggngcccacagccaagtngtngccctctttgatccagggcacaaaggatatatattccccagggtgctccattggcaaaagcggcgggatgttaccagaacttgcnctccacaggnacacactgtggttcagttccagggccagttcattcccagaactccaattcaca

SEQ ID NO: 490378 - DNA, 342 bp, Homo sapiens
agtaggtccttatcattcactggatgaatgaatatccaagttacggtgtatttagtgagctgggattggaacaatacaattgatcaaatgcattactgagtatgtgccccatctaagtttgcagctttagattgtggtcagaggctgttacaagatcttatatattctatgatgggccatatgcatctaaagcatggtggttcagtttatgaatatataaaaggacaattttttgattaatgtcagctttgagtttagaatgtatcccagacatcttagttgcccttaattatttttggagatatttttctcagccattaataaagcaatccgaatgatgca

SEQ ID NO: 490379 - DNA, 130 bp, Homo sapiens
tcaaaactgctcattcaaaccaaagttcaactctgtgagatgaatgcccacatcacaaagaagtttctcagagtacttctgtgtagtttctatttgaggatagttccttttccaccacagaccagaaagg

SEQ ID NO: 490380 - DNA, 251 bp, Homo sapiens
  misc_feature (43)..(43): n is a, c, g, or t
  misc_feature (47)..(47): n is a, c, g, or t
  misc_feature (63)..(63): n is a, c, g, or t
cgagtttaagcgggaggttgggaaaaaatattttccaaaccanatanctaatgatatcttagnagggtttagtgagggggttttagtagggcttttttttccccccttcccaattttaaaagggggtaaatagggggggaaaaaaaatgtccggtcctgcgggggggggccctagaattggggggccaagaaatgaagccaccaaatttccgcccatttgggtccccagggttggtaataatttttatttt

SEQ ID NO: 490381 - DNA, 147 bp, Homo sapiens
gcctctacgacggactccgccacgctcttgccacggtttggtgtaccacggccacaagacttccaccgggtggtcctgacgaccggggtgccctcaaacactgggtgactgggggtgacacggaccgacacgcaagttctgggcaac

SEQ ID NO: 490382 - DNA, 3734 bp, Homo sapiens
gcacgaggatttttgaataccttttctgaatgtcttgaatacatgttgggaagaatcggtgtcttaacagtctccagtgtccacgcgttgactgccgtgtgtgactccagtcggcgtctcaacagtctccagtgtccacgcgttgactgccgtgtgtgactccagtcggcgtctcagcagtctccagtgtccacgcgttgactgccgtgtgtgactccagtcggcgtctcagcagtctccggtgtccacgcgttgactgccgtgtgtgactccagtcggcgtctcaacagtctccggtgtccacgcgttgactgccgtgtgtgactccagtcggcgtctcagcagtctccggtgtccacgcgttgactgccgtgtgtgactccagtcggcgtctcagcagtctccggtgtccacgcgttgactgccgtgtgtgactccagtcggcgtctcagcagtctccggtgtccacgcgttgactgccgtgtgtgactccagtcggcgtctcagcagtctccggtgtccacgcgttgactgccgtgtgtgactccagtcggcgtctcagcagtctccggtgtccacgcgttgactgccgtgtgtgactccagtcggcgtctcagcagtctccggtgtccacgcgttgactgccgtgtgtgactccagtcggcgtctcagcagtctccggtgtccacgcgttgactgccgtgtgtgactccagtcggcgtctcagcagtctccggtgtccacgcgttgactgccgtgtgtgactccagtcggcgtctcagcagtctccggtgtccacgcgttgactgccgtgtgtgactccagtcggcgtctcagcagtctccggtgtccacgcgttgactgccgtgtgtgactccagtcggcgtctcaatagtctccggtgtccatgcgttgactgccatgtatgactccaggtattgagttcatcttcaacttctcccaacaatgaactggagttttctgtgcatgtgtctggcatgttttcctttagatctagtcctaggtgttcgatatgctattgaggactgtgtatttttatttcatttgtcacctgtgcgtggtgctttaatcctgtgccctaaactcccgccttggccatggcggtgtttctgtggactcgtggggtttccgtgtgcacacgcgtgtcctctgtctgacagtggctttgcttccccttgtcagtctgtgcctcggcttctcactgcactggcgaggtgagccggcgcttgctaatcttattcccagtctcggtgaacatgggctcagtctctcccggctcagtgttgggtttgcactggtgcacttacaggcggaagagcttcctcatttgctgagggcttttcctgaatccgtgttgaatgtggtcagctgcctttcctgcacctagtgagatgctcatgaggtcacttccttaccgcattactgtagtgaattacgctgactttcatatgccaagatgacctggcatttccaggtaagtccctgtggccatggtgcattggccttttctctgcatggccagatgagatttgctcataccgggctaaggacctcctgtgtaggaatgctcttgagggacactgggcttggatgttcattgtcttgtcatgtgatgtgtctgtcatggtttgatattgcattaagtgggcctcctgaaacaagttctgccatagtttgtataggattggcattatttgtttcatagagatgtgatgggtgaggccatctatgcctgccattttctttttgcttaggtttttcattaagaacttgatttttaaaaatagacatgaggcctggcatggtggctcacgcttgtaatcccagcactttgggaggccaacgtggatggatcacctgagggcaggagtttgagaccagcctggtcaacatggtgaaaccccgtctccattaaatatatagaaattagcagggtgtggtggtgcatgcctgtagtcccagctgctctggaggctgaggcaggagaatcgcttggactcaggaggtggaggttgcagtgagctgagatcacaccactgcactccagcctgggcaacagagcgaggctctgtctcaaaaaaaaagacatgaggcttttggattttctgtttcttcctttgtcatttttttaaagataggtttgtcgcagaatttcatctaagttatcaaaacaatttacataaatcattcacagtatcctctgtgcagtgatgtccattctcattcctgctctgggccatttgtgttttcttttccccctgatcagactagctaagagtttatcatttttacagatattttccccaaagaaacctacttttgggtccattgattttttttttctattgttttctttttcattgacttttgctcttttcttatgaatttcctttcttctacctattttgtgttcaatttgctgtccttgttttaggttcttttgatagaggcttagatcattgatgaagaatatgaaagaatgggataatacagttaaaaacttggtctacttatgcccattagagaaaacattcttaagcacgcatggaatcttttaaaaatggacaaggtactaggacccaaagcaaatgtcagtaattcgcagatgataatgtaatgtataaatatatgatatgtaggtaaataatacaaatcacattctttggccagagtgcaattgaggaggaaatcagtaacaaaaagacaattaaatccatttgattcttttgttttcgttttgtagtaacttgcacttccctggtgccagaggcatgacacctttttgtctgctcttggccatttgggtggcgtctttgggaagggcctacttaattcttttgcctatttaaaaaactgggtcttggaaatcttgtctttttttttgagtcaggatctttctcgcacaggcttggagtgcagtggtgcgatcatagctcactgcaacctcaaactcctgggctcaagcgagcctcccacctcggtcttctgagtggctgggactgcaggcatgcatcactatgctctgctaatttaaagaaaaggttttttttatagagactgggtctcgctgtgttgcccgggctggtctcggagtcctggtctcaagtgattcacctgcctccacctcgcggagtgccaggattacaggtggcgggagccaccacacccagcctggtcttagcgttattcccaggtctgggtgtgagtccttcctcagatatgtgttgtgaataatttccgatcctctggcttgctattttactttcttaatggttatcttttggaaagcaaaggtttccagtttgatgaaatctaatttttattttttatttttccgttctagtggtctttctattttctcatcaaattgagactttggggaaactacacagcagcaaaccaggatatatcctcttaaaaacagctcgagccggccgggtgcggtggctcatgcctggaatcccagcactttgggaggtggaggtgggtggatcacgtgaggtcaggagtttgagaccagcctggccaacatggtgaaaccccatctctactaaaaataaaaaattagccaggcatggtggcaggcacctgtaatcccagctacttgggaggctgaggcaggagaatggcttgaacctgggaggcagaggttgcagtgagccgagatcgcgccattgcactccggcctggggacaagagcaagacttcgcctc

SEQ ID NO: 490383 - DNA, 640 bp, Homo sapiens
ggtcatccctccttatcatctccactagcttccaacttttcttctgcagcttcctcacccctctctgcctttacagaattgaagagttagggcctgctctagattaggttttggcataagggaatgttgtgactggtctgattgtctacccagaccactcaaactttctccatatcagcaataaggctgtttattttcttatcattcatgtgtccactggagtagcacttttaatttccttcaaaaacttttcctttgctttcatgatttggttgtttgctgcgagagatctagcttgcgacccatttcagcttctgacgtgccttcctaactaagcttcaacatttccagttttggatataaagtgagagatgtgtaactcttcctttcacttgaacacttagaagctattatagggttattaattggcctatcatatggtttgaatatgttttccctccaaatctcatgttgaaatgtggtctccagtgttgatggtggggcctagtgagaggtgtctggatcatgggggtgtacccctcatgaatggcttggtgccatccccttggtgataagtgagctcttgctctgagttcacacgagtaaaactccctgtagcctccctagaagtccagcagat

SEQ ID NO: 490384 - DNA, 132 bp, Homo sapiens
ggcctgtcgtcgctggcggtcttaccggtgccgatggcccagaccggttcataggcgatgatcgtgtgcgtaaggtcgtctggcgacaatccctgtaaccctgcttcttacctgcgactctagcacctgaga

SEQ ID NO: 490385 - DNA, 368 bp, Homo sapiens
gacgacatgcacacacagtgcaggctcacatgatgagcacaggtacacacacacccacatgcacacacacaatgagcacgggtacacacatacagagcacccacatgcacacacatgcaggtacacacgcatgagcacgggtacacacaaacacccacatgcacacacatagatgagcacgggtacacacatgcacacccacacgcacacacatgcacggacacacagataagcaagagtacacacacaaccacatgctcatctgtgtgtgtgcatgtatgtgtgtgtgtgtgtaaccgtgctcgtctgtgtacctgcacgtgtgtgcatatggatgtgtgtgtgtacccgtgccaatcaagggagat

SEQ ID NO: 490386 - DNA, 553 bp, Homo sapiens
aacaatggctggtcaggctggtgtaattggccgaggcgcctttcgtgggcggcagccagtccgctccacgctcgcagtctgtggtgccctccgggaggctggtggagtgtcaccgcggggagaggggctgggctgcagcattgcatgcctccttactgtgctccctcgtgaggcttgcctccgtgttctccgtgtactggagccggcggctgcgtgcggcagcctggcagctttgcagcggtgtgttctaggtcagtggcttcaaagactccagttggattcattgtgactgggcaacatgtgggaatccaatggcaaaaaatctcatgaaacatggctatccacttattatttattgattgtgttccctgattgcctgcaaagagtttcaagatgcaggtgaacaggtagtatcttccccagcagatgttgctgaaaaagctgacagaattattacaatgcttgcccaccgagtatcaattgccaataggcaaatggccttttaattttttcccccggggaagggccaaaaatttgggggggaaatttttcc

SEQ ID NO: 490387 - DNA, 348 bp, Homo sapiens
ggtcttcaagcctgacggaccctcaagattccggaaagcgtacaagccagagcaacccctggtgcgactgagagcgtcctacatcgggaggccgctggagtgctcaaaaatgagaatggggaccctcacgacaatggactgttcgcagttgttgcaagactggcttgggagtccaaagagcatcactgctcccgactgggcaggattcggacccatccacctcaacgagatccagtgcacaggcaatgagaagtccattatagactgcaagttcaatgccgagtctcagggctgcaaccacgaggaggatgctggtgtgagatgcaacacccctgccatgggcttgca

SEQ ID NO: 490388 - DNA, 93 bp, Homo sapiens
gctttgcacgtaccccgtttaaaaacttcccaggcacccaacattgaaaataaagaacccgcggttcccttgggcccctgcgaaaaaaaaaaa

SEQ ID NO: 490389 - DNA, 83 bp, Homo sapiens
  misc_feature (25)..(25): n is a, c, g, or t
tatcgcttttgtggaagtgcatatnaaatagagtatttatacaatatatgttactagaaataaaagaacacttttggaaaaaa

SEQ ID NO: 490390 - DNA, 253 bp, Homo sapiens
  misc_feature (201)..(201): n is a, c, g, or t
ctcgaggatccccctcaggaacgagctgctcactataaggcctggggctcaaggagctgtatgttccggcagagggacagagctaggctgggaggagcccaggtcctgcaccacccactatgtaaacaccaggctggtgccctgcagctgtgccagttggggcacagacgttttattaacattgaaacaagaagctaagtnacaaagaggctgggcccagcctctttgttacttaggtgcttgtcactttgta

SEQ ID NO: 490391 - DNA, 218 bp, Homo sapiens
attcgagaggatcccgttatccagggctttggaagctcagacgttacgtcattacacaggcgtactcctcaagagcaggcaccactgagcatctggcatccgatataactccttcttatggggattgccctgttccttgcaggatgtttagcaaatcatccctagacctatcctcactagatctcagcaatagctgccaccagtcgtgactagcaaaa

SEQ ID NO: 490392 - DNA, 83 bp, Homo sapiens
  misc_feature (30)..(30): n is a, c, g, or t
  misc_feature (69)..(69): n is a, c, g, or t
atgccaactcttggatgtcccagagtgcanccaatgcctttgtgtggtagtactaaattttaattgcanctgagaaaacctgg

SEQ ID NO: 490393 - DNA, 221 bp, Homo sapiens
gttcaccctgaattgaaagcacttgcaatgggttcccagtcaatggttataagaacactaggaggaattctagctccaatatatttgggggctctgattgataaaacatgtatgaagtggtccaccaacagttgtggagcacaaggagcttgtaggatatataattccgtattttttggaagggtctacttgggcttatctatagctttaagattcccagc

SEQ ID NO: 490394 - DNA, 267 bp, Homo sapiens
  misc_feature (206)..(206): n is a, c, g, or t
  misc_feature (217)..(217): n is a, c, g, or t
gaggtgactctaagaggatcccctgctgctccctcttcaagctattaatggtctcatgcaaattcaggacagcatgaaacctgtgttgaaaattcaggctgtgatgtcagcaagctcattctgtgcagactccagtcagcgttattggttccaacagatttctggttggttcttcttttatcttatagggagggagtttcagcatntcttcagcatntcagccaagtgttttttttttttttttttttttttttttttttttttttt

SEQ ID NO: 490395 - DNA, 402 bp, Homo sapiens
tagctcgcttttggctgcacaatgaacttctgtgcatggaaaagatgttcttcagtagcacagaccagttcattcagtaccttcttcagctgctcaggatcgctgttaccaggtggggcacagagctatgcatagtccttgattatgggctctgtcccgctggtgcgcatggtgtccacgcctccattagcacaggtgatggtgatcatatggctgctttgactagtggcaagaattgaatcggacagtcgaggtgtgggttccagcactctgtttccccagccttcttggtaactgatgctcccgcaagtgtgagaactcctcacagggagagaatgatggatcctcagatataaaacccatgttctccctggaccgcctccaattcagctctgtgtccac

SEQ ID NO: 490396 - DNA, 238 bp, Homo sapiens
gggctttctagaggatcccgtcgtcgatggcctggtactgctcagcggctgcccatctcgatgagcagcttcactccgtccaccgcaaatgcttctaagacggactcagcagatgcgtagacttttgctgcagtgggttaatgtgagaatagaatattggccccgtggcatagtgcacacactctcatgctaagcctcagcgaaagtggaataaagccttcgaaaaagaaattgtcct

SEQ ID NO: 490397 - DNA, 2275 bp, Homo sapiens
  misc_feature (546)..(546): n is a, c, g, or t
  misc_feature (690)..(691): n is a, c, g, or t
cgtggtgaccaaggaccagcccctgagcatgatcttcagctactgttcgcacggcgacctccacgaattcctggtcatgcgctcgccgcactcggacgtgggcagcaccgatgatgaccgcacggtgaagtccgccctggagccccccgacttcgtgcaccttgtggcacagatcgcggcggggatggagtacctatccagccaccacgtggttcacaaggacctggccacccgcaatgtgctagtgtacgacaagctgaacgtgaagatctcagacttgggcctcttccgagaggtgtatgccgccgattactacaagctgctggggaactcgctgctgcctatccgctggatggccccagaggccatcatgtacggcaagttctccatcgactcagacatctggtcctacggtgtggtcctgtgggaggtcttcagctacggcctgcagccctactgcaggtactccaaccaggatgtggtggagatgatccggaaccggcaggtgctgccttgccccgatgactgtcccgcctgggtgtatgncctcatgatcgagtgctggaacgagttccccagccggcggccccgttcaaggacatccacagccggctccgagcctggggcaacctttccaactacaacagctcggcgcagacctcggggccagcaacaccacgcagaccagcnncctgagcaccagcccagtgagcaatgtgagcaacgcccgctacgtggggcccaagcagaaggccccgcccttcccacagccccagttcatccccatgaagggccagatcagacccatggtgcccccgccgcagctctacgtccccgtcaacggctaccagccggtgccggcctatggggcctacctgcccaacttctacccggtgcagatcccaatgcagatggccccgcagcaggtgcctcctcagatggtccccaagcccagctcacaccacagtggcagtggctccaccagcacaggctacgtcaccacggccccctccaacacatccatggcagacagggcagccctgctctcagagggcgctgatgacacacagaacgccccagaagatggggcccagagcaccgtgcaggaagcagaggaggaggaggaaggctctgtcccagagactgagctgctgggggactgtgacactctgcaggtggacgaggcccaagtccagctggaagcttgagtggcaccagggcccggggttcggggatagaagccccgccgagaccccacagggacctcagtcacctttgagaagacaccatactcagcaatcacaagagcccgccggccagtgggcttgtttgcagactgggtgaggtggagccctgctcctctctgtcctctgacacagctgccctgcctaggagcacccaagccaggcagggggtctggcagcacggcgtcctggggagcaggacacatggtcatccccagggctgtatacattgattctggtggtagactggtagtgagcagcaaatgcctttcaagaaaataggtggcagcttcactccatgtcatatatggagtgaatatttcaaaacgttgggaataagggcctgcaaaaggcagcgaggaggcacctcgggtcttgaggttcctgacaaccgatctggtctgttggtttgaggatgaaggggctccatttctgctgcctccctgctgagaatattctccctttagcagccaaagattcgctggaacggaggctgccctctgctgcctgtctggggtcggaagacaaggggcttctgaaatgggagttcctgagatacaacaaaatgtgtgccttcaaagaaactgacagctttgtatttggtgaaatggttttaattatactccatgtgtattttgcccactttttttgggaattcaagggaaagtgtttcttgggtttggaatgttcagaggaagcagtattgtacagaacacggtattgttatttttgttaagaatcatgtacagagcttaaatgtaatttatatgtttttaatatgccattttcattgaagtattttggtcttaagatgactttagtaatttaactgtttatgttacccacgttgggatccagttggtcttggtttgcttctctctgtaccacgtgcacatgaggtccattcattttacagcccctgttacacacagacccacaggcagccgtctgtgccccgcacacattgttggtcctatttgtaaatcccacacccggtgtatccaataaagtgaaacaaagcaaaaaaaaaa

SEQ ID NO: 490398 - DNA, 559 bp, Homo sapiens
  misc_feature (64)..(64): n is a, c, g, or t
  misc_feature (69)..(69): n is a, c, g, or t
  misc_feature (218)..(218): n is a, c, g, or t
  misc_feature (278)..(278): n is a, c, g, or t
  misc_feature (482)..(482): n is a, c, g, or t
aagtgttcagaggatcccaatcagttaacaagctagtatatgttaggatgttagcatctgtgtntacanggatattgacatatagttttcgtgttgtgtgtgttctgccggtttggtatcagagtagtgatgatctgtaggatgaattagagagaattctgtccttttcaatttttgaagtagtttcaagacaattggtattagttctttttacgttnggtagaatttggctgtgtatccatctggtcctgggcttttctttctcaggaggctttttnattactgatataatcttgctatgcattattggtctgttcagggtttttctttctttccaattcaatcttgataggttgtatgtttttaggaatttatttattttctctaggtgtttcagtttgtcagcatgtagttgtttataatagtctctaatgattctttgcatttctgtagtatcagttgtaatgtcttctttgtttttnctgattttatttgggggcttctctctttttatttttttatttttaacctgggaaagtctaagctagcagtatatcag

SEQ ID NO: 490399 - DNA, 111 bp, Homo sapiens
ttgaggtaaatccaccaagaaagcctctcttctcccgtcaatggctctgtgagcgaatcacaaccccccgagagacaaggtagagccgagagacaaggtagggcctgagag

SEQ ID NO: 490400 - DNA, 491 bp, Homo sapiens
tgcaggattatagcataatctctgtccctttacccactagatgcgagtatcatcctacatccggtataaacaactggagtggtctctatacactgctctgtgcgcggagggcaaattgcccctggtgaagaacaagggctcttaaggaataggaccccctcaatccagatgaggagtataatgataatgacaacatctatagatctactgaatgcgtggcatatggcagcatgttctaagcagtctacgtgtgttaaatcatttagcccccagaataaccatctgaaatgggtggtgtaccaccttcatcttagaggaggaaatagacacagtgagattaagcacctcatgtgaatgaacaaaccaaagaatggcttcctgcaaaaactgagatccaacactatgtatctgaaccactattctttttttagagatggcgtctctctgtggcccaggctggagtgcagtgttgcaatcttggctcactgcaa

SEQ ID NO: 490401 - DNA, 630 bp, Homo sapiens
gggcagacccacgcgtcctgagagaatctggtgaacttgagtagaccctggagctccaggaaaatggctatgtgccaggttatgtctagccagttcacttagtggaacagcagctagccactcagtgctgtaattcccacctagaggagagtttcacatccaccgaatgaatcttccgaagaaaatgtcaactatataagggtcagacagaggcacagtaccaactgatagctgcacataccagatgcagctagtgatagcagctctcgctagtgggatatggataagtcgcagcagcaaaccaagcctggcggccggtgcagctatgtaggcacgagtcctgccctgtcccttatagttcatggccaactgtatgccaacaatacaactactaacccagcaactgcgaacgcaacggatgctgtcataacagtcacattaaccactgcgcgacaatcgtagcaccccgacgaatcatgcaacgccaaaggaacaatactacacatacctatcaaatagggccacttgatctaacgccaacgtacgctcacattaagcgcacacctatagcgctcatgagcacatgacactcgcaacattcccatacagacagcatacacaagaacctgg

SEQ ID NO: 490402 - DNA, 831 bp, Homo sapiens
  misc_feature (784)..(784): n is a, c, g, or t
tttttataaaaaccctagaagaaaacccaggaaatactattctggacataggccttggcaaagatttcctgacacagactccaaaagcagttgcaatgaaaacaaaaattgacaagtgggatctaattaaattaaagagcctctgcatagcaaaagaaacaatcaacagtataagcagacagcctacagaaagagtgaaaatattcagaaactatgcatctgacaaagatctaatatccagaatctataaggaacttaaacagatcaacaagcaacaaacaaccccattaaaaaatgggcaaaggacatgaacagatacttctcaaagaagacatacactttgccaacaattgtatgaaaaagtgctcaacatcactaatcattagagaaatgcaaatcaaaaccacaatgaaataccgtctcacaccagtcagaatgactacaattaaaaagtcaataaataaggctgggcatggtggctcatacctgtaatcccagcactttgagaggtcaaggcaggtacatcacctgaggtcaggagtttgagaccagcctggccaaaatggtgaaaccctgtctctacttaaaatacaaaaaagtacccggatgtggtggtgggtgcctgtaattccagctacttgggaggctgaggcacaagaatcgcttgaacccaggagttggaggttgcctgagatcacaccactgcacttcagcttgggcaacagagtgaggacttcgtcttcaaaaaaaataaattaaaaataacaaatctacaaacctttancttgactgacaaggaaaaaaagaagaatgtgaatactagaatcgcat

SEQ ID NO: 490403 - DNA, 311 bp, Homo sapiens
gtcttcgtttgcatggaagtagaactttgtaatttcatcctagcctctgattggttgctttgtgcaaccaatcagatgtttgcacaggagtgtgacctttgtaacttcacttcagcctgtggttcatgctgtccgcatccaatttgagacatgaggtgaacataaagtggccaataggaaacttctagggggtatttggacccaagaagattctgtatccgagcccttgagcccctgcttgggtctgctcccacacagcggagtgtacttttgttttcaataaatccctgcttttgtcctttaaaaaaaaa

SEQ ID NO: 490404 - DNA, 276 bp, Homo sapiens
acacaaagacacaaaaaacacaaccaaacaaccaaaaacacacaaccaagcagagcagagaagagacaacgaaccgccaaggaccagccaccaagaccggccgcgggccggcagagcaacgagccatatctcgaagccgaaccggaccggcagacccccacaggaacacgaagcaacggccaaacagcacaggacaaagcagggcaccacccgccagagagagacaagacgacaaacagacagcaaaggagggaagacaggaagaaggagaaaaac

SEQ ID NO: 490405 - DNA, 258 bp, Homo sapiens
attttctttcttggacccaggagaaccttgtggtcccttcctggcccctagcctgctcttacgggcgtgggggtgggggcgtagtggcacaggactggttacatttgggatgctgtaatatgggactggatgccggcagagagtgatagggagggagagaggcgtagagaggcctctgtcagtctccttctcttgtctcgcctactatactggctgtccttatggtctccagctcctgtcccaccccaaaaactagat

SEQ ID NO: 490406 - DNA, 342 bp, Homo sapiens
cttccagttttattgaggtttgatctcagttactcccttacttgaagaaggcttcgatgattcctcatggagaaatcccagatacttctgcacatgattcagaggtcccttacaactggcttcagcctgccttccaagccctgtctctcgcctctcccttccttcacgccgtgcttcagcgagatgctgtgttttttgcaaatggacggtttgggcaactctttgtggagcaagtctatcggtgccattttcccaacaacatggattcacttcatgtctctgagtcacattttggtaattttctcaatattttgaacttttcattattattatatctataaa

SEQ ID NO: 490407 - DNA, 905 bp, Homo sapiens
tgggcgcccgcctgttgtctcccgacagcggtgtctgcgcctctctgtaggacccaggcgtggcttttcttcgggagagttgagatgcccgcgttcgcgtttgaaatgtctggccccccgcggtgaaaaaccccggagccacaaacgtgttttctttgggcactcagccggctctactttctgtgcgagcgccgctgctaacaaacccgaagcgcttcgtgtatagcgtgctgctccgaggtatcaagtccccgaatggaggcgttctgtctccccaccgtccgaggttggcgctccaaaacgcaaccacacggcgtcttatgcttataacctcggaagactgcctccataggaggatgagtaagaaccacgaccccgtgggggtctatgtctttgaaaaaaacacgtttttgcatggaaaatgtagtaaactgcgacgggaaattgtaacaagattttctttaattggacgcaatagaaagggccccacgagtcaattgtgagatacctcaccacccgtgcgaccaaaagttgcttcaccctgtacactgggagggggggtgtatcaacgccacgccctcgctcccagggccacaaaatttccttggcgacgccctttaaaaagacacagggcaggcattgcccctgtgagtagtccacttgagggagaaaatatcacacacgttgtatctggtccacaccacaggaatggacccttcagaaccacgacatttccaaaagcggttgggtttgaatatcaaacagtgagtaccacgaccggacgtttttgttgtttcaacacttcccgcggaagggttatttctggctccacaacggtaccggcggccgtgtgatgtccccaagacgctgcatttttaaaacaaggaaaccgcccccacaaaaca

SEQ ID NO: 490408 - DNA, 416 bp, Homo sapiens
  misc_feature (199)..(199): n is a, c, g, or t
  misc_feature (230)..(230): n is a, c, g, or t
ctagagatcccattgatatgcgataggactcaggacagcagacaagctgtgtgtagggtggtatgcattagagagacgggcactcacgctcacgctgagctgggcagggtgcgaatcgtgttggctctcgcagccgtagttgccctggtcggccagtatgacaccatggatgaagaggcggtggatgtgcccatcctgngccatggacaggcgagagtcgtggggcaggngctgcccagctcgcacccagcgcacggcccccgctgcacccactcggcctgtctccacttcgagacacacgtcctggccttcctctgcccgcacatactgcaaccgccgtaggaacagcagctctgtctctcgaacatggagccgggcacttgtggccgtgctccctgcccgcaaagtcacggtcc

SEQ ID NO: 490409 - DNA, 274 bp, Homo sapiens
gccaatctgtatatggcgtccactgtcctcacggtcagtccagtagtagcgaagcctgccatctggatgcatgttctcaccaagtaaagaactgtcgttaatgacattagcaaggctgtgcttgctttgttctgccgcccctgtcctccaaggtttactctttctggtctctgttcttcaagattacccttatgattgatttcatgtaatctttgatgtacttctagtaggcttctatagtgaaactggtatccttacagggtggttcttgtag

SEQ ID NO: 490410 - DNA, 139 bp, Homo sapiens
aggactatgtggctgattgaagagtctgcaatgagcgattttaggatctgtttgtcgataagcagatggagcttgtaattaattatgcctcatagggatagtacaaggaaggggtaggctatgtgcttagtcaggggtt

SEQ ID NO: 490411 - DNA, 1232 bp, Homo sapiens
ggcacgagggccacccgcgccgcgcccaggtaagcaggtccgtgggtcgctgggtccatgcgtgggtccgtggctggccggggatggaccagcccctccccgcaggggcatcgcctgcccaaggacgcaggacccagtgagggaagcgcgcgctgcaggcacggggctctccaccctcgccatggttggcaccaagccacactgtgcactcgacacacgcagcgtcctggctgccacctgcagattccagctcgtgtctatgcagggccatggccgccatcacagggccatatgcaagaaactctctgagctctcctcgcccaaaaccgcagctatccttttgtggtttggtattataggtaacatgcccttccttaaagaaacagtatttcaggcctgtagtcccagctactccggaggccgaggcagaagctgaggcagaagcaggaggatcatttgagcccagaagtttgagcctgggcaatgtagcaagaccccccccccccacctcactccccaatcagttaaaagagagagagagagagatagaattccagcaggaagaagtacacatttccacgaatggtttgggaattcaagcatcatatggctgaggtttgaactacagctcatgccaataacatgtgcacatgcgccagcattccagcgtccaacagagcatgcgtgcaccattccagcatccggcaacaatgcaccagcattccagcgtccaacagagcatccgtgtaccattccggcatttggcaacaatgcaccagcattccagagtccaacagggcatgcgtgcaccattccagcatccggcaacaatgcaccagcattccagcgtccaacagagcatccgtgtaccattccggcatttggcaacaatgcaccagcattccagagtccaacagggcatgcgtgcaccattccagcatccggcaacaatgcaccagcattccagcgtccaacagagcgtgcgtgcaccattccagcatccggcaacaatgcaccagcattccagcgtccaaaagagcatccggcaacatcccggtgtccagtggcacatgtgcacctggacgttccagtgtggtgagctttcaggcacggagcaaggccaaagggataaaaagatgaaggtgacgcagtactcccccttatagtgcctacaggccttataggccagacagatctggaaataaataattcataataaaaaataattacag

SEQ ID NO: 490412 - DNA, 177 bp, Homo sapiens
  misc_feature (106)..(106): n is a, c, g, or t
  misc_feature (163)..(164): n is a, c, g, or t
gagcttgagatggaggatctcattctgccttctggttcctgctttggtgtaggggttgggaaaacaggaaatcctctcagctctgctcagatctcctacctctccnttagtcttgtaggggtgtccaaggatggctcttctaaccagaaggctggcctgtctnnttaaaacttaact

SEQ ID NO: 490413 - DNA, 123 bp, Homo sapiens
taagcagctcgatagagtgcgccctctactggaggggtgaagaaacctcatcgttacattgcctggtacttgtggcgctccgtgaatattagacgttatcagcaagtccactagaacttcttg

SEQ ID NO: 490414 - DNA, 147 bp, Homo sapiens
gagtctccgcaaggcaaagggcacgtgagggtgacggccgtcccaagtgggtccaccccgacgcgcgtcccgaaggggcacctgtgaactcaaaaggctcttgtcagagccactgacgttcgcaattaacagagccgttatttctga

SEQ ID NO: 490415 - DNA, 709 bp, Homo sapiens
tctggttcccttaaatatgaggcaatagaaatttataattggagaactacagtacccctgtttttagctcttatcacagcgggcaacgggtagtgattttttggtggtgggttggtttggtttggagagggagctctcgctcgtgtggcccagggtgggagtgcaggggcacgactctcggctcatgtgcaacctccaccttccggggtccaagtaatttctccggcctcagtctcccgagatagcggggataacgggtgcattgcccccaacaccgggataattttgggtactttagtaaaagacggggtttcaccattgttagccagggagggtctcaatctccgtgacctaattgatccgcccacctgggcctcccagagttgcggggatggcgggcgtggaccaccgcacggggcccgggtagtgatttttattccattccaacaatctatgtggcggggttaaataacaggggtcattagtggtctatttcccagggggagttaatggtgcgtcccagagatccctaactattctccttattttgacggaaactccttctaaaaaaacccctattcagaactgtgatgctctaattgagaaacaactcttgtgggccactatgtgcggccaaagttcctatccttagatgaaaaaactccatcgttattcaagtgacggggtaaaagcggattcctttgccacg

SEQ ID NO: 490416 - DNA, 849 bp, Homo sapiens
  misc_feature (322)..(322): n is a, c, g, or t
gcctttcgctgcctgcggacgcagccatgaggtatgctcaggcttcgagaagaggctcgccttctagtgtcctccggctgtggcaagaaagaaggtctggttagacccctatgagaccagatgtaaatcgcacaagtgccaactcacctgttgagcagatccaggaggctcaagtcatagagatggtgttgtctcattgccgcatagcctgtgaacagagttccgatctcccggtgctcgatgccggagaagaacatcttgggcccgccggaaagggcaaggcaccttggggcatgttaggtgagcggcaaggggtcgtagncaccaaatgtcgccaggatagtgctcgcgcaggagaagggtccaccagttgggattcgaatgggcacggaaattggacgcgcatttgatctggccgcccgggggaaatattggccctcccaaggacaaagggaattcacccccggtttggcacaccatttcctctccattggcaaatggatttcgggggaaatggccggccccaaaaccaaatttttggctttcacctttcccactcctgaagggctcccccatggggtgttaaaccccctgttgggtaaacacccagcgtcctctgcgaatactcggcgcgggaggaccactttttggcctcggatttcctccattattcaagaataatcccaaaaaacttgcccaggaggagaactttctaaccccttactaattttccggtgttaacgcccccagtctctagggttgctcacagagaatcccacagaacagaaggcctttatttgggaacacacacatggcgccgccgaaacgacacaacccccaaaacatcgg

SEQ ID NO: 490417 - DNA, 581 bp, Homo sapiens
attgcaaaccaaactgaaggcagaagaaccttcaggagccgatgattctccatcagggacaaaaagttcttcttcagtgcggatcaaaaccttctctgaggtcctggctgaaaagaaacaccggcagcaggaaatggaaagacagaaatccaaaaaggatacaagttgcctcacgctaacagacgacactgaaatgaaaaagacagtgagtctgcccactgttgctgttagcaaaggacaaccagaggagcctgcaggaagagccaggtctatgcaggaggtgcatattaagacgctagaggaaattaagctggagaaggccctgagggtgcagcaaagctctgagagtagtggcaactcccgacctcaagctgaggctgccccagggacaaagaggctgctccgcatcaccaagagagcaggtgtaaaagaagagaaaaaatgtggccttgaagacagtggtgaccctcctcagagcagtgtgactaagatggaggctaatgagacttcagatgagaccataagtgatcccacaaaacttgcagtcaacagatgtgacactgtcaaagagaaacacacac

SEQ ID NO: 490418 - DNA, 1724 bp, Homo sapiens
aaggtcctgctgcgtgagcattgacgtgtttggagctggagacggcctgggtgctggcgaagcggaggccggagttaatacacgaggaactcatgcaaaggaggggactttcggaaatccaaacttagagtgccttgtatttagaatccggaaggaaaaggaaatgaaatgtgaagaaactcatgcaccaaactcgaactgggtatatgtgatgttacctagtaagaagactgttagaatgccctcggtaacacagaggctgagagatcctgacataaatccttgtttgtcgatcctgttctaccttttaaatgatgcctctcttatatctgtaaggaatctgatgcttccaccagatgtctggatgaaaataactatgacagggaaaggtgttccacttacttcttgaggtacaaaaactgccggagattctggaattctatcgtgatgcagagaagaaagaacggagtgaagccatttatgcctacggcagcagaaagagatgaaatcttgagagcagtgggaaatatgccctattgaatgtttgcattaaaagtgtttatataacttagaagcagatgaatatttctaataaatgattgctgtaatatttaagactgtacacccctcacccagacagaccttaagttcttcaagtggagacagtgaagtcaccccgtgtcctttttgcttgctctcagtgccatgccgatggtatgttgctgttggctgtgttgtggcatgagtttgcatgactttctggaggcatggagttaggtaaggctacatgagaaattgagcttttccactgggttttgaaagaagagtatgatgtgaacaagtaaagactgaatggggctgagatgaaggcaatgtttccaaggaaaggaaatgttatgagcaagagtgtgaggcaagagaagctggaaccacattcagagagtatcctgtagattgctccacctagaatctcaggtgggtggagcagtggtgggagaagactggaaaggtaagttgaaggtaaggaatgtgtggtgggcctcagatcccaggctcattcctcaaatcacttcttacttccctcacttatctttgtttaaataaggttagtacattcactaggggcaaatgggtttttctaaataaatgacataaaaaagaactggttgtctttctttaaagaaagtcttagttacaggattctgtgattaaaatccttaaatattgggttgccttctgcagctgtagtatcagtttttgaaccacagtaatgggaagaaagacaaatggattcccttagaagtaagatttctatttgcaggatgagttgggcagggaaaagggtcagggttcatcaggtgaactcaacactgggatgagactagaacttcactttatgatataaacacaatacgattattcaatgtggtgactggggtagactgtgaagcagccctccttatgcccactgccttttagaatcgtttgttttattcatggtagttttatgaagacatactattattgaatgaaatttaatgtgtacttgaaaacattgcttttgtcccttctcttcatctggtcttgggtcaagaacattgttttaatggctgccgacaatgaactgtctgtctgagtctaaaaccaagctcaggtttctaagccacatgaccttgattgttaaatgtagttatatttgaataaaaaatgaatcatttccaaaa

SEQ ID NO: 490419 - DNA, 1679 bp, Homo sapiens
aaggtcctgctgcgtgagcattgacgtgtttggagctggagacggcctgggtgctggcgaagcggaggccggagttaatacacgaggaactcatgcaaaggaggggactttcggaaatccaaacttagagtgccttgtatttagaatccggaaggaaaaggaaatgaaatgtgaagaaactcatgcaccaaactcgaactggtaagaagactgttagaatgccctcggtaacacagaggctgagagatcctgacataaatccttgtttgtcgatcctgttctaccttttaaatgatgcctctcttatatctgtaaggaatctgatgcttccaccagatgtctggatgaaaataactatgacagggaaaggtgttccacttacttcttgagaattctatcgtgatgcagagaagaaagaacggagtgaagccatttatgcctacggcagcagaaagagatgaaatcttgagagcagtgggaaatatgccctattgaatgtttgcattaaaagtgtttatataacttagaagcagatgaatatttctaataaatgattgctgtaatatttaagactgtacacccctcacccagacagaccttaagttcttcaagtggagacagtgaagtcaccccgtgtcctttttgcttgctctcagtgccatgccgatggtatgttgctgttggctgtgttgtggcatgagtttgcatgactttctggaggcatggagttaggtaaggctacatgagaaattgagcttttccactgggttttgaaagaagagtatgatgtgaacaagtaaagactgaatggggctgagatgaaggcaatgtttccaaggaaaggaaatgttatgagcaagagtgtgaggcaagagaagctggaaccacattcagagagtatcctgtagattgctccacctagaatctcaggtgggtggagcagtggtgggagaagactggaaaggtaagttgaaggtaaggaatgtgtggtgggcctcagatcccaggctcattcctcaaatcacttcttacttccctcacttatctttgtttaaataaggttagtacattcactaggggcaaatgggtttttctaaataaatgacataaaaaagaactggttgtctttctttaaagaaagtcttagttacaggattctgtgattaaaatccttaaatattgggttgccttctgcagctgtagtatcagtttttgaaccacagtaatgggaagaaagacaaatggattcccttagaagtaagatttctatttgcaggatgagttgggcagggaaaagggtcagggttcatcaggtgaactcaacactgggatgagactagaacttcactttatgatataaacacaatacgattattcaatgtggtgactggggtagactgtgaagcagccctccttatgcccactgccttttagaatcgtttgttttattcatggtagttttatgaagacatactattattgaatgaaatttaatgtgtacttgaaaacattgcttttgtcccttctcttcatctggtcttgggtcaagaacattgttttaatggctgccgacaatgaactgtctgtctgagtctaaaaccaagctcaggtttctaagccacatgaccttgattgttaaatgtagttatatttgaataaaaaatgaatcatttccaaaa

SEQ ID NO: 490420 - DNA, 340 bp, Homo sapiens
cgattacatgtgttagccctcgacttcaggtctcgagggaagaatgcctagatacagggacagttgggtatctttgccattcctgagtagtaggaatagatacaaaatgcagcagtttgtcttttactttggagggattatcccaagcgtgctccagagcaggactacctgatgtctaaaaacttcactgaattgacaggtccctgaatctttgtagggttgctgtcgtaccttctggagcacgtgtatcttaccaaagactccagcacactagccactgcttgtttattttatctaagcaacatgataggattgatgtaatggaccagtgctctgcctc

SEQ ID NO: 490421 - DNA, 1851 bp, Homo sapiens
  misc_feature (1674)..(1674): n is a, c, g, or t
  misc_feature (1687)..(1687): n is a, c, g, or t
aaggtcctgctgcgtgagcattgacgtgtttggagctggagacggcctgggtgctggcgaagcggaggccggagttaatacacgaggaactcatgcaaaggaggggactttcggaaatccaaacttagagtgccttgtatttagaatccggaaggaaaaggaaatgaaatgtgaagaaactcatgcaccaaactcgaactggtaagaagactgttagaatgccctcggtaacacagaggctgagagatcctgacataaatccttgtttgtcggaatctgatgcttccaccagatgtctggatgaaaataactatgacagggaaaggtgttccacttacttcttgaggtacaaaaactgccggagattctggaattctatcgtgatgcagagaagaaagaacggagtgaagccatttatgcctacggcagcagaaagagatgaaatcttgagagcagtgggaaatatgccctattgaatgtttgcattaaaagtgtttatataacttagaagcagatgaatatttctaataaatgattgctgtaatatttaagactgtacacccctcacccagacagaccttaagttcttcaagtggagacagtgaagtcaccccgtgtcctttttgcttgctctcagtgccatgccgatggtatgttgctgttggctgtgttgtggcatgagtttgcatgactttctggaggcatggagttaggtaaggctacatgagaaattgagcttttccactgggttttgaaagaagagtatgatgtgaacaagtaaagactgaatggggctgagatgaaggcaatgtttccaaggaaaggaaatgttatgagcaagagtgtgaggcaagagaagctggaaccacattcagagagtatcctgtagattgctccacctagaatctcaggtgggtggagcagtggtgggagaagactggaaaggtaagttgaaggtaaggaatgtgtggtgggcctcagatcccaggctcattcctcaaatcacttcttacttccctcacttatctttgtttaaataaggttagtacattcactaggggcaaatgggtttttctaaataaatgacataaaaaagaactggttgtctttctttaaagaaagtcttagttacaggattctgtgattaaaatccttaaatattgggttgccttctgcagctgtagtatcagtttttgaaccacagtaatgggaagaaagacaaatggattcccttagaagtaagatttctatttgcaggatgagttgggcagggaaaagggtcagggttcatcaggtgaactcaacactgggatgagactagaacttcactttatgatataaacacaatacgattattcaatgtggtgactggggtagactgtgaagcagccctccttatgcccactgccttttagaatcgtttgttttattcatggtagttttatgaagacatactattattgaatgaaatttaatgtgtacttgaaaacattgcttttgtcccttctcttcatctggtcttgggtcaagaacattgttttaatggctgccgacaatgaactgtctgtctgagtctaaaaccaagctcaggtttctaagccacatgaccttgattgttaaatgtagttatatttgaataaaaaatgaatcatttccaaaaaaaaaaaaaaaaanaaaaaaaaaaaanaaaaaaaaaaggcgggggggggaaaaaaatcccggggggggcaacattttgagatcacccttttttgaaacaaggggccacaagggaggcggaaaaaaagacagggagggggagaaaaaacaggggggagggaaaggcgtggcttggacagcccttggtggggg

SEQ ID NO: 490422 - DNA, 1723 bp, Homo sapiens
aaggtcctgctgcgtgagcattgacgtgtttggagctggagacggcctgggtgctggcgaagcggaggccggagttaatacacgaggaactcatgcaaaggaggggactttcggaaatccaaacttagagtgccttgtatttagaatccggaaggaaaaggaaatgaaatgtgaagaaactcatgcaccaaactcgaactggtaagaagactgttagaatgccctcggtaacacagaggctgagagatcctgacataaatccttgtttgtcggaatctgatgcttccaccagatgtctggatgaaaataactatgacagggaaaggtgttccacttacttcttgaggtacaaaaactgccggagattctggaattctatcgtgatgcagagaagaaagaacggagtgaagccatttatgcctacggcagcagaaagagatgaaatcttgagagcagtgggaaatatgccctattgaatgtttgcattaaaagtgtttatataacttagaagcagatgaatatttctaataaatgattgctgtaatatttaagactgtacacccctcacccagacagaccttaagttcttcaagtggagacagtgaagtcaccccgtgtcctttttgcttgctctcagtgccatgccgatggtatgttgctgttggctgtgttgtggcatgagtttgcatgactttctggaggcatggagttaggtaaggctacatgagaaattgagcttttccactgggttttgaaagaagagtatgatgtgaacaagtaaagactgaatggggctgagatgaaggcaatgtttccaaggaaaggaaatgttatgagcaagagtgtgaggcaagagaagctggaaccacattcagagagtatcctgtagattgctccacctagaatctcaggtgggtggagcagtggtgggagaagactggaaaggtaagttgaaggtaaggaatgtgtggtgggcctcagatcccaggctcattcctcaaatcacttcttacttccctcacttatctttgtttaaataaggttagtacattcactaggggcaaatgggtttttctaaataaatgacataaaaaagaactggttgtctttctttaaagaaagtcttagttacaggattctgtgattaaaatccttaaatattgggttgccttctgcagctgtagtatcagtttttgaaccacagtaatgggaagaaagacaaatggattcccttagaagtaagatttctatttgcaggatgagttgggcagggaaaagggtcagggttcatcaggtgaactcaacactgggatgagactagaacttcactttatgatataaacacaatacgattattcaatgtggtgactggggtagactgtgaagcagccctccttatgcccactgccttttagaatcgtttgttttattcatggtagttttatgaagacatactattattgaatgaaatttaatgtgtacttgaaaacattgcttttgtcccttctcttcatctggtcttgggtcaagaacattgttttaatggctgccgacaatgaactgtctgtctgagtctaaaaccaagctcaggtttctaagccacatgaccttgattgttaaatgtagttatatttgaataaaaaatgaatcatttccaaaattcttttgatttgtattgactgctataaaaatgatggattaaaataggaccagaaaagaatga

SEQ ID NO: 490423 - DNA, 632 bp, Homo sapiens
  misc_feature (23)..(23): n is a, c, g, or t
  misc_feature (46)..(46): n is a, c, g, or t
  misc_feature (57)..(57): n is a, c, g, or t
  misc_feature (61)..(61): n is a, c, g, or t
  misc_feature (66)..(66): n is a, c, g, or t
  misc_feature (90)..(90): n is a, c, g, or t
  misc_feature (94)..(94): n is a, c, g, or t
  misc_feature (106)..(106): n is a, c, g, or t
  misc_feature (160)..(160): n is a, c, g, or t
  misc_feature (164)..(164): n is a, c, g, or t
  misc_feature (190)..(190): n is a, c, g, or t
  misc_feature (200)..(200): n is a, c, g, or t
  misc_feature (203)..(204): n is a, c, g, or t
  misc_feature (214)..(214): n is a, c, g, or t
  misc_feature (220)..(220): n is a, c, g, or t
aagaaaaaaaaaggaaagaacantcactaggcgcaaatggcccacnccaaaaaaatnacanaaaanagaaccggttccccccccaaaaanaaanccccagtcacangaccccgcgaccaaaacccccaaaaaacgggttgccgtcggcagctgaagtaanaggnggggaaccacaggaaggggaagaaanggaaaggganggnnggagaaggangagggngatttgcaggatgagttgggcagggaaaagggtcagggttcatcaggtgaactcaacactgggatgagactagaacttcactttatgatataaacacaatacgattattcaatgtggtgactggggtagactgtgaagcagccctccttatgcccactgccttttagaatcgtttgttttattcatggtagttttatgaagacatactattattgaatgaaatttaatgtgtacttgaaaacattgcttttgtcccttctcttcatctggtcttgggtcaagaacattgttttaatggctgccgacaatgaactgtctgtctgagtctaaaaccaagctcaggtttctaagccacatgaccttgattgttaaatgtagttatatttgaataaaaaatgaatcatttccaaaa

SEQ ID NO: 490424 - DNA, 511 bp, Homo sapiens
  misc_feature (11)..(11): n is a, c, g, or t
  misc_feature (22)..(22): n is a, c, g, or t
  misc_feature (33)..(33): n is a, c, g, or t
  misc_feature (45)..(45): n is a, c, g, or t
  misc_feature (67)..(68): n is a, c, g, or t
  misc_feature (95)..(95): n is a, c, g, or t
  misc_feature (187)..(187): n is a, c, g, or t
  misc_feature (400)..(400): n is a, c, g, or t
ccccccccccngacccttattnttgtgcacccnttaattgaggtnattctggccattgtgctacttnnattacttagtactttatctgagcattncctaatcactcatagaaagtctcattttaatttaggtcgcatactattcactcacgctaatgtaccacattagctatatattgggtaatttnctatttcccctaatataaatggcactagagtgaatattctggctcaggaacactgattgttttcttaggataagaaagaggaagaacaagtcaaagactaaatatttcaggtttcttaatgaactttttactattaaagttttaaaacatatgtatgtatttataacacatatggccaaaaagttaatatattaaccctataaaaacagcttngggtatccttaaaagaaaggcatgcatctcagtggcacaaaaaggggaaaaggaaatgacagctcagaaatacatgattacctgtgggaaattgagtagaattcagcttgg

SEQ ID NO: 490425 - DNA, 510 bp, Homo sapiens
aaggtcctgctgcgtgagcattgacgtgtttggagctggagacggcctgggtgctggcgaagcggaggccggagttaatacacgaggaactcatgcaaaggaggggactttcggaaatccaaacttagagtgccttgtatttagaatccggaaggaaaaggaaatgaaatgtgaagaaactcatgcaccaaactcgaactggtaagaagactgttagaatgccctcggtaacacagaggctgagagatcctgacataaatccttgtttgtcggaatctgatgcttccaccagatgtctggatgaaaataactatgacagggaaaggtgttccacttacttcttgaggtacaaaaactgccggagattctggaattctatcgtgatgcagagaagaaagaacggagtgaagccatttatgcctacggcagcagaaagagatgaaatcttgagagcagtgggaaatatgccctattgaatgtttgcattaaaagtgtttatataacttagaa

SEQ ID NO: 490426 - DNA, 191 bp, Homo sapiens
gctgtgaagaggccgatggacaggaggaggtctataagcagctgatgttagagctggagactctgcccagagatgtgtcccggcttggctaacacccagcgcatccttgagatctgtgtgcaaaatactggaagcagaaggaagagatcaccacagatcttgtcttgatacgaacggagcttcaagaaatg

SEQ ID NO: 490427 - DNA, 1278 bp, Homo sapiens
  misc_feature (1278)..(1278): n is a, c, g, or t
ggcggagtctgggccgctgccgtcgtaggggtcccgtcccgatggcgtccccggtatttccggtccgaatccggagtgccgggtcgcgcctgcaccgaaggtcccggctcctgtgcccaccctgcagtccgtcagggaccgtctccccaactcccctttccgctcagtgcagggtccacgcgagccatgctggccgttgttttgacccgcgcagccagaccgtatcccgggccggccagctggcaccatggtggccctgaggcctgtgccagaaactccagggggctaaagggctcagagatgcaggccgtggaggcagcgaaggggtccccgtggccctgagccccgacgccatgaccggggcaccatctgctttccccggcaattgacgccttcagtgttctctcaagagtgaagcaacccaaaagaacgtaccaccgtgcacggattcgttcacccatgggaccgcccacagaactggcaggttccaaaatttgcgaaagattgacactctggcacaacgtgctgacacgtgacccctacattcagaaataattctacgggtagatgccacgggacacccttctaggagcgagcatcccgacgtaacaaagcactgggtatagccttaaataggacacccttgcacatagatagatacatgaactcgcacggggacaccaccacaggaatggtgcactggcacagtctcaagaacaagttggtaagacaacacacaaccgtggtcacactttgtggcaactaccacttatgcacagggctattccacaacagcgagacaggacaaccgccacctagggacccacaaccattatttccagcacgtgtaaaactttaaggcggcccaagaaatatttatttagaagcccgtgatgaaacgcaaccataggtcctggaagtaaacgcactacgcattgagagattcacaacagtggagtaaagatacaccagcacaaacacgaagattcataaattcccatatccattatacacgcgcgcttaaaaacgcaaaacagcaacgagaatttagctcagacgcatagaaacccgacagacaatcgtaactatcagcagactctatcgccgtggaagagagttcataaagggtagatccacattggagcattacttaaacgaaggcccggtcctcaaggaccgcagaagcgaataggggatcggcactaaacggacaaccccccaggaggagtataaccaccaaaagcgcggggaagagtctaaatggagcgccccaaggan

SEQ ID NO: 490428 - DNA, 177 bp, Homo sapiens
agggttgaagcggttgtggttggtgcaggcagcactggagcagtcatactgagggcacccacaggttggagcgagccggtgtcaaagaggacagtagaaatcctgggcaggagttcctgatgccgattagtgccgaacgtactccaatatccagcgtagttctccgagggagctgtt

SEQ ID NO: 490429 - DNA, 961 bp, Homo sapiens
  misc_feature (464)..(464): n is a, c, g, or t
  misc_feature (477)..(477): n is a, c, g, or t
aaggtcctgctgcgtgagcattgacgtgtttggagctggagacggcctgggtgctggcgaagcggaggccggagtaagaagactgttagaatgccctcggtaacacagaggctgagagatcctgacataaatccttgtttgtcgatcctgttctaccttttaaatgatgcctctcttatatctgtaaggaatctgatgcttccaccagatgtctggatgaaaataactatgacagggaaaggtgttccacttacttcttgaggtacaaaaactgccggagattctggaattctatcgtgatgcagagaagaaagaacggagtgaagccatttatgcctacggcagcagaaagagatgaaatcttgagagcagtgggaaatatgccctattgaatgtttgcattaaaagtgtttatataacttagaaaaaaaaaagacaaaaacacaacacaaaaaaaaaaaaanaaaaaaaaaaaanaaaaaaaacaacacaaacacaacaacaaaaacaaaaaacaaaaaaaacacacacaaaaccaacaccacacgcgcacccccccccaaacagaacagaaaggaaaggcacacagagtacacacccacatcacaacaaagaaaaaaaagagacaacacaaagaaaagcaaacaaacaaaacaacaaaaaggaacaagaacaaacaaacaaaaagaaaggaagaacagcagagcacaaaaggagaaagagaaggcgaagagacgccaaaacacaggcggcagcacaaacaaagacgggacacacccaagacccgaggcacacaacacgcccgcagcagcaaaccaacaaaaaaaacaaaaacaaacaaggagacacaaagaaccgaaacaagcacacacaacacaaaaaacgcgaaacaagacgaaaccgaaaaaaaaaaacaaataacaaggaggccacgcgcacaagaacagcaagacacgacgag

SEQ ID NO: 490430 - DNA, 440 bp, Homo sapiens
aaggtcctgctgcgtgagcattgacgtgtttggagctggagacggcctgggtgctggcgaagcggaggccggagttaatacacgaggaactcatgcaaaggaggggactttcggaaatccaaacttagagtgccttgtatttagaatccggaaggaaaaggaaatgaaatgtgaagaaactcatgcaccaaactcgaactgggaatctgatgcttccaccagatgtctggatgaaaataactatgacagggaaaggtgttccacttacttcttgaggtacaaaaactgccggagattctggaattctatcgtgatgcagagaagaaagaacggagtgaagccatttatgcctacggcagcagaaagagatgaaatcttgagagcagtgggaaatatgccctattgaatgtttgcattaaaagtgtttatataacttagaa

SEQ ID NO: 490431 - DNA, 1046 bp, Homo sapiens
  misc_feature (590)..(590): n is a, c, g, or t
  misc_feature (900)..(900): n is a, c, g, or t
  misc_feature (939)..(939): n is a, c, g, or t
  misc_feature (974)..(974): n is a, c, g, or t
tttttataattctttttcacagctaagctccattcagagtatcctttttccgtatttcgctcattttgtggtttgatccttttctccttttcggaatgcacatcaggcttcatgaggaaatcaaatggttaactctttgcctgagacaaacaacacgcagaagaaaatgagaagaacttataagaccagtcttccatagttggagacatgggaaactgtgctcccggacagcagctggagggtggagtctccgaggagatgaagggccttgcccacgaggacaaggtgagaacagcctgtctccatagttggtcctgactgatgtggtggtggaatgttggtagggttgcagcgcttgtcattaactgcttctgtgagtcctatatataattgtcattccacttagtccttaatgaaaacaatcatgtgccattctctgatcttttctctgcgatctcacatggcaatatgtcgcgcaccggctcgttaatccgtcgtcgatgtctgatcgttccccgttacgcttcctccactagtacgtcgtcgtcgtttcgtcgattatccatatcatcgatcctgcgtattcgcgncgtgttgatccgcgttcatcgttctccatcctttgtctatcgtttttcccgttcgccgtatgatttatcgtccttcacgttcacatcatctgcatctttcattcgcttcgttcctatcctctcacattcttcactattatccgcagttggctcgtattgccattgtcgaatccttgttcggcgtcgattcgtatcgtatatcggtgcgcttcttcgattgtcgttgtcatcatcggtattctgtcggtgggatgtgattctcattacacgtcatattgtgtacgcgtaccgttcccgttattcgcctccntatgccattattatttcgcgacggtggtatcgtatatanggcccggtaagtattcattcttacgatttggatanatacgtacacatgttttctcgcgactgggcattccattacgttcttatattgctctcacatggatccacatg

SEQ ID NO: 490432 - DNA, 539 bp, Homo sapiens
tggcagagaggctagatgacatcgtagaactggctgaagaagcgcgacgggacccggctgccaccaccccatcgtgacggacgcagctgcagagtcctaggtgagagtccagcgaggtggctgtcatcggcttctacaaggacgtgaagatcagactctgccaagcagtttacgccggcagcagaggacatcgatgacataccatttgggatcacttccaacagtgacgtgtactccaaataccagctcgacaacgatggggtcgtcctctttacgaagtttgatgacggccggaacaactttgcaggggaggtcaccaaggagaacctgctggactttatcaaacacaaccagctgccccttgtcatcgagtacacacgagcaagacagccccgaagcattaaggaggtgaaatcaacgactcacatcctgctgtacttgcccaagagtgtgtctgactatgacggcaaactgagccaacttcaaacagcagccgagagcttcaagggcaagatcctgtacatcttcatcgacttgcg

SEQ ID NO: 490433 - DNA, 505 bp, Homo sapiens
aaggtcctgctgcgtgagcattgacgtgtttggagctggagacggcctgggtgctggcgaagcggaggccggagttaatacacgaggaactcatgcaaaggaggggactttcggaaatccaaacttagagtgccttgtatttagaatccggaaggaaaaggaaatgaaatgtgaagaaactcatgcaccaaactcgaactgggtatatgtgatgttacctagtaagaagactgttagaatgccctcggtaacacagaggctgagagatcctgacataaatccttgtttgtcggaatctgatgcttccaccagatgtctggatgaaaataactatgacagggaaaggtgttccacttacttcttgagaattctatcgtgatgcagagaagaaagaacggagtgaagccatttatgcctacggcagcagaaagagatgaaatcttgagagcagtgggaaatatgccctattgaatgtttgcattaaaagtgtttatataacttagaa

SEQ ID NO: 490434 - DNA, 320 bp, Homo sapiens
ccaggtagacctaactcatgcggtttcagcccatttctttggggcttccgacttcttgtgattggccatcgcgcgctggaacgcgccgtactgcaaagaaacaaatgcgccacagtcagataatccaagagagtacagttcgttcaggctttcattatcaatggctttgtctacagctttgcgaagaacttcgtgctcgagcttggcgagcgcctctttctcgcggggtgtaagtttgatctcacccatgtcctgtagcctcatcgtacgctgctgagccgaaaggggctctaccgactacctgggttaggtctacctgg

SEQ ID NO: 490435 - DNA, 140 bp, Homo sapiens
tccttgaggatcccgattacgtctgacggcaggtcagctcctgctgcaggtcagcaggagggtgggtcttgggagtgaaaggccgcctgtccccgtgggccagctgcaggcctctcctgaccatgcctctctaggcctct

SEQ ID NO: 490436 - DNA, 816 bp, Homo sapiens
ggaaaattgagactgagtaggagaaagattgaaacgagctcatcagaaagttcttaaagtggatccttctattttctctgcttggggtttggtctgtactgtcctcctgccattgtcctcttcttattctgccagacagcaggtgctatgttctgaatctcaaaaattgaaagaatcttttgtctcaccagcagcgcccattgaaaatgataaacaggagagggaggatgagaactggcctgtactgtcccctccagtagcagaaatagagaccccagtacaaaaaattctacatgctgtggccatagctggcgagccactaggaccttgcacttttcctattaccttaaggcctgatccaaataatccacagcagtttattcatgaacacactccagtaaaatttaaattattgaacagaattaaaagctagtgtggttaataatggaatacagagcccatttactttaggattgttagaatctgtattcagcactatgcgcctcccacccttggatataaagcatttagcttgcacttgtttctctgctagtgcatatttgacatggaatttaaattggcaacgaaatgtgttgcagaccaggctagacagcaatctcaccgctggacatgggaacattaccgaggaaatgctattgggtagtgactcttatccagatctggtgcaccacttgacacttccagatgctgcttaccatcagtgcgcctggccgcttaagggtgctgggccaccattcctgagagagggtcctcaataaatcttttcgcatattctgcaaacatcacaggacccct

SEQ ID NO: 490437 - DNA, 199 bp, Homo sapiens
caggaggattgcttgaggccaggaatttggcacaatacagccagaccccatctcaaaaaaaaaaaaaaaaggggaaaaagaagaggagggtgaaagtccaataccagagctttttaacgagatttccccataatcatatctgaggttcaacaaattaaatagctttaaaataaaagacacagcagattatggctaagga

SEQ ID NO: 490438 - DNA, 242 bp, Homo sapiens
  misc_feature (15)..(15): n is a, c, g, or t
  misc_feature (20)..(20): n is a, c, g, or t
  misc_feature (23)..(23): n is a, c, g, or t
  misc_feature (34)..(34): n is a, c, g, or t
  misc_feature (56)..(56): n is a, c, g, or t
  misc_feature (92)..(92): n is a, c, g, or t
  misc_feature (96)..(96): n is a, c, g, or t
  misc_feature (104)..(104): n is a, c, g, or t
  misc_feature (111)..(111): n is a, c, g, or t
  misc_feature (114)..(114): n is a, c, g, or t
  misc_feature (123)..(123): n is a, c, g, or t
  misc_feature (128)..(128): n is a, c, g, or t
  misc_feature (138)..(138): n is a, c, g, or t
  misc_feature (144)..(144): n is a, c, g, or t
  misc_feature (146)..(146): n is a, c, g, or t
  misc_feature (150)..(150): n is a, c, g, or t
  misc_feature (157)..(157): n is a, c, g, or t
  misc_feature (162)..(162): n is a, c, g, or t
  misc_feature (171)..(171): n is a, c, g, or t
  misc_feature (173)..(173): n is a, c, g, or t
  misc_feature (189)..(189): n is a, c, g, or t
  misc_feature (201)..(201): n is a, c, g, or t
cctttcccccatagnaaggncgnccttccctgcnccatgcccagagtatagctagntcccttcccctccctaccctctgaatgtgtgctagnagtnccccactnttttctnaancctgggagncgggnctccccatcncccctncncacncttcccntttcntcccccagngntgtctgaataaagtgngaaaaccttttntgttttcctaaattgacattttcaatgaaaaaaagaatcac

SEQ ID NO: 490439 - DNA, 144 bp, Homo sapiens
ggcagcggcacaatcgtcatatctatcagagattgccctgcatggccctacctcacagctgaaatataaaaaaaacaggatgggacaccagccacctcctccaaactcaacaacattctataactgataactccctgagaccat

SEQ ID NO: 490440 - DNA, 197 bp, Homo sapiens
gcacgaggcagtggtgggaattgtgaacggtaagccacgcagctgctgagaactagcatttaggatctgggcttggagcaacatttttaacattatgtgactttcctcgcatcaagaaggggaagttctcccttatggccacactgtcattcaatttgtcctttcaaccctcagtagggcaagcagcgcggcattct

SEQ ID NO: 490441 - DNA, 474 bp, Homo sapiens
acaggggaaagggggacttactgagcaccgtgccagtatccggacaccacaggggcccttcgctcgacgcagagaaccacacttgacaaacgcttcactcaacactaccttcctcgccagaagatgcacaaggaggaacatgaggtggctgtgctgggtgcaccctgcagtaccatccttgcaaggtccaccgtgatcaacatgcacagcgagacctccgtgcccgaccatgtcgactggcacctgtgtaacaccctcttcctgaactggtgctgcctggtcttcatagcatacgcctactctgtgaagtctacggacaggaagacggttggcgacgcgaccggcgtccaggcctatgcctgcactcgtaagtgcctgaacatctgggccctgtctgggcatgctcatgaccattggattcagcctgatactggtattgggctctgtgacagcctaccatattatgatacagtt

SEQ ID NO: 490442 - DNA, 255 bp, Homo sapiens
aggatcccgaaacataatgaatgatagtgacgtgcttaagtaatacaggacagcacgggcagaatcacagttcaataatacagtgaacagcatgggtgtctcaactgggtggaattagtccgcataataattcagcatcataacaaaaatctagcaagggctgttgagcaagtgaattggcaaaaaacgttcacaaataaactttatgccccttgaagcgagttctgcattttaacacatttctatgtgttgtcg

SEQ ID NO: 490443 - DNA, 330 bp, Homo sapiens
tttttgagacggagcttggctcgtgttgcccagactggagtgcagtggcatgatctcggctcactgcaatctcctcctcctgggttcaagcgattctcctgccttagcctcctgagtagctgggattacaggcctgtgccaccacgcctgactaattattgtactcttagtagagaaagggtttcactatgttggccaggctggtcttgaactcctgacctaggtgatccatctgcctcagcctcccaaagtgctgggattacgggcgtgactgtgaaaaaaaggcccagcttttgggttttttggcagggtctcactttgttgtcgacg

SEQ ID NO: 490444 - DNA, 105 bp, Homo sapiens
ctggctgcagcccgctggggctgagacattcttgcgtttgctgcgtgagggtaacgacaaccacgacggctacgcagctgctgggcgttacagcgtgggctggat

SEQ ID NO: 490445 - DNA, 868 bp, Homo sapiens
ttccatctatcgttcatccaattcgtcctaatgtttctcaatcttttctatccgtgtgtgtcccattggctactatggtcttttgcttttgcgacataataaatctggtctgctcagtgctagcggactgttctgtctacccgataatgggtatggatttatttatgaaatgtctgccgtcactggtgtcatcggccgttctcttcctcgtgtggactctggctcttcgtctgctctattctgttcatttctctcattctctggggtttccggtgtctcttctgtctgtgttgtcgtattcttcacgggggcttttcttgattgggttggttccctcttggatctgtccgtatccgttctttccgctttgctctgcacacggcctatccgtgctctgactcggactctgctgggcttgccactcaaggattgactgtatgctgtgcgtttgtcccctcgtcttgcagcgctgcaactcccgtgcggggctttggactgtgacagcggtctggggtcgctagggcgcttgggctgtgggcccccgcggcgccagcctcctccctggtccctcggaaatcgttgcatcatcacttctgagaacgaaatctcgcttcagtcactctgcacgataggcagctgacggcatcgcaggctcaggtaacctctgggcccggcccactcccagggcctgccgctccgtgggaataaaacagctcctccatttcccttgaaaactgaacgattacttaaaaatagattaaacttcgctggaaactgagtagccaggaagttcaggggatgggttgccgggtccttcccgggcctggcgtgtcggagccaaaaactgtacccgcatgctgccgctgag

SEQ ID NO: 490446 - DNA, 109 bp, Homo sapiens
  misc_feature (25)..(25): n is a, c, g, or t
tcgagctcggtacctttctctaacngtcgatgtgtgattgaatctgtcagaatacagaatacgcatctcaagaaagcgaatacggctcgttgttcctgatgatgtagat

SEQ ID NO: 490447 - DNA, 158 bp, Homo sapiens
agtcctcagttccagcactccaatagccagctcacctcctcatcacacaccctacaggagaagcattagggctctccgactacgtcgtttcgatagctattgcctatctaaagaggagactcctgatagcaaggcggtgaagaccttagctagccacg

SEQ ID NO: 490448 - DNA, 113 bp, Homo sapiens
gggccccaaaattttttttttttcccgggaaagggaaagggggaaatttaaacccttcccgtttgttttgggaaggccgggatttttcccaaaaaattaaaaatggggcggga

SEQ ID NO: 490449 - DNA, 943 bp, Homo sapiens
gcctgcctcagcagcaccaggttgactgctcgtgtgccagcggtgtggggagtgacggggcttggacgctgcagctctctccagccctgttggcatcctcaggtgcctgtaggcctctcgctgcctgtgtgggctgtctggggagggtggccatttagggatcgtggggacggggtccactcccaagaagaaagagaggcccgtcctaccagggcccgggtctgggccacggtgccccggaagcaggtgtgtccaagaagtcagctgagggctctcctcgcgacagcaccgagcgagtgaagctggtgctccgtttctgctctcatgggaccgagtccagcttccagccgttctggctcgagggtggtctgaccaattccttctgagtgggcttctctgggagctctccagtggactgtggacctggccacgttgttctgtaaaatcaggatacgtgggctttaggtaaagcagacaagggcttcggtggcagggaaaggtagcgtggggggaagtcaacttgaaaagtgctgcctaaggaaggttggaattagtccctgtttccagaatggctttgaatttttaaaacatgtgctttggggaagtaggttcaggaggcactaggattcagggatggttcatttttcacactttcacaagtccattgaaaactgagaagaagtggctttcaggggtgacacctatcacgttccaggccggatcactgagatccgaagggttgaagaatcttcgtaaagcggtcgagaaagccttttgctggtcccctggcacattccccgcggaattaaccggtcccgggtctcgggggaattccggcgctgggctggattgggaagcatgcagatgctactttttggcaacagggaggtgtgtccaaaaacgcggagacccgcacttttatggtgggagcaccccaggggga

SEQ ID NO: 490450 - DNA, 274 bp, Homo sapiens
cccgttaatatcggtgcgatacatagcagatgcttgatcccgatcttccttcctcgactttattatatatttgctcaagttatgtgcttagtctgccaaggacatttcttccaaaatagagcaagataagacaatgtgtctgaacaaacataactaagactctcctaatcgagctttagagatttagctcatagttaatctcttctgtgaagtcttccctgtacccaaggcagtattaatcactcttgctgatggactactctgacattttact

SEQ ID NO: 490451 - DNA, 290 bp, Homo sapiens
aggattgcttgagcctgggagtttgaggctataatgagccatgataggaccactgaactccatcctgagtgacagggcaaggtcctgtttctggacatggtggcacatgtctgtagtcccagctacttgggagactgaagtgagagaaccacttgagcccaggagtttgaggctacagtgaaccatgatcatgtcactgtactgtagcctaagcaacagagcaagacgctgtctctgaataacatgttgcccagtcagtttctcttcctggattcagaagtctttcatgg

SEQ ID NO: 490452 - DNA, 146 bp, Homo sapiens
aggatccacctcagaggcatattcttagcatttccggatcgtgactctagtaactcctgctaacctgtctaagacccggtttggacatagcctttccgtgccttctttacactccaactctattttgcttaatctggttaccgagg

SEQ ID NO: 490453 - DNA, 485 bp, Homo sapiens
agctccagctacagctcagaaagaacaaaaggccatcaaactccagtcatgcaactggagaggcggacaatggcccattctgctgggaacccttaaataggcctctgagggactttgactgctgttttgccgaaacagcaccccctgtcagcaggaagcagttaagatcggtctttgtccttatccttatccttattctaatggcagttagatgcatttctttagagggggcaatgagacagccaggtgggaaggggtccccagagaaactccagcctgcacactgggaggagtgtgcactggggtgaagacacagaagtttgcgccatttccagtggggaagagcccagcccctcctcttcctgggtggaacctgaaattcaaactgccaggtgggaagcccacaagcagggagtctggctttgcagaaggaccgtttccctcttttccttttcacccaataaacgctgccctcctcacacttc

SEQ ID NO: 490454 - DNA, 118 bp, Homo sapiens
ctcgtagtctgaatgtgaaaaatatctgaccatttctgtagcaggtcttctccctccctctgcttgcatttctccttttcctctagtggactctggttgttctgctctaccgtagatg

SEQ ID NO: 490455 - DNA, 355 bp, Homo sapiens
actcagacaagtgaccgcactgacacattcatggaacaaatcgtggtcaatctttatcaattataaatatgtgtttcataattaaacattattttattttatttttattttcttttgagggccacacctgcagcatgtggaacttcctgggctaggggttgaatcggagctgcagctgctggcctataccacagccacagcaatgctatatctgagctgcgtctgtgagctgcaccacagctcatggcaatgccagatccttaatccactgagcaaggccagggatcaaatctgcatcctcatggatactggttgggttcttagcccgctgagccacaatgggacggtcaacttg

SEQ ID NO: 490456 - DNA, 115 bp, Homo sapiens
cggccctccatgactgcttcagactcttgaaattctctaacatctgtgggcacacaatcccttttctttgataaatttggcaatctccatggcttcaagtatcaaccacatatag

SEQ ID NO: 490457 - DNA, 834 bp, Homo sapiens
atcgtctttaaagccctgcgtgggaatccactgacgcaccgtcgtgatggccagggaagacagggcgacctgtgaagtcgcaagcatacttccttaacgatcatccatacataagttggattgattcaatgcgaagatgttctcgatgtgtgggagcagcacaatgtgggctccaagtcgatgatgcatgccaggatctcgccattggtcccttcgtcggagagaggactgtcggtgcgttgagtgtgcgcagatgtaacaccctatggatgtctgcagagtgccatccggagggcagcgtggagaaacaagccagactctggagaaacctggtgcctcatatccgggggaatgtgggctttgtgttcaccacaggaggagctcagtgagaatcatgggacagtgttgctggccagattaaggtgccatgctggtggctccgatgctggtgacattgccccatgtgaagtcacgtgtgccatgcccagaaccactggtctcgggcgcgagaaagactaccttttatccaggctttatggtatcagccacgtaaaactctccaggggcaccattgaaatcctgagtgatgtgcagctgatcgagactggagacaaagtgggagccagcgaagccacgctgctgaacatgctcaagatctcccccttctccttttgggctggtcatccagcaggtgttcgacaactggcagcaatctacaaacctgaagtgttgatatcaccagaggaaaactctgcattctcgcttcctggagggtgtcgcaatgttgcaggggtatgcctgcaggatgggtaccccactggtggatcagtaccc

SEQ ID NO: 490458 - DNA, 211 bp, Homo sapiens
actctaaaagatcccctgatgcctcctgatctattcataagcctggaagaacaacactgggatgacgatgagcagaatggtcatgaagatgcccaaaatcagggcccatatgttcaagcacttggcgggggaggcataagcctgggccccggtcacgtcgccaaccatctttctgtccctagacttcacggagtaggcgaatgctatgaag

SEQ ID NO: 490459 - DNA, 320 bp, Homo sapiens
agatcccccaccgcagtgtgaatggagtgccacctggagcagaacgtaactgggggttttactaaagctgctgaggggcgtaaacaaaattggacgtattggtattttacctggacttgtgaaaggacgcaattcagttgaggtatttgtgttacattgtgcactgtagtgaaatccctgggaatggaactggagtgaagtccgagattgtcttttagaaatagatacagaacggtggtcctggactgctgcgaagtgaactgtgttattattttagggatgagtccagttgtagtaaggcaccgaacaggaattgcaaa

SEQ ID NO: 490460 - DNA, 397 bp, Homo sapiens
  misc_feature (12)..(12): n is a, c, g, or t
  misc_feature (352)..(352): n is a, c, g, or t
ctctagaggacncgcgtcatccgtacacaggatacattacagcaaaattacatgttcaagtctacacactcagaagtactagactttgcagaataaagtcacattttagaaatgcaaaccacttccaacctttgcacagtccaaaaaacaaggcattaatgatttaaagcattacatacatatctactacttgttgtttagaattatttatagtctatctggggttcatgtacaaaatttgtctctaaatcatgtacaaaaagctgtattttgaaaaagtcaccacatactgtacaagtttacaaggaaagagatccccgttattttctctagcatttttggccttgctggncttgcgtcaccaatatgagaatgattgtgtaaaccttatactctt

SEQ ID NO: 490461 - DNA, 706 bp, Homo sapiens
  misc_feature (33)..(33): n is a, c, g, or t
  misc_feature (76)..(76): n is a, c, g, or t
  misc_feature (214)..(214): n is a, c, g, or t
  misc_feature (227)..(227): n is a, c, g, or t
  misc_feature (258)..(258): n is a, c, g, or t
  misc_feature (272)..(272): n is a, c, g, or t
  misc_feature (282)..(282): n is a, c, g, or t
  misc_feature (285)..(285): n is a, c, g, or t
  misc_feature (311)..(311): n is a, c, g, or t
  misc_feature (317)..(317): n is a, c, g, or t
  misc_feature (321)..(321): n is a, c, g, or t
  misc_feature (324)..(324): n is a, c, g, or t
  misc_feature (367)..(367): n is a, c, g, or t
  misc_feature (372)..(373): n is a, c, g, or t
  misc_feature (397)..(397): n is a, c, g, or t
  misc_feature (426)..(426): n is a, c, g, or t
  misc_feature (434)..(434): n is a, c, g, or t
  misc_feature (446)..(446): n is a, c, g, or t
  misc_feature (451)..(451): n is a, c, g, or t
  misc_feature (463)..(463): n is a, c, g, or t
  misc_feature (470)..(470): n is a, c, g, or t
  misc_feature (533)..(533): n is a, c, g, or t
  misc_feature (565)..(565): n is a, c, g, or t
  misc_feature (587)..(587): n is a, c, g, or t
  misc_feature (594)..(594): n is a, c, g, or t
  misc_feature (609)..(609): n is a, c, g, or t
  misc_feature (612)..(612): n is a, c, g, or t
  misc_feature (614)..(614): n is a, c, g, or t
  misc_feature (617)..(617): n is a, c, g, or t
  misc_feature (619)..(619): n is a, c, g, or t
  misc_feature (632)..(632): n is a, c, g, or t
  misc_feature (653)..(653): n is a, c, g, or t
  misc_feature (677)..(677): n is a, c, g, or t
  misc_feature (691)..(691): n is a, c, g, or t
tttaaggaggccacatataacattttcccagtnccagattctacagagtagggacacccccacttccatttcaatnctgaagcaagggagccaggaatgacaggagatgtttaactgatggttacactttataccctcactatgaattctatttttatactaaattaacttagttatgagatctgattttccatctctccaggttgaacttctncattaggccaatncgtttgcaagtgggcactgtttcagcacctnattgaaaccctcanagagcttgangtnaccctggttctgggcacactccaganactgtntganctnatagaggcaaggctgctgctgctgttctggctgggttccctgnggctnntgggaagtgaggtgagggctgggnggcggcagcattgcgtgtcctcgcactgnggcgcccngtggtggcgtgngcgantgtgtgccccanagcagancccacagctacgccagcggcggtggttgcgatcggggcgatcagagctggctgcgggggcgcngggcggagggggcggagcggcggaggggggtnccgctgctggtggctgagcgantggtgcnggactgggtgcagcnctnanctnangggcccggctggncggaggggccatgcgggaagngcggcttcggcttccacgcggcancctaggtacgcgangcctaggcctccgga

SEQ ID NO: 490462 - DNA, 729 bp, Homo sapiens
tgggaggagaattggccacggggaaaaaaggacacaatacccacaaaagggcaagggtaagggggtgtgttttccgggaaacacactggtgggtttaaaggtgtgtgggggaaaaccctttggaaaaaaagaaaaacactgtgttaaaaaacacctctctataacgaggggtaagagtggtgctgtcgcccagagggttttgggaaatttggggggtgtgtaaattttcttttgagtttttaaaaaatataaaaatttttaaaaaaaaaaaaaaaaaaaaaaaaaaaaaaaaaaaaaaaaaaaggggggggggcgccaaaaaaattcccccgcggggggccccaattggcggccgcccccgtttttggggaaaaggggggcccaaaaggggaggggaatataaaaaagagagagagagcgggggcgcgcgcggttaaaacaagaggcgggcgaggggagaaaaagcggggaagggggagaacacgtggggagaaagagaacccactccaggggggggggcggacaaaataggggaaaaaaccccccacaaaaaattaaggcctagggggcacaaaaacaactcaaaagggggaaaacagggcgcgaacaccaaacacgagccaaaaaccgcaacgcacgcggcgccgagacaacacaaacaaaatgagggcatccccacgcaggaaaaaataaaaataacacaacaaacaccacattaaaacacaggag

SEQ ID NO: 490463 - DNA, 622 bp, Homo sapiens
ggattattatacagagtaaagcctccgctgttaatgtctccagtgtttaatcatcatacagtaggatggttttatgcatatttcatttgcatatcattaaactacgttagcgagggggcacccagagccgagaggagcacaaagttgggaagacagggaaggaaaaagagattccctatgatgcttatcttcaaacgggggcttgttccttccatgatgtgtcttctgcctttctaaaatcattatgacttggaaacctttgaagttggatacaaccttggattcctctaattcctgcagagcggtatatttttaagatcggcagcaatgtccctgcactagacaattaaaggaatataaactccagtgggctgagactagtagctctttggggaacacagtggcaggagcttctacaaataccaacacttaaaaaaaatcataataaagaacgtcataccaaaaacaaagaaagaagacaagagattttaacatgtggattatattgtcttgttggggggtaataagctaaagagagtgaagaagtcatggtaatttatcccctcattaatgaagtcaccctttttatttgtgacaaaaccaacaaaaaaaaagaaaagag

SEQ ID NO: 490464 - DNA, 200 bp, Homo sapiens
agacctctcggaactcagtggatccaggcatttgggaaatgtatcccgattgaatgcagtatattccatgcagcatggtgcaatggatgccgagtgaatgcagtggattgcatacaacgtggcccaatggtacctgattgaatgcaggggatcacatgcagcgtgcttgaatgcagtggattctatgcagagtggtgcct

SEQ ID NO: 490465 - DNA, 338 bp, Homo sapiens
ccagattggcctgcagcgcattgttctgcaggtcgctggtcacatcggcaaaatattgccggtcctgctgcagcgccagcaggaatttctgcgaccatggatagagatcgtcggcattgatgccctgcagcacgaactggtactgcgcgcgcgacgacgtgctgccgatgcgcaggttctggatggcgatgggatagctgttgatgccgggcgccttggccagcgactggcgcaggtccgtcagcagcgggtcgagcgccaggcgctgggatttgggtttgagctcaacgaagaaactgccctggttgaggctcgatgaattgaagccgccgccgatg

SEQ ID NO: 490466 - DNA, 252 bp, Homo sapiens
gatccccaaaatacagccttcagagagacatacgttagctctgggctagatatacatccacctacaatgatgggggatagcccgagttcaggctgggagcttaatcagtcatagggtcaagtgtgagttaagcaagggctgagaaagctgcatctccagtgtcattaacacagtggaaaggtacgataagcacacacactggtaccgataattcatgatacatactcttgagtctgcaaaagcttcttgtgc

SEQ ID NO: 490467 - DNA, 891 bp, Homo sapiens
gcaccatattgcttttccgaactttcgtccacattccaggcctcctggcagacttaacctttatgtctttgtacgtttcgtgatgggttggttcttttgctgcctgtttgtggtctatttgtaggatagtttagttcccagacagtttgtgtctaatttgatcttcttggacattgtccctcatggccaccagattctaatgccataaggtcccagctggttccccagtcacagaaccacccagacaggaagccgggggtacaaatgaccctcggcacaacaacagagcgctcgtgcattatcagcaagagcgccatccacagaccaatgcctgtggccagcacctgacactccagcactcgagctggagttgcatccaagaggtcaggcccagcagggcctcacctccacatagaggtggctgggccaacttgcccaaagcacgtgagacacacagggagctttatgtgttcatcttcctgctttagaaccttgctcccgagatctatggatttttcttgaggaacaagaccacagaggttccccttgaacccatccacatacctccctatactgccgtctgtctcttagggaccctggtcatgagagatatttcatctgaggccatcctagggagcaggagacacttacagcggttacataccctgaacttagtatcaaaagagacatagctggagtgacattcccagacacgaagaggagtgacgacgacaaaccacagagcactgagggacaaagtggctccaaagtaggcagccacctacggaagcacctcctgggattgagagggacacgcacatgcataccaaagcctaccccaagcaaacaacacgaagcacaacaaggctcagaaacagtgccctaccatac

SEQ ID NO: 490468 - DNA, 614 bp, Homo sapiens
  misc_feature (177)..(177): n is a, c, g, or t
ttttgtatttcagtaagatgggtttcaccttgtaaccgggtggtcttgattcctgacctctgatccacctgcctcagcctccaaagtgctggattacaggcatgagcaccgcgcctggcctaatgcttggtttatttcatggattcttgctagaattttcctttaataggattttcntaagtcatcttaaactacccccctttgcaaatttttcatgttaattacagccatacttcgaaattttgttttctggtggatattcctgctaaaaattattatttgttggcactaaaattatgtgatttagaaaaccttgcctcatggagataaattactttcttttccagagattcccgaccttctaaatgccagtaatctgaaaacctttagggaatggggctttgatttgaagaaattccccaaccttaaaatgagaaaaatttgcgctaatgatgccattccccagacgggccagaggaaaacttttataactgtaggcccagatttgggggaattggaacttaacgatgaatccagtgattcagatgaggaaatggctgcagtggcctaattgttttcccttgaattgaaaattaataatttgagagcttcca

SEQ ID NO: 490469 - DNA, 858 bp, Homo sapiens
ccgtcaatctacctctaccatcttagcaggcacactcatcagcagcgctaagctcgcactgattttttacctgaggtaggcgctaggaatataagatcatgactagctgttattccagtttctacaccacaaaaggaataaaccctgcgtgtccacagaagctgccatcaagtatttcctcacgcgagcaaccggatccataatccttcgaataggctacttcctcattcgaacaatagtactctccggtacaactgtaggccagtaagccaatagcataccaatcgaatactctagtcgatgttaactagagtcagtaatggctatagcaataaaaactaggaatagccaccctgttcgagttctgagtcccagaggttacccaagggcacccctctgtacactccggcgctgtctatctgtctctagatgacgaaagcactatgcgcccatctcaatcatatagcaaatcgtctccctcacataaacgtaagccttctcctcactctctcgaatcattagtcgcatgcaatagcaggcagttgaggtggattaaaccagaacccagcctacagcagaaatcgttgagcatacgtcctcagattacccacgataggatgaataatagcagttctaccgtacgaaccgtaacataaccattcttaatttaactatttatattatcctaaggtactaacgattcctactactcaacttaaactccagcaccacgacctactagctatctcgcaactgaaaaagctaacatgactgacacccttaattccatccacctcctctccctagaggctgccccgtaacggttttgcccaatgggccatatcgaagaatcccaaa

SEQ ID NO: 490470 - DNA, 117 bp, Homo sapiens
gtctagatgatccccgaaagaggagaggtggtcgggtcaagatagcagcagcaggtgtcagtggctcaagacagcaccccctccagcttctggggcccaggagcctctccctgctac

SEQ ID NO: 490471 - DNA, 804 bp, Homo sapiens
ctcatacagccagagctgtggacccacagctgcagtacctgagctcaaactccgcgaacaggacgtcgaatgtgcctcagcgcttccctcatcttctctgtcacaggccagctcgtgttcccggtccccgcaggaggttctcttacattcagagcaatcagtgagggctgataaccgatgtcccccaatgtgacccacggggttcctcacagtggccccacggagcacgggaggagcatgggcatgcgcaaggataagccacagtggatgaagttcaatgaagcttggagcttccatgttccacaattcatggtctgtgctcctcatgggatgaagcgaggcgggctgatccagggctcgcgaggtccccaagcactatcttagatggagccgacaagtacaccgacactagtctaaaagttgctcactagcctaggaggaatagcgcaaaacttccccggataggcaaaactcatcagtgtagagagtccctggggtcctgaggcgaggtaaggaggtgctcctccgcacaccataaatccacccatgtctgccctgggttgctgcgacggcagctccccagccgtgcgctcagcagattgggaatttcaccaagctgccctctggcacaggggctgagtccaggccctggtagacctgttgtcacagggaggcttgtctagaggccggggcctcgccaggtttaggatagaaccaatccacctgctgtcccctcagtggatgatcaagtgatgcaggacaagaagccatttcccaggtgacagaatgagacggcgctgatcg

SEQ ID NO: 490472 - DNA, 289 bp, Homo sapiens
tctgagcatccatcaatacctggtactatggatggggcttctggttctcggcgggagggccactaccctaggggggggagagagggcacaccagatgctttggtgagaaagggaggggggagtgagagccttggccttgagggtgtatgtattcacatagtcctcagggctcagtcttgggaggtaagtggaatgagagggcctggcttctcttctttccattcttctggctacacccctttgccaggggcgggggaccaaggcatctctggaaaggcaaatattatcc

SEQ ID NO: 490473 - DNA, 162 bp, Homo sapiens
ttcaaagctacccgtcaaggaaaggattcggtatgtgattagcaaacatgagcttctgcagtacaacacgtgaagatcattcgtggtgtgcctcaaattttatggtacggtacagccttcgcttcagtgctccccaacgcttccgctaattttttgcagaaa

SEQ ID NO: 490474 - DNA, 361 bp, Homo sapiens
gatccccgacacaaaagcggcccaaatgagttctttatctgccccacactctgcccctctcagcttggtccaggcacctccacgtaggctgcacagaagtggacttcgtaaggtttattgggaagggtacagagtccatccccatccagggtcctgagaatgggctggagaggaagaggtggatctcagtgggctttcttgctgtgctggatggtcttggggaaaggctgggggcccagccagagctgcagcaggatgacagcatggcacacgtgcagggcagcagagctgcaggacgtggatgggtatgtgttccaggagagctcaatgagccccagcaccagcaacccgcttttgtgtt

SEQ ID NO: 490475 - DNA, 117 bp, Homo sapiens
tgcgtgcagccgtcgcgattacgctcctagacgggcaggatgatccattagaccgaggcagtccaaggttcacagtgcagggtcaatcaatgcatggtaggtgatgtagatatgggg

SEQ ID NO: 490476 - DNA, 244 bp, Homo sapiens
gtttttttttttacccccccatttttgtggggaagcccaccccccgtgtttttttccccctcttaaaaaccccgcggcgccctccccccccccggttttttccccggcccgggggggggtcactttttttcccccggacccctttttcccttttggcctttcccaaaaattttttttggggccctttaaagggggcccccccggggccgggtccggtttttccggggggccccccggggcccga

SEQ ID NO: 490477 - DNA, 212 bp, Homo sapiens
tatgctcatccccccatggcatggcttgggaaaggagaaaaaaaatagaagaaggtcggccgggctaggtggcttaagcctgtaaccccagcactgtgggaggccgaggtgggcggatcacctagaggtcaggagttcgggaccagcctggcaaacaccccatctctactaagcgaaaacccagtctctactaaaagttacaaaagattagc

SEQ ID NO: 490478 - DNA, 297 bp, Homo sapiens
attcgcggccgtcagacaagcgttcctttttcatccacaaccctgtcagcatctgttgtttcctctccccaaaatgctatggtctgaatgtatgtatcctccaagacctagatccagcaatcccattactgggtatatacccaaaggaatataaatcattgtattataaagacacatgcatgagtatgttcactgcagcactattcacaatagcaaagacatggaatcaacccaaatgcccctcaatgatagactggataaagaaaatgtggtacatatacaccacagaatactatg

SEQ ID NO: 490479 - DNA, 439 bp, Homo sapiens
gctcttattgtccaggaggcgaaggttgcagtaagctgagatcatgccactgcactccagccagggcgacagagcaagactccgtctccaaaaataaataaataaatacataaaatgatttatatgaataatagcaaagaataaaaaaaagaagagccgggcgcggtgactcacacctataatcccagcactttgggaggtcgaggtgggtagatcgcctgaggtcctgagtttgagaccagcctggccaacatgatgaaaccctgtctctactaaaaatacaaaaaattagctggacgtggtggcagatgcctgtaatcccagctactcaggatgctgaggcaggagaatcacttgaacctgggaggcagaggttgcagtgaaccgagatcatgccactgtcctccagcctgggcaacgagagcgaaactcttgtctc

SEQ ID NO: 490480 - DNA, 565 bp, Homo sapiens
  misc_feature (88)..(88): n is a, c, g, or t
  misc_feature (205)..(205): n is a, c, g, or t
tgttggggagaagcttttttttttaaaaagaaccccccccaaaaaaaagggcgggcggggggggggggtatataataaaccctttttnaaaaagggggggggttttttttccggggggaaaaaaaagggggggaaaaaacccccccccccccggaaaaaaaaaatggtgggggggggggggccccccctataaaaaccccccccnaaaaaaaaaaaaaaaaaaaaaatctttttttttttggcccccccccccccccccccctttttgggggaaaaaaattttcttttttaaacccccccaaaaaggggtttttaaaaaaaaattttttttttcaaacctttttggaagaaaaaacaagccccccccccccttttgtgtgtttccccgggggggggggattccaaaaggtcccccggggccaaaaattttttttccccccaaatatttccggggggcccccaaaaaataaaaaagggggttttttttgggccccccccaaaaaaaaaagaccccttttggccccaagttgggatggtcacttttttttttttagccagcctttcg

SEQ ID NO: 490481 - DNA, 1169 bp, Homo sapiens
  misc_feature (53)..(53): n is a, c, g, or t
  misc_feature (61)..(61): n is a, c, g, or t
  misc_feature (154)..(154): n is a, c, g, or t
  misc_feature (267)..(267): n is a, c, g, or t
  misc_feature (407)..(407): n is a, c, g, or t
  misc_feature (410)..(410): n is a, c, g, or t
  misc_feature (412)..(412): n is a, c, g, or t
  misc_feature (496)..(496): n is a, c, g, or t
  misc_feature (997)..(997): n is a, c, g, or t
ctacatccctagcaaatttttatcactccccctaccacataatactctccganttcttcanctactgatttgcacctgatctagtagacgtgagtcgagatgcagatccaccggactacactactcatacactacctgaagccacaagaggatnatctggggtagcactgagagagcatgacttgatgtggcgcgttgaggacgcagcgatggacccagcttgcagcagaagtacgtgactcggcagtctcactctattgcatgtcntcgaagccctgcgagcaactaagattacaccgtacaatgaatatgtgacccagttggcgcgctggactcgctgcaatagaacccagttctcgattgcataagcaatcgtgcatcctcttcggcaatcccaggacgcgtgncantncaacacaaatcatacgaacactggactccgctctagctagctctattttcacaattactctcacgcccttgagaccctcctcanacctgttaattcttaatcaataggcgcgtttatgcctggctctaatgattactctctacaacccgtcatgtacttatcgcgaatcacaccaacctcaagcacacgctcattgcgacacacaccgacaagtagcgttttggatttcctgtcatcaactgtctcttttcggtctccgagcaaacttcatcattacttatcttgtctaccgtcaacttctctcctcatccgccctatcatatgagggtacccgacatatatctgcgcacttccagtccgtccatacccgtcgaaccaccatatacacgcgctctcgctccacgaacaaataaattatatgtaattataattctatttatatctcctatctccccctcatcgcactccactatcctccccatatagcatcactaccccgacctccaaatatatgatttgtctaatgtactcttatctctctaacgacccacacttgtcatacatcctatcggccacctctatagnccctcctcacacacatctttacgcactaactccgctccgcgtccaatttaactattatctctagacactctgaccattgtgcgaaacgcacaattattcaccatctcgtacccgtatcaacatcattaacctccaacatctgacattatcattactacctcttccctccacg

SEQ ID NO: 490482 - DNA, 1016 bp, Homo sapiens
  misc_feature (536)..(536): n is a, c, g, or t
gccgccgggggggaggaggagagatggacgtaataaaacggacgacgcacgagcgactggaaaagaactcatcaagcaattcatgtgcgcgaggctggtcaattagcgtagctattatattttactaaaggtggtgtaaccggaagtgtaaccccgccctattaagtggggcccgcccttaatatttggggacgagaagaccatttgtgtgtttccaaacaacttccgggggttttcccgctcacccaaaaggtttttggggtccagcaactcaccttggggttggttaagcgagaaaatcgtgctcgggtccttctaggcaacaggcatccacactggccatgtttcttaagggaagaccaccaacagggaagcaatttttctcctgggacccccgagataattgttaacaaagatggaggtcaaaccccagcactcctctcaccccgtgagatgtcatatcattgagcccgcacacaattggtagcgtcttataatcagcaagatgcgcagcgtattccactactatgccctcncacaataagaatagttagtattgatacacgcggtaacatttaaggatacatccttcagcgtttctttctggaaatattaaaaaaatagatccgcggcttctcttgtgtcagctcattttcaataagagagacatcgagtaaactctctcgctacgattatataggatctgataacataatattgacaggaccgctctcgatgaacactataggcgcacacacaccaccaacaggtgaagagatattacttctcccacctccttcttgtagcagtacacagaaacatgtctgtatataatccatcgaagccccccagacagagtgtttatacagaagtcatacacacactactctcattattagtcgcgttctaataatacaaggattaatgaatttcttcttttcagtgctttaaacaaatccctcttccctccccaattgcaaccagttttttttccgaaataaacaacccacatgaca

SEQ ID NO: 490483 - DNA, 153 bp, Homo sapiens
ccggccatcggctggtggtgttaatggcccttctagctcacgcgcgtgtcatgaaccctgccgagaggccggggctgaggccaggcgacccgatcttgggcgcggtctcttgaggtggggccggggtgagcagctgagtccgggtacccggaa

SEQ ID NO: 490484 - DNA, 140 bp, Homo sapiens
actctgaggatccccgcatatgtatagcggcccttgggcatgaccgggacctgctcacgggtccacagcgggtcgaacccggcgcccaggaagcccacgccgatctggtcggccacctgtcttgacctccatcaggtgct

SEQ ID NO: 490485 - DNA, 268 bp, Homo sapiens
tgatattcttaattaaattggaggttgtgagggaagaaaaactcagggtccacagggtgggaaaagtccacaagatcaccctcaagtgccgccatcctctaggaccccgagagccctagcggtggtaaggcttgaagttttgatttattacagtgaaaggttacagattaaaatcacccaaggaaagagatgtttggggcctcttgggggccaaggtggtcggttcacttgaggtgatctggacggttccagaaaaagggtttttcca

SEQ ID NO: 490486 - DNA, 190 bp, Homo sapiens
aggtaaaattggagttaagaaaagggagcgaactccctttttgttgcagagattagcctgcttttttgataccaccacgtgacaatgtgaatgccatgatcgtgagcgtaataccgattgcaataacaaacaatgcagctaaacctgttgcaataccacctatacgaagtgaagcttgagcaagaaagtc

SEQ ID NO: 490487 - DNA, 226 bp, Homo sapiens
gatcacccgaattaacccttacctctcatccaacataacataatacagtcttcctacacctattaatacgtacaccataatcaccaacccatcatactcttcccacccacagtcagcaatcctgacctccatcgctgaccccagtaagacactcaccaagacctcaacccttgaccccccatgccgcatgatactcctcaatagccatcgctgtagtatatccaaa

SEQ ID NO: 490488 - DNA, 794 bp, Homo sapiens
cttggagaagctgatgctgtgacccagaggatgtcagctgccattggtgtttcttgctgaatctttcatacacacacgagtcctgttgtctgtcacagcccaagggttctgtagggttgctataccaatggtcgtaattactactgtacaaggtggcgactacaagagtttcgttgtagagtcctttatactctcgtgccttctagccaagtcatgttccattcatacgagtctagtcgactctgctggtctctgttagaaatatgtgctggctatgttaaaactcaaatcttgtgggttctctgcagggctttgtgatccaatgaggtcactatttggtggggatggttgacagatggcttgctgcactccatcagagataggagtatcaattttctttgtgaaagcaggtcctgatcaccgtcgctctcctgtcaccccattgttgaagagtggtagaactggaagttgaactgcctctgttaatatcctagtttgaagcccaggaatttctagaagtaatcgaagagtgcgctttaatcgcttaaactaattgtttggatcgacccgaagttcctaacaattagcgcaagattgctctttcatatttcttcaagtccatcttgttcgctctggggcgaaaacacagcttaaattcgatacctcctagtaagatagtgccacccaggaaagcacccttcactatttggctaaaaagcggagaccgttcacacgggcatggaagaggtccctggcccgggtgtgccgtgccttttgctgctcccagggtcaca

SEQ ID NO: 490489 - DNA, 432 bp, Homo sapiens
gaaggccttaacagaataagaccgtatgtgacatctgtgccttatgagtaataccgatgtagaactcgtcttgagataaacgggatgcagggtcaaactacataactgccagctatattgagtggatacaaagaagccaggaagtacatagcatggacaaggtcccggggatgaagagctgtcgatgattctcttgaaggatgatttgggaacagaccgccgacaggatagtcatggtcactcgacgtgaagaaggaaacaggaacaattgtgcagaatactggccgtccttggacacagggcactcgggcttttggagatgttgttgtaaagatcaaccagcacaaaagatgtccagattacatcattcagaaattgaacattgtaaataaaaacgaaaaagcaactggaagagaggtgactcacattcag

SEQ ID NO: 490490 - DNA, 115 bp, Homo sapiens
gtaccgtcgcgcaagctgacaggcagcgcggtattcagccctcgccccttgctcgcagttctgaactgcctggggacttcttcaacctcacagcagaggagatcaagcgggagca

SEQ ID NO: 490491 - DNA, 153 bp, Homo sapiens
ccacacgcaagaatcatgaggaggcatccacgctgttgcctgcaccccagcaaggcctcatttgcagtgctggctgctgatgccctggccaaggtcttcgtatgatgcccacctggccctgccctgtgccgccacgctggcttggggtgtaag

SEQ ID NO: 490492 - DNA, 258 bp, Homo sapiens
ctatgacttactgaatataagtattcagtatcttaatttcgcttctctctttcgaaggtttcaaatttgagcttgccctgcttacatcaccaggttcaaggatctcgtattactcctgctctgtgcatctggaaaccctctcggtccctggcctgggaacttcacatgctgtgggtctggccaaataaaaaaaaaaaaggtgttgattttggtttaattaggttatttaaaagttcattagcttttcccgggttaccg

SEQ ID NO: 490493 - DNA, 1179 bp, Homo sapiens
ggagcctcaatgcttcaaggtgtagaccttattagccgatgctgtggccgtgtacacatggggccaaaggcgactgaactgatgattattgagcagagttgagggatcgtcccaagagtacacaagaagatggtcactgcttgcgcacagtcccaattgaccttcaacgaagataacatacaaggaaacattggagcataaacacttggttccacagcatgttgccaagtaaactccataatgcaccgaagcttggggcatggcacgtagccactgctacgtgtacttggccacgctcgtactcagcgctacaggcaaagagcttccggaggacagcattcaggcgaacaggtgcatgaatcccaggtggcaaaatcagggcagtcaggtagtggattgttgcagcttgttaagaatcgcatgttcgatggtgcgcagcaactctgatgagacagctcagtgcatcaactcgcgtgttggaactactcccgatggaaagcgacaactgaggcgcacccagtggctacgacactccacagaacttgcggtgacaacagaagtacgagccaaggaaatgacagaacatttggggccaccatcatcgagatcatcgcatgcaatggcgcaaatggcaggaacaaaagaatagggggcacccgacccggagggggaacgatcgacaaagacagaggcaaaacaagcgagaatggaggacagaccccaacgcaaaaagggggcaaaccgaggactgcgacgatggcacgacccaaataactgcacggcagacgcgtgaagcaagggacaacagcccgttgagacacacagggagaggagatgcgccaagaacaagacccccccgacaaagaccgagaacaccttccgacgcaaccaacgtccgaaggagcggggcgagaagccaacaaaaaggaaggcaacgcagcccaacaacaggaacagggcgccaaaagagcccgtgcggaaggagacaacagaacaaaacaaaagcagaaccgaacgacaaagcaaccacagcgggcagcgggcaagggatgagacaaacaccgaagaagactacggaggaagaccaagagcaaaagcaatgggaacggagaagagggcgaggaaacagagagaagcagagcacctagaggacgagacgacacagacaaggcacgcgaa

SEQ ID NO: 490494 - DNA, 728 bp, Homo sapiens
gggggctactatttatttaaaggtggcggggcggagctaacaaaaattcctgaaaaccattagtcacacaaatccgcccccacctgtggcaagcgagccaaactcttttggaacagatgcttccgtgagaccctaaggagaggatcggtttctgcacctgagacagctccggagttatcaacgatcaggggagtcttagctcctgaacatgttttacctgccacagggttttctctggcaatcctaatacaaccttttcctattttggccacacttctctcaaacgtcttttatgtggaagaggctatcaagacaagaggtggcagccacaacccgggtacacctgccagtcaaggtcacgactgctggaacatcgtagcatttataagaccatggacttgtttttcacttggcataccacgtgcacatgagatttaggcctgtctgcctttttatccaagccgtgtatagactggattcggcaaatacatcctgccagattgctgaattaatttccctagtttttgacaaaaggccgaatttttctcttgggccgcccagttttttgacctctttggagtgcacatgccctggaagtcccgcagttttttccccaacgctttaaaaaactttcaccctgggaggcctgcccaaagaagcccggatcttacgacagacctcaaagtaccccccggtgtggctgttaaaaaggggccctcaaaaagccg

SEQ ID NO: 490495 - DNA, 1088 bp, Homo sapiens
gactctgcatcaaaaaaaaaaaaaaataattaattaattaattaattaattaaccaaattagaaattattcttagaaaagtgaaagggtaatttatacattgtgagaaaccttggcgtgtaagaagtttaacataggggtttagacattagctgaagaaaagaattggacaaaccgtgaaagaagcgtgaggaaatttacccagaaaggttacccacaaaggaaccaaaggccagattgaaaaattttaaacaagatatttccagagagatatccagagggaccagagtcctgggaggttcctccctggaaaggtatctaggggatttggaacatttcctggggtacgacaacctttcaaccatttggtacgttgaatgtgcccggaattgttcccagcctttttaaaaacagagccaacacacaaagggaaccaaccgaggggtctcccagcggacttattacttcgtaaagaccatctcaaaaagggggcgagaacactacgcaggaagtctggcgccaagaaggaaatctctcccttttccgtgcgctacactctttatattctcgcacaccaattttttttatcctctcaataagcaggggcctctgcggaaccagagacactaatttatcacttgtgtctcacagaaaaaatctccgagggcgccaggggagaagctcatttttgcggcaacacgaggcaacttatttgtaatttttcaaacacaaaatctcgaggggccccgagggaagcacacgtggggggcatttataacgccccgtgtttaaattcccccattcaaacttttggacggaaaaaggggccccgggacaaacggaccaacgggggtggtttccaccaccctgtggcaaggggcttccacgaggggaaggtattcccagaaaagaaaccccaagtccctgtggggcccacaaaccctttttgcttttgaaaacacccccccccggggtagtattcctaagcgttaacaatatagtttaaccgaaagaacaatttttaagccgggggcggcataggatgtaggattgcggcacattgttaaccctctgtgcttaagctcccta

SEQ ID NO: 490496 - DNA, 319 bp, Homo sapiens
agatggagtcttgctttgtcacccaggctggagtgcagtggtgtgatctccactcactgcaacctccacctcccagcttcaagtgattctcctgcctcaaccttccaagtagcttggattacaggcgtgcgccaccacagctggctaatatttgtattgttagtagagacagggtttctccatgttgtccaggcttgtcgaacttctgacctcacgtgatccacctgcctcagcctcccaaagtgctagattataggcgtgaaccactgcgcccggccagcatgcattttaaaagtggcttagatttagttttaaatat

SEQ ID NO: 490497 - DNA, 108 bp, Homo sapiens
atgtttaaagggggcaaaaaaaatttgagcttttttttcattcccatttgtttaacaaaatttggaaagtcccctaaccaaaataaatgtaaatgttttttccccata

SEQ ID NO: 490498 - DNA, 978 bp, Homo sapiens
  misc_feature (53)..(53): n is a, c, g, or t
  misc_feature (85)..(85): n is a, c, g, or t
  misc_feature (113)..(113): n is a, c, g, or t
  misc_feature (115)..(115): n is a, c, g, or t
  misc_feature (137)..(137): n is a, c, g, or t
  misc_feature (184)..(184): n is a, c, g, or t
  misc_feature (186)..(186): n is a, c, g, or t
  misc_feature (200)..(200): n is a, c, g, or t
  misc_feature (217)..(217): n is a, c, g, or t
  misc_feature (242)..(243): n is a, c, g, or t
  misc_feature (261)..(262): n is a, c, g, or t
  misc_feature (271)..(271): n is a, c, g, or t
gcaccaacgccgacggtatcagcgccctgcaccaggcctgcattgatgagaanctggaggtggtgcgcttcttggtggagcaggntgccactgtgaaccaggcagacaacgangngctggacgccactgcacgtggncgcctcctgtggctacctagatatcgccaggtacctcctgagccacngnggccaacatcgacngccgtcaacagtgacgnggacctgcccctggacctggccganntcggacgccatggagggnnctgctgaangcggagatcgcccgccgaggtgtggatgtggacggcagccaagctgtggcagaagcaggaacttgctccattcatgacacgaggtgctgcctgaatggtcggcgccatgccagatggcccgtgcacaccccagcatcaggcgcctcttgccctagcactgtggcatgactgccaaaggtgctacacttgatggtagatgagtgtatgctaccatatcaagagcattgagcttacgaacctcagaaagcatcccgagcgagcgatgtgaccgtacatggtactttcccccttgcacagctagctgactacacacctgataggacgcagccggcaatagccttgcccgtcatgccatgtgccagacgcaattggaccgaggatgacaattaggacctccagcttgaccccaataatggacgggcaaatgctagtacccatgttgaaacaagggctctagataatacgaccagctacctgaagcaccctgaatgggtagtgacacttgcaccccgacaacctcagtgaaggagaacattacgtggaaaaccaccagaccggaaatgcttttctcctattaaaccctcgaggccactgtaagcccctcaagacgtcccctttaattctggcggagtgtaccatgtatgcgcgcgacttgttgtgtattactacttgaagataactgtgcacaacgctttctccatccggga

SEQ ID NO: 490499 - DNA, 217 bp, Homo sapiens
tagagctgaagaagcagttgatgaagctgcaggccaggtcaccctgtcaatgcccagctaagagcattcaatgagtaggagaaggcaagagaagccctcagacgagcagaagaggaaagctcaggtgaggaggcttgagggaggtagcagcactgacatcctcttaccttcctcatggagcttgcctggatggatgcacatgtgtgtggctctgggc

SEQ ID NO: 490500 - DNA, 128 bp, Homo sapiens
ttgatcccccattcgtcatgggtgtgaaccatgacaagtatgacaacagcctcaagatcatcagcaatgcctcctgcaaatgagccccagccttctccatggtggtgaaggcgccacgtggactccac

SEQ ID NO: 490501 - DNA, 493 bp, Homo sapiens
  misc_feature (33)..(33): n is a, c, g, or t
gtgacttttacctagtaatttagcacctgaatntctacatatgaaatatgaatataagatacaaattttcaagccaggcatggtgactcacacctgtagtcccagctacttagggggctgaggtgggaggatcagttgagcctaggaggtcgaggctgtagtaagccgtgatcaaaccgctgtattccagcctgggtgacagagcaagaccctgtcgcaaagaaaagatacaaatttgtatcttatatattatctggaatgactttttaaacataataaaagtattttaggtattttataagtacttaaaggtaattctgaaaatttcttagaccatccccgttaatttcagctagaaaagtgatgatataagttcactttgttatgctcattcccttaaatatgaaatgcattttataggcttcttttaccaagttatttgactcttcttcttgatatttcactggtgaagtttttcatgatgactgaatct

SEQ ID NO: 490502 - DNA, 452 bp, Homo sapiens
cgggggggggcttcggcaaggggggttttggaatggggggctccggaaaaaatggaatggattctccggggggctttggtccctttggaaaaatgggaatggggccccattcccgggggggataggggcccccccagggtttggggggttatgccccgggggggggggcccgggggggtttctatgggccagggggccaggggggggggggagggggggttttgtttttaaagccaaaccccccccaaccaggttttgcccccggcgttggggttaaaaggctttttcccagatttaatttttttgggtttttaagacctttaaaagggcgggggggggggggtttccaaaaatttttggggaaagcccccggttgggggggggaaaggtttttgggggggttttttgggggcccctttggcttaaaaaaaaattttttttttcccccccca

SEQ ID NO: 490503 - DNA, 1896 bp, Homo sapiens
  misc_feature (262)..(262): n is a, c, g, or t
  misc_feature (1454)..(1454): n is a, c, g, or t
  misc_feature (1795)..(1795): n is a, c, g, or t
ggcgccgatatgggagcggtaggacggcgagggtgctcacgagaagggtgttgcggtcccaaccggtcgtcaaaagccgggaggctgatcaatcgttggtggatgtctctctggttgagcaaccatgggctgtcaacaagattctcggccatgggcacagtgcaagagttgagcgctgtacagagcacctcaacacgctggttgagtcactctgtgtcccacggctgtgtcacgcgtgttgcatgctgagccataacgcagnactagtacccttctgaatacacgccgaggtcgaaacgcatgtcgtccattgctgagtaaaataccaagatgttcattctccatgggcccgcgtgagcaccgtgaatcagacacgaagtgttcacttcatccctcgcgtcacaagccggtgcgcacaaaaccgtagactacgaacatcgaccacgaaacttaagggccaagacgcaggagaagacacgccaagggacgtacactgtactgcggctccagggtgccgcgagatggggcacgaagaggagactaagtcttgtgggacttgacaaagccgggggaacgagtgggtccccaggtgggggaaccccaaaccgaaagcgaccaccgtgggggtccaccctcttgccctgtaggtgtcgaaaagcgcaccgttggtggagaaacggaaaactcctggattcctaaacacccaaaaggctgtggtcgccggcgtgggcggggagggacattatcaacaaccgaaatacaaagggcctggcgaaaagaacattgggggtttggggatgcggcattttggaggcccatttatctgggaaaaccccgaattggaagacaggtcgcccccgatatgtcggagaagagggggagtcggagagtatcgagccttgtttcgatttattgttccacatttgtggctcctctttggggtggtgtgtgtgcttatacaagagagttggctgaagtggtgaatctccctcttctaaagagtgtgggggatattttaatattcttagaagggggcgcacattatcggggcaaaagtagaaggctttcgagagtaacggggttcccttataggtatccattagggagcgtgcaataatcgcgagcacggtggtcaggcctgaagaataggttgcggcgttggtgtttcaatggaaccaaatggacgcgtggtcaaaatctctctggtgggcaaaatcgaacttccccagtatggggggcgggacagtttctttgggctttagagaaatgccccctgagaggttgtggcaatagggctctctaagtctaaacgagggattccggacgtgtgtcctgagcagttgaacggtatgaaagtaggcgtggagacccgcacaggagatcttcctcgggcgcccggagtaacaacctagtgtcgggctggtttgggcttagtaccgctttgccatggtggngccctccagttaaaagtggtccttggcggggcgattcagaatagattgaggaccaaacggttcctcgagatggatattggccaaagggaggttcataaggtgagcctctcggcgcaagcactctataaaggtccgcgtaccaagatgatgtcgttcaccccggtcggcctgagacgacgctcacactgggtgaccatcatgagatattatagttttgtcgcaccttatagatgccacctagcgtttcaccatctaccggagagaacaacagtcagcaagacagactccccggggggagccaacactaataagcgcggcgggcagacgaacacaacaacggngtcagtaacaacagagcgcgccacgtggtcatctaacacgcgtgtcatgcagcagccagcgattgatacaacaaggacggaggaaactaacgagagcagca

SEQ ID NO: 490504 - DNA, 800 bp, Homo sapiens
cgtggtctgtcgggccgctaccgccggggcacattgtgctattgccgcgcccgccgctcgccggccctgctgcgtgacgccacgccttgctggagtatcgtgcaaccgttcgtctcatggctgctccagtctctgtgccgcgtagactggcaggttgagcctgctgttgagaactggcctgcgtgttgcgtccctcccgagccattggtcctctccagaccctacttcgccacttggtggtgcaagtgtcgcgtatttgattgttcggccatgcccgttttcgcagcactcgatgagagacataattggggccacgcgctcactttttaggtaagtcaatctgggctttacccagtgggaagacaaaggatattcgcgcacttgtgccagatagcccttggtaagcacagcgcaggttggcaagaagcattgggtgcgccctacttcttcacatttgcctcagccagcaacccgtgcgagcgcatcacgacttgacgtacgagttcacggggcgtctgtcccagaagggctcgttgcgcagagacagcttgtgcgagcgtccctgggttgacggttgatgcgacgaacttgctatgtcctcggagagggacttcccccgcgagttggaggacatgggagccggtggagtggttgcatccctgccgtggagcagtgcgaggacgaactgagtgcctgtctagtgctgagactggtgggtcctcttacacgtaccctggcattgtccgacagtccttcccatgggtcaaccctccttggcccaggctgtgggggggcccttg

SEQ ID NO: 490505 - DNA, 1747 bp, Homo sapiens
  misc_feature (1409)..(1409): n is a, c, g, or t
tcgttgtctactgttgtcgctgctgtgtggttgtctttagtcgcgttgtttgggtgtgttgtctttgtgtttcttcaactcgtatcttcgtattcttatgttggattgttgcttttctctcctcttcttgtggtttggtggtggtctgcgtcttgtcttttgtctattcttcttgagttggtgtgtgttagtttgtggtcatttctgtcatctatatgtgtggttttcttatgtagtgatctgtcgttgtttctttgtgtctctggtttttgctttgtttcgttgttgtgttcgtcgtgtgtcgcttgctcttctttgttgtggattgtgtagtcgcttgttgtgctggtggtgtgttctttatttttgtgtttgcccccttctattatttgttggtggtttgattgggttattgtgctctgtcttgttgtcgttctatttccgtgctggtgggttcttcgtggtgttcggctcttctgtaaactccatcaccttgctgtgtgttgttgtatctgtatcgttgtgtatttgtgtgtatttagtgttcgtgtcgtcgcttggtcggttctcctcgtcatggtgtgggttgtgtctctcatgtttttcgcttgtgtctgcgtcgtgtctttttgttgttgttactgttattgcttctcttctttagctttctctgtctttcttctgttgccgcacgtctgctggtcatacttcctctcatcgtgctgtggtgcgtgtctgcgtacaggtgtgtgagttgagtaattatagagtgaggactctctcgtcttgtttatttttgctcatctgctcccctcttctgcttctgttgctctttgagttgtcttgttgctttgtgcttgttggttgttgtgttgtttcctcctctcttttatgatgtgtgttgttgtgcgcgtggctgttggtttacctctcgctctgctctgctgtgttggttcgtactcctccctctactcccactccgtcgcgctctgctctcgtcttcgtcgtggtggtgttgtctgcctactctccgcactacgtctctcctctgttatcgttggttatgtctcgcttcgttcgtgcgtgtctgatttatctactcgccctgcgcgcgatgtgttgaagtagtgcttttatgctcctacactcgtctttctagctcgctcgcactcgtctccctcgtccacaccccgggcggtgcgctcgtctgtctctctttagctgatatagcatcaggtcgcttcgctattataggtgtgcgcgcccacaccacagtgtgttgttgtgggtctctcgctagtgtagagttgttctctctcctcgtgcgcacaccacctacacagagtgtggtcttcctcaccgcccgcctcccgcgctcgtgtgcgcgcacccgcttgaggtgtttgttngcgcgctggctctctctcgcgcgctcgtctctcgcgttgagcgctcgcgcgcgcctcccccgctgttgcctaccacccaggagtgtgttctctctctctctcggtgtgtgtttgttgtttgctttggctttggtggtgtggtctctcggcgtgtgtgtgttcctcctcctccatcctctcggatctgcatcgcctatgtttcccccattttgtatatataagattgagagtgtgtgttgtgtggtgtgtcttgtgtgtcgatgttcgcgcgcggggtgtgttgtgttttgataatataatatgcgcgcgccgctccctctggcttggtgaaataaata

SEQ ID NO: 490506 - DNA, 350 bp, Homo sapiens
  misc_feature (45)..(45): n is a, c, g, or t
  misc_feature (51)..(51): n is a, c, g, or t
  misc_feature (78)..(78): n is a, c, g, or t
  misc_feature (143)..(143): n is a, c, g, or t
  misc_feature (162)..(162): n is a, c, g, or t
  misc_feature (194)..(194): n is a, c, g, or t
gtgtttccttgattttaactgagcttcctagaaatggctattttnaatttnctgtctgaaagttaacacatgtttgtnactccagatttggtcactggtgctttatttagttcattttgtaaggtcatatttacctgtatgtncctaatacttatgtttgtngatgtctgggcattaaagagttaggtacttantctagtcttcacagtatgtgtttgtttgtacccatccttcttggaaaggttttcccagtcttcaaaaagaattgagtattctgatctaagtcgttggtcactgcagccatatatacattaggggggcacatgggcccagggaacactgtggactct

SEQ ID NO: 490507 - DNA, 692 bp, Homo sapiens
  misc_feature (3)..(3): n is a, c, g, or t
  misc_feature (77)..(77): n is a, c, g, or t
  misc_feature (139)..(139): n is a, c, g, or t
  misc_feature (182)..(182): n is a, c, g, or t
  misc_feature (251)..(251): n is a, c, g, or t
  misc_feature (260)..(260): n is a, c, g, or t
  misc_feature (304)..(304): n is a, c, g, or t
  misc_feature (306)..(306): n is a, c, g, or t
  misc_feature (318)..(318): n is a, c, g, or t
  misc_feature (340)..(340): n is a, c, g, or t
  misc_feature (350)..(350): n is a, c, g, or t
  misc_feature (359)..(359): n is a, c, g, or t
  misc_feature (369)..(369): n is a, c, g, or t
  misc_feature (443)..(443): n is a, c, g, or t
  misc_feature (570)..(570): n is a, c, g, or t
  misc_feature (573)..(573): n is a, c, g, or t
  misc_feature (576)..(577): n is a, c, g, or t
  misc_feature (581)..(582): n is a, c, g, or t
  misc_feature (584)..(584): n is a, c, g, or t
  misc_feature (588)..(588): n is a, c, g, or t
  misc_feature (599)..(599): n is a, c, g, or t
  misc_feature (651)..(651): n is a, c, g, or t
ttnttttattttatgttaaataaaatgggaaaggattgtaaggatgaaaaactcagtcaacaactgcctcacaaggnataagcaaaattctgccatgttattagcaaaggtaaaggaggaaaaatttacactgtaagangcaccatttccccaaggaatacctcttggcttttcctgtatgngtgggatttgcaatctaaataaatcatatttcaagaggtaacagcaacagataaaatttaaagggattnttaaaatancatttacaagactctgaacaattcttgaactcttttttaaaccncnatgaaagaacanttctttttttatgattttcttnaaggactctntgtgcactntcttctgctngtgttgttctggttttttacaacctgtcctgtagccgaacagtttgttttttttgtgttttctttccgtaaganttctttaaaggcttagcctatttgtcgctgtacactcaaaaaaatggtctccgtgggccatactaccaatgaaatggataggtaaacaaatctttttctggtcaagagaaaaaaaaaaaaaaaaaanagnggnngggnngnttcnctctacaagangaatttccctaaaaaaaatccaatgaaaatggctgcaattacaacaagaagngaaggaagaggactggtgacattatctctgaaggatgcagt

SEQ ID NO: 490508 - DNA, 164 bp, Homo sapiens
gccgcgcccgccccttccccctccccccgcgggccctcgtggtcacgcgtcgggtggcgggggtgagagggggtcgcgcccggctgagagagaacgggtgacgtgccgctgccgcccgcgaagacggagagggaaagagagagcgcgctcgggccgagaagaaa

SEQ ID NO: 490509 - DNA, 816 bp, Homo sapiens
gaaaatatgaacactggaaatgagcgccatttaaatgagatgctgtatgtaagccaggggtcagcaaagttcagctcttgtgacctggtgtgtgtgggtgtgtgtgtgtgtgtcgtgtgtgtgtgtgtgtgtgtgcgtgtcgcggtgagtttaagaatggtttataggcttgtataggattaagaaaaaaaagaaaacccacgagaaaaatgtagggagccaagaataaaatagcgctttcacgagaaatgtggggtgacccgggaagtgtcactctcgggtgacaagagtgggtttctagggaaacagtcgggctctgtcacccaggggtggagcgcaggggcatggtcgcgggtcagggaagactaccacctccggggtcaccaagcaattcggccttaccagcctcctgagtaggcgggcatacagggggtgcaccaccacagagagaataatcaacgggtgtacccagcacacccaagaaatcactggaccccgggaagggtgggggttgcaagcgagcccggggcctcagggcagtgttccccagccctgggctgaaccatgtgtgctgaacaaactaacgacgtacacgtcgcggcgtacacaaactaaagggggctccacccaacaggaacgctggtgaacacaacaaggtgctcttaaagcactaccttaccgccctagatattaccacggagcgggggcagcaaaacctggtcgccacaccctgccacacctctccaacacgccccgcaacaacagatactcgcagacacgcgcgggctcaactggtcaccacacccggcacgcgcc

SEQ ID NO: 490510 - DNA, 1169 bp, Homo sapiens
ctggagctctctgagcagcaggaggggcatgctggagctctctgagcagcaggagggacagctgaagcacctgagcaccaggaggggcagctggaggtcccagaggagcagatgggcagctgaagtagctggagcagcaggaggggcagctggaagcacctggatcagcagtgaggagagcagtagatgctcccagagcagcagatggggcagctgaagcacctggagcagctaggaggggcagccttaagcatttggagcatgcaggaggggcaattggagcatcctgtagtgagcaaggagggggcatgttgaagcatccttggagcagcaggaggggacatgttggagcatccgtggaggcattccaggaagggtaatgttgtgaggcatccgcagagacatgcagggctgctgcaaatgttttgaaaagcatcgcgtagagataggcaggcatggcgggtagggccaataagctatcctgggacgcgaagggagtgaggggggctaaggctgatacgcaaccctgtgtggcatgggcaaggtgaagggggagctagcgttgaacgccattcgtgggttgggaggcaggttaggcggtgtatggatttgcaaatctatgccaggttcacaagggccagtgttagcgattacagactggtaatgttatgcaagggctgtcggggtcaaggtcttgcacaatcatcccttaaagtttacgccagtgcgccgttggggccatacgcttgacaagagtcctttccttggtaagtctcatggcgcggtccatgcgggtgggtcgagttttgcgaaaggatttcccctatcagttattggctggtgctgggggagccatgcgcaacaagtaaaggccttgatcctgcagtggtaggcgaagctaaagccaattgcttgcgaatggtactaccgtcaagcagttatagccaggaggaagtggggcctagcgttagcaaagtacttctctttgtacgtatatgactgctgaactgctgcctattctggcaagtccttccctctagatatcaaggctgtggtttgagagacgatgctctgatatggtaccctggacgctcaggtcgggacaaggggcagcttatgtcagcacccacaatcatgtatgtcgtgttgatggttagcaacttacaacc

SEQ ID NO: 490511 - DNA, 104 bp, Homo sapiens
tggcccgcttctgctctgcgctgttggggatatggtctcttgaagcattcttaggctgccagtattgtattaacgcagaacagtataacctcgtattttagctc

SEQ ID NO: 490512 - DNA, 934 bp, Homo sapiens
  misc_feature (232)..(232): n is a, c, g, or t
gagccggcttgtaggcattcaggacagtgtcttctcgcatctcctatggaaccatcggggagcggcgagactccgtgcgccgtggtagcgagaggcgggttccggagatccgcggactcgacgttcgtcgccacatgtggttgagagggatgagtccatgccacaatgttgaagtgatgttgctccaaggtgcccattgtcgcaggatattggtagcccgaggccagttctnctgagccgtatcaattgaggggcttcaaagggagtgcgtgactcaagaagggggtcggggaggtgttctcactgtgtcgcgtgcccgtgcgtgcgtggggtccacgtggtgctctatgtgcatcctctgcactatctacctggatgcaagtactgacgtggttggcttggcctggaattggcagcatctacatgttccaagctggcatcccagtgctgtatggtttgctgggcatgagtggtattcctatcggaggtgcgtacactggtgtacctgggctggccacaggtcgtagtggatgggtggacactaaactagtccataggtaccatcctctcccatagcgagtgcgtgcatggtaccttggatggtgacttcggtcgcgtcactgtgtaagtaggggagctcgagttagctagtccttggtactgttatacactaaaacatgggaagggactgtccaaaccgtctgactccccgttcagcagactggctgggcaatcaagcacggtgcttccctctttccgcctggcagtagggttccttgggctcatgcgtgtacttcctaccgggccctgtggcgtcccatgtgagctggcgcagacatccataaaacctattccacgtcttggaaagggagcccgacatccatactcttctgtccaatcggatccggccaatttacgggcattactggaggaa

SEQ ID NO: 490513 - DNA, 410 bp, Homo sapiens
tgtgctggtttgattagaggatcctttcttgccacgaatcgcaggggtgtttatgtcaccattctgtcctgctagaggcttgcagaggagtttctaatgcaatcagagaggagctttaaaaggtaagtcatgcgaagtgatcaatagggatcttaactcaataaagtgaggtgtcttatgaagattctttggggggcctgcaatttggaagatctgcgaagtctgagtggggcaagctgtataattcctcaatgggctacgaggatatcaagatgctgagaggaaatcagcggtggttgacgagagtggatacaaaccagggattgctctctttgagctgtgtaggaaggtgattctaaatcacggcttaaggaattcctggacacatcaggcatagattagatcatcca

SEQ ID NO: 490514 - DNA, 358 bp, Homo sapiens
tcatcgagctcggcccatcttatcgctgactgggcataccaggacgccatattggcgcggctgcaaagccaacttgatcgcctgttgctccaacaccacagacagcaccaagcgcacctgctccatcagcccacgaaaactggcgccctgatcaccgtgttggtaatgaacgttcaactgcgcacgcttactgtcactggcgaacgttgataactcaccgagcagggacaccagcgcacggaacactgcttcgggccgcacccgagcctggctcaggcagtggcgcagctccagctcggtacgattgattacttgcagcatcaggaagtcagcgacatgatgggccgagctcgattat

SEQ ID NO: 490515 - DNA, 523 bp, Homo sapiens
aactcccaaaccagaagcttgaaagtatttattaaatccccactggacgaaagacagtgatgactaacacctatccagtcttgacagttttaatcccaaacactgggctatttccccagtctgtaactgaattgcaaccatctgtttgtcaaacacctaaccatctaacttttacaccattatgcgcatagaaaggctaagtgttcattatttaaaaaacaagtagtcattaaatatccactattcccccagctcaccaagcccttattgcaatcccaaatatgcaatctgtgtcacacagtgacaggctgtatttcatatatatatatgtgtatatatacatatatatgtgtgtatatatacatacacggatatatatatatatatatatatatatatatatatacacacacacgtatatatatgtatatatacagtattaggtacaaatggcaattaacagtccctacaaaaattcaatttcagttgaggctatggctcctatgccttgggatggtttcga

SEQ ID NO: 490516 - DNA, 434 bp, Homo sapiens
tgtcttcctctagatagtcagtcatacgcactgactttccatggaatactatgcagccataaaaaatgagatcatgtcctttatggtaacatggatgcagctggaaccagtatcctaagtgaactatcacaggatcagaaaaccaaataccacgttctcactttaagtgggagctaaacattgagtaaacatggacagaagggaacaacaggcacgggggcctactggagggtggagggtgaggctccaaaaaacacccatcagggactgggcacagtggctcacatctgtaatcccagcactttgggaggcggaggtgggcggatcacctaaggtcaggagttcaataccaggctggccaacatggtgaaaccccgtctcaactaaaaatacaaaacattagccaggtggtggcgggtgcatggtggcgggta

SEQ ID NO: 490517 - DNA, 706 bp, Homo sapiens
aagacaattctcctcgcagatcacatcgcagtaatgcatgagcttaggtgtggttcatagtgtctcgtatcatccactactaaagggacactatgtgcgtgctatactaagtccataatgccagtcatgctatttcgtactgatgcgcgaaacgcaaaggattggcatttatgacgtcaccagtcccatagactcctgatcctacgcatatctctgtgtagcataagtacagtcatggctggcttgagagccttatgaaatctacgtcagtaagacattagcccgcttactatctcctcccatacaggtagaagtccgcgctctcaactcaagtttggcatcttaaagtaaactccactgttctagctagtaacacacaagttgtcagctacacattatcctctatgaactcatatgtatcacttctcaacgtctcgtatgttctgtcatctccgacaagtgtacgtataaaggtctaatgtatccacagtaatgatctcttattagtcaatgcaaagtaccgtcggcgtctgtcttcccatagtcaagcgtccctcccaaccaccatttcaaaaccatgatcatgagtccctatggcggattcatcagaatttcatgtacgtcgatgcacagtccacaaccagactgattaacataatgtacgagaatgaatgtgcctcaagttggtgcgcttcaaataattaaa

SEQ ID NO: 490518 - DNA, 478 bp, Homo sapiens
tgttgagtagattggggccaaagtacccccagcaagagccgctccatttcggcaggagggggaccacgaaaagtgaactctctgaaaccatggcccggcccggggcgtgtcgtctgacgcccaaaggcttgctccgtcatcattaaagatccagttatatctcttcgtggggggaacatcgctggactctcgtgggggtctggcttcccaggccttgtcaggtatctcctcctcttcaaatttgttggcctcgcggccacaaagtggcatggccagggcctttgtcctccaaagtggtggtggaggagttggccagagaggcatcgtactcttcgtcctcatcctattctgccgtgaggctctgctccttctcgttggccagccgggtactctcctcccttagctcctggttaatcttctcacgctccttctcgttgtctaccaccttgagggtttccaggatggttcttgatgggcc

SEQ ID NO: 490519 - DNA, 998 bp, Homo sapiens
ggcgcatgcctcgtaatcccagactatatgggaaaccaaagcaggaggacgcttgagcccaggagttcgaaaccagctggcaacatgcaagacctggtctctacaaaacaaattacaaattaagctgggtgtggtggtgcttggagaggctaaggtgggaggatcacttgagccctggagttcgagaacagactgggcaacatggcgaaagcctgtacctacaaaaaaatacaacaagttagccaggacgtggtggcacacgcctatagtcttagctacctctggtggcagaggtgggacagcttgtttgaagcctacggaggttacatggctgcaggtcaagccgagattaggacacaaatacgattccaagaccatgtgttgaccagaggtagaaaacccgtagtcttcacaaataacaaaatgtgaacatatcaggagttccaagaaccagacgtggccaaacacccggtgcaaaacccactcttgatacgtaaagagagaccacaagaatttccggccttggagcaccagaatagcaccatgagatcctgcgacacttgataaataccccaggacacagtacatgcggaaggggcccaaagtgcagtggtgaaatagtccacgatgcaacaggggatcacaggagggtatacgaagaacgccaaaccgatgagcacccaacatacttggatggaaaaaacgaacgcaagatcgtacataacactaaagaaaaaagtaacaagaaaaacaaacaaagaaaaacaaagaattaacagcacccacagggacaaatggagaaaggacacgacaagatggccaacatacatagaagacccaaaaggaaacaagacagagagcgaaaaagaataagtgaaacgcgcaaagaggagataaaccacggcgaacgggaaagcaaacgaaagggaaaaagacaaaaagaacagctgataggagaaaaaaacaccaatgtggacaaacaacaagagaaaacacaa

SEQ ID NO: 490520 - DNA, 663 bp, Homo sapiens
acaggcagtacggacgctgctgacatgctggcttatgcgtattttagcggttagatcaccgcttttcttgaggaggtgccatagggaaagagaattcacggtagggtattcgtgcggcatccgtcatgcgctattgcaagcttgtatctgcaacccgggaaactgcatttgcaatgtacttccccaactatgtctattgaatagaggtcacgccaacgaacgccactgagcgttaaggagtgaccacatgccgcagacacctgcactgcgacctggcgagcgtcgcattctgcgactcgacgaggtcgaagccaaatcgggcttcaagcgcgcccacatctacgcccttatgaaaaaaggacagttcccccaggctttgcgcctgggggtgcgcgcagtcggctgggactcggccgaagtggatttgtggatcagcgagcgtttgaagaaccgggcgcacccgcctgctctcacgcacaacgcctgaggagatcgccatgaaggtcatctccgtgatttccaccaagggcggcgtcggtaaaaccaccaccgcggccaatcttggaggactggttgccgacgctggcttgcgcgtgctgctgatcgatctcgatgtgcagccaaccctatcgtcgtacttcgaggcgtacgtagcgggcgggc

SEQ ID NO: 490521 - DNA, 1071 bp, Homo sapiens
  misc_feature (498)..(498): n is a, c, g, or t
  misc_feature (631)..(631): n is a, c, g, or t
gagatggcggcgcagcagcgagactgcgggggtgctgcgcagctggcggggccgcgccggagagaagctgaccccctaggacgcttcacagtgtcccgtgtgcttagaggtgtacgagaagccgcgatacatgtgccctgtggacacgtctttctgctctgaagtgccctgcggggaactgtcttgagagcccgtagagtaaggtcctgtcgtgtgcgggtgtgtcggcagtcgacgtctgtgcatccatgtgtcgctccagatgcctgtggatgctcgttagcggcagattcgagagcactatgacgacttcattgtccatggctgcacgtaaggacatttcttccttgtcctagaggatcgcggttcccaccgctgtgcatacattggtgtccaaacactatcgcatgcaattaacatcactggaacaggttgatgtagagggcctaccagttagagtgattgcaatctcattcgaagccatatggcaattgttcncaacatccgtgtcttacgacgcttgttcctttagttccattacctgtcctcgagacaaggaaatcttggatcgacgggacatggacctttgtaggaaccactttgcgagaattattcccatacgcgacggatnacctaatatcttgtgcgatttgtcccgagtagtgttgccgtcgaatgcgcctgtggggaagaccccgagactactcgcaatggggctcaacctttcaggagagcacattccagcgccggcaccggtttctcttactgaccacttcttgtggattatgactgttgaattgaaagaaggggaccactcgattgcacgtcagggctgctcgccagtggcgtctaagcaagataggaccctcggatggaagcataacgtccggtgggactgccaagtcgtgtcttcgcatgtttacccacatggttcacagtttaaccattgttcatccgtgtagatctattgacgcctgggttaacgatataccctgggcccacaggaaccttgaaaataaggcatggcgcttggggacacggggccactactaggcgggggaagtgggcccc

SEQ ID NO: 490522 - DNA, 189 bp, Homo sapiens
tcatagaggatcccctagggtctagggagaacagagtccgtccaccactcttccaactcacggtggcacaggctgcagaccagaggcctggaggccgagacttactgatacgtaggttttattcgtcccaccgctgttttcataaaacattggaattgctgtcgtaacatgactctccctaagacccta

SEQ ID NO: 490523 - DNA, 189 bp, Homo sapiens
cccgctggttttacccactaactttggaagaaggtaaattatttcttttaccttttaccaaattcccaataccttattaatcactttaagcaaaaaatccttttttttttttttggaaagggccaccctttctttaccatgaatttcctgggggccccatcctgcctatgggtgcaaaaaaccatttat

SEQ ID NO: 490524 - DNA, 103 bp, Homo sapiens
  misc_feature (24)..(24): n is a, c, g, or t
taactttcccttggaaagcgaaantttccccatttttcttaactattcttttaaaaaaaaagtttcacttttttagagaccatattttccttaacccataggg

SEQ ID NO: 490525 - DNA, 141 bp, Homo sapiens
tacagtctatgctgagctagcgtattcagtggactcatccatggagcgtctactcacgcacagcttcttctctgggcatattggatatacttatttgcactgaggtaatctaggcttcactatccattgtgtaggtactgg

SEQ ID NO: 490526 - DNA, 107 bp, Homo sapiens
cttagtctcatcttcccttataagcccaggaggaggtttttcgtaaaaggactccaggtgcttgagctgctgcagctgctgcgcgtcgtgtcgccgccgcttctgct

SEQ ID NO: 490527 - DNA, 442 bp, Homo sapiens
  misc_feature (155)..(156): n is a, c, g, or t
tcactgcaagctccgcttcccgggttcacgccattctcctgcctcagcctcccgagtggctgggactacaggtgcccgccaccatgcccgactaatttttttgtttttagtagagacagggtctcaccatgttagcaggacggtcttgatctccnnacctcgtgatccgcccgcctcggcctcccaaagtgttgggattacaggcgtgagccactgcgcctggctaatttttgtatttttagtacagaaggggatttgccatgttcatcaggctggtctcgaactcctgacctcaggtgatctgcccaccttggcctcccaaagtgctgggattacaggcgtgagccactgcgtctggcctcaatctctacattatatcagatgacaattaaggaatttttccgtcgacgcggccgcgaatttagtagtagtaggcggccgc

SEQ ID NO: 490528 - DNA, 752 bp, Homo sapiens
ccggagcgtgctaatggaaggtcactctggcagcaaggactcatacatgaggaactgaaatacatcactgtatataattgcggcaatcagcccagatgctatcaagtaggaatcatagagcagtagtccattagtgggatggactaaaagatccatctccacgtgatgcgttggatttataagctgatgattgttaatacgaaggatggcacaagaattatatcatgcctgggtcagacattcgagcgaatgggttactgcaggggagtttgacaaatctttgggatgatgagcctgcggtatgtggagacaactgctgaatgaggatgtgagagatcaactacctgtcgtagtgaatccctgaaagagtatgtatcggtagatatctaagcaccacgtggatacgaggatacggtgcatgatcatcgtgagagagaagtccaaataacactctggaacatgattaaaacgtaggtatcaccagtaattgatacggtgatggagacttgatttgaccctgggatctgaagggatccgcgctctgtccgaaaagtaacgctaaatcggaaagatcaaatttgatttgactatacgtaaacaaaggtcatagtgtcaccctaactacggagtcatgatgggtgggctatttatgaagatatgttagaagttctggttgacataaggtcaacatggagtagaagcgatcagtatgtagacctagtaagaacggagcatataatggcttttggtac

SEQ ID NO: 490529 - DNA, 135 bp, Homo sapiens
ctgctcaatggataaacctgtgcataagagcttagtaactgtgatataaacagattgtgaaaaatagacttagccaaatctcatgtgaggattaaaaaacgcgatgtcctagataagtcagtgtgacactaaaga

SEQ ID NO: 490530 - DNA, 533 bp, Homo sapiens
  misc_feature (322)..(322): n is a, c, g, or t
  misc_feature (510)..(510): n is a, c, g, or t
gagtagctgggactgtacataggcatgcaccactgcacctggctcataagacttgataatttataaaataattctacagcctcttccttactcttcccctttatttattccaactggcatatgctcttttcctggtgagtgagtcgtctacagtgttttctggtggataatgcatcccgatcaaccagagaaaaaacagtgagaaaaatctgtgttctgttgcaatccctctgtgatttgtctaatacaatagatgtgggtggtacccctcgcagagaaaatagtattcgctttccttgtctccttgatacaggttacaaanatatccattgtcaagaatattcaaagaggataaagtgattaggggaggaaaggtaaaattcccctgaagactcgccaaccaagaaccaactttgtaacggtttgtgggtgcgccgatactgttgcattgtatttgctgtgatatcaatggaacacccccgaaatattttagtgtaaatcttgtgatcnttacagttgttagagataaagaa

SEQ ID NO: 490531 - DNA, 813 bp, Homo sapiens
ggtgccactgcactccagcctgggcgacagagcaagactcagtctcaaaaaaaaaaaaaattactggccaggcatggtgatggtgcctgtactcctagctactgtgggaggcctgacggcatgagaaacttggctgaacccaggaggttggcggttgccagttcagtccgagactcggtgccactttgtattccagcgtgggtggttgaccacgcgcgaagaaactccggtcctcacaaacaacagcgttggcgtggtggggaacacacctgtgggtcccacgtatcgtgcagacctgaggccggcggactgtgcttgagcacaggagtcctggacatgccagcggcaccaagtgatcacgtgccaccgtggtatttcaccagaatggggctggacaaggaatgcagagccgaccaggcctttccaccacaaacgccaacactacatagaacacaaacacaccaaaattagtagccgacaaccgacaccagccaaaaaacgatcaaaacacccacaacccgatgtgtgcccgcgcgagccacccgaagaccaagaagcacacacgaggaccaaacgagagccaccaaccaggcccccgcgcgatccaacaaaacagcgcacgagaactcactcccacacaaccaacaagcgccgcgtggaaaccaccgcgtgcgcgaaacacaaccacaaaggcgctcagcagcaccaccgtgcgacccaccaagcagcgcaacggaccacaccacaaatcgaccaccggggacacagagcaagacacagaagaagcaagagacacgcacagaacaaacggca

SEQ ID NO: 490532 - DNA, 138 bp, Homo sapiens
gttgtagaatgcagaggaaaagttcttgaagtgaaattaaaagtgccactccagtgaacacgcagatgataagaaagcaaaacaacctttatttgcttgatgggagaagactggggatcctactatgagtctgacctt

SEQ ID NO: 490533 - DNA, 577 bp, Homo sapiens
ttcggcacgagaaaaattgtctccgctcccagaaaaagatggcgtttcttctgagttggtaaaacatgctgcttcacgagggaaaaaaactatcactggcccactatcctctgattttctctcatatccagacgaagcaattgatgctgatgaggacgtcactgtccaagtgccagatactcctacttgagagaacaagtaatggtgagggaaaaaatcataatatgaaatatattatgacgacgtcaattaacgtcgtccacgcctgtcgtcgtcaacccacgaaaatatgggggcggtttttataacggttattaaaacgacgggatgccgtctacggcacggacaaacccatcgctttggaaataggtgactgcgcttgaaaaacataattatttattagcataataaattcaagacagcaaatatatatgctgtcaatacgtacatattaagcctaaatattctgtggaaaaaagagacaaattggtaattatggagaaagctttggaattagacggagaatatccggaatctcttagggatgaattcaacatccctacatttaaatccatgg

SEQ ID NO: 490534 - DNA, 147 bp, Homo sapiens
acagcaaccggcactcacttggaatcccagtgttccgagttctaaggccactgaaaaccatcaagcgcttgccaagctcaaggccatcttcgactgcgcagcgacttccttgaagactgtttttaacataccaaaggaggacaagct

SEQ ID NO: 490535 - DNA, 425 bp, Homo sapiens
tcacgattctttgccctgcgcaatgacttcgatggctgcagtcaacagttcaccgcgtttttccagacggttacctaccgggcggccgcgacgtggggcgggcgctgaatcactgtcttgggagtgctgactatccgtggaaggcgcttgagcatcatgcatgagagaaagtgattccgttggttgaaggcgttgagccggcagcggctgcgaacgccattttggcttggcacgtcgcgatcatgcaatcgttcagattcgaccgctgccaatcaccgcgacggcccgaacctccacgcgcaagcccggcattgccagttgtgaaatgccgacagcggtccaggctggataacgttcagggaagtattcgtcctttacctgtccaaaggcgtgcacttcgccctgcagatcggtatgaaacgtca

SEQ ID NO: 490536 - DNA, 1593 bp, Homo sapiens
gtggcgaattcggcacgaggacaccaaggcaggaggctaggaggtctacaaatagcgactgggtagctggtgtgaacacagggggtactgggggggcttagcccccaaggaagaggaccagtttttccccagcaccaccatcaaggcctcgaggctcccagctccctctacagcctgtggactgacttagggaatcccgaactacagcggctaaagcagttactcaggaagggttctacagggacaaaggagatggaacttcccccagagccccaggccaatggggaggcagtgggagctgggggtgggcccatctactacatctatgaggaagaggaagaggaagaagaggaggaggaggagccacccccagaacctcctaagctggtcaacgataagccccacaaattcaaagatcacttcttcaagaagccaaagttctgtgatgtctgtgcccggatgattgttctcaacaacaagtttgggcttcgctgtaagaactgcaaaaccaacatccatgaacactgtcagtcctatgtggaaatgcagagatgcttcggcaagatcccacctggtttccatcgggcctatagttccccactctacagcaaccagcagtacgcttgtgtcaaagatctctctgctgccaatcgcaatgatcctgtgtttgaaaccctgcgcactggggtgatcatggcaaacaaggaacggaagaagggacaggcagataagaaaaatcctgtagcagccatgatggaggaggagccagagtcggccagaccagaggaaggcaaaccccaggatggaaaccctgaaggggataagaaggctgagaagaagacacctgatgacaagcacaagcagcctggcttccagcagtctcattactttgtggctctctatcggttcaaagccctggagaaggacgatctggatttcccgccaggagagaagatcacagtcattgatgactccaatgaagaatggtggcgggggaaaatcggggagaaggtcggatttttccctccaaacttcatcattcgggtccgggctggagaacgtgtgcaccgcgtgacgagatccttcgtggggaaccgcgagatagggcagatcactctcaagaaggaccagatcgtggtgcagaaaggagacgaagcgggcggctacgtcaaggtctacaccggccgcaaggtggggctgtttcccaccgactttctagaggaaatttaggcgtgcgggcgcctgcaagcgggagacacccacaccccattctgggcgggcccagtggagtttggggaggggggcgaaagcaacgggactgctgggagaggaggggtaggaaggcccgcctgagcgcgacggggcttccgggaagggactggttctcgcccccttccccagcctggggcctcggatacctgctgcccagagcagcccggacccgaaacctttcaggccccgcttgcaagagctggaaaaaaacgcgtatctactaggaggagccagggactggggcggggggcgggggcgagggagggcgaactgtcgaatgttgcgaatttattaaacttttgacaaaacttaaaaaaaaaa

SEQ ID NO: 490537 - DNA, 292 bp, Homo sapiens
  misc_feature (1)..(1): n is a, c, g, or t
  misc_feature (230)..(230): n is a, c, g, or t
  misc_feature (275)..(277): n is a, c, g, or t
  misc_feature (284)..(284): n is a, c, g, or t
nttgaccagacctggttattttgtgtcaacaacataagccgaattacaactgatgacgtcttagatttctaggggttttacacaattttggaacattcatatcaattacacacccataaaatataactgacgaagatctagtgtacttttttgacaatgtttttcatacagtttttcatcttccaatgggcctgattttgtttaatatgtctcttttttcaacctttggnaagtttccgggccctctgggacatccggttaattcccggtaaccnnnggcaagncaatttag

SEQ ID NO: 490538 - DNA, 1661 bp, Homo sapiens
gtggcgaattcggcacgaggacaccaaggcaggaggctaggaggtctacaaatagcgactgggtagctggtgtgaacacagggggtactgggggggcttagcccccaaggaagaggaccagtttttccccagcaccaccatcaaggcctcgaggctcccagctccctctacagcctgtggactgacttagggaatcccgaacgatgacagaaaaggaggtgctggagtcccctaagccctccttcccagcagagactcggcaaagtgggctacagcggctaaagcagttactcaggaagggttctacagggacaaaggagatggaacttcccccagagccccaggccaatggggaggcagtgggagctgggggtgggcccatctactacatctatgaggaagaggaagaggaagaagaggaggaggaggagccacccccagaacctcctaagctggtcaacgataagccccacaaattcaaagatcacttcttcaagaagccaaagttctgtgatgtctgtgcccggatgattgttctcaacaacaagtttgggcttcgctgtaagaactgcaaaaccaacatccatgaacactgtcagtcctatgtggaaatgcagagatgcttcggcaagatcccacctggtttccatcgggcctatagttccccactctacagcaaccagcagtacgcttgtgtcaaagatctctctgctgccaatcgcaatgatcctgtgtttgaaaccctgcgcactggggtgatcatggcaaacaaggaacggaagaagggacaggcagataagaaaaatcctgtagcagccatgatggaggaggagccagagtcggccagaccagaggaaggcaaaccccaggatggaaaccctgaaggggataagaaggctgagaagaagacacctgatgacaagcacaagcagcctggcttccagcagtctcattactttgtggctctctatcggttcaaagccctggagaaggacgatctggatttcccgccaggagagaagatcacagtcattgatgactccaatgaagaatggtggcgggggaaaatcggggagaaggtcggatttttccctccaaacttcatcattcgggtccgggctggagaacgtgtgcaccgcgtgacgagatccttcgtggggaaccgcgagatagggcagatcactctcaagaaggaccagatcgtggtgcagaaaggagacgaagcgggcggctacgtcaaggtctacaccggccgcaaggtggggctgtttcccaccgactttctagaggaaatttaggcgtgcgggcgcctgcaagcgggagacacccacaccccattctgggcgggcccagtggagtttggggaggggggcgaaagcaacgggactgctgggagaggaggggtaggaaggcccgcctgagcgcgacggggcttccgggaagggactggttctcgcccccttccccagcctggggcctcggatacctgctgcccagagcagcccggacccgaaacctttcaggccccgcttgcaagagctggaaaaaaacgcgtatctactaggaggagccagggactggggcggggggcgggggcgagggagggcgaactgtcgaatgttgcgaatttattaaacttttgacaaaacttaaaaaaaaaa

SEQ ID NO: 490539 - DNA, 346 bp, Homo sapiens
ctgtactgatagagattagatgtcttctgtccgttgcaaatagctagtcagttggtgctagaagcagatctcaacgaggcactagggttattataatacaggaaacttcttatctactcaacttgttccttctagtgccaagctcatgttctatgagttcatttacaatagcctccttagtagtgggtttcaaatctagactcagttgctttccagtgaggaccccagaagtgtctgttttccacatcgtacccttctacagctctacacaatacagggcattttgaaaacatctggacactagcacctagaacattgctggagtattgttttcaacgccactcag

SEQ ID NO: 490540 - DNA, 1263 bp, Homo sapiens
gtggcgaattcggcacgaggacaccaaggcaggaggctaggaggtctacaaatagcgactgggtagctggtgtgaacacagggggtactgggggggcttagcccccaaggaagaggaccagtttttccccagcaccaccatcaaggcctcgaggctcccagctccctctacagcctgtggactgacttagggaatcccgaacgatgacagaaaaggaggtgctggagtcccctaagccctccttcccagcagagactcggcaaagtgggctacagcggctaaagcagttactcaggaagggttctacagggacaaaggagatggaacttcccccagagccccaggccaatggggaggcagtgggagctgggggtgggcccatctactacatctatgaggaagaggaagaggaagaagaggaggaggaggagccacccccagaacctcctaagctggtcaacgataagccccacaaattcaaagatcacttcttcaagaagccaaagttctgtgatgtctgtgcccggatgattgttctcaacaacaagtttgggcttcgctgtaagaactgcaaaaccaacatccatgaacactgtcagtcctatgtggaaatgcagagatgcttcggcaagatcccacctggtttccatcgggcctatagttccccactctacagcaaccagcagtacgcttgtgtcaaagatctctctgctgccaatcgcaatgatcctgtgtttgaaaccctgcgcactggggtgatcatggcaaacaaggaacggaagaagggacaggcagataagaaaaatcctgtagcagccatgatggaggaggagccagagtcggccagaccagaggaaggcaaaccccaggatggaaaccctgaaggggataagaaggctgagaagaagacacctgatgacaagcacaagcagcctggcttccagcagtctcattactttgtggctctctatcggttcaaagccctggagaaggacgatctggatttcccgccaggagagaagatcacagtcattgatgactccaatgaagaatggtggcgggggaaaatcggggagaaggtcggatacctgctgcccagagcagcccggacccgaaacctttcaggccccgcttgcaagagctggaaaaaaacgcgtatctactaggaggagccagggactggggcggggggcgggggcgagggagggcgaactgtcgaatgttgcgaatttattaaacttttgacaaaacttaaaaaaaaaa

SEQ ID NO: 490541 - DNA, 171 bp, Homo sapiens
gcaggcgtcgcttcacatagcagggaactcctcccacctggagcctccgtagacctaaccatcttctccttacacctagacaggtgtctcctctctcttaggggccaacaatttcatcacaacaattatcaatatacaaccccctgccataacccaataccgcgtgcccct

SEQ ID NO: 490542 - DNA, 758 bp, Homo sapiens
  misc_feature (549)..(549): n is a, c, g, or t
  misc_feature (758)..(758): n is a, c, g, or t
tttttttttttcgatagtcatttcattccatggtgggacagatactggatcaagcttgctttccataattacttcactgactccctccatttcaaaatcgacattcacaaatgagctggatatcactgtctctggacgatctgtctgaacaatggaatcagtctgcaatttattctgttgatattaggcttctgcttcttcagacatcctgtgatcttcttcttcttcatcttcctccttcttcatccgataatattcatcaatggcatattggtactatggggtgctgatacccaaaacagatgcaatcttctctccaaggaagtcacacactgatagagttgatgtagcagcccgaagcatgtaaaaccataagtagggaccccacgtaagcactggcggatcaacagtaggcaaaacatctttcttctccaggccatcaacttggacttcatctgagctatattcttccattgtttcaccactaacaaagtgcatgactctccttgagactatcttgttttttcctatgactgccacatctacatnttcgctgcagcccggggatccgaccggctatagcggacgcaccgtagtgcacttcaactttccgtcctttcatgaagtttagttcgagctcgagcaatcgctgccgatctgacggtcacttaaacagctctgctatatagacctccaacgtacacgcctacggcccatttgggtattgagctgagttgcacaaactttggaaggtcccn

SEQ ID NO: 490543 - DNA, 1534 bp, Homo sapiens
gtggcgaattcggcacgaggacaccaaggcaggaggctaggaggtctacaaatagcgactgggtagctggtgtgaacacagggggtactgggggggcttagcccccaaggaagaggaccagtttttccccagcaccaccatcaaggcctcgaggctcccagctccctctacagcctgtggactgacttagggaatcccgaacgatgacagaaaaggaggtgctggagtcccctaagccctccttcccagcagagactcggcaaagtgggctacagcggctaaagcagttactcaggaagggttctacagggacaaaggagatggaacttcccccagagccccaggccaatggggaggcagtgggagctgggggtgggcccatctactacatctatgaggaagaggaagaggaagaagaggaggaggaggagccacccccagaacctcctaagctggtcaacgataagccccacaaattcaaagatcacttcttcaagaagccaaagttctgtgatgtctgtgcccggatgattgttctcaacaacaagtttgggcttcgctgtaagaactgcaaaaccaacatccatgaacactgtcagtcctatgtggaaatgcagagatgcttcggcaagatcccacctggtttccatcgggcctatagttccccactctacagcaaccagcagtacgcttgtgtcaaagatctctctgctgccaatcgcaatgatcctgtgtttgaaaccctgcgcactggggtgatcatggcaaacaaggaacggaagaagggacaggcagataagaaaaatcctgtagcagccatgatggaggaggagccagagtcggccagaccagaggaaggcaaaccccaggatggaaaccctgaaggggataagaaggctgagaagaagacacctgatgacaagcacaagcagcctggcttccagcagtctcattactttgtggctctctatcggttcaaagccctggagaaggacgatctggatttcccgccaggagagaagatcacagtcattgatgactccaatgaagaatggtggcgggggaaaatcggggagaaggtcggatttttccctccaaacttcatcattcgggtccgggctggagaacgtgtgcaccgcgtgacgagatccttcgtggggaaccgcgagatagggcagatcactctcaagaaggaccagatcgtggtgcagaaaggagacgaagcgggcggctacgtcaaggtctacaccggccgcaaggtggggctgtttcccaccgactttctagaggaaatttaggcgtgcgggcgcctgcaagcgggagacacccacaccccattctgggcgggccctcggatacctgctgcccagagcagcccggacccgaaacctttcaggccccgcttgcaagagctggaaaaaaacgcgtatctactaggaggagccagggactggggcggggggcgggggcgagggagggcgaactgtcgaatgttgcgaatttattaaacttttgacaaaacttaaaaaaaaaa

SEQ ID NO: 490544 - DNA, 1228 bp, Homo sapiens
gtggcgaattcggcacgaggacaccaaggcaggaggctaggaggtctacaaatagcgactgggtagctggtgtgaacacagggggtactgggggggcttagcccccaaggaagaggaccagtttttccccagcaccaccatcaaggcctcgaggctcccagctccctctacagcctgtggactgacttagggaatcccgaacccacctggtttccatcgggcctatagttccccactctacagcaaccagcagtacgcttgtgtcaaagatctctctgctgccaatcgcaatgatcctgtgtttgaaaccctgcgcactggggtgatcatggcaaacaaggaacggaagaagggacaggcagataagaaaaatcctgtagcagccatgatggaggaggagccagagtcggccagaccagaggaaggcaaaccccaggatggaaaccctgaaggggataagaaggctgagaagaagacacctgatgacaagcacaagcagcctggcttccagcagtctcattactttgtggctctctatcggttcaaagccctggagaaggacgatctggatttcccgccaggagagaagatcacagtcattgatgactccaatgaagaatggtggcgggggaaaatcggggagaaggtcggatttttccctccaaacttcatcattcgggtccgggctggagaacgtgtgcaccgcgtgacgagatccttcgtggggaaccgcgagatagggcagatcactctcaagaaggaccagatcgtggtgcagaaaggagacgaagcgggcggctacgtcaaggtctacaccggccgcaaggtggggctgtttcccaccgactttctagaggaaatttaggcgtgcgggcgcctgcaagcgggagacacccacaccccattctgggcgggcccagtggagtttggggaggggggcgaaagcaacgggactgctgggagaggaggggtaggaaggcccgcctgagcgcgacggggcttccgggaagggactggttctcgcccccttccccagcctggggcctcggatacctgctgcccagagcagcccggacccgaaacctttcaggccccgcttgcaagagctggaaaaaaacgcgtatctactaggaggagccagggactggggcggggggcgggggcgagggagggcgaactgtcgaatgttgcgaatttattaaacttttgacaaaacttaaaaaaaaaa

SEQ ID NO: 490545 - DNA, 117 bp, Homo sapiens
  misc_feature (76)..(76): n is a, c, g, or t
tcgtgggttggtctcatgtggaggaatagaagtgtctctgttgggggacagaggaacctgggtgagtccgatcgcntatgtcctacaatctgctcttagcacacggccttgccagtg

SEQ ID NO: 490546 - DNA, 615 bp, Homo sapiens
ctgacctcaggtgatccgcccacctcgacctcccaaagtgctgggattacaggtgtgaggcaccgtgcccaatccgtacttgacatttttaactcctagggtccttgggcagatatccacatcctgtcttgggaggcagtcctggtccttagctctccaccccaaccccctcatatccctggaaattgagagctgccaggagcaaagcagattgttgctgacctcagaagaacacaagttggccatttgtgaggaggagggattcaataacctcctggaacagaaataatgaagatgaggccagtctttcacgtgtggcatgttttcttggtgtgctttgctcctttggaagagacttaggggacaggagcatgagaatggggcccccaaatatacctgttccttctgaggcagatgagaagcagcccaaatgaaaaccctcttcctgactggtgctgagacagctgtctctacatcatttttcaaaaaagccacaaaggacttcatggagggtgaaatccttccccatcttaatttgcctgcctaacccaaatgtgggaagttggaaattgcttattttcaaaattagccaggattttgtcacttccaaggcaa

SEQ ID NO: 490547 - DNA, 519 bp, Homo sapiens
  misc_feature (467)..(467): n is a, c, g, or t
ttgcgggcgactctaaggaccatagctgtgtcatacagaatcacaaatgcgagcgctcatgagcaggagccacacaatcatattacagtataactacgaaattccttttacagtaaagtgccctagatccttacaagtttcactaaattttatccggttccaaccaaagcctccacgttgaaagagactatcattgtaattatcaaacatgatcgtcataacccaaaataaaaagacaattgggggaggccataaaacttctcataaaaccactgaggaaattaaaatggacttggacatgtctttagtttgatgcataaatttgaagatgcaccactgtatatggtagagctctaatagccacctaccgaggctacatcggcagctgcagcggtgctgcaaagttaaagcaggtcgcactgagctgacacataaagccctttgtgggatactgtagtggtagtgtnggcaatcaacagatttaggcactccaagtttaaggcagcatttgaatggaag

SEQ ID NO: 490548 - DNA, 1755 bp, Homo sapiens
gtggcgaattcggcacgaggacaccaaggcaggaggctaggaggtctacaaatagcgactgggtagctggtgtgaacacagggggtactgggggggcttagcccccaaggaagaggaccagtttttccccagcaccaccatcaaggcctcgaggctcccagctccctctacagcctgtggactgacttagggaatcccgaaccctcccctttgaggaccaccctactgcaagggacagaaagggagagaagaatgaaagggattagatttcatagtggggtccaacctcttgcagcgatgacagaaaaggaggtgctggagtcccctaagccctccttcccagcagagactcggcaaagtgggctacagcggctaaagcagttactcaggaagggttctacagggacaaaggagatggaacttcccccagagccccaggccaatggggaggcagtgggagctgggggtgggcccatctactacatctatgaggaagaggaagaggaagaagaggaggaggaggagccacccccagaacctcctaagctggtcaacgataagccccacaaattcaaagatcacttcttcaagaagccaaagttctgtgatgtctgtgcccggatgattgttctcaacaacaagtttgggcttcgctgtaagaactgcaaaaccaacatccatgaacactgtcagtcctatgtggaaatgcagagatgcttcggcaagatcccacctggtttccatcgggcctatagttccccactctacagcaaccagcagtacgcttgtgtcaaagatctctctgctgccaatcgcaatgatcctgtgtttgaaaccctgcgcactggggtgatcatggcaaacaaggaacggaagaagggacaggcagataagaaaaatcctgtagcagccatgatggaggaggagccagagtcggccagaccagaggaaggcaaaccccaggatggaaaccctgaaggggataagaaggctgagaagaagacacctgatgacaagcacaagcagcctggcttccagcagtctcattactttgtggctctctatcggttcaaagccctggagaaggacgatctggatttcccgccaggagagaagatcacagtcattgatgactccaatgaagaatggtggcgggggaaaatcggggagaaggtcggatttttccctccaaacttcatcattcgggtccgggctggagaacgtgtgcaccgcgtgacgagatccttcgtggggaaccgcgagatagggcagatcactctcaagaaggaccagatcgtggtgcagaaaggagacgaagcgggcggctacgtcaaggtctacaccggccgcaaggtggggctgtttcccaccgactttctagaggaaatttaggcgtgcgggcgcctgcaagcgggagacacccacaccccattctgggcgggcccagtggagtttggggaggggggcgaaagcaacgggactgctgggagaggaggggtaggaaggcccgcctgagcgcgacggggcttccgggaagggactggttctcgcccccttccccagcctggggcctcggatacctgctgcccagagcagcccggacccgaaacctttcaggccccgcttgcaagagctggaaaaaaacgcgtatctactaggaggagccagggactggggcggggggcgggggcgagggagggcgaactgtcgaatgttgcgaatttattaaacttttgacaaaacttaaaaaaaaaa

SEQ ID NO: 490549 - DNA, 1683 bp, Homo sapiens
gcaggctgtagagtcagcgaggtctaggaactgatggacctgcatgggtgctggtgagaccagccggtggagtgatctgggcggtggctgtgagcgctggagggaacaatcgactcattccaccatgatacctgaacccaagcgacatacgaccgtcacacccacttcacctactcaatgcacgtgctgagacatgaatatactgcgatacccacgcaaggaacgatgacagaaaaggaggtgctggagtcccctaagccctccttcccagcagagactcggcaaagtgggctacagcggctaaagcagttactcaggaagggttctacagggacaaaggagatggaacttcccccagagccccaggccaatggggaggcagtgggagctgggggtgggcccatctactacatctatgaggaagaggaagaggaagaagaggaggaggaggagccacccccagaacctcctaagctggtcaacgataagccccacaaattcaaagatcacttcttcaagaagccaaagttctgtgatgtctgtgcccggatgattgttctcaacaacaagtttgggcttcgctgtaagaactgcaaaaccaacatccatgaacactgtcagtcctatgtggaaatgcagagatgcttcggcaagatcccacctggtttccatcgggcctatagttccccactctacagcaaccagcagtacgcttgtgtcaaagatctctctgctgccaatcgcaatgatcctgtgtttgaaaccctgcgcactggggtgatcatggcaaacaaggaacggaagaagggacaggcagataagaaaaatcctgtagcagccatgatggaggaggagccagagtcggccagaccagaggaaggcaaaccccaggatggaaaccctgaaggggataagaaggctgagaagaagacacctgatgacaagcacaagcagcctggcttccagcagtctcattactttgtggctctctatcggttcaaagccctggagaaggacgatctggatttcccgccaggagagaagatcacagtcattgatgactccaatgaagaatggtggcgggggaaaatcggggagaaggtcggatttttccctccaaacttcatcattcgggtccgggctggagaacgtgtgcaccgcgtgacgagatccttcgtggggaaccgcgagatagggcagatcactctcaagaaggaccagatcgtggtgcagaaaggagacgaagcgggcggctacgtcaaggtctacaccggccgcaaggtggggctgtttcccaccgactttctagaggaaatttaggcgtgcgggcgcctgcaagcgggagacacccacaccccattctgggcgggcccagtggagtttggggaggggggcgaaagcaacgggactgctgggagaggaggggtaggaaggcccgcctgagcgcgacggggcttccgggaagggactggttctcgcccccttccccagcctggggcctcggatacctgctgcccagagcagcccggacccgaaacctttcaggccccgcttgcaagagctggaaaaaaacgcgtatctactaggaggagccagggactggggcggggggcgggggcgagggagggcgaactgtcgaatgttgcgaatttattaaacttttgacaaaacttaaaaaaaaaa

SEQ ID NO: 490550 - DNA, 162 bp, Homo sapiens
attcagatggctatcagaggccgacgatctacacatggtatgtcagtgacctgcggtggccatgcatgcagcagttccagaaccccgacttcccacccgaagtagaggaacaggatgccagcaccagcacgaattcccttagcaccagcactgaattccctt

SEQ ID NO: 490551 - DNA, 837 bp, Homo sapiens
gtggcgaattcggcacgaggacaccaaggcaggaggctaggaggtctacaaatagcgactgggtagctggtgtgaacacagggggtactgggggggcttagcccccaaggaagaggaccagtttttccccagcaccaccatcaaggcctcgaggctcccagctccctctacagcctgtggactgacttagggaatcccgaacgatgacagaaaaggaggtgctggagtcccctaagccctccttcccagcagagactcggcaaagtgggctacagcggctaaagcagttactcaggaagggttctacagggacaaaggagatggaacttcccccagagccccaggccaatggggaggcagtgggagctgggggtgggcccatctactacatctatgaggaagaggaagaggaagaagaggaggaggaggagccacccccagaacctcctaagctggtcaacgataagccccacaaattcaaagatcacttcttcaagaagccaaagttctgtgatgtctgtgcccggatgattgttctcaacaacaagtttgggcttcgctgtaagaactgcaaaaccaacatccatgaacactgtcagtcctatgtggaaatgcagagatgcttcggcaagatcccttccccagcctggggcctcggatacctgctgcccagagcagcccggacccgaaacctttcaggccccgcttgcaagagctggaaaaaaacgcgtatctactaggaggagccagggactggggcggggggcgggggcgagggagggcgaactgtcgaatgttgcgaatttattaaacttttgacaaaacttaaaaaaaaaa

SEQ ID NO: 490552 - DNA, 446 bp, Homo sapiens
  misc_feature (15)..(15): n is a, c, g, or t
  misc_feature (182)..(182): n is a, c, g, or t
aacctaaaaaaaacnactccaaaactttgaaaaaacttttacttttccccctcccctaactaaaaagaaaatgtaatgtaccctcataaccctgtgtcaatttagtgttcagcacttttgggaaacatcagttggtgaactttaaattttgcctgtcctactcactgggcacggtggctcanacctgtaatcccagcactttgggaggctgaggcaggtggatcacctgaggtcaggagtttgagaccagcctgaccaacatggtgaaaccccgtctctactaaaaatgcagaaattaggtgggcgcctgtaatcccagctacttgggaggctgaggcgagataatcgcttgaacctgggaggcagaggttgcagtaagccgagattgcacccactgtcgtccagcctgggtgataagagtgaaactccatctcaaaaaaaaaaaa

SEQ ID NO: 490553 - DNA, 1110 bp, Homo sapiens
ggtgtagtcagaacacaatagggtaccagatttcctaagcagatgacaagatctggttctgatgcacgttcatatatatgatcgactccagtatacggagcatacttactgaggctaggatagaactgcgcgacctagtagcggagtgtaggatttcccgtcctacgtgaagaacccgcgagctcagggtagatacactctcgtggagcatattgctgacgagccacgacgaggaacataccaagaaataccctagagctaggaaggcatctatgagcccacagagggacctacgcatgcaggagcaaccatggtagagaatgaccaacgtgtagacgctctgtaccgtacacagtgatttgcacgagtactagggcaagttgagatggacaccaagatgtactagcagtagagacagtaggtaacaatgggcaggctagcacagaaacgcgcccaaatcatactccatatggcttggtgacagagcaacacctgaagcatagacatcagtagtcatagggacggatacgacggcttcctgacccttagagtaccaggccagagagagcacaaccgagacaccccgaccaaagaaccgcacatgacaagtgataaatctcccacaaaatggcacgccccaaaaagtagagacaggccaccaccaaagaccaaacgaaaaacgcacaaggaacaaactaaccaagcgacagaaagggcacttgaaccaggacgtgaaatagaaaatctgaccacattaggagccccatagatctatggggaacagtgactgaagcaaatatgcacgacgaacgagacagagaaccaaaagacgcacacggacaatgtgacaactacggccttggtcacacggaaccgcgcaacaaccagcgccttacacgagcagacctgcacaaccgacgcacacaaacaaacaaaaaagtcggacaaagaagcaaaccacacaactagtcacaacgatggtgataaatagagcacccacaacgcacaccccattccccaaatccccgcgatagcagtactggggaatcagtgacaatcaaaaccaggaacgacattatggagacggcacaattgacacatgtgcacgaa

SEQ ID NO: 490554 - DNA, 609 bp, Homo sapiens
gtggcgaattcggcacgaggacaccaaggcaggaggctaggaggtctacaaatagcgactgggtagctggtgtgaacacagggggtactgggggggcttagcccccaaggaagaggaccagtttttccccagcaccaccatcaaggcctcgaggctcccagctccctctacagcctgtggactgacttagggaatcccgaacgatgacagaaaaggaggtgctggagtcccctaagccctccttcccagcagagactcggcaaagtgggctacagcggctaaagcagttactcaggaagggttctacagggacaaaggagatggaacttcccccagagccccaggccaatggggaggcagtgggagctgggggtgggcccatctactacatctatgaggaagaggaagaggaagaagaggaggaggaggagccacccccagaacctcctaagctggtcaacgataagccccgccccgcttgcaagagctggaaaaaaacgcgtatctactaggaggagccagggactggggcggggggcgggggcgagggagggcgaactgtcgaatgttgcgaatttattaaacttttgacaaaacttaaaaaaaaaa

SEQ ID NO: 490555 - DNA, 1788 bp, Homo sapiens
  misc_feature (1246)..(1246): n is a, c, g, or t
atctcaaaaaaaaaaaaaaaaaaaaaaaatcctaagacttagcaattggggccgggcatggtggctcacacctgtaatcccaaattgctgagattacaggcgtaaaccactgcgcccagcctcagaattatttcttacccttacccattagtagccacagagtgctcatcaaacatcactttaatacaggattaaatactgaaaataaagaatgttagcagtgtacatttgtaatgctgattacatcccaaagagacatatactttattttgaatatgcttgtaatataaatggctgttcccactctaatacggataattcaaagttagtgacatcaccacaaaaatgaatttatgcagtattcaaattggtagcatttccacatcctgaaatatcttttttttgtaatgctcatttctattcatgaaatcttaacaaaattcagatttactattattcttcttttccttcttgtttaataggtgctttaggcttaagttcatcctaccaaattgtccaaaaatctaggaagtaatattcagaagttgtttctcactcaccttggaaaatattttctctaatcaaactttaaacaaattattagctttaattaaatgtgaaataaaacaaagcatacaataaaaagccctttggtgtaaagagctgatacaaataagtccaacttgaatattcacaacttttctgtaataattgattgcaacataatcacagtaaaatttcagcatactttaagtcattttatttgtataaaagtaaatatataactctgaaatgattaaccaaaatactacttaagtatactttgtaaaagtaaacctatattttaatgtaatctgaccatttccctttctagtagtatatagtctgtatcttttctaactaatgtgtctttggatacctataacactattgatacttttcaaataatttatcatagtatccagttatataccagtagtattcattattcatctgttaagtacatttctattaagctaaaatctgagtaaaatctgaaggaaagtaatgagtaattcactcaagggcaggagcatagtgtgtgtgatatgaatgggatggatattgtggatggaggcaacacattaataaactctggcctgggagttaacataagtagactaatatgactttcctaacatactatatagtgactggttttcgctgcatgccatgatttatatgtattatataggctattgtctcnttcttaattatttagaaataccatgtctataatatagtagcattactgtttatttcttaagaggcatctctatggtgtataaggtttaggcaattctattatgaataacataggctcagattatacattgtggacaatcgaattatgcatgtgctatctgagaggagatctgtatgtgagcaagacatagaagccctgtatactctactctctctcagaggacagaggagatttgaagaccaattgtggatgggtatcgtgcatcaactgaaatacccacttatatctccttcatcagttgcccttgtgttaacatacgcatcaagttcctgcttgtgccggcccagagctatggattacccagttcttctaagaagttatatcttctaaatgcctattgttatgtatttgctgtaatatcagttttgcctatgaacacagcacgtagcatcaaaagcaaggcaatgtatgagcaccacctattagaagagatttagtgccatgttatttataacaaaacctggaaataatctcaacatccc

SEQ ID NO: 490556 - DNA, 185 bp, Homo sapiens
aacagagtgatggctccgtctcaaaaaaaaaaaggttagctgggcgcaggggcttatgcttgtaatcccagttactcaagaggctgaggcacaagattggtttgaacccaggaggtggaggttatagtgagccaagatcacaccattgcactccagcctgggttgacagagcaagagcatgtctc

SEQ ID NO: 490557 - DNA, 620 bp, Homo sapiens
  misc_feature (56)..(56): n is a, c, g, or t
  misc_feature (91)..(91): n is a, c, g, or t
  misc_feature (111)..(111): n is a, c, g, or t
  misc_feature (148)..(148): n is a, c, g, or t
  misc_feature (159)..(159): n is a, c, g, or t
  misc_feature (200)..(200): n is a, c, g, or t
  misc_feature (203)..(203): n is a, c, g, or t
  misc_feature (217)..(217): n is a, c, g, or t
  misc_feature (258)..(258): n is a, c, g, or t
  misc_feature (260)..(261): n is a, c, g, or t
  misc_feature (269)..(269): n is a, c, g, or t
  misc_feature (295)..(295): n is a, c, g, or t
  misc_feature (310)..(310): n is a, c, g, or t
  misc_feature (356)..(356): n is a, c, g, or t
  misc_feature (369)..(369): n is a, c, g, or t
  misc_feature (396)..(396): n is a, c, g, or t
  misc_feature (398)..(398): n is a, c, g, or t
  misc_feature (407)..(407): n is a, c, g, or t
  misc_feature (411)..(411): n is a, c, g, or t
  misc_feature (417)..(417): n is a, c, g, or t
  misc_feature (436)..(436): n is a, c, g, or t
  misc_feature (510)..(510): n is a, c, g, or t
  misc_feature (519)..(519): n is a, c, g, or t
  misc_feature (522)..(522): n is a, c, g, or t
  misc_feature (537)..(537): n is a, c, g, or t
  misc_feature (552)..(552): n is a, c, g, or t
  misc_feature (602)..(602): n is a, c, g, or t
gtccctaattggctccttctctactttgtgcacaattattctcactctccacaganaggctgcttaacttctcatctggtggctggcagcnctaaaatcctgattttaacngcatagtagtaaaaatgcctcagtgatttaagttgcncgctgtacacnggtacatggctcttgtacccagtatcgggaatcgctacaantgntttttattcccaantccaaaatagattatctgtaggcgtggacaatgacagcagngnncccttctntgttttgctccgctgtttcccgtacntgctggttattgtgnttttcagcccgcctttttcttcattttctccaactggcttctctgnggttattggtgcnggaacactgccttgggcttcctgtcgncngttccttantcanggtcangccctagtctaggggttgngaacatgccacctcccctcccccctccccttcccccccttgcccccattcctgggtccttctcttcttttggantttctgtgnctncaactcctggctgtngttaggcagtgaggncactccagcagcatgccattaaggcagttctcacaacctcttgttgggtnaatgattcctttttccac

SEQ ID NO: 490558 - DNA, 180 bp, Homo sapiens
  misc_feature (141)..(141): n is a, c, g, or t
ggggttactctagagtgatcctcattggaagcggactacgggggtggaagaaatcagctggccccggatgttctctggggtttgtgccaaggttctggagcctataaactttcaaaagttaactccccacgtacccatccntgcttgggtttcttgggcttttctagaggcacctggcag

SEQ ID NO: 490559 - DNA, 1112 bp, Homo sapiens
cagtataccagtatctcttcttatcttaaaggatattgacaatgctttagacatgtagtaactgctcaggttaaatgtgttagaatgtttgaattaagagtagtaatgagtagagtatttaagagtttgtttaattaattttgttcaaatttatgagagtactttgtgagtgtttaaaatgttatgtctttaaagttcaaccaggtacttgggatagccggaatagtattagaagtactatagatcccgcattagagagaacgatcgtttatctgtcccttaagaagaaagaaacgatcgaaattcgcttatgtttaatcaacactttgatagagacaaggtaaggaagatcgaggcaagtgcctaggcgcgtgtgggcttatggcctgtaatcccagaaattgcgggaagtccataagcgcatgggggacaaggtcaacaatctgagaggtccgaggagttcgtgaaccccgaagccgtgggcaaactgtattgtgagactgtccattctgtctatacataagagaattttcacaaagacttaggctaagacccgtggaatagcatagtgttcgcctgtaaatgtccctcaaacaataactgtgcggagaggtgcatagacggttgtgacatggggctctcacgttgtgaaagccccaaagagagcgttggcacgacggctggaaagtagacgcccccttggaatttaggaacacaaattattgaacatcaagagccttggggttagaccagaaattttgaagaaacccttacctctttccaaggaaaaccgcaagtagtccgttaacaaaacccccagggatttataacgggcccaaacggggtgaggttaaacactggggaccccgtgtgaaactacaacagcgcgatcacacgggtcctggggaccaaggacacccaaaggggggtttaaaacaacaacccactggtcgttccaacatgatggaaaaagggggcatactcaccggcacaaaacagattgggggccccttcgcgtgggagccgccacgaacgcctagccacagaaaggtcacataggcgggtgtacataacaaagcgggcgggtcccaacttggcgaaagacaaaagac

SEQ ID NO: 490560 - DNA, 846 bp, Homo sapiens
  misc_feature (176)..(176): n is a, c, g, or t
  misc_feature (182)..(182): n is a, c, g, or t
  misc_feature (318)..(318): n is a, c, g, or t
  misc_feature (334)..(334): n is a, c, g, or t
  misc_feature (351)..(352): n is a, c, g, or t
  misc_feature (360)..(361): n is a, c, g, or t
  misc_feature (385)..(385): n is a, c, g, or t
  misc_feature (410)..(410): n is a, c, g, or t
  misc_feature (434)..(434): n is a, c, g, or t
  misc_feature (448)..(448): n is a, c, g, or t
  misc_feature (454)..(454): n is a, c, g, or t
  misc_feature (536)..(536): n is a, c, g, or t
  misc_feature (574)..(574): n is a, c, g, or t
  misc_feature (683)..(683): n is a, c, g, or t
gagtatttttatgtcccaggatatgctgaaccaatcagtactgaatttaaaaagttctttatccaaaaagtgaagcataagagatgacgagtcatctcctcaggtcttaattctactatttccaggagctcaagaggtctgtatgaatcatgtcaccaaacatgactttcgctcanatgctntctctaaaggctcttcctatgcatagaattgcatatacactgtggtgatgcaggaacttgtctttccagtggactgaaggatacttggctctgcttgccttcagttcactcaagcctcagtctctcatacccattntcccctgtacaatgantgcagcaacagggcctnntctctccnntgtattagatacctgatgcatacncacgtgtgatttcaggtgaagactntctagtcactgctttatagcgttntctcactatgcatntctggngttaatgagattcatctgcagtaaagcctctgacattctgacagcataaggctctttctgatgactatctgagcatactagngtgcttcttggagaaagctccacactactacatcatanggctctcagatagatctgatgatatgaggctgctcagtgaagtttccgatcacaattaaaggttcctatgggattttaggtataattgacgccaggagcctcacttacncaaataggcttaccttgggttctatccacgggtggactttgaaatttcaagccgcttataagtctccctaattttatccataaacgcttttccttattcctcacaaattttttctcgccctttcagttccttctcttatactcctttttggtcgctgatgacg

SEQ ID NO: 490561 - DNA, 541 bp, Homo sapiens
tacccgataaggtgtctctgttttcacagcctcagtttcccttgctgtaaaatgatgacaagtcatgtctaagggcccacagccaggccaacctgggagcctgtatttagggcttgttcattagttgtgtctccctgctgcctggctgcatgacccctggggaagtggccaaatgaggccatatacaactccatttgcagaaataccttgccaggccccaggtgttttctgggagagtctcagttcaggtctcagctttgaggtatggcttttgactactgctcacttcagcccaggacagagtattcaaaacaggagcccttgtagcctggccagggagaggctctgcatcccatctcagtgaaggccacatgtcctgcccccacccttctccaggaaagaatgcctattgtgtgtcctgtccaatgacccccaagggaaggcagtccctgaagagctggccttgggaatagctgaattttcactaaacaaggcagaagtgatgctctctatgctcactgcctacatcattaaccgacag

SEQ ID NO: 490562 - DNA, 1047 bp, Homo sapiens
gtcacccaacgagcttccgggagttgaaaggaggccatcataggatcctggagagcctcaagtaacatgacgtgtggagctaggctgtctgcatcgggctcgcccaccgtctccgactgtggtaggcctgtagtaagccgaacgtcgggcagaggaagtttctgggatgacatcagagaagctacgaggaaaacctcaagaagaccctgtgacaatggtggccattgctggaggaggagaagatggaagcagtgcccgagcgtaccagcgcacaggaggacaaagcccgagggggcgagtcgaccatgtgaatggctgaagtggcaccaggcgaaacccccaggctagtcttgtggccagacacgtgtgggctggcaagctctggcgtcacctgtcaccaacgccgaatggcgcggaggtcttcatcctgatacttggagttctggcaccctccaaatcatatcgtttgaaggacagagttgaagcttccaggcctgccagacagtcgcaaggaagatgcttcagcactagtggcggagaggacgatggcggctggcgtggctacctcactggccgtgagtggcatcatgggtcaacgactattctgaagactcagaatggacctctgtctcaagctctcatcaaggggccccgactcgaacctccctacggaggatggcctctactgtgttggactatctcaggtccccatggattgacccaggcgtgcccccaagttgctggtacctctcccaatgcgggggccgctgaagcccaagctgtttgaccatgggcacggtgtgtgtagccctcctgaggcaccggtattgggcaggggaccgaaagggtggaccaagcaaaggcccaagcattctccagaggggcccatctacacgcgcaaggccggggcctgcgtaaagggaccgctattacaagaagccgagttcaagaggtaaacgaaggctggcagaacgcgtagaaacagcgaggaaatcagcgaagcgcccgatcccgtgattaggcacagacagaagtgctggggctcag

SEQ ID NO: 490563 - DNA, 1286 bp, Homo sapiens
ggctccggcgcttgtggccagagtggtgcgggctgtgcgcgtggcggccgatccccacgtggtggctttctcactgctagccctctttggtcctccttgactgtccctgtggcctgtgtggcccgctttcttgcctgagattgccgaatggtcaatgtctggtggtgccatctggcctgcctgcctgcgggtgctgtgcatgtgatgcatgctgcctggtgatgctgaagagctgctggagtgactcattgttcaacactgtgggcatttgggcaagcgacgatttttgcacaacaatccttctcattcattcaacatgccattatctgatcaatggctcgccttaagaccacactgatgtcagtgcttggaagttggaccttgtgaactgtgccacacgattgacctcgtcacaacgttcgtctccacgcacacaaggggcaacacaacagtgttcgtctcgcattgtcgcacacttgcacccaaacggcctcagtcagctcgcaactttccacaacacagacgttcgatctggcacgcactgtgcgccagcacaacgttcaaagctacatggcatggggtgcatgctgctcgacaaacagcaatcttgccagtctctctgcataccttcgtgttggccaggattctgcccttgatcaggatctctctccacccttccctgtccttcacacgccttgctctggcgtagcctcgcaccccttctcgccacggttggttgctatacttcactgtctcaacacgacgcacatcttggcgctccgactggctttgcacaacaacctgggcagcatacggtgatacttggcagaactcctcacactcacatccaccagcgctcgtccgcgcacgctctctggacccatcctcccttgcaccgttggggccccggcactcctcctccaagaccacccgcccccaggcttgccactctcacgccgcccgctcacactggttcagcagcgctatggaatcgaccagccccgccatcccagctctccgggcactgtgggctgtggtctccgtacggcggcttacccctgtggcgcgcgacagcagcacgcgcaacgctccctgcgccgccctcaccgccccggtcgccgcgtaccgtccttttgccagaccagccatgcaacttcgcctgtccgccacgctcatcgccggaccgcacggtatctcctgcgcacacgtctaccccgtagcgcgcagccgcccccatcacagcggaggcctttcaccagcagggcgagcaggggggcagcgcggct

SEQ ID NO: 490564 - DNA, 487 bp, Homo sapiens
gcgaacaatacccatccggcacgatgcacgcacagagtccgcccgttttaaaatgcgtaagactaatgccaacaatacaagttccggttttctttgtctttacaacttttaacaaatcatttgaaactgcatcataatctaatgaacctttaacaaaggcggattggcaaggacaagggtgtatttgtccttatcttagttctgttccgacaaggagtcgcgatattcgatattcggattttcaatgccatggagcatcatgttcatcgcgccaatccgcagcatcgtgcggtccatgtcaaaaacgtagaaccatatggttattaacatgctcttttaaactttgcactaaaaataagtcgctgcgatgttaacgcaaatactctcttgccgctactaagaaacctgcggaacctgcgggtggatcgacaataatatcttccagtgtcggtttgactaactctaccatcatcttgatagtatgaag

SEQ ID NO: 490565 - DNA, 2232 bp, Homo sapiens
  misc_feature (950)..(950): n is a, c, g, or t
  misc_feature (1095)..(1095): n is a, c, g, or t
gctgagattgcgagcatcctctgactggcgtctgctgctcttgtgtctgacatcgtagatgaatagtggagcgtcgggtgcctcagacatcagtagatggggcgggtgatatgtccacctaccgacatgaatgaatggtatatgataataatgatgagggtgggctgtgtctggaatcattggcgccacagcagctgagtgtgattggttgcgtgtagctgacagcagtcttataatcgaatatgacttgtgtctggtgtcgtgatatagatttgagatcaaagatgatggtatgcgtgtagatatagagtagctacaactatcaacggtaccgattgctagcgagtatatgttgtggtgtggtggtcacgtatcacagtatagtagatgttaggtaatacgtcgacatctatcttgtctaattggtgtgtgggtgaatatatgaatggatacgggcggtggctctgcttgggctgtgcgtacagtcctgactcgggtgtggtcgcgctacccccgataggggctgaatccgcccacgaagataaggtgtgttggacttacatgtatcgtcagtacatgtagcggtgtttctctgtacatacagggaggggtggtctctctgttgctttatgttgttgtgtgtggtataataaatgtgaggtagagcgtgtgctatctgttggtagcattggagagtagggtgttgtggctccaacgagcagatgtggatgtgtgcgttgaatagaaaaacgtggtgtgaccaccagtctgtgttttgatggagcggaacacaggtgctgtgtccatactacacggctgcttgggtagttgtttgtgtcccggtgcggtggtataggcaagtggatggctgtggtctgccaacggacggggtggcgtagtaatgataaaatctcattcggtgcctgcgccgtggtgtcgtcgttatgccncgtgtgtctacgcctcgtgggggggtccacccctttgggggtgtgttctgtgtgttgctccgtctctcgcgccgggtgttggtctgcccctcatcgatcaatcatttgagtgtggggtggtgttcctccacgtagtgtgtgtggncttcctcctcgtagtcagatatttgtggtgcggcgaccgacgtctaccactgaccggttgggggggtgtgtgttagtggtgcggttgtctaccttccggcttgtgtttgaagatggtttggtggctgtcccactggagttgttgtttctcctccggtctttgtggtggttgtggtagcactattgggtgctttgtgtgcgttgtgctgtggtgtttgtgccttctgtggtggttgttgtggcgggggtgttgttgttgttcttcgtccttggttattattacctgccgctccgtctacttctacaacttggttgccagctagtagttgtttgccccagccggatttatagtgactcctccctgcttgcctgttgtgagtagtggggtgctctgccaacgaagtcgtactccatctatctatcaacatgcagcggggggtcctccgcctctcctccattatttgtttcccctgctgtaagtaatagtattataagtattggtggtagttgggcggagcataatttgttccactggggagggacctccccttcatcggtagtagtgtgttgccaacgacagtactactatctatttgtgtatcattctggtgttataatagtataatattgtggtgtggtcacactgagagaagttgggagtgtgtctcacgcacctacgcctactgtgtgtgatatatatagacactactgtaagagaataaagggtctgtgtgcacacactgtctgtagtgtgtgatagtctctgtgctctctcactcagagtaggtgtgtgtgtccgtgtgagagagatatatagtgtataaatagtgctgtgataagataagctccacacagtgttggatatctgtgtggaatagctgctactgtgaacttgtcacttgtgtgtataagcgcacctgaagtgtgtctgggaataaagccacctcggggacgcaaacacaccggtggctgaaaattgtgatacgctaactgtatggatatgtgaccccccgcgcccagagatctgtttttaagattccagacttccaatgaggggcccaatgaaaagggctatttgtgaaaaaagataaaagtatacgcgagcatataagctcggtcgagaagagtagtgtacccc

SEQ ID NO: 490566 - DNA, 406 bp, Homo sapiens
aaaagttacaaaggttatttgaatgtaacatataaagatgcagcctttttcctagggcaagggaaggaagggctgttacataaggcacaggaatggcagcatgcaccacctgaaggcagggccctagtgggagaggaagttggcactggggtccccctgcagctgttgatggggaggtagagaccccctcaaagtgccatggtctgaggctgaactaattggccaagcagatgctatgcagcggcggtggggcggaggctttatccaccgtctttggtgcagattgcccttacacacccaaggccttttgttaaaccccagagtcctgggttccagaagccttcttttggaccacaggccctggaagggggtggtataaaatgctttgggaaaagtttaaaagttt

SEQ ID NO: 490567 - DNA, 3748 bp, Homo sapiens
gctgggacatcaagccccaccggactgctccagcctgctgaggccacatcagggagatcctgctgcctgtcctttcgttccatctgctttactggagccctggagccctttggacagtgtatttattgacaccacctacattttcaaagagactcatttaaagtgacagtggaaaatccatgtccatttacttggacagtggaaaatccatgtactgaaccccaccctcaactcccaaactctgcggtggtgcatttgcacttctaattttgagggcctggtaatgacgccaaaaccaagggttggttctctgtgaggccaagcagttttgttctgtgccaagatggcagcccctacccctcagcccagccctgaggcccgtctccagccccccaaaatccttgcctggagggctagtcagtctctagatggccagtgctgagcctttagtagaactcccaagtaccgccgcagccgagagcctgtccttaactgcacagtgattcttctgccgggggtcaaagcacaaacctgggaggcagaaaccctggagctccttctgttacactacgtggccctgaatatcaagtccagattccactgcccttttctggctattgggtgggagggtgctggggaagggcactggcacctacttacccccaagtgggcagagctcactccttcgggcccacttggtgttgcagtcaagagactcagttccaaaaaccttcagcagaggtctcccctcctcctggtatttcactggttgctctccagaagtcctcttcagaggaatgctcatcacacatgcttattctccgttttcccacttcaacagttacttcaggtttaaagtcctttttatctctgtaacctggtgacataaagccaggaacattttcccacaatccaccttagcataaaacataacaatttcattcatcagttgttattgtgtagaaccaatgaacatgttggtcatttgtctgtatttagtctttatttgtattgctatctttgagcattccaagattgcagagcatgagcgtgtgtatttgtgtgattctttaatttcagctgccttaggtttgagtaaaagatgtaaagaaaggtaagtgattttctattgtaagactttaacccatacctgtcacacttggtgaaaaggatgtacttacctgagtattgtgttttggtgattctgagccagtcgtccatacaaacttaagtagggtagctttacctgttacttatcacaactcagtagcagtgtaggggaaaccacctggcagaatgtctccctggagtagccctgggagggacagagacagcatctgacagagtctcagagagctgcaaggtcacaggagacgaggcaactaactgtggcacaggaacattctttaaggcaaggctttttctgaactcgggtgtttattctgtcctgagagaaccattcattgattctaaaatataaaattcgagttgcaaatgtccatgtgcctggaagctgagggaagttttagacacctgcccagtttccctctccttgcccactgcggtacagcacgacattctagtttctcctgatgcttcgtcaaagacatttagtgcagttatgtcctgttccttggttgggccacaatggagagaacagtacttgagaaggatttctctgtaagaataccatggcagagagacccctctgccccctgctttgcattgctaacagttattagcattttatatttctttaatgcaacctaataggaaattattattcgagacagactcctctgggaaatgcataacccaggaggcactgattccttgctgagaatcctgagtggtctgtcattttacataagatcacatccttcaaacattgtgtatgttggagcagcgaaagaactgttcaccccttatgaataactgacattcaggaagcccaactccatcatgcagatgtctatctttaattgctagctcagaagcagacagagcttcctgggacctggctaaagtaactgatagatggaactcttctttggggactattactttgcaaatggggtcagagcctcatctatgcagagaatgtcaccatatgtggtttcatgtaatctgtaattatttgttccaacagcctttaacatgactattgtttgagaaacatggcaacttttaattcccctttgatgcttctagctttctttagtattttaagaactcatacagtactaggtatgttggtccctctgagaaaaacatgtggactctcaccagtccgttgtgctcaggactgagcagcagcgtgtgtgcggggcagctgtggaggtgaatactgattgtcccccttttcctccacagggatatctgcattacctccacctcctccacctccaccaccaccagcagctcccttgcctcctgcgagcaccgaggcacctgcccagctctcgtctcaggctgtgaatggcatgagccgaggggccttgctcagctccatccagaatttccaaaaaggaactttgaggaaagccaaaacctgtgatcacagtgctccgaagatcggctgaagcttcctgtttacacttggagggaaaagttcttttttattcctactcacccctaccccccaaactaccctcttcctgggaaagtaattgctgagccagtacagccacaaacagtactattttgcagatgctcatgtaagcagcttttcgagagaaataattctttaagcagaataaagttaggctggcattgctcccttaagatcttgctcctttattaaccctgtaaaggagtcttgtttatcctctaatggccaggcttttgggacagcagcatattgaaatattttcaccaactaaaggaaatagacagaaaaacaatgacaatattcaatcacagcagtaaatggcctttgtgttgcaatcccttctaccccatcagacagctcctagaaacattcctcttacagttcatttctctaaagcattttctgattcttagataactccaatttttgctacctttatcttagacattaacactatagcccaaagcatagttactttgctaaatcagaaagcaactgagttctttgttttctcctcaaatagaatggggaacgttcacaacattctcttaagttctaacaggaataccattgtggttatagaactcagggctgctaaagcaactactctagacccatagttctttttagttagatgtattgaaacagacaaaaatattaacatcagaaaaagctcttgccaattagaggatcttcttaatcctcagcaattaagtttggggtttgaggggggcaggtcattgttacaacagaagtaaatttggcatctatagaaatcaattatgatttttgaaagatttatctaaatatatcaatatagcatctctttaatgttagtcatttattagaaagatcctttatcctgatttgcttaaacctttcaataaattgcactttaaaggattataaataatccatttaaaaattcaagtacacacatcagtgttggttactatgcagagaatgtcattgtgtatagtttcatgtaatctgttatgtcagctgtattttttattaaaatcatgtcaagaaaacgtgttgtctgtagcttgacaagatatttcaaatgagaactttttgtagcgtctgttgttagcaaagaatagattcacacagtctaaggtttccttcctacct

SEQ ID NO: 490568 - DNA, 814 bp, Homo sapiens
  misc_feature (479)..(479): n is a, c, g, or t
gctgtggttaatttgagtatatcctagtttcgaagtgagaataatcagcttgtgattcagactaatattttactgtctgttactatttgattaaatgacactaaaatctgaataatgacttgtgtcccccctttctctctctctctttgctgttttcagtagagcatgcaccattttgaacgtgaattttcggtaaagtaaactatgctgatttctcagactttaaagatgctctgtttctgtgtgtgaaataggacccaaagtgtctcgattgctgaagtgatgaacaagtgggaaagcagatttgagactatttccttatctgaatatttaaatgaaatacagcatctttaaaaagcacccagtgacttcatctatattcatttcattttcatcatgaccttcaaaatcttcattttcactctgatttcagttttaaaatacagctctaaaacctgcaaatcaactgcatggcattntggtatattttaattttggaaaccataactctcaaagtgctgggattacaggcttgagccactgtgcccggccaggattgcaacttttggctggccagcccatgcttaggctgttcttccttgcagaactggaggtcggtcttctcctgggctcaagtgatcctcctgcctcagccttctgagaggctgggactataggcgtgcaccacacatccagctaatttttaaattttgtggagacaggggtctcatcatgttgcccaggttggtatcaaactcctgggcacaagcacttcctctcacctcaagctccaaattgctgggattatagattg

SEQ ID NO: 490569 - DNA, 1635 bp, Homo sapiens
tcagcggatccctgtatcacgccattatagcagcctccgtggctctagcaagtatctgacttttacagaaatgactttcttggtttttggatggcagtttagtcttgtctgcttttttttgtttatttttttatctacttcagtgtccatttgcagtcccgtcggcctcactgttttccctgccgtttatctgttgaagagcctgggctgtttgtcccatggcttcccacagtgtagattttgctgaccacgtggtcatggtgtagttcagcatggtcctctatgtttcctgcacattggcagctgggtccagaggcttgatgagcctcaaatttgatccctttggcaggagaacaggcggttaggagctttcctcaggaaagtaccatgttgacggcagctgatgctcagtgccaagatccattaattatttggggttgcaaaatggtggtattctcattctgtcgttttgcttgcctttattagctggaatggttttctaagaaagtgttttcttttttatacttatctggttacccagtggtacagttcatataggaagggcaggataaatgcttgattctttgctcttgtacactaagtttttaagataatgcattagttgtctgtcaaggaaggtgagtggtgaagggtttttacatatatacaagaattcagctgggattacaggtgtgagccaccaaagccggccccaccttgctttttaaaacagctctgttgaggtgtaactgacaggtaatgaactgcacatacgtgaagtgaccgatgcatttgcctgtgaagctgtcgccagaacatgtccatcaccaccaacagcagtttcacaccccggtctaaaccgtccctcgtgtcctccatgttcaggcaaccactggtctgctccctctcactaaaggttaatttatatattctagaattttatctgagtggaatcgcagagcaagtactgtggggggaggtgcttctactcagcataattattttggcattcacccattttgtgtacatcaataatccacattttgtattgcatggatataccacagtttatttatttacctgttgaccgatatttcgattatttccaatttctaaataaaaataaagcaaataaagctgccgtgaacatttaaaaagcagaaacaaaacacagaaaacagacaagcaacccaccaaccgaacacaacgagacacaacacaaaaaaacaggcggggcgggggccactaaaacacacccccgagcggccccccacacggcagcgccgcgacaccctctccgcacaaccggcggcgcccaacaatgagcaggcgagaattaccaaacacagaagcggcaccggaagcccccagaatacacacccagagcgcacgccggaaacaaacaacgcccaaccgtcacggtgaccatctttgagagaaaaccaccccaatcccgtcgtagggtgcggcgctacaacagtgagggcaaccaccacccacagaccgactagaagatccaacgaccgccgcaggcaacaaatctactcacgaacaacaggagcgacacaaaggagtgcgctaccacccccgcctccatgtgtcgaccacaacagaaaatgttgagctcacacaagt

SEQ ID NO: 490570 - DNA, 582 bp, Homo sapiens
  misc_feature (117)..(117): n is a, c, g, or t
  misc_feature (193)..(193): n is a, c, g, or t
  misc_feature (377)..(377): n is a, c, g, or t
  misc_feature (462)..(464): n is a, c, g, or t
ccacattcttcttctgtagaagagggaaaggcaggaaggcattaggggcatgagaaaggactcttcctttgcatactcctctacctggcatccagacccgagccaggaagtagacangctgagcaaggaaagattttcttttatcccaataaaatgtggtttggcaaaacatgttggagaagattttcattanggaagctgccttatgtgggatatgcttacatcttatggtcttttaaagattcaccagcatcgaagactgacaagagctcagtcccaccatggatctgaggaggaaagaaaaaaaagaaagattttagctcgaaaggtaagcctgctgtctctctgcagtccctctatgagttcttgagtacatntgaagaaagttctaggttaatggtgcccatttaatgacagatgctgtgctatatctccttgaaagctaagactatttccagatgnnnggggtgcagttttttttggggaaaaaaaaagagtcatatgataatcagccgagaaatagcccatgtagtttcctagcttgctgggcagattatggcgtaatgtaattggaggaaacga

SEQ ID NO: 490571 - DNA, 172 bp, Homo sapiens
ctacctctagacgatcccggctcatcgggtggctcttggtgtggctcatcggggggctcgtggtgtggctcatcgtgtggcacctggcggggctcctcgtgctggtggcatctttcccatatttctccttgatgacattcttcaggttgtggtaaacctctgcccccacgcg

SEQ ID NO: 490572 - DNA, 3644 bp, Homo sapiens
tcagcggatccctgtatcacgccattatagcagcctccgtggctctagcaagtatctgacttttacagaaatgactttcttggtttttggatggcagtttagtcttgtctgcttttttttgtttatttttttatctacttcagtgtccatttgcagtcccgtcggcctcactgttttccctgccgtttatctgttgaagagcctgggctgtttgtcccatggcttcccacagtgtagattttgctgaccacgtggtcatggtgtagttcagcatggtcctctatgtttcctgcacattggcagctgggtccagaggcttgatgagcctcaaatttgatccctttggcaggagaacaggcggttaggagctttcctcaggaaagtaccatgttgacggcagctgatgctcagtgccaagatccattaattatttggggttgcaaaatggtggtattctcattctgtcgttttgcttgcctttattagctggaatggttttctaagaaagtgttttcttttttatacttatctggttacccagtggtacagttcatataggaagggcaggataaatgcttgattctttgctcttgtacactaagtttttaagataatgcattagttgtctgtcaaggaaggtgagtggtgaagggtttttacatatatacaagaattcatgggctgggcatggtgtcttatgcctgtaatcccagcactttgggaggctgaggctggaggatcacatgaacccaggagtttgagactagtctgggcaacatagtgacaccctgtctctacagaaaattaaaataaaatcaggtgggtgtggtagtgcctgcctgttgtcccagctattctggaggctgagatgggaggatcgcttgggcccaggaggtcgaggatgcgtgagctgtgaccatgccaccacattccagcctgggcgacagcaagtccttgtcttaaaaaaaaaaaagaatttgtggagttaagcatacttggtgggtttcaatccgttgtgatttttatctttatttagctcagactagcttattcggtcagtgagagggagcctcttcagcttggctcttgctttcttttgataagtgtgcacatgtgtgcatacatgtgtgcacagaccacacgcacagtcattgatagctccctgcagcctggcatgtcaagatgctctaggcccaatttatagagcttctgctccaaacctgtcttaaaagaaaaactttagacaagttagcagtttaattgagcagaaaatagtttcttcagctgggtagcactcaggaccaaaagtggttcagaacgttctcctgtgcgttgtgtgcaggctgtatttatttatagccacaggaagggaaagacacatgtacatggccagactgactgcaggtcagcctccacctcacataggcatgttttgggagccttcagcatgtgattggtgagactctgctgcttgttacagaagtgtactctcaagtcaggtcccagtttgcttatacattaagtgaggttataagtcactatgtacagaggcagttttaggccaaacttaattccgtttaacacttggaatccattatttttcccagagtctctggtagagatggtatttcagatccagtttaggatgctcattgctattgcgttggtcattatttctagatttttggacggagctttaaaaaaatacaaacattgcacacacatatttaaaggaagaatattttctgagcctatattgatattcccaatacaaattcagggtcctggggcctttacatagcctcctctatatgatgtctgtgtctcctgcactcggaatcctgcttctcaagacacaggacaatggcatggaatatccatcccttaatcactcacttgttttattcctctttagcatttagcatttaaaaaaaatactaataccatagcattaattgtgatgatgaaaacagcactgtgtctacgttgtcagaaaaattgctcctttttaccaccattgactcatttctgtgtgttcaggtctcataaccagtctatagtcagtgtcatcttggggacagtattccttgagtttctgatgttgaattcagttttgctggatacgaaattcttggcccagattttctttgagtatcttgttttattctgttttcttccagcataaagtgatgcatgaaaagcctgatgaatcttgttttcttcccctgacagtcatatgctgtttttccttagatgcccaaaggattttttcctttttctgtcaagtcggccgttttattcgaatgtgtcatgtgttggtattggttgtcctggtccatatttgcaagcgtatggtgtgctctttctatgtgtacttcatatctgttattttaagaagatttgcttgaactggagtttagtgttacatttttcttgctttggcttttttctgtggggatccctgttatctgtatgttgaaatctaaattggctgttctcagtgtttgccactgtctcttgaatctcttttatctctttctttgtttctttttgagttttaaaagttgttatagtaccactttggtttgtttagttatttaaaataggaacagtgtctcactgtgttgcccaggctggtcttaaactcctggcctcaagcgatcctccttccttggcctcccaaagtgctgggattacaggtgtgagccaccaaagccggccccaccttgctttttaaaacagctctgttgaggtgtaactgacaggtaatgaactgcacatacgtgaagtgaccgatgcatttgcctgtgaagctgtcgccagaacatgtccatcaccaccaacagcagtttcacaccccggtctaaaccgtccctcgtgtcctccatgttcaggcaaccactggtctgctccctctcactaaaggttaatttatatattctagaattttatctgagtggaatcgcagagcaagtactgtggggggaggtgcttctactcagcataattattttggcattcacccattttgtgtacatcaataatccacattttgtattgcatggatataccacagtttatttatttacctgttgaccgatatttcgattatttccaatttctaaataaaaataaagcaaataaagctgccgtgaacatttaaaaagcagaaacaaaacacagaaaacagacaagcaacccaccaaccgaacacaacgagacacaacacaaaaaaacaggcggggcgggggccactaaaacacacccccgagcggccccccacacggcagcgccgcgacaccctctccgcacaaccggcggcgcccaacaatgagcaggcgagaattaccaaacacagaagcggcaccggaagcccccagaatacacacccagagcgcacgccggaaacaaacaacgcccaaccgtcacggtgaccatctttgagagaaaaccaccccaatcccgtcgtagggtgcggcgctacaacagtgagggcaaccaccacccacagaccgactagaagatccaacgaccgccgcaggcaacaaatctactcacgaacaacaggagcgacacaaaggagtgcgctaccacccccgcctccatgtgtcgaccacaacagaaaatgttgagctcacacaagt

SEQ ID NO: 490573 - DNA, 381 bp, Homo sapiens
atccctgggctttgtttctcagagaagccttggggcaggagcgcgagggtccacaaagccaaagtgaggggtgaacacgctgctactctttcttccaaagacattggaaagtgtggatgtccactgctttggccacttactgtatgaaatgacttatggacgaccgccagactcggtgcctgtggactccttccctcctgccccgtccatggctgtgggtcagtatggggttgggaagggtcttctgggccctagtagtgtgcagagccactcatcccctttttcagagtccaggaaagacccagaggaagttgctgtcctccacagtccagaattcttacaaaatttaaaagtagatccagaccatctagatgaatactt

SEQ ID NO: 490574 - DNA, 506 bp, Homo sapiens
tcagctcggtccctcccagcagcaaagacggtgctgtgaaatgctttcgatcttcttactctcacaaggagaatatctatctgatcattacaccatctgcaaagacagaaattatatcaatgattcagatctcatattctagaaactgtgccaacacttaggctgaatcactcaaaacctgaagggtatgtgaactagaaactacaagtgaggagctcatgagtgtgaggttctgtcccttcgggagatgtcttctctcttctgtgcctctgagacctttatctgtatcaagatacaagctgacttctccacagtcctctcgatgtgacttgtggacttcgactctcgtgcgtggggacatggcacctagtacagtcttctacctcctagtcagccagttttctgtaagtcaataaacattcattaacaatcacacaaaccaaattactgtacctcctcaggcaagctgaccaccaaatcatttttttgtctgtccaaccagcgcc

SEQ ID NO: 490575 - DNA, 2814 bp, Homo sapiens
tcagcggatccctgtatcacgccattatagcagcctccgtggctctagcaagtatctgacttttacagaaatgactttcttggtttttggatggcagtttagtcttgtctgcttttttttgtttatttttttatctacttcagtgtccatttgcagtcccgtcggcctcactgttttccctgccgtttatctgttgaagagcctgggctgtttgtcccatggcttcccacagtgtagattttgctgaccacgtggtcatggtgtagttcagcatggtcctctatgtttcctgcacattggcagctgggtccagaggcttgatgagcctcaaatttgatccctttggcaggagaacaggcggttaggagctttcctcaggaaagtaccatgttgacggcagctgatgctcagtgccaagatccattaattatttggggttgcaaaatggtggtattctcattctgtcgttttgcttgcctttattagctggaatggttttctaagaaagtgttttcttttttatacttatctggttacccagtggtacagttcatataggaagggcaggataaatgcttgattctttgctcttgtacactaagtttttaagataatgcattagttgtctgtcaaggaaggtgagtggtgaagggtttttacatatatacaagaattcatgggctgggcatggtgtcttatgcctgtaatcccagcactttgggaggctgaggctggaggatcacatgaacccaggagtttgagactagtctgggcaacatagtgacaccctgtctctacagaaaattaaaataaaatcaggtgggtgtggtagtgcctgcctgttgtcccagctattctggaggctgagatgggaggatcgcttgggcccaggaggtcgaggatgcgtgagctgtgaccatgccaccacattccagcctgggcgacagcaagtccttgtcttaaaaaaaaaaaagaatttgtggagttaagcatacttggtgggtttcaatccgttgtgatttttatctttatttagctcagactagcttattcggtcagtgagagggagcctcttcagcttggctcttgctttcttttgataagtgtgcacatgtgtgcatacatgtgtgcacagaccacacgcacagtcattgatagctccctgcagcctggcatgtcaagatgctctaggcccaatttatagagcttctgctccaaacctgtcttaaaagaaaaactttagacaagttagcagtttaattgagcagaaaatagtttcttcagctgggtagcactcaggaccaaaagtggttcagaacgttctcctgtgcgttgtgtgcaggctgtatttatttatagccacaggaagggaaagacacatgtacatggccagactgactgcaggtcagcctccacctcacataggcatgttttgggagccttcagcatgtgattggtgagactctgctgcttgttacagaagtgtactctcaagtcaggtcccagtttgcttatacattaagtgaggttataagtcactatgtacagaggcagttttaggccaaacttaattccgtttaacacttggaatccattatttttcccagagtctctggtagagatggtatttcagatccagtttaggatgctcattgctattgcgttggtcattatttctagatttttggacggagctttaaaaaaatacaaacattgcacacacatatttaaaggaagaatattttctgagcctatattgatattcccaatacaaattcagggtcctggggcctttacatagcctcctctatatgatgtctgtgtctcctgcactcggaatcctgcttctcaagacacaggacaatggcatggaatatccatcccttaatcactcacttgttttattcctctttagcatttagcatttaaaaaaaatactaataccatagcattaattgtgatgatgaaaacagcactgtgtctacgttgtcagaaaaattgctcctttttaccaccattgactcatttctgtgtgttcaggtctcataaccagtctatagtcagtgtcatcttggggacagtattccttgagtttctgatgttgaattcagttttgctggatacgaaattcttggcccagattttctttgagtatcttgttttattctgttttcttccagcataaagtgatgcatgaaaagcctgatgaatcttgttttcttcccctgacagtcatatgctgtttttccttagatgcccaaaggattttttcctttttctgtcaagtcggccgttttattcgaatgtgtcatgtgttggtattggttgtcctggtccatatttgcaagcgtatggtgtgctctttctatgtgtacttcatatctgttattttaagaagatttgcttgaactggagtttagtgttacattttaaatgatcttcacctttattatgcatctatcttcatggggtttcccgatatctcactgtccagtccttcatcgcggaatgtgtggatagggaacaggttgaagattgcagtttagcataaagagttgggaaacagttcagagtcaggtcaactgaatcatgcttgcaccccaggcccaggagcgtcgcccactttacagacggccggcaccttcgagcctctttcaacgcccaaagcagtaccaccatgaaaataacgtcggaccagccccgcacctcaccgtatcccgccatcacgcgcacgtccgactcctcagcacctcgcactatgaaccccttagcaaacactttggctctgctcgaccttccgcacaacagcacaca

SEQ ID NO: 490576 - DNA, 2741 bp, Homo sapiens
aagatacagtgactttgatttgcttaacaacagcttacagattgcaggcctaagtctacctcttcctcccaaaaaattgatggtaacatggatcgtgaattcatagctgaaaggcagaaaggtcttcagaactatctcaacgtgatcacaacaaatcatatcttgtctaattgtgagctggttaagaagtttttagatccaaacaactattccgcaaactatactgagattgccttgcaacaggtttccatgttcttccgatcagaaccaaagtgggaggtggtggaacctttgaaagacataggttggagaataaggaagaaatatttcttgatgaagattaaaaatcagccaaaggaacggctagtgttaagctgggctgaccttggcccagacaagtatttgtcagataaagattttcagtgtctaatcaaacttctgccttcttgtttgcacccttacatctatcgggttacctttgccacagctaatgaatcctcagcgttgctaattaggatgtttaacgaaaagggaacattgaaggatctgatctacaaggcaaaaccaaaagacccatttctaaagaagtactgcaaccctaagaagattcagggcctggaactccagcaaataaaaacatatggacggcaaatattagaggtactgaagtttcttcatgacaagggattcccttatgggcatcttcacgcctccaatgtgatgctcgatggggacacttgccggctgctggaccttgagaattccttattgggcctgccttccttctaccgatcttatttttcacaattcaggaaaatcaatacattggaaagtgtggatgtccactgctttggccacttactgtatgaaatgacttatggacgaccgccagactcggtgcctgtggactccttccctcctgccccgtccatggctgtggtggccgtgttggagtctacgctgtcttgtgaagcctgtaaaaatggcatgcctaccatctcccggctcttacagatgccattattcagcgatgttttactaaccacttctgaaaaaccacagtttaagatccctacaaagttaaaagaggcattgagaattgccaaagaatgtatagagaagagactaattgaggaacagaaacagattcaccagcatcgaagactgacaagagctcagtcccaccatggatctgaggaggaaagaaaaaaaagaaagattttagctcgaaagaagtcaaaacgatctgctcttgaaaatagtgaagagcattcagcgaagtacagcaactccaataattcagcaggatctggggccagctcacctctcacgtccccgtcatcgccaactccaccctctacatcagggatatctgcattacctccacctcctccacctccaccaccaccagcagctcccttgcctcctgcgagcaccgaggcacctgcccagctctcgtctcaggctgtgaatggcatgagccgaggggccttgctcagctccatccagaatttccaaaaaggaactttgaggaaagccaaaacctgtgatcacagtgctccgaagatcggctgaagcttcctgtttacacttggagggaaaagttcttttttattcctactcacccctaccccccaaactaccctcttcctgggaaagtaattgctgagccagtacagccacaaacagtactattttgcagatgctcatgtaagcagcttttcgagagaaataattctttaagcagaataaagttaggctggcattgctcccttaagatcttgctcctttattaaccctgtaaaggagtcttgtttatcctctaatggccaggcttttgggacagcagcatattgaaatattttcaccaactaaaggaaatagacagaaaaacaatgacaatattcaatcacagcagtaaatggcctttgtgttgcaatcccttctaccccatcagacagctcctagaaacattcctcttacagttcatttctctaaagcattttctgattcttagataactccaatttttgctacctttatcttagacattaacactatagcccaaagcatagttactttgctaaatcagaaagcaactgagttctttgttttctcctcaaatagaatggggaacgttcacaacattctcttaagttctaacaggaataccattgtggttatagaactcagggctgctaaagcaactactctagacccatagttctttttagttagatgtattgaaacagacaaaaatattaacatcagaaaaagctcttgccaattagaggatcttcttaatcctcagcaattaagtttggggtttgaggggggcaggtcattgttacaacagaagtaaatttggcatctatagaaatcaattatgatttttgaaagatttatctaaatatatcaatatagcatctctttaatgttagtcatttattagaaagatcctttatcctgatttgcttaaacctttcaataaattgcactttaaaggattataaataatccatttaaaaattcaagtacacacatcagtgttggttactatgcagagaatgtcattgtgtatagtttcatgtaatctgttatgtcagctgtattttttattaaaatcatgtcaagaaaacgtgttgtctgtagcttgacaagatatttcaaatgagaactttttgtagcgtctgttgttagcaaagaatagattcacacagtctaaggtttccttcctacct
